United States Patent 9,487,797 (GENOMIC PLANT SEQUENCES AND USES THEREOF) - sequence listing, part 62

SEQ ID NO: 71126 - DNA, 43628 bp, Oryza sativa
gagaaagatagtaaccatcaacagtagaggtgacttcaatccctagaaagtagctgagtggtcccaaatcagacatcataaactgttcgctgagtttccctttcacgaaagcaatgtactccaaatcatcccctgtaatcaacatgtcatccacatagagtaacaacaaagtacgaccacgggaggaagtatgaatgaatagtgctgggtcatgatcgctaggagaaaacccagctgcaagtaccactgagctgaagcgtgcaaaccaagcacgaggggcctgcttgagaccataaagtgcacgccgaaggcgaaatacatgtcctggtggagcttccacacctggtggtggatgcatatatacctcctcatgaagatcaccatgaagaaaagcattcttgacatccatttgtgagatagtccaagaacgggtagctgccacggcaattaaagtacgcaccgtagtcatatgagcaacaggagcaaatgtctcatcatagtctcgaccatgagcttgctggaaacctcgcgcaacaaggcgagccttgtatctctcaacttgaccatctgatttggtcttaactttataaacccacttacaggtgattggaacagcatgagatggcaacgggacaacatcccacgtgttggtacgctctagtgcagcaagctcctctgacatagccaatttccaatgaggtaaaacaattgcctcctgataagtagatggctcaaacacaaccccaacaacaaaatcatctctattaggtgcacgaagagcatcacgagcacgcaagttgtacctcggagcaggagatgaatcatcaacggaacatgttggatcctcaagggtaggttgggagggttgtgattcgttaggaattttgggtctacgactgtagtggaaaggaaaagtgtctaatgttatagtggaaggaacatgtggaggtgatgaggaagctgggatgtgtgatggtggaggcgatacaggtgagggtgaaggggaaggtggtggaggtggtacatatgttggtgaaggtacagaaggaggtataggcgatggtgatggggttattggtgatgaaggtaaagactctggtgaaggaataggtggaaggtaaaggaaggagatggaattttctggagaagaaggctgattagtagaagaatagaagaagggtttgttctcatcaaaagtaacatctcgggagatacgaattcgacgtgcagaaggatcataacagcgatagcctttatgctcaagactatatccaagaaaaacacactcaactgattgggctgtcaacttggtgcgctcacgtggggctagtaaaacatagcaagtacaaccaaaaactcgaaggtgatcatagtggggaggagagccaaacaacacttctccaggggacctgccttgcaaagaagaagatggttgcatgttgatgagatatacagctgtagaaatagcctctgcccagaaatgagctggaacaaatgatgcaatgagaagagttctagcagtctcaatgatgtggcgatgtttacgctcagcaacaccattttgagcatgagcaccaggacaagaaagttgaggaagagtgccctgagataccaaaaattcacgaaaagcatttgacatatactctcctccggagtctgagcggaaaatacgaattgcactagagaactgagtatgaatcatctgggcaaaagactgatatatagaaattagctgagaccgatgcttcatgaaatagatccatgtatatctagaataatcatcaacaaaaataacatagtagttgtggcctccttttgaaggaaagggggactttccccaaacatcagagtgaaccaaatcaaaaggtcgactcgacctggaggtactggaaggatatggaagctgtacttgcttaccaagtttacaacctttgcaaacaaaggtagtgtcaacagggacggaaccaagaacgccttgattgataagagttgctaggcgagagccacacaagtgacccaaacgatggtgccactgtgggaaggatttacaagctgtagagcacataggagaatagacagaaggtgtgttagtggaggatgaaggcaaactcaagctatcaaggatataaagcccacaggatcttttctgacgatgtccggtgccaatgacagctcctgtgtggcgatcttgcacaaagcatgaagtatcatcaaatccaacgaaacaatttgtatctgtgagttgacctacagaaatgaggttcatggatagttttggaacaagtgacacattaggtactgtaaactgaggagaagagatagacccctgatgagtaaccttacacaatgttccattagctgtatgaacggtggcaccatttttaaccagacggcatgatgtgagccatgaatcatcaaatgacatatgaaaggaggctcctgagtccaaaatccatggttgggaggcaattggggtaacagttgatatagatgaacatgaggcaataccagcacatggatagggaccaagaattccatctgacaccatgatatatcaaaacaattgtataaaccaaagatcactagcaactcagctacttgagtctgatcttttatctgatagcagagagcctcctcctctgattttctggaagcagaaagcagaagcggcagcaccgcagcaggcaatgggaggaacagggcctcgacctgtgcagcaagccagcaacgatgtagatggtcaagcgcgcagacagcggcggacggagagttggacgacgtccacgcgcggctgcgcaactgcaggcccacgcgggtaagggcaaagtcgcggcggcggcgacggcgacggcggtcaacgacaaatcgcgctggggtccgatagcccacgaggcgacggtgaaaaggacagtggagcagtggataaatatgaattggaggaggttgcttagcagtgaaacgccggcggcacgccgccgcgccggccggcgatggggaattggcagctagggttcagaccattgctctgataccatcttaactaacttgcaacctaacaatagtattagcaatagagaagtatatacaagatacaagatccaatggactggacatccgatgggctggacatgggccaactatacagtacattagcttgtatatatatttaacaacacacactgacaatcagtggggctcattggtgccaagtactcctacttgaaaagtgattttgctcttcaccagacatcttgttggtacaaattgatcttgtgctgtgctttgcttaagagccttttttaagtacatctaaagacatccgagtgatagaaaccacacatgtcaggagcttattactcacaataccatcatatggtttcttgttcttttttttttcttctgaattctgtttttttgttggttgtgttcagttcaacgagaatgtatcctatgcacataagtttcaggtacacactctgtgcacaccaactaacaaatatcacaaaaagaatcttaaaaaaatgtatatgtacttctaatagtgttacacctatatacatagtctcaacttcagattcattatattttagctgtaacaaaatgatgaaaatctagtagttttagagtgtaaatttgtcagaagatcatcttttttgttgctctacgtataatagaatctgatgataagactttatatataagtgtagcactattagaagtatatgtacaaacttttttagctttcttggtaatatttgttagttagtgaacacgaagtttgtgtgtgcaggatatgtcccctagttcaacactccaaccaaggcagcttgtaagcaggtcaatggcaataagttcatggtggtgactggtgattagtaggatatgattagttgaagtcttggagaggaactgaaaaataacttattgatgtgtccccagcgcaagttcatatgagctgtgtactgtatccccttcaacgctgcagtaagatatccatattattacgtgatcatcttcagtagacagccaagaacgaacgtgtgcctctctgtgagatgactgatgaggtatctccacaacctcctaactgcaagaatttcttagattaatgttaagttgttaaaactagcttgttaggtttgtactgagatttctcaaatatcaaattgtgctatcatcagatcttctgtcaaaacattgattgatagtgtacttgaggctgtagtcttatgatttattgattaatagctgcttaattcatttttggtatagtagtacaatgactctgattatgtccaatatatgtatcatctactccgactttaataagtcaactactacgttgccactggattcagctgatgaggttacgcataactgatcgtgcatatccatgacatgatttgaaatgtaggtttaagaaagtgatctgtcgaatatctaatacttgaattttagttttatgttacatttttggggtcaaaaacagatgtcattttttggactaaagaaaacaccagttttagccttttttttagtttcagatacttgtcatttcagctttctaagactatgtttttgaccatcttgtccactttagttgccaattgtcttcttttgcctacgtttaactagtcaaaacatctaaatgtaaatagaggattgaacttttctagatttcctttgttataaacagggaattttttagataatagagataacttccagtctctgcatcaactatggatacgcacggccatgtatttaagggatgtggggtaggaagaatgtgtggatgagttctaggaaggtgcatgagagtaatttcatttgccataaaaaagggcacagtgacattcatgtgtaactattttttatgcttctatgatgctttgagcaaagaaccacttgcagtaagtaagagactgagatagtgagatgtgcgaatggtatcaagcttgcttcctggcatggactgtctacttaattagccactaattttatactgtcaaaacaaaaccagcaaatggagctttccacacaggtgatgacacatactgaagtggttgcaaatcaaagtaggaggagctcatgtaatccagaaggattgcatggttcaactgcaaagtggatttcttgcaatggcatgaaagtacccctgatggtccatgttaccccatgttcctcttatctttattatatccttacctcaactaccttttgttttccctcatccaagtgcttgcttctcttgcaagttctttaagtagaaacatattgtagttgcaagcaatttgatgcatcagttgtgggcaatctagaggatcacagagatatgctagtaaaaacgatacgaaagcgaaaagagaagaagatcatcattatagggtttccaaaaggcattgaagaacaatatatgtccttagtcagaggtatcaacaaacttcagttacaaaaacatatgaaggtatgagtacaaatgctcacccttttggaggctagatcattgatgcataactgcattagagttcacaagtcatgagttctctatctgcatagagcttggaatcagagctcacacctggaaaacccaacagtgatattattttagtaggggctaaatcttggatagtgccaagctcacatcttaggcttagttggaccaagactcaatgtagactactctggtagagacagaacagtttctcatggaatttttttgtggatattgctgccacattttttgctgtaatcactcctgtcattttaatacttgcatctctttattcctcaactgaattgtccctatgatctggtcttttctttctatgggcaattcctaagtggacctccagaaagggcaggcaaatcgagctccaatttgatcaagaaagatagtggggtgatgaaagcaatgcattgctaccctttattcttcacccatttcttgtttaaaacaaggtgatggcagtatggcactatttgcttggcctgtttgggatttggtgaatgtgaatattgccacagtgtcccatgctattgggtggcaacaatcactagcttttcatttgtttcagttacccgtgaaacctcatggtaaattaataaatagcatctggtactagttgtcaagcagaagaatgattaaggaaactgtcaagtagtatgagtgctgaataattaggggactgatgatgctggtgagggacccaaacctgaaattaagcaggtggcaaccctagtcccaacatgcatataatactaattccaaccttttttctttatgtgagttgtgcagaggagaggacagcagaattggacagttccattgaagctagctgcttgtttcttctttttgtttggaggtgaagcagcctcaatcatcccaatgtagaggcactgctccaaccaagtgttgttcaaagaatgtggtatatcagcagttcaagcacattggtagcagggtttgtatgtgcaaatctgtacaaacaaagagaattattctagaacatgtgtgtggggaaatttctggccactgtagttttcagcttgtgaaatgtagacctgcctcctcttcggagataaatggttgatttcattgggggagaaaactccctcctcttttgatagggcatattttgttttgtcaggataagattctgagcgacaattactctattaatatttcattttttatgtggtccaaaattatgaccagaagaaagtttttttttgtaatacaaatttaataacatcaattttatgtcacaaacattatgtattaatggagtaattattagtcaaaaccttgtcctaacaaaataaaatatgccctataaaaagaggagggagtataggtggctaatccaaagacacccaataagtggaatgtactaccttcacacataaaaatcaacagggcagtttgcttcctctagagtgtctcatcagatgcttagattttcttacccatcataatctttaagtgacataatttccagaacataaagttcttaagaagacctctctaatccttagaacttgaatttttgactccatgaaaaggagtctaaatccttgactaatagttcctataaatgttatattcatattcggtgcgctctttccatgtatccgaaagttttgtaagtttgacacattcatagtgctgaaaaaggctacctagcatgggtcggggggatacaattccaccttcttttttttccccgaacacgcgaaagatgtgcgcgtcactataggaatacaattccacttgccattgcaacatattttggcaccattttatgcagacatgagtgctgcacctgtttagcttgtgactgaatgcaaggtgtgccactgtaaatcatcatcttatgataggtaaacttacacattgaaattgatattaagccacggttattttcaattaattcttttagatgatggaggctttcagaattcaaccatttacaccaagttgacacaaaagcaccgagcacattctaattaattttatgctcattcaatttagagcagcaaatttgtgtaaaatttagtattaaaccttacattttattacctcaatcccatgtacaaatctcaggcaggaggagaaaccttttgaggcttggtttagttatcaactttttcttcaaactttcaacttttccatcacatcaagactttcctacacacacaaactttcaacttttctatcacatcgttccaatttcaatcaaacttctaattttagtgtgaactaaacacaccctctgagtatgataccgacgaccaggaaacagtccagatcagaggggcaaatgcaaaccaatcagaaataattctgaaccccacaggctcaagtcaacatgctttagctaaggagatgagatgaatcgcagcagcagagggaggaggaaaggggggagtactaagcaagcagcattgatgcctccattactcccctgtttaatactctcttcttgggaggttggaggagatcacaggacagcctgtgcctgtgcctgtgctgctgtggcatttcttcagagaagactgtgagatatcaccacaaataaaattcccactactgtagtatgaaaactttgggacacattcagatacattccgatgaaaccagaagtagtttctctcaattttatcacatcaaataccgatcgtgctagagtataagtgaattgtccgtcttaagctttgggttaaactggttggtacatgtaactcaatagatcaaacgaagcatgctaattctagtagagaacttcccttcagaaaatgttgtggcaaaagttttataatgggagaaactgtatattgtgtgacagtttagttagtacagttgctctttttccccggatgagtgagtgatgactagcaagtaacaaggcctgtttagttcgcgaaaagaaaatttttgggtatcacatcgaacgtttgaccggatgttagagggggttttcggacacgaataaaaaaactaatttcataactcgcttggaaaccgcgagacgaatcttttgagcctaattcctccgccgttagcacatgtaggttactgtaacacttatagctatcatggattaattaggctcaaaagattcgtcttgcgatttcctccttaactgtgcaattaattttttaatttatctatatttaatactctatgcatgtgtccaaagattcgatgtgatgtttttgggaaaaagtttgtggaaactaaacggggcccaagtaagatggcaacaaaaacaggaataaaagaaatggtgaccaaggcagtgtggaacaccccggggcttttaactatttgccactcttacgagtggtgcttaacgatttgccactagactcatatgtcaaaaacacatgagggcccacatgtcattgacagggtgtggcaaatcattaattgccatgtcataagagtggcaaatagttaaatttcccggaacaccccaaccccacttccctcaccattccattcaccaaagcacagcagcacacaccaaggaaggcctagaaaagagaaaggcaaagaggaccaaaagaaaagaaaagaaagaaagaaaaaacttgaaaaaaaaaagctcaaaagaaagcaagagagaaagcaaccaggcaggcagaggcagaggcagaggcagaggcagtagccctcccttttttttttctctcttctcttctcttctcccaattcacacaagattcactcaccagctgtgccctcccattcccctctgatccaagcctttcactcaaagcttccagcttttccaattgcttggccacttcaagaatcaaggaatatgttcttgttcttggggttcctctgatccgactctccatcttccagcttccaggcttctctctcgttctgtgccatttttgctctgcctgagctctgtgcttgttgcattggtcactccaagaaaaggattttgaaggctggttttattgttcttctgttcctgggatccgaattgcaggcgagctcgctgttcgtgtggaggtttctttctttcattcattcgcttgaagaattcggcaaagccatgcgagcaattcgggatgatttctcggggcctttggaacgcgtgatgattctttgacccaccattgcttcggttttttttttctgggagaattctgcaatttcgcgagtttggtcgttgagctcgagccgtggtggtgttcttgatccggtccatgggtctctgtcatggcaagccgagccaaatcccggagcccgaggcggaggaggcggcggcggcggccggtgtagccgtcgccggcgccgcctcgccgggtccggctgcggcggcggcggcggcggcggcggcgaagccgggcacgccgaagcagccgaagttcccgttctacctgccgagcccgctgccggcgtcgagctacaagagctcgccggcgaactcgagcgtggcgtcgacgccggcgcgcggcggggttgaagcggccgttccccccgccgtcgccggcgaagcacatccgcgcgctcctggcgcggcggcacgggtcggtgaagcccaacgaggcgcccatcccggagggcggcgagaccgaggtcggcctcgacaagggcttcggcttctccaagcacttcttcgccaagtacgagctcggcgacgaggtcggccgcggccacttcggctacacctgctccgccaaggccaagaagggcgaccacaagggccacgacgtcgccgtcaaggtcatccccaaagccaaggtcggattcccgccattgccacgcctcaatcgcttctttcttcttcttgaaatggaacacatgcctctgcatttgaccaaaataattttccctgcgtgaattaatcaactgcttctgctcagttttgtcgttaagatccaatcatttctgacgtgcagatttaacttatggcattcggattctccattattttctttttaatcgagttttctttttttttttgttgcggggttcttttaatcaagttcactttgatgcaactctgattttgcatcttagctccatttggtagtatttggtagaacgttggttgattcaagcacgaggatattggaaaaaaggagccacctttagccggcacttcgttttcgttttagctcccggggtgctcgtgattattgttgggaggtaacctcgccgctttgagaccattcgtgccaagatatgtcattgccaatgccatgtccatccatctggacgtggactgcctcctgcagcattgattggcttcatgccatgctcatggtttcaacgcttgtcgagttcttggtgccaccaccatcttttgtcctcacgcttccatcatcggggtcggggagggtaaatggagcagatgaccctctttggatagatctgcaggtcaaaaaggggagcagagtttgctgctgaagctgcacagcttgatgcttcaattctgtggaaagagtttgctcataatgcgcctcctctgcaattgtatgaaagggtcattcaatttaaggccctgtagatgcggccagtccagtgcttttatgagcaaagctggcaatccttctgttgccaatgcaagggggtaatgcccccaccctcctcttggcttctcacattccatgtgctcgtgttcttcctcggtcaattgcagtcaattgttagaatgtcagcaatgctgcgtttcttggttttattctttccagaaaaataagattgagctcaaagacagttgcaagagtgttgttcttgttggatttctaatggagcactccacttgtcactttgatactggagtatatgttcatttcattatagaatggtggtgtagctttggttgaatcttctagtgttattcgtgtcctgagggcattaattccagcaataggcatttcatttcttttcacccataattgatcacttattgtctgtctagtgcactgttgtacaacattgaaccgaacagtagttggttgttggcttgctcgcataggtgtcataattcgcgcttcgagatctacatatgttgcccattaccatgataaatggaagttgagctggcattgttgtagttgcatgcttttatttacttactagtaagtaatataattgattgatcttatagatatagttcattatgtaaaagaattatcatattttgcttgtgggttgtttactcatttgcaaatttcattactcttttacacttggtagctgtttactgcaatgccagttcatgctgctttctactcttaccaaattaagtctctgggcagatgacgactgctattgccattgaagatgtcagaagagaagtcagaatattgagttcgctgacaggacacagtaacctagtgcagttctatgatgctttcgaggatgaagataatgtgtatatagttatggagtaagtgtgcacttattccatacagtgctctcctttaacttctttttttgccgggtcgtctcctttaacttctgtcttcatttgttgctgtcatgcatgcgattcttgtcttgtatacattagaaggttcagagatgaaaaaaaaatgttatttcatcttggtggaatgtttggctttgttcctgtcattaatgtttgtgaaactaccctgatacatgagaatccaagcattgatatataaatagatcattttctgtcagcaaggatttgtactttcaatctcaataacatattcccatcatgccgttgttactataaaaaatataaaatttcgtgcatgatgttgatcagagctcctctatgatcagttgtttataattcaagataacatatcccagtcaaattaaaaatccaagatactcataaaaaatggtgctttcctgcaacttgcatcacttgattacatttaacttaatgtgattgccttttctgtttcaggctatgtaaaggaggtgaactactggataggattttggcaaggtagagtcatgatatttattttgtaaacaatgcttgtaactaattctgctagatttgagttataacttactttctttcttcacagaggtggaaaatactctgaggaagatgcaaaggttgttatggtgcaaattttgagtgttgtgtcattttgccatctccaaggtgttgtccatcgtgatctgaaaccagaggtaggcttgctgccaaacaattaatagccaatgttaagaagttcatgttacaacctaaaaattgttaatgttgaatatgggctctaactgacataagacattttctcttctattgttatttctgtaaattttctgaattttttttacccaaagtctactattgagtctagcagtcagcagaccaaatgcattattttgtaaataaccatatttgttgttcccctttccagaattttcttttcacctcaaaggatgaaaactctgccttgaaggtcatagactttggcttgtctgactttgtgaagccaggttagatttacagagtccagttttgattcttctttagtatttatccttgccaaaccaaatttaaatgtgttgagatatcatatcattgctatattctgcagatgaaagacttaatgacattgtcggaagtgcatattatgttgctcctgaggtgcttcatcgatcttatggcactgaggcagatatgtggagcattggagtgattgcctacattttgctttgtgggagccgtcctttctgggcacgcaccgaatcaggaatatttcgagctgtgctgaaggcagaaccaagttttgatgaggctccatggcctactctcactgccgaagcaaaagactttgtaaaacgactgcttaataaggattaccgcaagaggatgactgctgcacaagctctcagtaagcatcagatttgtttgtcagtgtaatattgtggcactcgctttttatcgaatgatggttaattgctcacttgcatcatgatatctgcaggtcatccgtggatccgaaattctcaacaagtgaaaatacctttagatatgataatctacaagcttatgcgagcttatatcagttcgtcttccttgcggaagtccgctttgagggtatgcataaacctttgtgttgttcttatctggtctgtaaatgactattcttgctgcttatattttttttcattttttacatgtgtcaagttatccatgtacgagcaatatattgcttttggttgtgcagtttaagtaggcttataccgatatgtcttgactctgatgacatcaccaactagccattttaagcaatgtccatacattttgcaggccctagctaagacattgacggcaaatcaactgttctatctaagagagcaatttgaattgttgggtccaaacaagaatggttatatctccttgcaaaatttgaaaacggtaggtattctcacctttgttacttgatctaatttatagcatgcaattgctgaataagtaaatgttcctacaggccttggtaaagaattctacagatgcaatgaaggattctagggttattgactttgttaacacggtaagactctttcatagaacattctcttgtgttagtatatcggactgagataaacactgacctgctcaagccatggtactaggtgtgcactcttcagtacagaaaattggattttgaagagttcgctgcttctgccgtcagcgtttatcagatggaagctttggaaacatgggagcagcacgcacggcgtgcatacgagctattcgataaggagggcaaccgacctattgtaattgaggagcttgcatcggtatgatttgagctgaagtaactttttcgcatgattattaaacatttctaactgttatatttttcatctcttaggaacttggacttggtccatcagtccctcttcatgttgtactccaagattggatcagacacgccgatgggaagcttagtttccttggattcattaaacttttgcacggagtttcttcgcgatcgatcccgaaagcctaagataaaatcattcttgcatcaaccaatgaggtcaaattgatggctaagccaaattctctggatggtgttcgttgtgttgcgcggtttgaggtggttggagaggatgtcttgaaaatcagacaaaaaaaagaaagtgacagtttgtgtaagaggtgaaaatgttcttgctgctactacttctacccctccccttcgccacgtcggattgatgttgtactgaagctgtgtagacgatgtacagatgatgaggataggaaaaagaatatggaagggttgaaaagatttgagactggtgtttgtcaaagtcttgcattgtagtagtgcatcttttgtctcaaataagacatttaacgtctcaccccttggtctctcattgtgttattatgccagtatgcgacagccctgaggttacagattcaactgtgtgctgttcatttctctgtacttgttgttgcaattgcttctactgcagccttctggtaccaatgcaacaatctctgctcctcactgtccattgatgatgggagaatctgcatttttactgcaaggctgcatctacccaagcatatgcatatattcatggcgatatgcatatatcaccaatgaccttggccgatccgcagaagccggggatctaaaccatttccattctctaaaattcagagtatcaccagaattctgaagaagtgatctctccaaatgtaataagatgccctggaagagggctattcaggatcaagacaaccacttccttttttcagggtctcaccccttgttcagcaatcagtagtatcactgtctgttcaagtgttcatagcaaaagaaaaggcatcacacagtgacattgctgatattggtgtgtgcaatgcaatgctgttaatgccgcgttgtcgctgtctgtgcaagaatgcaaaagcactggatctggggtgcccgtacggcaaagcaaatccggtcaaattctgatgaaggagtccggcaagatgggacccactgacagtcaggaagggacccaacatggttgaaataattgaaatgctattgaagttctaaatttgaccaccgataaattttaaattatagtgtttaaacgaataaaaactgcgtgctcatatttaacatgcaatgcactttcataacatgtaagaggtaaaattttggatacgaacaatatccggtgacaattatttagggatagagggagtaatcatattatgatattatggtattgcatgttcttagatggataatatatttgtgagcaattttatatgtcgaaagatgtttgatgatcgtgaaaggaatgcaaaatgtgtgaagatttttggcatggtgtgccacgtgacatgccaaagttcaggtttttcaggctgtatggtcctcggtttggacctgtttggctgcatttggatggatagtgtaaaaccatgagcacaggttcagtttagtagagtgactttatgtgcttgtttttactgtcacaaggttcctcgagcaacacacagtaaagtaatggtaaaaatttactacttattgtacttgcttctgctgtgatatgaacaaagaaggttattaaaaaaatgggaaagaaaaaggaggcctcttctcaaaggtcgcaaagaagcagaagaaatggctcaagcttctgaactctgaagtctcctgcactttgtatgcagttaagtataacactgaaagtttcttaaaagacttgagagttgcaccaaaagctcgaatcatggcaaatgatgtgagctttgtttaaagtctgaagaaatcttttgtgatgtttaatgttaaaattcgaacactggagggtcataaaagacagacaacagttagagtttcgaagcaagatcagatatgttattaacacctcaaaagatgcatgatttttgtgagtggactcaaaagctgcatgatggcatgcatacattgttcagtctacttcagaaagaaaaataaattacgttcattggaagttcaaatcgaagtccattcaaaccaaacatgccggacataataataatgtctgaatcgttgaatgttaaacacaatagattagagaaaaaaagcaacattcgttactgtaaaaactactactaggaataaaatattttaacatggatactcactaaaaatttacaattaatgtggagatgcggggtatcgatccccgtacctctcgcatgctaagcgagcgctctaccatctgagctacatccccaatttgacatttttctatcatatattttacttatcagttaaaacatgaaatggcatcgtttcatatgaatttgacacccttagcgtatattgcgggtcttattcgagcagaaatttctttagaaatcattcaacttgggaaatcctccttgatgtcaggttcagttctaccggtaacacagacagtagacacctaattttcccgtgtgattatctagttcaagactaatcctccgttcctccttgatgggatgaagctcctgcttcgccaaataatagtaataaaaagatctgcatatcttaatgtggccttaggctgagtttgaaggagcatttgggctgaaagtttctttaatttaccatgttcacgctttcaaaactgttaaacggtatatttcgtataaaaaaattttatatagaagtttcttaaaaaaatattaatttattattaagtttaaaataattaatactcaaattaccatgtgctaatggtttatctcgttttacatgccgctaagttgctaagcccaaatgctcttccaaactcagcctacgccaagcaaaatttaaggcccgttagccagtaaaagagcgagattacagtcctattgggcccaactcactcgcatgggccgaaatccagcctatccatagtctggatttcactcaatggaggcccaacaaaacaaggcctcgcaaacaattaacagcccaataaggcccatataatcagatcccttacttaaccttctcctctaatctcaagaaaaaccagaataaacatttcccccaccaccttcgcctcctcctctcccatggcgatcccctaccggatcaccgccggcggcggcggcggcaggcagcggatggcgctgccgctgccgccgaagggcgccctgctggccgccgtgacgacggcgtcggtgctgtccatcctgtgcgtgctgtccttcaccgactcgctgtcctacctcgggttccaggtcaggggcgtcgacaagagggagagcagccgcagctacctctactggggcgccgccatcgactgccccggcaagcactgcgcctcctgcgccggcctcggccaccaggagtccagcctccgctgcgccctcgaggaggccctgtttcttgacaggtaaccatggtttggcacgtgtatagattttgattcgtacctgcattgatctgtctgggctgttaatccgtaatattcccacttaggaggatggaaattgttgcaaagagccaaagaatgtaatgtgggatgatgtgatataataatgtggatatgtatgaattagtttttgttgttgtggcagaatatttgtgatgccttcaaggttgtgccttaattcagtgcacaatacaagggggattattaatcaaagcgatgcgacttccaataaaaggtttggcttcttgttaaccacctacttctatgtgattatatatcttcctgtatcattctgttttcctgaaatcgtgctagaattgaaactcaccaactcaatgttttggcagtggcaggtgggaaacaagttcatgtgcgatggaatctttgtatgacatagacctcatatcaagaactgttcctgttgttttggacaatccacaatcatggtatgctatagtatcaagaagtacgaagctaggagaggaaggagatgtagcacatgcacaaggagttagcagacaagaactcaaagaaaacacactttactcaaaggcattcctcataaaccgcaccgcaagtcctcttgcttggtaagaatgctagctcttaaagaatagccttaagccttcaagatcacaccgaattgaacctatacaccatgactagaattctggtatagaccttaatcatcattacagttcaggtttatggagtgcaaggatcggaccaagcgtagctctgtgatgttaccatacaattttctgccatctatgccagcaagaaaactgagggatgcagcaaacaaggtatatttccataagtttgcctccttgctcaatttaattgaaattggttgctccaatcggctgaaaatgatatcttgttttgcaccagattgcttagcaccaagttaataatattgttcatttctgtttatatcgaattgctcatggaaatttgccgagtagaactatataacataaaattcaaaatcctaagaatgtggctttagtgtgcctaatgttagttccccacttaaaaggactaacattgatgtcccactgtaaataaatctcgtagctgtcatttttgtcagcattgcgtgcgacataagatgtgtagcactgtagcagcgggcatctgcttgttgaaagttaaaattcaccggcaaatggtgaattattgcctcatgctgccatgggattatgttttattactccactccttcattgagaatttcatgtttgtcatggttgttctggaataccgtgggccatggtaccactctatttaccctatgtgcctatgtaattgttcatatgctagctttgcatctaaaaaagagctttgggacctattgaggttattggattactttccgaaaagattttttggtaggacaaaattgcaaagcttttgtctttctaggtttggtcaggcagaacatcataatatatcctgtatataaatcatttgtactgtactactgtttgtttatgttaagtgacatccacgtattagtacagcatagtatgttactctgctttctcccatctaaatcagtgtgctttctttagattaaagtgatacttggtgactacgatgctattcatgtaagacggggtgatctactgaagaataggaaagatcgatttggtgttgagcgaagccttcatcctcatctggacagagatacccatcctgagaacatcaaaagaagaattgcaaagtggattccgcgaggccgtactcttttcattgcttcaaatgaaaggacaccaggcttcttttcacctctatcagacaggtaatcaacacattgtgtcagctgctcttcttgactcaccagcattaggatctcaggcacgatttacatttgcatttggtttctgcaatcaatttagatgtgactttagcgattcgtgttctcatggatttaccacggcacatggtttgtcttcttctgttatcaattacttcctccgtttcacaatgtaagtcattctagcatttcccacattcatattgatgttaataaacctagatagatatatatgtttagattcattaacatcaatatgaatgtggaaaatgctagaataacttacattgtgaaacggagggaatacttcaaaaacatcccattcttaagaaactcgactagttgctgcagtactaatgcactttgtcattctggaatatttattttgtttggtatattcattttttttatttatcacaccatggcttaccaatagaaaaaaacaaataatatgtacatgaccagcagtgcaatgtcataccattgaatgcttataatttcatgacacaagctggctaagatttctattcgttttctttggcgtggatacagatacaagttagcatactcatcaaacttcagcagcatattggagccagtaatcgataacaactatcagctgttcatggtcgaaaggttaatcatgcaaggagcaaggaagtttgtgaagaccatgaaagaattcgataatgacctttctctttgcgatgaccctaaaaagaacaccaaagtctgggaagaagcagtttatacagatggctgatggttcgtatttgaccgtatttgaccttccattgcatatgaagtacagctcgcaaactatcactaatggttttgcatagataatagtataatactgtcatatgaatatatatgattaaaaagttttacttctgatctgaagttacactcaagctaggacactcaagtcaaccgacagaacaaggggaagcatgcatgtttcctttcttcagacaagagatgttcaatttgttcctctctcttttttctttgatacacctgggaagagactatatatgctggtgtgtgatgtaacttcatcgtggttttgatttaaaccaaattgtagtgtatatgtaataggcaattacctatcagctaatggtgaatacatctgtaattaatttgtcaatctggaaattgattcctttttggagaaaatctggaagttggattatgtttaacctcttgcagatgaaaaggcaaatatacataccatctacagtgcacgcttgttgcagatgtactgcatgtcagtacagcagaaatatgcaaggtacagcagaaatgtgcaaccgtaggtgtatatttgcatgcaaaagttttttttttttgccaaatgcaatgcacatacatgtgataattaaacaggtgcatgattaaggtgcaaaaacttagatgccttggacttcattagtaccatttaacatccacttagctagctaattaagctagttcctcatctgatcatcactcttcaccagcatgaaaggtgatcagtactctctcacatgatgcatggcatgcatgatgcatggcaagatcaaaataagcaagaacaaaacaagagctacctaagtgcaattaagcactagcagtagcagctagctactaattgatttgattgatcctaattacctcctagctagctactcctaccttaacgctaatcaactcttgtcatctcatctcaaagactaattaacaaactaattaacacctgcacccttgcgcaaatcaatcgtcgtcgtcgtcgtcatcctcctcaagaaatcaagcagcagcatgagctgagctgatcgatcgagctagctcatcatcatcctctcttctctatatgtacacgagatcgagcaagcatggcggctgcaaagctcgctcacacctcgcttccctggtcatggacgccgtcgtcgtcgtcccggtgcgcccgcttcttcctgccgtgcagcgacacgccgaacagcttcaccgtgtcgccgccgtcggttgctggagtcttgggcggcggcggcggcggcgagtgatcgggggagtcgagctccatcagcctgcaggaggcggcggctggaaggtggtgttgcgccgccgccatggccgtcgacgagggggtggtggtggtggtggtgaccggcgcgacgtggttctggaggaagtagatgatgtcgttgtagagcttcttcatgtgcgccagctccgacagcagcagcgagttgcgccgccgcagctgccggttgtcctccgacagcgccgccaggaagtccccgccttcgccgccgtctccggcgacagtacagtgcgccgtcgtggcgggctcttcttggattagatggtggtggtggtacgccggcggcggcggcggcagcgagaagggattgaggtggtggtggtggtggtagggttggtgcggcatcggcggcggcggcggctgcgacgacttccgccggtgaatctcggcgaggaggtgcttggctcccttcctgaagaactcgttggcgaactcccacctgtcagctactatcttcctgaaaccctgcaattaacatcatcataagttcataacaccaattaattaatgcccaaagttaaacatacatacttagtattagctattagggaaaggattatgaacactcgagaggatatctcctaatcgtttgcatgtcatctaaatggttataaaattttagaaaaaaaatcaacaagatgattaatatgtgattgtattagtagctaataactaaaaaaactaagcaatcacacaaccaatggagctagcaatcacaaaaaaaagagagagagagagagaaaagaagaattggcaaatggcaaaatatactactacctccataaaaaaaagataggcagagatgaaatctttgtaaaatgaaggcagtactatgtaggagtatatggtaactgatgttcaatattgttgctagtcatgtcaagtggtgctaatatgaatggtggagtatatacttggcacagaataccaaggtacatatatgcatctctgtttattgtgtcaaacttttcccaatgattgggagtggatagtgcactgctaattctctaaagatgaggaggatagaacaaactataaatacatgtaaatggattattcatggagctagaattaactactactacggcgactacgtactaataaatactaatccactgcttactgtgcttgcacatttaatttgtgcactttgattttggtcaagactcaagaggcaaagggaagattagaggaagtactagcgaagtacattaattagggaaggtagaacagtggtgctggagcaagtagggtaagaagtgaatgtacaacacagtcatcaacttatagtggttcagaagaagaaagagaagatcagcaaacagtcagcacgtactctcatgctgctcctcacttcaccattgagagaaactaattaatgtgcatcagataatgttcagtaaaagaggcacaaaaaaaatttaaatctccctcatgttaaccaggctaaacagacaagaaaaacagtagatgagattaatcatcagcacgaattaatatacccccagctctactctatcttttcatcagaagcaagaaatatatttttgaaaaaaacaagcaaaagagattaatcagctcgttggaaggtcgcactcaaacagcaatgcctttccagcgtgcaacaaaaatctggtacaaaacaaaagatcgatgaacaaaaacttttccaaaaccctgtcacattctaggaaacaagcttgctaaccaccacatacacaccaaatcacccatcaaaacaacaagaacattaaaccatagtccatgcatgccagcatcccccatgcactgactgaccaaacctctacatcaaattaaaaccaaagcaagaaactatagcagctagaaaaccaactgatatatgtatgtatagctagctatagatcgattcaagaacaagcaaagaaatcaagacactacaagaacccgcaattttcttggcggccaaaaaaaacagccgccaagttcatatatattattggcggttctaaccagctaccaagcatatacatgtttttttggcggctatgcacaaccaccgtcatgtttttgaccgacatgaaaattacggattcttatagagcaacaatatatatgtggcaaaaatgtgcaatggtagcagcagcttacataggtgttgagctgcctgacgaagctggagaagttgttgtgcttgaagtagttggggaggaggtcgcgggcgaactccggcggccgccacacgacgaaggtggtgtcgtcctcgccccacgacacgatgtggtcggtgcaggggtcgtccaccagctggtacgtcttcgtcaggaacggcgccggcaccggcttccccgccgccgcgccgccgccgccgtgcggccccatctccatcgacaccaccatctccccgcacctctccaccaagaaagccatagctagaagaggaggaagaagaaggggagaggagaaaggctgcagtgtctcactgtctcgcactcacacagagagtgagacagagagagacgcacacgcacacaccacgaaccccgcgcttcaaatattctcgtgtgggctcacgtactctctctcagctcagctgcctggacctctctctcatgagctctagggggagtgtagtagagaagagagtggtggtggtgtgtgtctgttgcatctctctctctctctctctcatgattatagatgcatgtgcatggaaatctgtgcaaggagcagtgggtgcagggtgtgtgagggcggttcaaagtgctatggtggtatagcttagcttattagggcctgtttagttcgcgaaatggaaatttttgggtgtcatatcggatgtttgaccgaatgtcagaaggggttttcggacacgaatgaaaaaactaatttcaaaactcgtatggaaaccgcgagatgaatcttgtgagcctaattaatccgtcattagcacatgtgggttactgtagcacttatggctaatcatggactaattagactcaaaagattcgtctcgcgatttccctcctaactgtgcaattagattttcttttaatttatatttaattttccatgcgtacgttcaaagatttgacgtgatgtttctgggaaaaatttttggggaactaaacggggccttagcttaggtgttggggagaaggacgcagctggagtaggagcgaggagcttcttttggcacttagcattgtggtaatcccatgcttaattggccgtttagggcatggtcatggggttgagttagtacgtgttgagttaagagggggagagagagattgagtgttaaaagaaaaacaatatttgaagggagagacattcctctaaatattgagttactacctctgtccaaaaatatagtaacttttgagtatgaatctggacatactccaaatatatagtaactctggagtaatatttaaagggagagacattcctccaaatatttaagaagaaattataagcgtgttggggattgaacacatgtcctcgagattgaaaccatacatcccttgccactgcactatcaagtgcatctctgagaaattgagtgttgtttggagaagagagacctcgattaaaccatgtgatttctaactaatgaacatcatggatcaatttgtagtgtgctttcgttagttcaaaggtgaagaaggagagcataatttgggtcttagcaggagcaaagcggttaacggagtttctaccttaagcaccctaacctaacattatatttactttcacacttgtaattaaataaactttttttctactgtattcaatgaaattagcacgtctggtgtccgttcatgaaaaaaaatagttcgatggaggtaatctttgggcagctgttttttttcctttttttaaaaaaaacaaaccatataccatatgtcatatgaaatatgaagtatacggatttgctaaatgatatttgataaaacaataatttgtggccaattcctgcaacttcttgactgtcggatctgattcatgattcgagttccaatgacattcctgctcgatccatctccggtgaacttccgcgagctcataaatctagtggattgcggagttagggttcaatgttgggctagggatgttgtacactcaaaatgcaaccatttggtatctgttaaaagtatgaagatggggcatgttgatccctaccaaaggagcccatatattgcaccttttgatccattggtgtgatcttcttccccctccagttacaccgtctctttggtccctaccatttcgatcctaattatatttccaccgcaattgtacattactttttctacatacgcaggggcagagctatgtatagctaggagggtgcccacgaacccggttaaaaaaatagctatagtttatatattttcaccatatatataccccgtcagtttaaacttagtcacccatatcaagctaaattcgattcaaaccagagtaaattaagcaagtggaacccctttattatgttgtagctccgccaacatacacactatatatactgttatctcttacccgataatattttatttatgagtgattttacggtcctcgctaagatacatattagaggtataaagcactgaaaggtactacttccgtttcaggttataagactttttagcattgcccacattcatataggtgttaatgaatctagacaagaaatatatatctcgccacggtatatcatcatacaattaatttctccttgctcatattggccaactcagtgttgtgtacgtgacaactgacaacctctcatttggtgtgtttaacttgcttttgttcatactagctatttttttccaaatattgagaatatagtacttcttagttattgctacccttttacagtgaaactccaccacagatatatagctaatattgttctcttcaatcatgatcgaattagcatatatagtattggtgacacaagcagacaatacagatatttgcatggtgggagaataatcaataaaatagaatgtagcatggacaagatgttgacagatctagtgctgtgtagctttatctgtttctttttaatgaaagaaagcatgaaaggaatatcctgtgtatatactgatgataattaatatacatatataccataacaaaaggtaactaatcaattacaaagttattactattgattacaagtgggaggtaagttaagctagtgatacatttctttataaatcgattgcaaattttcaatacaacaaagcctgcatctggctagatatagctcaagctagctttgaacatcagaataggtccaaaattgaagtcaccgtgggtgtacatgcacgaatacgtacggcgacgatttgacaggaaggagcagagatagaatcatagaaagaacaagagaccaactcgatcgcacgggcatacactcctgcatgcagatcacaaagctatcaccataaacaaaagaaatggaaaaggaaaggagagaaaaagcagagatgcagatgcagagcacgcaacacatgcaaagaaagaagaagagatcgaggcctatccgatccggccgtgcaggtgatgcagtggattcactgcagagaaaggaagagaagagagagagagagagagagagaggcagctagcacatgtaattgtgctaggctgcacggccggtatcctcatggtatttagtgaccaaattgttctctctatccctagctggtagtagtggcatgcaggggaagtgcatgcacacatccatgtacagatgtctagttgtaaacaaccaaagatacttttgtgcctgcctgccttgcccctgcctcctgctggtgacttgcaagtttcaaggcaggcccgtgacttccatggagcagcgaaagcacagaaagtaaatactctactcactccatcactctttttaccgttcaaaattggtcccataataacttcttcatctttgactaattataattattcttttattaaacttctctacttacttactcgtttctaaccaatcataacttaataataactatattttgagacgataaaaatgctacagaaatacttgtattttaagacggagagagtgcttatagttattctttactcgtttctaaccaatcataacttaacaataactatattttaagacaataaaattactacagtttgagacggagagtacttacggttattcttcacttggtggtgagtggtgggtgcagccatgcagagccactggtagctagggatccacttttgatgcaacatcattttctattgccctttcctctgccattggcctgctgcatgggtgtgatgcaaggctgctgcttccattaatatcatatcaatgtgcaagaaaacaaacattcccccccaacttttcaaccagcattgaaagaaacaaaacaaagttttttttttcactccttcctctttggtcccagctgtgtgtagcaccatgtacacactatactgaatactgatgcagtagctatagtcactagtcagcatgcagatgcagtagctaggatcaagtacttcaagttcaaatgcacttgtaacttgtgtaaagattacatataggagtatacaaacttagctagttcctccaccaccactctccattttccttttgcctttccatgttcctagcaataaagcaggagtaatagcttaatttggctcagtcaaactaggctttgtgacccatccttttcccagggctgcccctgcaggtgatagatggatatgtgcaggaagatagcttagggttttggcatgcaagtactccctccgtcccataaaggtgacgtttttgactttttatttgcaacgtttgaccattcgttttatttgaaaaattagtgcaaatataaaaaaagataagtcatatgtaaagtacttttgataataaagcaaatgacaaacaaaataaataataattccaattttttttgaataagacgaatgatcaaacattgacaaacaaaaactcaaaaagacaagtaatatgggacggaggtagtacccaagaagatgccacaacctgcaagcaacatttgcatatgcatcaatgcaggtgggcagctatatatgtggcctagtgcagtacacactgctggtattgtccctaggtgtgtgcatatatgcaacagctacagtttacatagcttgtggaccaaaatgcaacaagaaaagaaaaaaagacaagggaagaaaaataaatcatagcatataaaactagcaagaagccagttatcttacaagctataggactgaggcctatagatgtgcaaaattgaagcttgcatacatatatacatgtgtgcaaaagtcttttgcttcattgtgcagtgtggattggctggggagtttgaatattatggaagattctgttccacatatgacaagttgctttaatatgatatgttttgtagtagacattttatgagtacatcacatgacctttctccatctccacatgtggcccactgcatttgtggccaggtctagatctatctttgactgccaaaaatatgcataaaataatgagagaaattaaaaaaatgatggagatcatcaaatatcatatgatatatatgtacgtgatatggaagtgtggctagtgaaagacatgaagcaagaaaagaatgtcatgttcttctctagatcaggcccacattatctgatgatgatgacacgatgcatgcatgctagatgccgttaaaaaccagttctctagacatgttgtgtgctccacacagtgtgcctctcatttcgagattcctctgaaatcactactaattctttatcatatcatgcattgcatgcaagagctagatactgtggcgcttatatacatgtatctatgtgcatacaatttgctgcatgcgacaccactgttgtttgcatgtcgaagaacacctctgttttcgtgcaatgaactgattgatactcaggagtagtttgctaattagctaggggagatgcagaggtgactagaataaggaagatatactcactagaagatggcatactgtgcaaaagatgtagctgtttgtttgtctacgagtagtagatcaggtaggacaatgcagcatgcatagaggtcatgtgaagagaggagaccaccaccaattaccaaaacgtgtatatgcctgatcacttctctcagctccatagctaggctccatagaaaacagctgcatcttggactttaccatggttgccactcacatacctgcaaataaccttgtggaggattagacaattaattagagatgcacttgattaaagagagatctagatgtttatgttgtcctggctagctaccttagttctttacattattaaacttgaaggccactacatatgtgcagtacagtgatggtacatagatcttagccaatgcatgtagctagctaggtccacagctagtacacatttccaggtttcttattaggcatgtatgtatgtatgtttgtccctttggatgtaccctagtactacactactgaatatctagaactagagcttagctggggagatggatggagagaaagacacaagatcttttgctgtggttgcattataaaaagaggcttgattcttcttttaccacctctatgcttaagagctttttgtgttaggaaaaagtaaaagggagaaaaagaccactccaaagagggggagttgctagacaaaggaagcttttcagagaacatttccttcttttttttccccttcagatagagagtgagaggagagggaggaggaggggtcagaagtctcagagcattaagggaaaaactgattaaagtctgtgcacatataaaggagctgtaaagatgtgaatttaccacagctagctcctctacagcctcctgctggcttttgtcagactcttacacatgtgcatatgcacatctctttccccctcatgtccctgccatgggtggtgcaggagtatgtggtgcctctgagcactagatttagatgtttctaccttgacaaactaagccttgatcttgtgtccatgcatatcatgtagaagagccttctagatgaaacaactagctagttctacacccttcatgcatcatctaaatacatgcacattgaaagacagcttatatacttgaaaagagaaacaaatgtagatatggaatcaaattaatcatcaatgcaatcaagaatcaagagagcattcataagccctaacatacaaccccatcattttgtttatacataaatacttattcatacaacttattaatgataataattattataaataaaacttttatatgcgtgttcttaactattcaaaagcaaatgctgtaaaataaaatacgacgacaaaaccatggagacaactccaaaattaggttttaaaatttatattcaagcgaaacgacaaggctcatttggtttgcacaaaagtttagtaaggttgatttcggcaacaaaccaaacaaactctaaaagtccttttggcctatgaggttttcattcaatcccctccatatataccaagttttgcctgatcctctgaacatgtcatttaattttaagctctacatgcatggttgccaacccagtacccagaaattttgcttctgtctatctctcagcttgaccttctgacctgttgctcagctgcgatggaggagcgctagctagctagcaagctggcagcatggaaacatcatttcgggatggtgtcagctaccaggtcatacggctttgacgacgcacgcatgcaggcttgcagttgcacggctgcacgggccaaggtgcatatggctgctgatacatcagcgcagcaagcagcgctagaacaatcaagctagctatccagagccagccatcgatcgatcgcccccctgccgctgcctctgcagccggcccgtgcatgcatgcgtgctagctatagctgcgcgacaagcaacctaaacgacctagcgaagctaagcagcatgcagcctcagtaaatgttcttgccttactactagtaaatgttcttgcctctgcctgggcgttgcaatatctatagctagccaccagcattgcaggacggccggccggctggctggccggcatgcacgcgtccgtccaacctcgtgcactgcacacgtgactggatcggacgactcacatccgtgaagcttccaatatatctctcctcctctctttctctctctctctcacacacacatttaaacttgagcttgtgcaacctagctaccaatctgcagcatttcatggcctgtgtgtggctggggtgcagtactgcagtgtctattgccatcctctttctctctctctatctctctctgaagtctgaacatactatgacctcttctttctgagagggtcacaagctagttgccactgcctggtcttctgttgcttcacatggtgtcacatgcaccgatgcctcctctattcttccatttctcttctctttctttgattgacagataacagtttcatatgtttgcttgtgtgttatatatgtgtgtgtctactattttggccgatctgggtctgcatccattgcaaaaactacacaacagtgtctcttttttttactgcacctatggcgacatgcgttgcaaatttgcaatgtactacagcattagagagctaggggtagccatatgcatatatggatctttccctgcctctttgaacagaatctaatcatgctattgccttggcattggctactttctaaccttttcccctagaggaatcacagtctgctggtcaaaaaagttacaagagccagagagtaaactatatatataatagtattagtttctagttgcaagcaggacatgcatcaaacacagtactactgatagctcctatgcaagctcggctttaaggacgcctaccagtcactgccagtcaaacaaacatggacttaactctatggtttgagaaaaataatcatctgataataattgagtttcattagcttatagttaatgacatgataaaatatatacctggctagcttcatgtgtatatgcttcagttctagcaaaatggcaagtgatatcctatctgaaacagggtcattcagatgatggcagaaataattttcaagcactcctactaatttgttcatgacatcatgtgttacacatcacaaaagggaagtcaataaaaatgctgcacttgctatgagatgtgagtatgtgactttgtggtggaggttctgtgacataaatgagggcctgaacagctctcagatgttccaggctttcctgcttatgcaagtagtactaaggaaatttaaaatcgcaacatcttctgctggtcccaaaggatgcaacagaatttactgcaagctgaattccagcctgattcgtcagctcatagctgcacatgtgtgtgtacctcacaatgtcaatgcatgtgtctgtctcctttaagcatacagttccaggttcatgtcatcttgatgcatgtttatgcatgcagaatgtagtgccggacatatgcttgatttgctagactattttgattttgcgattaagttattctaagcatgtaaagtccaaatcatatccgtgagcagcaatgcgcaagtgcaaccatatacatatttgctgatagcctgatactactcctaatgatgatttgaggttatcatagataggcctggtgcatttccaactgatcaatttgtatagcaaaagcaatgccaactaatagatcatatggcttgatcgactcgatctgcatatgtggagcacgtgatagccaatactcctatatatacgcaaggtcaatggatgagatcaagaactgaaatgataacccagaaaaaggcccaaaagagtggttttgtgttgctaagaacaaagctacatgagttcttgtacttctttagtaatccatggcgtacttcctatcaatttcttcaactcctaattaattgatatgatgcttcaatgtctacattttccctcccagccatagaaattgtttccaagaattaacaacaatagaaacagtcctgatttattatctgaaaaggcacccaaagggcaatactggaaatatgccaatatttggcagcaggaacactaacatgggatgctagcttctgtagagcaaaaaagagaagtggctcaggccagtagagaagtgcatagctgcatatgcagggaattaaccaagtgatggaggaatgttgcaagcaatgattgtcctagcaagctcctttggcacacatgtctcgctagattctgatgcaaagatttagatctccaacagataaaagcaggcagtagtagtgaaagagggcagggggggaaaaggaagaaaagctaaatgggaatcattaaaagttgccagctttcagaaccctgtgggtccagtttggatcaaggagaatcacaaggcccaaagagccctccctccaaagatgaggagttttctaaaagcctgtgtgagctccatattgtaacttatctaccaaaagaatgttgtgttaagacatgcatggtagagaaagatgaaggctgtctttatagggaaaaggagtactgccggtactgtattgctacacacttttttaccatggacagcaggaatcctaagtagaaggatcgaatttacttgtagctacacagtgaaacaaccggctactgattgcctactcaaaattcgctttaggtcaaacagataggacagacaatgaagaacaactagaaaaccttcagaaagcaggctgctaagcattccacatttcctccctacacgtgtattaattagtgtgtatgctcgtgtatgatatgaacaagatttctgctgtatcaagacaacaatggacatctcctggtcactctacgttgtacatacatgcatagaggatgcagatttgtactgtagagaattcagatacgtacatacctggcacagtgcagtcagtcgtcgatccagggagatggaagaagccaaggacataagatccaagcagaactggtagattcctctagctcggacgtcctctcctcgtcttggcctgaaccatcatcagcaagcaagattagacgaccggctctgaagcctgaacgtgaagctagtggtaaacaaaacaaacaacaggatagcctggccggcactgcaaccgtctcgtcaagccgaccggtggacagggcgcctgcaaccggtcatgtgcgccgcgcaggacatctggccatgcatcccatcgtcgatgcctccgaccgacgatcgagccgttgcaacgaagagttgacggtgtacggcgaaattagcttgagcccggccggcctcaaactgaagtggagccttcagaaatgaaggagagaaaccaatcatcacaggcatgcagcaacgtacgattcgtcgtcgtcaatggaggttcaggcgtgtcgccggagctgggagggacaagatggcaaggccggcaggtacagccacagccacacccacaggcaggctagccgggatgccggccggcaagatcgatcggctccagctagtttagctcccaggccagtcaaggtagaggcagctcaaagtgtagtcatctcttgatcgttgattgctccagtcctatcccatgctcctccttgagctcccaatcattgagctctcggatcctctctgctcttctctgatctggtgtcgttccagtttccaaacatgttgcagaatgaagaacactgaacaacaagattataaggtaggtaagtagttgatcatttcaggtttccagagatgataaagcaatcagggatgcatgcacactgatgctgattgtacaaactccaagcaagtcaggcccaggtccaggtccaggtccattaggtttctgttcatttgaagttggtctcaatcagtttcagacaatgttgctgtaaagataatctctcgaactccaaggctatatcattgctggccatactgatagaggttgtgttacctgaaaggttgtcagaggacacaaaccaactgtcacgccgaccatctttcgtcctgggaatgcgaggctaccattaactccccaatgatgtcatttctctgagcaaataaatggtacctcatgtatctccaggaggaccagaatagcagcaagaactgcaggaaagaatgaaacaaagccaagaggatgagccaatctcaaattattacatgatactttcagcaagataagcatactaaacttcaagttaattgatgaatattattacaggattctactggttctcacaaagaccattgaatagtaagatctatagcttcggtcacttcttagaacaggaaaaacaacagtactagctaacgttcagcaaactaactgtacatttgtttgatggaggacgcatgacaaatgcaagtgcgatcataatgaaaggaaatgatatgtgaacagaagtagaccatcatatttggcatcctcattgtgttctctagttcttaagactcagtgtccgttgccgttctgtatgaatcactctgagaacgatgttttctcttactctttctcttgcttcttttttcaggatttttccttcaaagtttctttcatcagcttccttcctccctttctttttccagatcaggattttcaaaatgatagggaactggcatagcttgcttcttcagcttggtgctcttatgctgctgcatccttgagggccgggatacgtagaccccgtcattcttgcactagtatgtccaatgaccaggctggaagcacttctgacattgggtatgtgcagcaagagatgaagttgctgaaacttttggtttcacatccaatattgcagctttctctgtactaatcaggtacatctctcacttagccttcttcctctcctgccagcggcttggtccctcttccttctgcccataggtacattacgggcagcagatgtggcagcatgtttagcttgagacctgttcaaccctttagctgctgataatgcggctgtctttatacggtctactgcagctcgggatttatcatcgtttctggacatcttgattcacccaaattagggcagataatattgcgaggaacctcaccatcctgaaaggaagaaaaaaactatattggttagttatgagcaagggataatttcatctatagtaaacaaaacctaaaacatctggctaggtaattcactaacatggtcacatgaatgcagacataaacttttctgtttactcaggcttaacaccattaagccctgtaaagcacttacaaatggtactgctcataaacaacaaatcaaccatatgtattttacagttaagccttcgtgtatttagaacttgttgttgtacaattaaatcgatgaagattctatcatggcgtatacatttcaatcatatagaaccttaaagatatattttaagccaaagtaaggcagcggaaatgcaaaattgtatcaaatgctacacttctacataaatgtccgttccacgaacaaaacctctaatagaagaacatgccagttgcatactctcacagtactacacaatcagcatccaacgtaaccatcataagattgtgagaatacataggaaaccacctcttgagaatggttgtcagaatctagcaacatatacagctgctattcatagatataaatatacaaatcacaaatgattgatctgaatgacgtttaccgaaactacaacagcacaactcgaccacaagaagcatgcgaaattctcttgcagcaaggatgattagtactaattagtaacttggtgtgcatagcactagcaaggaagattagtactaatcagtaacttggtgtgcatagcatggcgtaaaggtgaacattctaaatttgcagggacctcgttaatttaaactagaggtttccactacatccatctcgtgttgcttaaaatctataaaaatactccctcctttcatattataagtagctttgacttttttttcttagtttaaagtttgatcaagtttatagaaaaaaattacttcctccgtttcacaatgtaagtcattctaacattttccacattcatattaatgttaatgaatctagatatatatatatgtctatattcattaacatcaatatgaatgtgggaaatgctagaatgacttacattgtgaaacggagcgagtagcaacaactataacaccaaattattttcatcaaatctaacattgaatatattttgataatttatttattttgtgttgaaaatgctattgtattttcctataaacttaatcaaatttaaacaagtttgactagtaaaaaagtcaaagcgacttataatatggatcagaggaagtaactcataaactcaattggacccatactttgtactgctagagaatactacccccaaaatcaactagattgcgccaaaacaatacagcaacgaaatgagcaagccaccccccgccacaaccaacccattctcttccattgcctcgacaccaaatcgcccctccaactgaccgctccaagccccccacgaaacccctcagaccaacccacctcgtcgactacctacagcaaatgcgactcctcccccacaacgactactcgccggatcccggaggcatcctcccaggaaggaagcgacgatacaggaaggggggggagtgggaggaggaagatcgattaccagttggatcggagcctcggagccggaggagatcgccggtgaaggagagcttcgcgcgcgctaggtttggcggtgggggagagcgcgtggggggaggcgagaggagaggccgtggacttcggccgcataacatgggaaatgatgggccatagactaggcctgtttgattggaccaaatttcggcccattgacgcatacccgatgtttccaactttgtgatatttacgcatactctgtttattttggaaaaaaaaaagtcatataccctccctatgtttccaactttgtgatatttgccctctttttgttggaaaaagaagtccatacactcctaacacctttagataagagtccgtctaagaacatccccagcagatatgccatccgaacatccatccagaaaatagcggttgagaggagaaaaacgacctcctgcagaaactccatcccaccctccaacattagcgcatcatctatccgggagagaaaaatgccagatttggcgttcctctctcctcacgccatcccgcaactgctagcatccagacccagttcccgtcccccatctggatcaatgccccatccaccgccgtcgtcgcaaagtcgtggagtcgtggaaagaggatggagaaggagaagcataccagatctggaaggagagcaccgccagcgacagccgtttgcgcccgctgccgtcgccttgcgcccacccgcggaccgtcgcctgccgcctccgcccctcgcccgtctgcccctgtcctatctgcgcctgccgcctgcctcctccccgcccatccgtgccccccgccgacgcctccgcccatccgaaccccccggacgccgccgcccctcgctagccccccggctgccgcctaccgcctccgcccctgtcccatccgcgcccgccgcctgcctcctccccgcccatccgtgccccccgtcgacgcctccgcccatccgaacccccccccccggacgccgtcgcccctctctcgccccccggccaccgcctaccgcctccgccctgtcccatccgcgcccgccgcctacctcctccccgcccatccgtgcccaccgccgctgcctcctcccatccgcgtcccccgctcgccgcccgcccagctgccactcctcgcttgccccccggccgccgccgcacatccgcgcttgccagctgccccatccaccctgccacaaaagagaaggaaaggagtagagaagagcagagagaaaagaataagaaaagtgtgaaaatgaggaaggtagcagttgaacacatcacattgaaaaaaaactcactcaatataaatatatcaattaagaaattaccaattaaaattatatccattaaaatttacttatttcgaaagattattgtgataaataacatcattatcattaaaattttagtgatccaaaatatagcccttaaaaaataatacaaatgtaaggtatgttagaaaatattactaaaatacagttaggtgtgatatggatgatctgttggagtaagaatggatatggaggaggaatcttcatatggaggaggaatcttttttggatggtcatccatatgggtatatggaggatcaaatttggatgagctgttgaggatgctctaataccataacttcgaaccgggatatccaacccttcaaacgtatacaatcctccaaactttgcaataattgaatggttttggatggtgattttgcgtaagcttaaaaaagcggttttgaaaagctagtatcacatatttacatatcatcaatcattggtcatcaatttatactctctagtgacgtcgtactaatattatatcgatattcatttgcgagagctaaaaaaaggttaaaaaaagaagatttaaatagagattttaacatatcccttcttcctataaagttatcccccactaagtgcaattaagatcctaaagctcaaacctcaatgatccacgtcatcattaatttacagcccttggattggtatattagattgcatctgcaccgttggatgcaatctgcctcaatctgcctcggggtcgaacacacctcaatgaacccaggaggcccaagtcgtgaggcccaggatgcccaagtaagtccaatgagggattttagggttcagtatgtctcatctcctcctgacttcctgagcggagcagcggcggcgtagtacggcggaccctagcgctcgcccaccacgtcgcgatcacgcgcaggtggtggtggggacagggcgctcggttgcaggaggcggcgatggcgcgcaggtggtggtagggaccgcgggaggtagcgatggggagccgtgtagcgatgcggcgatgggggagaagcgtctggactcggcaaccagcgatgcggtgatggggagaagcgtctggactcggaaaccctagcgccatccatccgatgggaagaagcatcaggaaccctggcgccatccatggtgaaatcaaccgccccctccccatcctcttggctagcagaaacggtaatcaccatgcttcttcccattccccgcccttaatgatgtgcatttacattagaaacggccaaaatcattatggtactggaggcacgatggttaatacgatttacgtgcctcttgcaatttcacttcgtaagcctcttccaaaccttttgataatcctcttgcaatccccagtcctaccagacgtctcctcaaacatgtgcctctccatcagacatcatccatccatccgcaagcctcagtccatacctccctcgacatcatcacttcatcctgcaagcatattctccaattcggacatgattgcgatcacggcatgataggttagttgtggatcaactttgtcagatcattgtatgtaggcttcgttactaattttgtatgtctgaattgagttggttctttgccctaagtactgattttagtttctgaaaaaaaatatgtctgaattgagttggttctttgccctgagtactgattttaatatctgaaaaaaaaatgtgtgaatttattctatttgataagcctgaatttgacatcaattttgtccatattctatttgagcaaacattatgatttcaaccaggcaagatcactatgaaagctttgtaaattggattctctacacctaaagaaataatccctatcctatgcactgattgttgttcgagttatttaagaaaaataaactgatatttgcagtggatacttatatgtcctatgtgattttagtttctgaaaaaaaaagtgtgagaatttattctatttgataagcctgaatttgacatcaattttgtccatattctatttgagcaaacattatgatttcaacactgatttttgttccagttttttaagaaaaaataaactgatatttgcagtggatacttatatgtcctatcactttaatgcatttgagcagttggtgaggagccagaggattgctacatagatgtcctgacatagcgagaagctactaacctgctcggtatgtcttctgttgagctcaccccatgctattcatgtttcctgttaaaatgtgaaaaaaaatcatttaaaaaacatatgttaaatgttatcaaaatttttgaaactgtgcacatccatagttcatgttatgatgcgtttttgtcacgaaaaaggtgttaaaatgaaagcttttggatgctttagtgagtcagttcagtatgtgtaaatttcacatgatttttctcagaataatatttgagcatacattgtggattttgcacatgcaggagacctatgcactgggtactgttttagtttcttaaaaaaatagaacctgcagcttatactgtttttcaaactatgcacattcatagttcatgttatgatgcatttttgtcgcaaaaagtgtgataaaatgaaagcttttggttggtttagtgattcagttcagtatgtgtgaatttcacatgaattttgccaggttatattatatttgagcatacattgtggtttttgcacatgttggagacctatgcattgagtactgttttagtttcttaaaaaaaatggtgcctgcagcttatacttctttcacctaccctttattaatagatacaagaacatttgtttcaccacttgaggagaagcctgacaattgtcataaaagcagataaacttgctcggtatgtgtgctgttcaactcatcctatatttttcatattattttgtacatctcttttctgatttcatattccagttacatcttatgcgtatactcctacatttagcaaatataataaagttacatccgatatttgtaaatatatgatcagatgctttgttcattaaaactaaaaaacaaaaggttcagcccatggatgctgggcaaagtacttcatgttttccagtaggacgtcgccggtcaagacgtccactggcacatattttggtccctcaccctgatcatgctactgctgctgaatcacgacgaaaacgtaaactcatattggatgcccatagaggtagaggttggttccccaatttaccccttcaaattttttagtaatgtaaaatttatcgttgcctacctaccttagttacccggttatagcctatctaattttgtacccacattcccttcacaacatatagcatcatcttcagaacaacggtccttgcatcgagagttgaacagaactgaaataggctcttcatctgcatctactcctccattggctaatgaacaacgaattattggaatatcctctcattcccagtcagctgagagtaataattcttcatctgtgtctacatcaaaccaagtatttcgccatcgccgtatgttatcatatcctttatacgtaaaatttgacatatgccaaccttacatcttatatataacagtatctgccatcttccattgatatactttgttaggaacaatctatgctccacttaatcttggcagcccccagcattcttgcatccattgtggtgctttattttggtatgaagaacgagcacgaaaagaaaggcacacgaggaacccaacatataatttatgttgcaggggggaaggatatcactgccatcttataatccacctccagaacccatattgaatttgttaacttctgcgagctccctttcaaatcatttcttgcagcatattcgtcgatacaattccatgtttgctatga

SEQ ID NO: 71127 - DNA, 28072 bp, Oryza sativa
ccgtgtaggcggaggcaccagtcggcggcgacggaggcaccggcggtgaagtcgtagacgcccaacagcggcggcataaaaggccagccgtgtaggcggaggcaccagtcggcggcaacggaggcaggccggcggtgaagtcgtagacgcccaacagcggcggcataataggccagccgtgtaggcggaggcaccagtcggcggcaacggaggcaggccggcggtgaagtcgtagacgcccaacagcggcggcataataggccagccgtgtaggcggaggcaccagtcggcggcgacggaggcaggccggcggtgaagtcgtagacgcccaacagcggcggcataataggccagccgtgtaggcggaggcaccagtcggcggcgacggaggcaggccggcggtgaagtcgtagacgcccaacagcggcggcataataggccagccgtgtaggcggaggcaccactcggcggcgacggaggcaagccggcggtgaagtcgtagacgcccaacagcggcggtaggggttcgccgagtttcctgtcaacaagtgtgatggaatcaatttcatgattcgtcggcttcgtcttcgattcgtgagttttcacttcctcgctgccgacgacttcaacaatctctctttctccgacttgggttttaaccagtcgagagaacggcgatcaaagatctgtgtcatcaagttggaagcttcaaaccgtcatcgtcaccgataccacggctggctagttgcataagacagctgattggatcaatctcggactcggctgactcaacatggaaaatcaaaaacacggagcagtacatacaagcagcaattttcacttggtcagctcgagtattttttaatgaagacgtatggctgcgggcacacgcgagctatatcaatgctcaaacttatccagcaattactggtcatcgcatgcgtttgtacgtgcctggaacaactatgtacctgtatgcataaacacataccaacagaagatctgcacatgcatatgatttttgctacgagagtctgggccatatatgtcgccgacgactttgtcaagtttctcttcaactcggactggaacacgacagacaacctttaatctaggatacaaaacgggctggactaccctgtcaatattggtggccatcatcatcaccggcttaccttcaccgccgccgactggtgtctctgcctacacagctggcctattatgccaccgttgttggacgtctacgacttcaccctgagcctgcctccgtcaccgccgactggtgccctcgcctatacggttggttggtcacaccaccgttcatgggagcctgcctccgtcaccgccgactggtgtctctgcctacacagctggcctattatgccaccgttgttggacgtctacgacttcaccctgaacctgcctccgtcaccgccgactggtgccctcgcctatacggttggttggtcacaccaccgttcatgggcgtccacgtcttcattgatcggccggacttcaccaccgccgactgctgtccacgcctaagcggttggttggtcacaccaccgttcatgggcgtccacgtcttcaccgaccggcttgactccgccgctgcctactggtgtttccgcctgcacggccggcctattatgccgccgttgtcgggcgtccacgacttcaccgccggcctgcctccgtcgccgccgactggtgtcctcgccgatacggttggttggtcacaccaccgttcatgggagcctgcctccgtcaccgccgactggtgtttccgcctgcacggctggcctttatgccgccgttgttgggcgtctacgtcttcaccgaccggcttgccttcgccgccgccgactggtgtttccgcctgcacggctggcgtttatgccgccgttgttgggcgtctacatcttcaccgaccggcttgccttcgccgctgccgactggtgtttccgcctgcacggctggcctttatgccgccattgttgggcgtctacgtcttcaccgaccggcttgccttcaccgctgccgactggtgtttccgcctgcacggctggcctttatgccgccgttgttgggcgtctacgtcttcaccgaccggcttgccttcgccgctgccgactggtgtttccgcctgcacggctggcctttatgccgctgttgttgggcgtctacgtcttcaccgaccggccgcctcgtctgccgccgactggtgcttccgcctgcacggctggcctttatgccgccgttgttgggcgtctacgtcttcaccgaccggccgcctcgaccgccgccgactggtgtttccgcctgcacggctggcctattatgctgccgttgttgggcgtctacgtcttcaccgaccggccgccgcatccgccgctgactggtgtcaccgcctgcacggctggcctgttataacgccaactgatgctatcttcttcacggctggctacatcgctgtcactactaataggcattagtatcttcaacacaagctgcctacgtttgtcatggctgccgactggtttcttcacttccatggctgcatgattctgccagtgttgattggccttaccatcttcatcgctggtcgtctcgtctgctgctgactagtgccctcacctctacgtctggtttatacagctaccactactgatggacatcatcgtcttccgttgccgactggttatgccgccgccaactagtgcttttatcttcacaactgcgcgtcttcgctaccagtttgcttctgttgccgccgactcgtgttcacttcatcacggcaacacaactttgtcaacatggtggagcgacttcatctttattatcttcggtaccagcaaactctattgctgctacttcacaagttttgttacatcaccaaccatgacgttgttgtgaatctcgacatctcggcatgcgatgccgtgttattttactacaacaagtggctctccaacattcatgatttctacttggacatcttcaacacatatcttcaatcaagcaataactattcgacgacaagatgctacagttctcgactctatgttcagttgtttcccaactaatcaaagagtcgggggctacacaaatacaaggctcaaaatttgacaaattttatgtcaagctgaagaaatcaattcatcaacccacgagtcaactccagaagtcattatcttcatctttgcttcggagcagacattctacttcaacaacttcaaatatttcggtttagacgagttgggcaacaacatcaactctcctccaagtgaagcatctacaacagttataacattaatttgatggattattgtcactgacatcatcaccagcacctctgcttcatcgaccctgacatctctgctgttgctaatggatgattatgtttttgccgacttattatttcaccttcacggttgacctactatgcaaatgctgatgagcgtctttgtcattatcattggttgctacactgctgttggctggatcaccgacatcgtcatcttcatcatgtcggttgcgtttgtcgtcgtcaagtattttcttcatcttcatgattggtggatttcgtcatcgcctttgatttgcctcgtctgtcaccgactgattatttcgctgccatagctacacaactttattgctgagcgccttcatattcattgctggctgactgctgccgactggtttcttcgcctccacggctgtgcaacttcatcacttttgattggtatcactatcttcactaccaccaatatttttgccacctctgctgggcaatattatctctgtattggtcgtcttgtctctatgccagttgcgtcagctaccatcaatgaacaattgtgactacgtgctcaggggcttactagttcaaacacaagtatcataccttcaatttggacttgctctggatacatgcaatatgaattcatgatcatgggtctattttctatgtttaaagactggactatttattattccccataagggttacaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttactcgactttttaggagttggtatagcgatagggttttgagttatcggctatatgtccaatgtagagtctaacactcgatgtaaataatgatataaaggcactgatcgatataaaggcaatgatatgatagaataagcactgatccgaaggttaaagcatacatcggctggaggtccgatgtcataaaatccacaattttagataaacagtgaaacctttgttgcgatcggctaagtccaacttatatgtatatgcaatccttacaagccaatgcaacgtccatataacttatcggctagcaccccgataaaacattagcatgaacctatcggcttaacaagacatatatattatcaacaacaatctagtagatcgaacctaaccgatgcagcatgacatcggatcccataagatataatagaaactctatcccctccaagtaagactttagaaatcactcgactcataggaatattttccataatttgtaacggattcctccaacgcatacggaaatcccgagctaattctttttctcttgaaatcacttgactcgatctccttttctttttctcttttggaatcccgagctaattcatttggaaatcgtcggattcgatgccgatttggtttgcttctctttccaaaaccctagagctttcctaatccaccggtgcctccatgggcttagctggcgccctccgccgctataaaaagcacccccctagttgtcctctacccatcccctcaagtcccgtccgccgacgagacccgtagcaccctagccgcgctagctcgtgcgccgccgtcgtcgaagggagtacggtcgtgccgtgccgccgctatagtctccaccatcgctcgaggttgccttcgtcgggttcgcaaggttgccgccgtccccatcccgcccttcgtttccgccgcagacagctagagtgccgccaccaccgtcgacccgaagaccaccgccgtctcgacctcgccgccattgtcgatcgtcaccgtccgtcgtcgttcgagccatcggtgagttggccacgtcacgctctacacgttgatgccctccgtttgcgccaccgcgccgtcgttcgccggctagcatgaggtgccgagccgacgccggtgatgacgtcatcgtaatgtcatttgtagaccgtggtagaccggaacgatctcggccgtccgatttggtcaagtttaggtcaattagatctcggccgtcggtttcgtggaccgcttctgtgaacccggtttagcatggaccgtccttgatgacgcagtaaatctcttttccttttcaaaagtaattctttattgtgtcataattcaattaaaatctttataaatgctttaactcgatttaaacttcaaaaattcgtaactaattcattgtaactcggtttaatgtggttcaagttgcaaaagttgtataaaatgaagatctatatattaaaattatccattatttgtgttaaattcatttaatcctttttaaataggcttcaattatattaaatcttgtaaaattcataactaattcgtacgaagtcggaatgaggccgttcaagtctcataatttatctaaaattatgatctacatgtttgtttactttactagcaaaagtgtccgtgcattgcactgggtgattatggagtgtgtatatcaaccaaaagtgttgtttggtttagcaaaagtgcccgtgcgtagcaatgggaagtgtacagatcagaaaaatatgcaattaattaaaatacaaattctctgaatatttgatatttttaagtaggtatgtatataattaaataaatttacaagtaaagcaattgtgagaaataaaatgacatggttaaatttaattttattaaattcttcatgattagttttgctctttgaaattttattggaattttcagagcttaattgctaactttaataatacaaacatcatttaacaattatttaattggaaatctaatttaagttcttgttgggccggccgacctacgtgcggccaatgaggcgtgcgcggcccagcattgatgcggcccgatgatggagaccggcccgacgcgggagtgatcaaagccgttcgttttgatggacggctcatatcggctcctaatctatcaaaaccctcaacccaaataaaccctaaccctaatttcattcttccccttcctcccctccacgcaggtcgcctttctccccgccgccggccgcgccacacccccaccggcgcacctctccgcgcccctccccaaccggcgacgcctctcaacgcccctcccccaccgccgacacctcttgcccccctccccaccggcggtggctttacctaccgagcagcggcgacggcacccttctcccccacaagcggacagcggcggcgcccttcctcccgcgagcggcgacgatggcggcagcggcgccctgccctcccacgagcggcagcggcggcacactccctcgcggcaggcggctgcggcgacgcggcgatggtgacgccgctccctccccccaccgccggctccttctctcctcgtcgggtggtggccgctgcaccactctctcggtagatccgccggtggtgtcgacggcggcggtagccgcgggtggaaccggatgtggtggtggcggtcgcgggccggcggcagctccctcctcccctctcgcctccctcttgcccctgatccggcggcgatggcggtgttggcggcgtcggcgggtgggtccgtggccgacggcgaggtggcgaggagcagtgcgctgcagcctccggtccggctcgcccctccctctcctcgtcatctcgtgttaatatgatgttttctaatgattccgatttagatttggactgggattttgtgtttgatttggatttggattgtgatgatttgagatttggagagaaggtgtgctcaatgtgggattctatttgtgtgatgatggaattccgactgggatttttgagggaggggagggacgaaaaatcaccgtacggatgtggtgacgaaaggaaaaatccgaatatttatattagttatagatatgtacttttcatttggtttttattagtcttttttctcgttttgcgtgttagcttgtcctttccgtcttttcggaggttcgcgagtgtgtcggaagtattccagaaaactaattgaagaccgattattgcaaggaaagtcacacagatcccaaacacaattcatttgagcatgttgatcctatatttaaattctctatttaattaaatcgtgcatttattttcgaatgtcaccgggtggtgtgaacctattcctttgttatggccaatttgcaatgattaccctatttcttgattacctcgggttataatttgactagtcggatttatatatcggttcaactagatgtattagatataattggttagccatgcttagaaacattagcacacaattgggataactaatgtttcactattacttaatgatggatatttaatgatagctcacgatggttaattgtgattggttaattaattaattcgctaactaaaacttgataatggtgggttgtgagcacgtggttttgatggtcgtgctcatgacaattaaggaccggttcacgagtttcggttgtgaaacattaaccgtgccaaccacaagccagcatgggtaacggctttaccttttgtatagcatggttcattgcggggcaccagactgagaagtggcggagataagcccacgggggtcgctggggagtccatgccttgttttataagggggtgattatgatccaggaacggtgcactgtgggggattgtgttatgcgaggggtactgtcacagctcctttccgaggtaccgtggtggtattaaggcgcatggtgacatgtcgtggggctatgtcttgtgggtacagtggtacatctttggccatagtaaaactattcgaatagccgtgcccgcggttatgggtgggtctaacaatgtatttcgtgattagtatcacacttctcaccataataaatgatgctataactggtaataatttgattagctcttggtttggaatggtacattcctagtttggagatagatctgtacagccgggtatggttgttcaggtttggttgggcctgtgcagcatgggtatgctgttcagtgttgattaatatcgatgattaattactttattgctttacaattctcaaatgtttgctaaatgctccttctgcaaatgagccctatattatgccattctttggtatccttgtgcacttgtgtacatgttgtgtggcttgcggagtattccatgtactcaccttggaataatcaatcaaacctcagttgaagacaagttacaaaggagaaaacatttgacttataccccagttgagctgtctgtgggagtggagctgaaacttcgctagattttatttttctgctacagttttcttcgtggtgaggactaggtacctcttatgtaagtatttattgctttagttcttatgatgaatttgtatattaaattgtcagtttgtatacctcggctgatttctggacaatgattttattcacaaattagttcggaaattactagtgattttctggtcgtgacagaccgccaccgcgccgcaagccgccgcgagccacggtcggtcgcgccccgtacggtgccgctgcacgctgccgcgggccgattgtgcccccgcacggcgccgtcgcaccgctcgccggccgcgcccccgcacggcgtcatcgcacgccgctcatgcgtgccgcgcccgcatagccgccgcgcagcgccgagccgtcccctgccgcgccatcaccgcacacgcacgcctggccgccacaccgcagctgcgctgcccgcacggccgcagcgtgccgccgcgtctcgccggcgtccgcgcctcgccccgcatgtccaccgcatgccgccggccgagccgtgctcgcgcaccgcccgtgccccgcatggacaccgctgccacgcatggctgccgaccgggcgcaccattcacgggaagaagaatagaaagagaagaaagatggaaagagattggcgattttgcaaaagggcccctgaattgtctgaaaattatgcgcatatctctcggcatggaaattccttgcgcgtagactctggaatttcagaaatttccattttcatccctccaccgcatggaaacttagtaaagggccccctgtacttgcatatttcgcctgcatttcttatttaagcattttgtttatgtcatataaatttttaatttgaatttcacgaggcattaattaatgttaattggtattttgaattttcattttcagtatttatatgaatacatgcaacttttgccccccttttatgaatatttgtatgaatttgtatgaactctagtatttctttattgaaaattgcatttactttgaattacctgcgtttctttgtataattagcatttcctttgcataagaaatattggaaaaatcatgaaatatttgtattcatatttgcaaccatgataatagcaagtaacacttgaatgctttgtcgtctttgtaacagaatgttagtaatcacgaacaaggagttcgctgaactggccccgtatgaccagaactacctgacctgggcatccaatgtccagattgtccttggggccaaaaagctcctcaagacatttgggatgggcacagtacaagaacctatgccgacacctgatgagaacgatcaggcgatgtacttcctgcgacaccacctttgtgccacactcaagaatgaacacatggcaacgaagggtctgctcactctttggaccacactaaaggagtggttcgagaagcggaaaaacaccaccttgccccaagcagagcaagagtgggcacacttgaggtttgccaactatataaaagcgttaccgaatacaactccgccttgcatcagatatgtatcaacctctccctgagtggcaaagtagtcacggacaaggagaagattgagaaaacgctctccaccttccacctcagcgctatgcatagcactcgtaaccacaggcggatgacatgcaagaagtatgatgagataatcaacatcacgcagatgtttgagtcccatgacaaggttctttgcaagaacttcatttcccatccatccaacaaaagtattgaccttaaggtcgatactagcagttacaagaatcacaagcccatctaaaagaagaggggcaagcaaggtgggaagaaagcacctaagaatatgcatgaaggaactccagatgcccaggtagcccaaaaagcacatgaaagcaagggcaaatcgaaggccaaggcatccacaaaggcacatttggttccaatcaacaacaccccagtagtagatgccatggcaaccctttccatcaccactccacttgacatccccgctcctgccatagtcgtagcgagcaaagaaaatgtcatataggagaagagtttgcaaagatggaggcttccccagactccgtcttagtccttgatacaataatgtcatataggagaagagtttgcaaagatggaggcttcgccagactccgtcttagtccttatacaattatcttatcttggttgcattatgaacttctttgaataatggatatttaacctctatgagagcataacatttattttgtgattcgccatgcatggctagactttatttccaatattatgttgcattttgctatatgataaagttttacttcttgccttgaagtagtgatgttttactttattcacatagacaatatgcatagcccaaggtgaagaggagcattgtggaacaaaagcaccacaaagtgtaatcttgagagacatgtgacaagttcagtctatgcaaagacgtgaactaccttcacaaccgcacgtaatgattgtaaaggttattgtttttcccgtagaaaagtgattacacctcaaatatcttgggaatggcaaactctcgcaccaaaggtcccttgtaggaattagaagatgagagaagcatactcatcacctaagcacgcgagatcaatgtcctcactaagaaatgtaggctaaagtagactatttcatagtcagtttttcttagaatttagtatcttgcaaatgaacatagcacaaacaatctcacatcatctgtcgtatcgcaacaatgagatatttgtcgcacgcactgccttagcgcctcgcgccagacttgcgccaggcactggcatgcatcatacagcatcatgacgcccactaaggcagctactagcaaccccgctgtactgggggactggacgaatcatgccgcgttagcacgcgccatgcaactcctaccatgcaccatagttgcaccggctgcatatctcgtggtcactctggtcgcgcatgccattgaacatcgaatgcgtgtcaaacgccaaccaccacatgaattccgacgtaccttaaaaggtatatcggaacaaattcgtgcataccacatgaattcgcatgcatatttagtcctttaatggatcatccaatgcatactgcgcttatgaaaaagctgtaattgtgtctaattgacactacgctcttgccaaatcgatcctgcaagatcacgcatgttggcatcagcacattaagaaaagcactaagtaccggacgtccacaagaataggactaaaaatgtccactgcaccattattgaaattcccgccacttcaatggactcttagctccaaaggcaatgaattatcaatatccagactattcaaaatgtgttgtccacttaaaagaatactagtgttgactcgacacatgtgcatatcccacaaccataaggtctccctccgaaaaaaattgaaagtttttaacagaggtatgaacgtagcttaaattccttgacaataagaaggattatttccagtcatttagggggacagaaataacccttaaatgataaatgtcaggaaaaatggtcaaagaaaggatggatgcacatttaatcaagcactagcaaatgcaaagtatgaaaagcacactttgtaattggataactgcctatcagttttgtgatttgcagagcatgactaagttgcattacctgaatataatgcaccggaggagggtgaaataccgaggaatgcaaaggtatacctcatattgtccagaggcctagagaagaataatgggacaagaactccggctccttaaatccctagagtaacaggagacgtctggtgaaaacggaacaaaaaggaactctcaagctcatagtcactaaaaataaccccagaatttgaagggagcgagttcaaagctggcaaatggtatggaaccccagaacaagcataccacatcttcctatcaaggaagaaaaccagcagttggagtgcacaccaacgtcggtaaaatgaaagagtcatgcccatatcaaagaatagaagcataagagaattgcatatccccatatatccatggatactcacataagtgtcacatacaaccaataagaattggtaatgagacctgctatgggcaatattctcttcatacagcaaatcattggcagttaacctggagttgaaaatcaactaaaagatcaaaccgcaaagctgacctatagttgacaatgaatggctagagaaattttggattgggcacccgcatacaagcattaaaaatccgaaaccaagttgatgatccgaatatcatcacataaagaaagaaagctcactctttccgaacgagtttgagataaaatagatagaaacctatgttgcttaggctcgtaaacatacaacacatgaagaagtgaaccatagtatatcagaatgtgaaaatacataggttccatgcatatagttcaccatttctagcaagtaacatggttcgaactttatccaaaccccaaatccattatcaagaagataatgatatgtgcgtcgcacaacactaatagactatacgaactatataagtcatggaaaatcatgcaagatttgaccattggagcatcactcgaactatcttttgaaaaggatacaagcaatgagttttgacggttcacacttaaaagagatgcaaaattcaaggggagaattttgccagtctattaacaaaagcttgaaactaaagaatttagtacccaaaaatcgattaagaaaatcgataaaagaatttgggtagattgtactctttttttttccttggataaattttcctgcagtttcttatcaaggtttttaatgaggcaatctgtgcgacatagatacgtatgccatgtactctttctccaatttttcccactgggtttttatggagttttgacgaggcatggacattacgcggtgagtgctcaagggggagtgttgagaaacttttgggcttggcccatgaaggcctagcctaaatacacttattggccccatcaccgaacctttcatatattagattgcactatataaagagaggagggggctactcattgtacaattgattggaggattgaatagtaaagagagtctcacccctaaaatttgtgtttccactttttgtagaattactggaccctcttgtactgctttgtgtagcatgagagttgcgtaataggacaaagtttatttccgattggttacttgcaagtctgtgaggaaatatagaaaccatcgcaaaatctcatgttctcaacatagttatgtagtgagtttttacttggaattgaagtttgacgatacgactcgaggaactaccgtggcatctcgacaagggtagagggatttgatagctttcgtgggagaaaagaacacaggaagaagaaaacggagttggcaagaggattcggttttctcttatcgcataaactcccaacaaccacagcttctcttataccatgcacacgcacactgatgccactgccagtccagcatggcacatcaaacacacactctcacggcccaaagacatggcccgactaaacatttaacaaggcccaatgtcatggcccagctgaacccataaactcacatataagtcaagtacttcatacaccaaaccgatacaggagtcatgacaattctcccccacttaagaatcggcttgtcttcaagccagtgcatctggaaaacgcttttgaagttgtcgcagatctttccaggtcgccaactacgctgacattcctctctagtgtaccagcccttgatggatcagcgacttgcctctcttgatcaaccgtcgttggagcacctcttcaggaagcacttctgttgttgcatcaatacaggggttaggaagtttaggactcaccactatacctgctttgaccgccttttcagaagtgatacatggaccattgcatgaatctggctattcgggggtaattcgaatttataagccattgctccaatcctgtctatcaccttataaggcccaaaaatacctgaaacttagcttatgacaagtgcgtcgagccacagacatctgcacatagggttgcaatttcaaataaaccatgtctcccacttcaaatttcatgttagttctgtgtttatttgcttgatgagtcattctttgctgtgcacgaagcaactggtgatgcagcatttcattgtacaaagttctgtcttgcaaccaagactgcacatctagtgcaatactctatcctaggtccaaggtccacttcaccaaaatgtgttggcttccttgcaaacaacacttcatagggagatttgcccaaagcagtatggaaagccgtgttataccaatgttgtgcctgggtaaccattgtgaccactttgttgggaaagcatgtactgcatatttaaggaaagcctctacacattgattcagcctctcagtttgtccatctgttaagagggtggtaagaagagctcatattcagctctcttccatttccccaaagtgaccctttcgtgggagagaagaagaacagaggaagaagaagacaaagttggcaggaggattcagttttctcttatcgcataaactcccaaccatgggttctcctcttataccacacacacgcacacggataccaccgctagtctagcacgacacatcaaacacatactctcacagcccaaagacatggcccaactaaacatttaacaaggcccaaagtaatggcccagctgaccccataaacccaaaccgaatttgctatatatttgtcgacaaattttcctccaaaaatttgacagatgtaattacagtataatcgtagtgtaattacactgtaacttgtatgtaattatactgtaactcgcatgtaacttgtatgtaactttcaaaaatctctccgtaacatgttatttcggtaaaatggaggtcgtgggaataaatcctttcacatgtgtgtgctgtgatttttttttcttcctcaccggaacaaatcttgtaatagatctaacgattcaaaattacatgaaacttacatacaagttacactgtagttacatgcaagttatagtgtaattacatacaagttacagtgtaattacaatacggttgtactacattctgtcaaatttttaggagaaaatttgtcgacaaatgtacaggtagtcccaacttatcagacaccacacccgtacaggagtcatgacatttgataagtagatggaacaagatagctagatttcagcacacatgctacagaaacacggaataagtaatttatcctacaagaataccgctaagataattttcagggatcgccaacggtctgcattctgaagatcagcagattagttgataatctactgaatcaactggtttctattcacagactcacagtgctagttgctgtggttgccacattttgttccttcttattctccagaaggacctgtgcttgtttcacttgagaaccgagaatgcttactggattcattgcgctctggtcgctgctagagaacatcatgaacgcttccagttcaaacatctctttggaagccttggacagagattccatcaagctctccagctctgctttggggtagtttccttcgagatttatcagtgatatgatcatcctactggcaatcttcagtattctcaggcaattggctgttggttcactgttttcttctaccaacttcttgagcttcccggcaaagctagatgcagaatctcctgttgcaattgcattagcaagttgagccaaatctgtatcattactgatcaatttttcaaatattgccgcactaagtgacagtaaagctgcatgtagtttcctgtccacgattttcttgttgtcgtccttttgctcattgacgttgccactatctttcgtagcaacggcaccttcgcctatttcaggatcttgtgtcacaaacttggttgcgtctgttcctttttctgtatgcttttctccttgcttcaatggaggagagggaagtatttctttgagcatctgcagtggtagaaattatgcttattaattagtaggtgatgataaagacccaaggtgcgcgtggttagttaaataagtatgaaacaaatgaaatgccttcatttgtttgaaattttatcacacaccgtacctttggcagcacatctttcatggcttccgtcagtttcttgagattgtcatcctcctttgtgtaacaaatgtatagatgcttgaggatttccgccgcacttattctgtatccgctcttggtgcgaacgtcgaggagcgttgtcttgagatcatcgacaacggtgtcactcgccttgaagatgatggcggcgttgctttcgctttggtcgacggaaagcattgccagtgcttcacctgccaattgtctcgtggaggcgtccttgttttctttagtgaagaagatgtcgaccagcagcttggtgattttctccttgctatcggctgtcgaagtcgaaggtgcttccatgggaagctgcgtgaggatcttgatggccaggacgtgtagcttctcgttgcattcgtcgcacccgaggatcttctcgacggtgttgatggcgcgcttgttggaacgcagcttgtcgccggccttcccagggagggcgacaaggcggaacaggagctgcagcgacgcggctacgatgtcggaccacgcgtcgtggccgatgttgtggaggaggtcggcggtgacgggcaccatggccttggagacgaggccctggttgctgccgatggcgctgcagttgtgctcgtcggcggcggcgagcttgtggaggatgtctcggcccagcaccatgagctccttgtagtgacccgacggggcactgtcgccgtcttgctgcttggtggtggtggtggtggtggtggtgtcgagcagcgacgagatgcaccggagcccttgcgggaagctggcgaggctgatctcgccggcgagttgcgccacgatcctggcggcgagcacccggacgtcccggtcgagcgggcttgtggagcgaagcgactgcagaagcctctccaagacctggctagccgacgcggagccgaccagcttcctgatcagcgcgtgctgcccctgcagctcctcctgcgcgaggatcttgtccaggatcctcgcaccggagacgtagtcggcggacgacgactcggacttcatcagctccacggcaaacgtcaccaggttcctctccttgacgaatgatggatccttctcgcaaccgatcttggtcttgcgcatgtaatccctcaccgactcgcgcccctcttcgtcttccttgtcgaacccgtagtcgtcggcgactactcgggccagccgtttcccggcgaagtaggaggctgactggtagcagaagagcacgccctggaagagcgccagtgagtagagcacattgagcgccggggtcaggttagcgccgccgtcctcgccgccgtagtcccgctctatgaggcgccacatggagaggccggtgctgacgagaaggccgaacaggtagagcaacgccagtgggagcagtatgatggcgatcaccagcgcctggaggagcaacacaagaatccccaccagtgcacgccagtactggtccgagtcgtcgtcgtcgtcctctttcctgaacaccatggctacagtaaccaagaggccatcgaacgatttccaagcgtaccgcagcttttcgttcaggaaaacatcgaacaccctgtaaatttagttagatagaggcgccgttagacctggacaagggagatacgacgaaatgggtcggagtgtactggaaatgtttctactttttaggaacttgaaacccataggaaaatgctcgatccgtcctaaaatatggctagattagatatgtagattcatagttgaagcaatagttatattcagtctagattcatagctgaagatagctatattttaagatagaggagtgtttgcaatttcggaacaagtagatacggtcaaaattttcaggataaaaaaatagctataagttaagggactgtctatataggatttgatggattttttccgataagttaagccccccaaaaaagaaccaaacactaatcccactacctcaattccgtctgtggcgcccaaaacactccttgcgacctgaactttccaagcaatggtgatgctacccttactagcggcgacgatgggtcaactactcctggagttggcggcgacggtgccaaaaaccctttctatggcttggactccctaggaggcggcgctcctcctgctagcagtatagttggctaaaagacccgttgcccgatggaccgggccacagcatggagatttagcccagcccaaccattgacgatgcctggtcctctttctcggcacaatgagttggcccggcccggcaagacccaataataagcaggcccaaagagatgagggaggtaaatagacatattccaaggacgagtacagtggactggtcgtgccttctggccgacatggcacggcacggcccaagtgttattgggttgtgcctgcattgaaggtgcagcccatagatgcgcacggcacgatatggctagttggtcctactctcgagccgtgccttggtcgtgcccaggctggaccgtaccgaatggcccatttagccatttataactggcggcgacaacagctcagctgctcctggagtcggtgactcagcgtcaggttcttgaggcagcagcagtcatgatttgctccttcatcctccatccttcctttttcactatcttgatatgtctctccgcctctatgggatttgtccctcagcacttcttctgttcttatagtagtgcgcacactgatttggggtcatggaagaagaagatcctgcatatgttggcagggggagacgcatggggtcatggtggtcctggatcgtcagccgcctgcacagctattgtaactgatttgggcaacaatgatggtagcggggtgggaggaaggggatcagcagcaacaactgttggaagaagaacggagagtgccagtcctaaatggatatgagatgtgtgcaatttatcaatttagcgtgatgtaactgctaaataattcagctgcaataagctcatttttttttctggaaatcatgcattatccgataagaaattaagatttgcgtggactaattattttatcccagaaatttccagaactttgaaattttgattgcattttgttttttgtaacaaaatttcatatttgaattcaaaatattcatacgaataatatccaaatttttgggttttttccgaccccccacgacaacaaaaaaacatttcaaaattgcataccctgcaagggagtacaaaagacgaccttaaaattgaaaactttagccaaagtatagttcagtgaattatacaaattgaatacatattatttattacggtacataataaacatcaaatattaatgctaaaagagtaaatgtcgtactcaagcaatcaattgacctcaaatctatctatctattatattatattattaaaataagaaggcatcatgttcgctgtgtaggctagaaattcctgaattaattgaaaaaaaaagaaaaaggatagtctatatagaaatacaattgagaaatcactgaaattcggaataaaaataagcaatattgcaaaagagttcatataagaacccaatacaaaattaatcgaaattcgaaataaaaaaataaaataaattctgaaattaggaaaagaacaggaagagttcaactagaaatacaatttagaaataattaaaattcggaatacaaaataaggaatattaaattaatagtttagctataacacagcacgagattaaataaattcagagtataaaataaaataaaatacgaaattaaaaaataataagagtctaggtaggaatacaattttgacgtaactgaaatttggaaataagaataaacaatattagaagaatagtacaaataagaatccactacgagattaattaaaattcgaaataaaaaataaaataaaataaattccaaaattaaagaataaaaaggagagttcaaataggaatgcaatttaagaaaaactaaaattggaaataaaaaaaggaatatttttttttgacgtgataaaaaggaatatagaacacaatatgagattaaaataaaataaatttataaattagaaaagtaaaaataactaagattcgtaataacaaataaagaagatatcatagaacacacgatgagattaattaaaataaaaaataaaataaattctaaaaatagagagttcgaataaatgagtagagtggtggtggttgataggacactaaaagatataaacaaaacccaaatagaatgtcactgatgattaagtggagggacgatgggtagaccattaagcatcacggtcacgatggcgggacttatagaaagtaaaaaatataccctaacgataatcatattttatttttaaaatctcatgataaaaaagaggggaggcagcgggtggtccatagaggagtacggtggcaaagccgctgacagtttgataggacttctagaaagtaaaaaatgacctaaatgataattatgtttgtcttttaaaatatcaatcgcaataaagagataagtcggtgggctggtcataaaggagtaaagtggtggcatttgacgagacttctaaaaattataaaacaaaacccaactagacaatgaactctaaaaactacaatgtctaatttttaaacgttccaagaagaatgaatataagcagtcatagatcgcatgcaaataaaggagtgataaaggagtaaggggtagcgactggtgtgacttttaaaaaataaaaaaaattagaaacacgtgaactatttaacaaaatttaagaaaaaatcatatgtaaaaagtagataattttgtatgggtgctagccacgcaattgcgcgggtcacccagtagttctattgaaaagcatcatccttttagtattgggttgaaatgaaatcttcctattggggcaagatgggctttgctttactctagaacttagtggattagaaattatggccccgtgtagtcaggcacctcgcaaatgctacaatattgctagcaaattcctttgcactctatctttccttccaaatgaacatgaacagtactagaaattcctgaagaatgatcttatgaaaatctttgttccgaaagtgtgttttgttagccccttttcagagaaagaaaaattatcattgggagcaataaatggtcagaaaagaaaagaaaaaagtgacgaataggaaatacaacaaatgtatagtagaattaagaagtctaacccagctgtctggacaagggtgataatggtgagactccaaaaatccttcttctcaagcatggagacgaagccaccaaggaggacgacggtggtccataaacctactaggaagcccatccccttgacggccattgacaggtaccccataaacagagcataactgttgataccgtcaacttccttccactcggactgatcaggttcattagccattgtcagttcttcctcaagaaagttgggatcatcgtttgcaaagcagcaagccaatatatatacaagctcctcgagcatatgggatgattaactatcaatacgtagaccaatagccgattaatgaaaaatgttcagatcttgactttacctgcacgaagcgatcgaggtcattgtaaagtatatattgttcatccagcctgttcagttttggaccaagcaattagctaggtctttattatatttatgtattagtagatcaatataaaagacctacaaataaattaaagctagtggcctcacaagttacaatacaatattatgcttctcactgtttgtgtacccacactctagctagattactaatgctgggattattattgtttcttgaatgccgggaaccagacgtaattgatgcacatatgtaacacatggtggactggtcgaggagcgttacatatgtaacaggagctgacaacgatccgctaaactcgcaagagtaaactctagaaaacatcatgaagccttccagttaaaactgtttacaactaaatttgacacctagattcgaattatgaacattgccaaaatttgaaaggcgccgagtttccttcacggggccggtccgaccaccgcctatgggagtccaaaccgattttcatcgggtctcgggtttccttacttggaaaggtatttttcgagtttccattggtttccaccccaaattaaacgtggagaagaacatgtagaagacaagaccaactcctttataatagccaaggtcggttcgacctccctcccccccaaatctcaatccatacataatcgaatcgtttttttacttctacttttagccattttttctactttaccttagttttgtccatctttgtcggtttgcgccgtaaaccgtccgccttcactacgagagtgcgattatctctttgtagatttgtcttataaccttccgttcgcccacgagacgggtggttatcttcaaatcaatctaaatcggccccgaggctaatttgatctctaaatcgcctccactagccggtttaatcttcaaagcccatcttgatttagaattctctagatcgaggtggttggtgactccattaacaccacaaatctttaaatgagtcatggttgggaccgaaaagggtgccaacatgaattggcgactctgctggggaacgtcaagaattttggccataccacggccagaaacaatctactatatttgttgcttacgcatataaattgatcgctcagttgattggatcagatcggcgacatcattctcttaccgccgcgccggtctgaaccagtctaaccgacgttgtaggcccggtctgaccggtgaggtgaccggtctaaccggcagaaagcaccaagataagcagcagcaacattgtttccttttattgctgcacactgttactgagaagaaataggaacagagcggccgattttatttaacatcggttaatttttggtatatttgctacagtaccaaataccctgttacgatcaatcaacaaggctaagtttgataaaattggtccaaatacagtagcataccaagaaaactatagaccgtatattaatctatttggtcaaaatatttcagctataattaatatgatcgaaattcatccacaaacatcttcatcaaccatgacgagtgggaaggagatcgacaagctcaccaaggaggactggaccaaggaggagtggcgagactttgaaaaccaaatggcggcgtgtgagaagacgatgctcgcaagcttcctcaagaccgaccaaggcgtcttcaaaagagacgtgacgtcccgctaccttgttaggagctctattgggccgcatgcagtatggaccatgcattctccagagcaagcccaggctagcccaagcgactgggaacaaaaggatggctgctgctcctacaacaaacattgaacagatcaaacaggcatcggcggcttcagccacggcggcaacggcgtcaaggttctaggctagaacctcgacgatctatcttctctaccgatctcttcctacctccagcttccactgctagttctagaagcttccaaaacttgtattccatagtttcttcttctcttttccccctaaaacaattgttgcttgtatggtggatccttgctattgaattggaagaagtgggttcctaacaatctagtatcagagccgctcggttcgtgggatttctcgtcatgcaggtgttgggaaggcagcagtgcaaggtggaggaagatttgggcaagtgaggtgctcatgaatctagcgcacacaacctgttcgatagaataccaaaccaacataaggtgtttaaggacgatgaaaggatatcagagcccgtttccatcaaatccaccatgaacaaggagggaatatccatggacgaatctttagatcagaatcttgggaagcttgagttgatggaggccaagtgcatgcaagaggagaagttcaatcaaatactacagaagttggaggagatagaggcttgtaggagcaaggctaccgaggtgacgattgctgccatcaggacaaccaccgccatcctcaaggcttcatcatctccaacacccatggcaccacctcctccaacaccgaccaagtgtttgacaaaatgccccaacaacaacttcacttgggtgatggcgaattcaagtcacattggtgaggtgcttgctccaacggctgcctgggagctaggagacaacaaggacaagggccacgccccctgcatcgtcaccaacgactcacccaaggtcacgcccgccaagtgctcgaattgttctagccctgacatcatgctagacctcaccgtggctgtgggggtttcatgtgccactacttctatggcctccatggagttgttggttggcgaggatgaaaccagtgtcatctacattgacaaccctcattgttccatagcgacgcatgccaagtgttcgactttgggcctcgatgtcaatggtagcgccaaccaacctgtggtcgtgttccctaccattacagctatgaatgggcatagcatcattccaactctgcctctgaccattatgaatacgtcagtcatccttgttgtcaaatcaagttgtgctagcgacaattctatcagacttatgactctatgttagccactaatggagtatgctgagaggaatccatggccacctcctccttcgaacaagctaacgggtagcatatgtgagctatggccagaaccatggtcatcgtttgcgtgtaatcgatgcaaagtgtggtacttgttccgattggagagcacactattactgtacgtgaatggagttgagcagtttctaaaggaattgccatgctggccaccgcctcaagaagatgtgattaaatctgagttttatcatggagggaatcaattttggttgaggaattcagcttgtgttatttttttttagataatggattcagttgtgttattgcagagacaaaaatgatatacgtagctactgttgtgaggttcagtttgtgctatatgcagatgggtgctatgaaaccttcaagtgttatacaatggttaaatttcccctactgcacatatgacggattcaagcggaagcttcgaggcttgttcacaaatggagccttgtgcatacattcaagtcagtatgatcctccagatgggctttgtgaataatccggttgctatttagtagaactagaaagaaagcccgcgcaaatgcgcgggcatcttattgattgttttataaaaataatgcttaaagaagttacatctcactatttctatttaaatgttataaaataataagaatatatctcagattaaaaatacactttgatcgagtgacatataaattctcctattgtcaccattacttactatgctttaaaacctaataagtaattaatacactaaattatcctctatttaggtttcatatctcattttttttctaaatccatttataaatattataaaaataccaccacttctattcattaatggagtagcaccattaaagttaaacacgaatactactctagtgggtgaagtcgattgtagccaccaagactttctttctctattgccttgaaacatgagtcccgcatcgatgtagccatgctcctgaagaccagcttggagcataattttaatgtatgattcattatcacatgctcatggagtattatattggtaagtagaaagttgagtactattagcgatggtggcctccactggaactgtaacttagtcatatattccattttatacttacgacaccataataaactttgttgtctaagtttagtgtcctttagggaagaacaaagagaagatggaggtgaccaaagtagttttttaaaaatgttttgagtagatttgtggtgcagtgtaaacacaatttctttatggtgttgatcattactactcattttttttatgaaaagatagaatactctcttttgaaaatggccgagtttaataattcgatgatgttttttaaaaaatatagctaatgagacatatcaccacgatagtatccagatcatcatgttattatctatgttttgacaaatatgtatagtcaaatagttctaaaaatataaaaatactttcagaatcttaatctcaaacaaattgtaatttaatcagacctactcgaaaaacacaactaaattgtgttgcttttattttttacatatgcagatttaaattaatgttgtatatttgtgaagtgaaatttccctccgtaaaatatgatgtgatttttttgaaaaattatcatacatatgtcagcctcatgtgccgtggtgtatttaggaccataatataacttttataatttaattaaagaaatataacatgatcacaaattggatatataatttcaaaataatttagaagatggtttaaaaaacatttattgagtattctatgtttttattatagatcttagtttaactatatatatttatattatatttgtgaagtaatatatttcatgtttatattgtggaaaataaccgtccatttttatatatctactagcaaaatgcccgtgcttcgctacgggtaaaggaacggttaaattatatgaagtacatcgttaacatgtatataataatgttccaatataggtaaattgttcattgcgctaatgataatcaagatggataaaaatattcatgtttagctcacatcgcgaaagaaaaaattaaattaaaaaatattaaattctaatttaatgaaatataatttttttgcaatattaattacactctttgaaattatagcaaaagtgctcgtgcattgcaaccggaagtgtatagaccagaaaattgaggaaaagttaagaaaaatctacactatgtaattaattaaaatacaaatttgctgaaatatttaatattttaagtaggtaggtgtaaaactaaattaatttacaagtaaagtaagtgtgagaaataaaatgacatggttaaatttaattttattaaattctccatgattagttatgctctttggaattttatttaaattttcagagcttaattgctaattttaataatacaaacatcatttaacaattatttaattggaaaaagaataaaaatcctcccttttaggtttgggcataatatgaaaaagtttatattacctccctttgcctatcatatgtatctggactattctttctccgttgaagttcattttacgtcctcatgcaatcacgcagtccgttcggcggccca

SEQ ID NO: 71128 - DNA, 26909 bp, Oryza sativa
cggctggcctttatgctgccgttgttgggcgtctacgtcttcaccgaccggccgcctcgtccgccgccgactggtgcttccgcctgcacggctggcctattatgccgccgttgttgggcgtctatgtcttcaccgaccgacttgccttcgccgccgccgactggtgtttccgcctgcacggctggtctattatgccgccgttgttgggcgtctacgtcttcaccgaccggcttgccttcgccgctgctgactagtgtttccgcctgcacggctggcctttatgccgccgttgttgggcgtctacgtcttcaccgaccggcttgccttcgccgccgccgactggtgtttccgcctgcacggctggcctattatgccgccgttgttgggcgtctacgtcttcaccgaccggcttgccttcgccgctgccgactggtgtttccgcctgcacggctggcctattatgccgccgttgttgggcgtctacgtcttcaccgaccggcttgccttcgccgctgccgactggtgtttccgcctgcacggctggcctttatgtcgccgttgttgggcgtctacgtcttcaccgaccggccgcctcgtccgccgccgactggtgcttccgcctgcacggctggcctattatgccaccgttgatgggcgtctgcgtcttcaccgaccggccgcctcatccgccgccgactggtgtcaccgcctacacggctggcctattatgccgctgttgttgggcacctacatcttcatcgctggtcgtctcgtctgctgctgactagtgcccttacctctacgtctggtttatacagctaccactactgatggacatcatcgtcttccgttgccgactggttatgccgccgccaactagtgcttttatcttcacaactgcgcgtcttcgctaccagtttgcttctgttgccgccgactcgtgttcacttcatcacggcaacacaactttgtcaacatggtggagcgacttcatctttattatcttcggtaccagcaaactctattgctgctacttcacaagttttgttacatcaccaaccatgacgttgttgtgaatctcgacatctcggcatgcgatgccgtgttattttactacaacaagtggctctccaacattcatgatttctacttggacatcttcaacacatatcttcaatcaagcaataactattcgacgacaagatgctacagttctcgactctatgttcagttgtttcccaactaatcaaagagtcgggggctacacaaatacaaggctcaaaatttgacaaattttatgtcaagctgaagaaatcaattcatcaacccacgagtcaactccagaagtcattatcttcatctttgcttcggagcagacattctacttcaacaacttcaaatatttcggtttagacgagttgggcaacaacatcaactctcctccaagtgaagcatctacaacagttataacattaatttgatggattattgtcactgacatcatcaccagcacctctgcttcatcgaccctgacatctctgctgttgctaatggatgattatgtttttgccgacttattatttcaccttcacggttgacctactatgcaaatgctgatgagcgtctttgtcattatcattggttgctacactgctgttggctggatcaccgacatcgtcatcttcatcatgtcggttgcgtttgtcgtcgtcaagtattttcttcatcttcatgattggtggatttcgtcatcgcctttgatttgcctcgtctgtcaccgactgattatttcgctgccatagctacacaactttattgctgagcgccttcatattcattgctggctgactgctgccgactggtttcttcgcctccacggctgtgcaacttcatcacttttgattggtatcactatcttcactaccaccaatatttttgccacctctgctgggcaatattatctctgtattggtcgtcttgtctctatgccagttgcgtcagctaccatcaatgaacaattgtgactacgtgctcaggggcttactagttcaaacacaagtatcataccttcaatttggacttgctctggatacatgcaatatgaattcatgatcatgggtctattttctatgtttaaagactggactatttattattccccataagggttacaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttactcgactttttaggagttggtatagcgatagggttttgagttatcggctatatgtccaatgtagagtctaacactcgatgtaaataatgatataaaggcactgatcgatataaaggcaatgatatgatagaataagcactgatccgaaggttaaagcatacatcggctggaggtccgatgtcataaaatccacaattttagataaacagtgaaacctttgttgcgatcggctaagtccaacttatatgtatatgcaatccttacaagccaatgcaacgtccatataacttatcggctagcaccccgataaaacattagcatgaacctatcggcttaacaagacatatatattatcaacaacaatctagtagatcgaacctaaccgatgcagcatgacatcggatcccataagatataatagaaactctatcccctccaagtaagactttagaaatcactcgactcataggaatattttccataatttgtaacggattcctccaacgcatacggaaatcccgagctaattctttttctcttgaaatcacttgactcgatctccttttctttttctcttttggaatcccgagctaattcatttggaaatcgtcggattcgatgccgatttggtttgcttctctttccaaaaccctagagctttcctaatccaccggtgcctccatgggcttagctggcgccctccgccgctataaaaagcacccccctagttgtcctctacccatcccctcaagtcccgtccgccgacgagacccgtagcaccctagccgcgctagctcgtgcgccgccgtcgtcgaagggagtacggtcgtgccgtgccgccgctatagtctccaccatcgctcgaggttgccttcgtcgggttcgcaaggttgccgccgtccccatcccgcccttcgtttccgccgcagacagctagagtgccgccaccaccgtcgacccgaagaccaccgccgtctcgacctcgccgccattgtcgatcgtcaccgtccgtcgtcgttcgagccatcggtgagttggccacgtcacgctctacacgttgatgccctccgtttgcgccaccgcgccgtcgttcgccggctagcatgaggtgccgagccgacgccggtgatgacgtcatcgtaatgtcatttgtagaccgtggtagaccggaacgatctcggccgtccgatttggtcaagtttaggtcaattagatctcggccgtcggtttcgtggaccgcttctgtgaacccggtttagcatggaccgtccttgatgacgcagtaaatctcttttccttttcaaaagtaattctttattgtgtcataattcaattaaaatctttataaatgctttaactcgatttaaacttcaaaaattcgtaactaattcattgtaactcggtttaatgtggttcaagttgcaaaagttgtataaaatgaagatctatatattaaaattatccattatttgtgttaaattcatttaatcctttttaaataggcttcaattatattaaatcttgtaaaattcataactaattcgtacgaagtcggaatgaggccgttcaagtctcataatttatctaaaattatgatctacatgtttgtttactttactagcaaaagtgtccgtgcattgcactgggtgattatggagtgtgtatatcaaccaaaagtgttgtttggtttagcaaaagtgcccgtgcgtagcaatgggaagtgtacagatcagaaaaatatgcaattaattaaaatacaaattctctgaatatttgatatttttaagtaggtatgtatataattaaataaatttacaagtaaagcaattgtgagaaataaaatgacatggttaaatttaattttattaaattcttcatgattagttttgctctttgaaattttattggaattttcagagcttaattgctaactttaataatacaaacatcatttaacaattatttaattggaaatctaatttaagttcttgttgggccggccgacctacgtgcggccaatgaggcgtgcgcggcccagcattgatgcggcccgatgatggagaccggcccgacgcgggagtgatcaaagccgttcgttttgatggacggctcatatcggctcctaatctatcaaaaccctcaacccaaataaaccctaaccctaatttcattcttccccttcctcccctccacgcaggtcgcctttctccccgccgccggccgcgccacacccccaccggcgcacctctccgcgcccctccccaaccggcgacgcctctcaacgcccctcccccaccgccgacacctcttgcccccctccccaccggcggtggctttacctaccgagcagcggcgacggcacccttctcccccacaagcggacagcggcggcgcccttcctcccgcgagcggcgacgatggcggcagcggcgccctgccctcccacgagcggcagcggcggcacactccctcgcggcaggcggctgcggcgacgcggcgatggtgacgccgctccctccccccaccgccggctccttctctcctcgtcgggtggtggccgctgcaccactctctcggtagatccgccggtggtgtcgacggcggcggtagccgcgggtggaaccggatgtggtggtggcggtcgcgggccggcggcagctccctcctcccctctcgcctccctcttgcccctgatccggcggcgatggcggtgttggcggcgtcggcgggtgggtccgtggccgacggcgaggtggcgaggagcagtgcgctgcagcctccggtccggctcgcccctccctctcctcgtcatctcgtgttaatatgatgttttctaatgattccgatttagatttggactgggattttgtgtttgatttggatttggattgtgatgatttgagatttggagagaaggtgtgctcaatgtgggattctatttgtgtgatgatggaattccgactgggatttttgagggaggggagggacgaaaaatcaccgtacggatgtggtgacgaaaggaaaaatccgaatatttatattagttatagatatgtacttttcatttggtttttattagtcttttttctcgttttgcgtgttagcttgtcctttccgtcttttcggaggttcgcgagtgtgtcggaagtattccagaaaactaattgaagaccgattattgcaaggaaagtcacacagatcccaaacacaattcatttgagcatgttgatcctatatttaaattctctatttaattaaatcgtgcatttattttcgaatgtcaccgggtggtgtgaacctattcctttgttatggccaatttgcaatgattaccctatttcttgattacctcgggttataatttgactagtcggatttatatatcggttcaactagatgtattagatataattggttagccatgcttagaaacattagcacacaattgggataactaatgtttcactattacttaatgatggatatttaatgatagctcacgatggttaattgtgattggttaattaattaattcgctaactaaaacttgataatggtgggttgtgagcacgtggttttgatggtcgtgctcatgacaattaaggaccggttcacgagtttcggttgtgaaacattaaccgtgccaaccacaagccagcatgggtaacggctttaccttttgtatagcatggttcattgcggggcaccagactgagaagtggcggagataagcccacgggggtcgctggggagtccatgccttgttttataagggggtgattatgatccaggaacggtgcactgtgggggattgtgttatgcgaggggtactgtcacagctcctttccgaggtaccgtggtggtattaaggcgcatggtgacatgtcgtggggctatgtcttgtgggtacagtggtacatctttggccatagtaaaactattcgaatagccgtgcccgcggttatgggtgggtctaacaatgtatttcgtgattagtatcacacttctcaccataataaatgatgctataactggtaataatttgattagctcttggtttggaatggtacattcctagtttggagatagatctgtacagccgggtatggttgttcaggtttggttgggcctgtgcagcatgggtatgctgttcagtgttgattaatatcgatgattaattactttattgctttacaattctcaaatgtttgctaaatgctccttctgcaaatgagccctatattatgccattctttggtatccttgtgcacttgtgtacatgttgtgtggcttgcggagtattccatgtactcaccttggaataatcaatcaaacctcagttgaagacaagttacaaaggagaaaacatttgacttataccccagttgagctgtctgtgggagtggagctgaaacttcgctagattttatttttctgctacagttttcttcgtggtgaggactaggtacctcttatgtaagtatttattgctttagttcttatgatgaatttgtatattaaattgtcagtttgtatacctcggctgatttctggacaatgattttattcacaaattagttcggaaattactagtgattttctggtcgtgacagaccgccaccgcgccgcaagccgccgcgagccacggtcggtcgcgccccgtacggtgccgctgcacgctgccgcgggccgattgtgcccccgcacggcgccgtcgcaccgctcgccggccgcgcccccgcacggcgtcatcgcacgccgctcatgcgtgccgcgcccgcatagccgccgcgcagcgccgagccgtcccctgccgcgccatcaccgcacacgcacgcctggccgccacaccgcagctgcgctgcccgcacggccgcagcgtgccgccgcgtctcgccggcgtccgcgcctcgccccgcatgtccaccgcatgccgccggccgagccgtgctcgcgcaccgcccgtgccccgcatggacaccgctgccacgcatggctgccgaccgggcgcaccattcacgggaagaagaatagaaagagaagaaagatggaaagagattggcgattttgcaaaagggcccctgaattgtctgaaaattatgcgcatatctctcggcatggaaattccttgcgcgtagactctggaatttcagaaatttccattttcatccctccaccgcatggaaacttagtaaagggccccctgtacttgcatatttcgcctgcatttcttatttaagcattttgtttatgtcatataaatttttaatttgaatttcacgaggcattaattaatgttaattggtattttgaattttcattttcagtatttatatgaatacatgcaacttttgccccccttttatgaatatttgtatgaatttgtatgaactctagtatttctttattgaaaattgcatttactttgaattacctgcgtttctttgtataattagcatttcctttgcataagaaatattggaaaaatcatgaaatatttgtattcatatttgcaaccatgataatagcaagtaacacttgaatgctttgtcgtctttgtaacagaatgttagtaatcacgaacaaggagttcgctgaactggccccgtatgaccagaactacctgacctgggcatccaatgtccagattgtccttggggccaaaaagctcctcaagacatttgggatgggcacagtacaagaacctatgccgacacctgatgagaacgatcaggcgatgtacttcctgcgacaccacctttgtgccacactcaagaatgaacacatggcaacgaagggtctgctcactctttggaccacactaaaggagtggttcgagaagcggaaaaacaccaccttgccccaagcagagcaagagtgggcacacttgaggtttgccaactatataaaagcgttaccgaatacaactccgccttgcatcagatatgtatcaacctctccctgagtggcaaagtagtcacggacaaggagaagattgagaaaacgctctccaccttccacctcagcgctatgcatagcactcgtaaccacaggcggatgacatgcaagaagtatgatgagataatcaacatcacgcagatgtttgagtcccatgacaaggttctttgcaagaacttcatttcccatccatccaacaaaagtattgaccttaaggtcgatactagcagttacaagaatcacaagcccatctaaaagaagaggggcaagcaaggtgggaagaaagcacctaagaatatgcatgaaggaactccagatgcccaggtagcccaaaaagcacatgaaagcaagggcaaatcgaaggccaaggcatccacaaaggcacatttggttccaatcaacaacaccccagtagtagatgccatggcaaccctttccatcaccactccacttgacatccccgctcctgccatagtcgtagcgagcaaagaaaatgtcatataggagaagagtttgcaaagatggaggcttccccagactccgtcttagtccttgatacaataatgtcatataggagaagagtttgcaaagatggaggcttcgccagactccgtcttagtccttatacaattatcttatcttggttgcattatgaacttctttgaataatggatatttaacctctatgagagcataacatttattttgtgattcgccatgcatggctagactttatttccaatattatgttgcattttgctatatgataaagttttacttcttgccttgaagtagtgatgttttactttattcacatagacaatatgcatagcccaaggtgaagaggagcattgtggaacaaaagcaccacaaagtgtaatcttgagagacatgtgacaagttcagtctatgcaaagacgtgaactaccttcacaaccgcacgtaatgattgtaaaggttattgtttttcccgtagaaaagtgattacacctcaaatatcttgggaatggcaaactctcgcaccaaaggtcccttgtaggaattagaagatgagagaagcatactcatcacctaagcacgcgagatcaatgtcctcactaagaaatgtaggctaaagtagactatttcatagtcagtttttcttagaatttagtatcttgcaaatgaacatagcacaaacaatctcacatcatctgtcgtatcgcaacaatgagatatttgtcgcacgcactgccttagcgcctcgcgccagacttgcgccaggcactggcatgcatcatacagcatcatgacgcccactaaggcagctactagcaaccccgctgtactgggggactggacgaatcatgccgcgttagcacgcgccatgcaactcctaccatgcaccatagttgcaccggctgcatatctcgtggtcactctggtcgcgcatgccattgaacatcgaatgcgtgtcaaacgccaaccaccacatgaattccgacgtaccttaaaaggtatatcggaacaaattcgtgcataccacatgaattcgcatgcatatttagtcctttaatggatcatccaatgcatactgcgcttatgaaaaagctgtaattgtgtctaattgacactacgctcttgccaaatcgatcctgcaagatcacgcatgttggcatcagcacattaagaaaagcactaagtaccggacgtccacaagaataggactaaaaatgtccactgcaccattattgaaattcccgccacttcaatggactcttagctccaaaggcaatgaattatcaatatccagactattcaaaatgtgttgtccacttaaaagaatactagtgttgactcgacacatgtgcatatcccacaaccataaggtctccctccgaaaaaaattgaaagtttttaacagaggtatgaacgtagcttaaattccttgacaataagaaggattatttccagtcatttagggggacagaaataacccttaaatgataaatgtcaggaaaaatggtcaaagaaaggatggatgcacatttaatcaagcactagcaaatgcaaagtatgaaaagcacactttgtaattggataactgcctatcagttttgtgatttgcagagcatgactaagttgcattacctgaatataatgcaccggaggagggtgaaataccgaggaatgcaaaggtatacctcatattgtccagaggcctagagaagaataatgggacaagaactccggctccttaaatccctagagtaacaggagacgtctggtgaaaacggaacaaaaaggaactctcaagctcatagtcactaaaaataaccccagaatttgaagggagcgagttcaaagctggcaaatggtatggaaccccagaacaagcataccacatcttcctatcaaggaagaaaaccagcagttggagtgcacaccaacgtcggtaaaatgaaagagtcatgcccatatcaaagaatagaagcataagagaattgcatatccccatatatccatggatactcacataagtgtcacatacaaccaataagaattggtaatgagacctgctatgggcaatattctcttcatacagcaaatcattggcagttaacctggagttgaaaatcaactaaaagatcaaaccgcaaagctgacctatagttgacaatgaatggctagagaaattttggattgggcacccgcatacaagcattaaaaatccgaaaccaagttgatgatccgaatatcatcacataaagaaagaaagctcactctttccgaacgagtttgagataaaatagatagaaacctatgttgcttaggctcgtaaacatacaacacatgaagaagtgaaccatagtatatcagaatgtgaaaatacataggttccatgcatatagttcaccatttctagcaagtaacatggttcgaactttatccaaaccccaaatccattatcaagaagataatgatatgtgcgtcgcacaacactaatagactatacgaactatataagtcatggaaaatcatgcaagatttgaccattggagcatcactcgaactatcttttgaaaaggatacaagcaatgagttttgacggttcacacttaaaagagatgcaaaattcaaggggagaattttgccagtctattaacaaaagcttgaaactaaagaatttagtacccaaaaatcgattaagaaaatcgataaaagaatttgggtagattgtactctttttttttccttggataaattttcctgcagtttcttatcaaggtttttaatgaggcaatctgtgcgacatagatacgtatgccatgtactctttctccaatttttcccactgggtttttatggagttttgacgaggcatggacattacgcggtgagtgctcaagggggagtgttgagaaacttttgggcttggcccatgaaggcctagcctaaatacacttattggccccatcaccgaacctttcatatattagattgcactatataaagagaggagggggctactcattgtacaattgattggaggattgaatagtaaagagagtctcacccctaaaatttgtgtttccactttttgtagaattactggaccctcttgtactgctttgtgtagcatgagagttgcgtaataggacaaagtttatttccgattggttacttgcaagtctgtgaggaaatatagaaaccatcgcaaaatctcatgttctcaacatagttatgtagtgagtttttacttggaattgaagtttgacgatacgactcgaggaactaccgtggcatctcgacaagggtagagggatttgatagctttcgtgggagaaaagaacacaggaagaagaaaacggagttggcaagaggattcggttttctcttatcgcataaactcccaacaaccacagcttctcttataccatgcacacgcacactgatgccactgccagtccagcatggcacatcaaacacacactctcacggcccaaagacatggcccgactaaacatttaacaaggcccaatgtcatggcccagctgaacccataaactcacatataagtcaagtacttcatacaccaaaccgatacaggagtcatgacaattctcccccacttaagaatcggcttgtcttcaagccagtgcatctggaaaacgcttttgaagttgtcgcagatctttccaggtcgccaactacgctgacattcctctctagtgtaccagcccttgatggatcagcgacttgcctctcttgatcaaccgtcgttggagcacctcttcaggaagcacttctgttgttgcatcaatacaggggttaggaagtttaggactcaccactatacctgctttgaccgccttttcagaagtgatacatggaccattgcatgaatctggctattcgggggtaattcgaatttataagccattgctccaatcctgtctatcaccttataaggcccaaaaatacctgaaacttagcttatgacaagtgcgtcgagccacagacatctgcacatagggttgcaatttcaaataaaccatgtctcccacttcaaatttcatgttagttctgtgtttatttgcttgatgagtcattctttgctgtgcacgaagcaactggtgatgcagcatttcattgtacaaagttctgtcttgcaaccaagactgcacatctagtgcaatactctatcctaggtccaaggtccacttcaccaaaatgtgttggcttccttgcaaacaacacttcatagggagatttgcccaaagcagtatggaaagccgtgttataccaatgttgtgcctgggtaaccattgtgaccactttgttgggaaagcatgtactgcatatttaaggaaagcctctacacattgattcagcctctcagtttgtccatctgttaagagggtggtaagaagagctcatattcagctctcttccatttccccaaagtgaccctttcgtgggagagaagaagaacagaggaagaagaagacaaagttggcaggaggattcagttttctcttatcgcataaactcccaaccatgggttctcctcttataccacacacacgcacacggataccaccgctagtctagcacgacacatcaaacacatactctcacagcccaaagacatggcccaactaaacatttaacaaggcccaaagtaatggcccagctgaccccataaacccaaaccgaatttgctatatatttgtcgacaaattttcctccaaaaatttgacagatgtaattacagtataatcgtagtgtaattacactgtaacttgtatgtaattatactgtaactcgcatgtaacttgtatgtaactttcaaaaatctctccgtaacatgttatttcggtaaaatggaggtcgtgggaataaatcctttcacatgtgtgtgctgtgatttttttttcttcctcaccggaacaaatcttgtaatagatctaacgattcaaaattacatgaaacttacatacaagttacactgtagttacatgcaagttatagtgtaattacatacaagttacagtgtaattacaatacggttgtactacattctgtcaaatttttaggagaaaatttgtcgacaaatgtacaggtagtcccaacttatcagacaccacacccgtacaggagtcatgacatttgataagtagatggaacaagatagctagatttcagcacacatgctacagaaacacggaataagtaatttatcctacaagaataccgctaagataattttcagggatcgccaacggtctgcattctgaagatcagcagattagttgataatctactgaatcaactggtttctattcacagactcacagtgctagttgctgtggttgccacattttgttccttcttattctccagaaggacctgtgcttgtttcacttgagaaccgagaatgcttactggattcattgcgctctggtcgctgctagagaacatcatgaacgcttccagttcaaacatctctttggaagccttggacagagattccatcaagctctccagctctgctttggggtagtttccttcgagatttatcagtgatatgatcatcctactggcaatcttcagtattctcaggcaattggctgttggttcactgttttcttctaccaacttcttgagcttcccggcaaagctagatgcagaatctcctgttgcaattgcattagcaagttgagccaaatctgtatcattactgatcaatttttcaaatattgccgcactaagtgacagtaaagctgcatgtagtttcctgtccacgattttcttgttgtcgtccttttgctcattgacgttgccactatctttcgtagcaacggcaccttcgcctatttcaggatcttgtgtcacaaacttggttgcgtctgttcctttttctgtatgcttttctccttgcttcaatggaggagagggaagtatttctttgagcatctgcagtggtagaaattatgcttattaattagtaggtgatgataaagacccaaggtgcgcgtggttagttaaataagtatgaaacaaatgaaatgccttcatttgtttgaaattttatcacacaccgtacctttggcagcacatctttcatggcttccgtcagtttcttgagattgtcatcctcctttgtgtaacaaatgtatagatgcttgaggatttccgccgcacttattctgtatccgctcttggtgcgaacgtcgaggagcgttgtcttgagatcatcgacaacggtgtcactcgccttgaagatgatggcggcgttgctttcgctttggtcgacggaaagcattgccagtgcttcacctgccaattgtctcgtggaggcgtccttgttttctttagtgaagaagatgtcgaccagcagcttggtgattttctccttgctatcggctgtcgaagtcgaaggtgcttccatgggaagctgcgtgaggatcttgatggccaggacgtgtagcttctcgttgcattcgtcgcacccgaggatcttctcgacggtgttgatggcgcgcttgttggaacgcagcttgtcgccggccttcccagggagggcgacaaggcggaacaggagctgcagcgacgcggctacgatgtcggaccacgcgtcgtggccgatgttgtggaggaggtcggcggtgacgggcaccatggccttggagacgaggccctggttgctgccgatggcgctgcagttgtgctcgtcggcggcggcgagcttgtggaggatgtctcggcccagcaccatgagctccttgtagtgacccgacggggcactgtcgccgtcttgctgcttggtggtggtggtggtggtggtggtgtcgagcagcgacgagatgcaccggagcccttgcgggaagctggcgaggctgatctcgccggcgagttgcgccacgatcctggcggcgagcacccggacgtcccggtcgagcgggcttgtggagcgaagcgactgcagaagcctctccaagacctggctagccgacgcggagccgaccagcttcctgatcagcgcgtgctgcccctgcagctcctcctgcgcgaggatcttgtccaggatcctcgcaccggagacgtagtcggcggacgacgactcggacttcatcagctccacggcaaacgtcaccaggttcctctccttgacgaatgatggatccttctcgcaaccgatcttggtcttgcgcatgtaatccctcaccgactcgcgcccctcttcgtcttccttgtcgaacccgtagtcgtcggcgactactcgggccagccgtttcccggcgaagtaggaggctgactggtagcagaagagcacgccctggaagagcgccagtgagtagagcacattgagcgccggggtcaggttagcgccgccgtcctcgccgccgtagtcccgctctatgaggcgccacatggagaggccggtgctgacgagaaggccgaacaggtagagcaacgccagtgggagcagtatgatggcgatcaccagcgcctggaggagcaacacaagaatccccaccagtgcacgccagtactggtccgagtcgtcgtcgtcgtcctctttcctgaacaccatggctacagtaaccaagaggccatcgaacgatttccaagcgtaccgcagcttttcgttcaggaaaacatcgaacaccctgtaaatttagttagatagaggcgccgttagacctggacaagggagatacgacgaaatgggtcggagtgtactggaaatgtttctactttttaggaacttgaaacccataggaaaatgctcgatccgtcctaaaatatggctagattagatatgtagattcatagttgaagcaatagttatattcagtctagattcatagctgaagatagctatattttaagatagaggagtgtttgcaatttcggaacaagtagatacggtcaaaattttcaggataaaaaaatagctataagttaagggactgtctatataggatttgatggattttttccgataagttaagccccccaaaaaagaaccaaacactaatcccactacctcaattccgtctgtggcgcccaaaacactccttgcgacctgaactttccaagcaatggtgatgctacccttactagcggcgacgatgggtcaactactcctggagttggcggcgacggtgccaaaaaccctttctatggcttggactccctaggaggcggcgctcctcctgctagcagtatagttggctaaaagacccgttgcccgatggaccgggccacagcatggagatttagcccagcccaaccattgacgatgcctggtcctctttctcggcacaatgagttggcccggcccggcaagacccaataataagcaggcccaaagagatgagggaggtaaatagacatattccaaggacgagtacagtggactggtcgtgccttctggccgacatggcacggcacggcccaagtgttattgggttgtgcctgcattgaaggtgcagcccatagatgcgcacggcacgatatggctagttggtcctactctcgagccgtgccttggtcgtgcccaggctggaccgtaccgaatggcccatttagccatttataactggcggcgacaacagctcagctgctcctggagtcggtgactcagcgtcaggttcttgaggcagcagcagtcatgatttgctccttcatcctccatccttcctttttcactatcttgatatgtctctccgcctctatgggatttgtccctcagcacttcttctgttcttatagtagtgcgcacactgatttggggtcatggaagaagaagatcctgcatatgttggcagggggagacgcatggggtcatggtggtcctggatcgtcagccgcctgcacagctattgtaactgatttgggcaacaatgatggtagcggggtgggaggaaggggatcagcagcaacaactgttggaagaagaacggagagtgccagtcctaaatggatatgagatgtgtgcaatttatcaatttagcgtgatgtaactgctaaataattcagctgcaataagctcatttttttttctggaaatcatgcattatccgataagaaattaagatttgcgtggactaattattttatcccagaaatttccagaactttgaaattttgattgcattttgttttttgtaacaaaatttcatatttgaattcaaaatattcatacgaataatatccaaatttttgggttttttccgaccccccacgacaacaaaaaaacatttcaaaattgcataccctgcaagggagtacaaaagacgaccttaaaattgaaaactttagccaaagtatagttcagtgaattatacaaattgaatacatattatttattacggtacataataaacatcaaatattaatgctaaaagagtaaatgtcgtactcaagcaatcaattgacctcaaatctatctatctattatattatattattaaaataagaaggcatcatgttcgctgtgtaggctagaaattcctgaattaattgaaaaaaaaagaaaaaggatagtctatatagaaatacaattgagaaatcactgaaattcggaataaaaataagcaatattgcaaaagagttcatataagaacccaatacaaaattaatcgaaattcgaaataaaaaaataaaataaattctgaaattaggaaaagaacaggaagagttcaactagaaatacaatttagaaataattaaaattcggaatacaaaataaggaatattaaattaatagtttagctataacacagcacgagattaaataaattcagagtataaaataaaataaaatacgaaattaaaaaataataagagtctaggtaggaatacaattttgacgtaactgaaatttggaaataagaataaacaatattagaagaatagtacaaataagaatccactacgagattaattaaaattcgaaataaaaaataaaataaaataaattccaaaattaaagaataaaaaggagagttcaaataggaatgcaatttaagaaaaactaaaattggaaataaaaaaaggaatatttttttttgacgtgataaaaaggaatatagaacacaatatgagattaaaataaaataaatttataaattagaaaagtaaaaataactaagattcgtaataacaaataaagaagatatcatagaacacacgatgagattaattaaaataaaaaataaaataaattctaaaaatagagagttcgaataaatgagtagagtggtggtggttgataggacactaaaagatataaacaaaacccaaatagaatgtcactgatgattaagtggagggacgatgggtagaccattaagcatcacggtcacgatggcgggacttatagaaagtaaaaaatataccctaacgataatcatattttatttttaaaatctcatgataaaaaagaggggaggcagcgggtggtccatagaggagtacggtggcaaagccgctgacagtttgataggacttctagaaagtaaaaaatgacctaaatgataattatgtttgtcttttaaaatatcaatcgcaataaagagataagtcggtgggctggtcataaaggagtaaagtggtggcatttgacgagacttctaaaaattataaaacaaaacccaactagacaatgaactctaaaaactacaatgtctaatttttaaacgttccaagaagaatgaatataagcagtcatagatcgcatgcaaataaaggagtgataaaggagtaaggggtagcgactggtgtgacttttaaaaaataaaaaaaattagaaacacgtgaactatttaacaaaatttaagaaaaaatcatatgtaaaaagtagataattttgtatgggtgctagccacgcaattgcgcgggtcacccagtagttctattgaaaagcatcatccttttagtattgggttgaaatgaaatcttcctattggggcaagatgggctttgctttactctagaacttagtggattagaaattatggccccgtgtagtcaggcacctcgcaaatgctacaatattgctagcaaattcctttgcactctatctttccttccaaatgaacatgaacagtactagaaattcctgaagaatgatcttatgaaaatctttgttccgaaagtgtgttttgttagccccttttcagagaaagaaaaattatcattgggagcaataaatggtcagaaaagaaaagaaaaaagtgacgaataggaaatacaacaaatgtatagtagaattaagaagtctaacccagctgtctggacaagggtgataatggtgagactccaaaaatccttcttctcaagcatggagacgaagccaccaaggaggacgacggtggtccataaacctactaggaagcccatccccttgacggccattgacaggtaccccataaacagagcataactgttgataccgtcaacttccttccactcggactgatcaggttcattagccattgtcagttcttcctcaagaaagttgggatcatcgtttgcaaagcagcaagccaatatatatacaagctcctcgagcatatgggatgattaactatcaatacgtagaccaatagccgattaatgaaaaatgttcagatcttgactttacctgcacgaagcgatcgaggtcattgtaaagtatatattgttcatccagcctgttcagttttggaccaagcaattagctaggtctttattatatttatgtattagtagatcaatataaaagacctacaaataaattaaagctagtggcctcacaagttacaatacaatattatgcttctcactgtttgtgtacccacactctagctagattactaatgctgggattattattgtttcttgaatgccgggaaccagacgtaattgatgcacatatgtaacacatggtggactggtcgaggagcgttacatatgtaacaggagctgacaacgatccgctaaactcgcaagagtaaactctagaaaacatcatgaagccttccagttaaaactgtttacaactaaatttgacacctagattcgaattatgaacattgccaaaatttgaaaggcgccgagtttccttcacggggccggtccgaccaccgcctatgggagtccaaaccgattttcatcgggtctcgggtttccttacttggaaaggtatttttcgagtttccattggtttccaccccaaattaaacgtggagaagaacatgtagaagacaagaccaactcctttataatagccaaggtcggttcgacctccctcccccccaaatctcaatccatacataatcgaatcgtttttttacttctacttttagccattttttctactttaccttagttttgtccatctttgtcggtttgcgccgtaaaccgtccgccttcactacgagagtgcgattatctctttgtagatttgtcttataaccttccgttcgcccacgagacgggtggttatcttcaaatcaatctaaatcggccccgaggctaatttgatctctaaatcgcctccactagccggtttaatcttcaaagcccatcttgatttagaattctctagatcgaggtggttggtgactccattaacaccacaaatctttaaatgagtcatggttgggaccgaaaagggtgccaacatgaattggcgactctgctggggaacgtcaagaattttggccataccacggccagaaacaatctactatatttgttgcttacgcatataaattgatcgctcagttgattggatcagatcggcgacatcattctcttaccgccgcgccggtctgaaccagtctaaccgacgttgtaggcccggtctgaccggtgaggtgaccggtctaaccggcagaaagcaccaagataagcagcagcaacattgtttccttttattgctgcacactgttactgagaagaaataggaacagagcggccgattttatttaacatcggttaatttttggtatatttgctacagtaccaaataccctgttacgatcaatcaacaaggctaagtttgataaaattggtccaaatacagtagcataccaagaaaactatagaccgtatattaatctatttggtcaaaatatttcagctataattaatatgatcgaaattcatccacaaacatcttcatcaaccatgacgagtgggaaggagatcgacaagctcaccaaggaggactggaccaaggaggagtggcgagactttgaaaaccaaatggcggcgtgtgagaagacgatgctcgcaagcttcctcaagaccgaccaaggcgtcttcaaaagagacgtgacgtcccgctaccttgttaggagctctattgggccgcatgcagtatggaccatgcattctccagagcaagcccaggctagcccaagcgactgggaacaaaaggatggctgctgctcctacaacaaacattgaacagatcaaacaggcatcggcggcttcagccacggcggcaacggcgtcaaggttctaggctagaacctcgacgatctatcttctctaccgatctcttcctacctccagcttccactgctagttctagaagcttccaaaacttgtattccatagtttcttcttctcttttccccctaaaacaattgttgcttgtatggtggatccttgctattgaattggaagaagtgggttcctaacaatctagtatcagagccgctcggttcgtgggatttctcgtcatgcaggtgttgggaaggcagcagtgcaaggtggaggaagatttgggcaagtgaggtgctcatgaatctagcgcacacaacctgttcgatagaataccaaaccaacataaggtgtttaaggacgatgaaaggatatcagagcccgtttccatcaaatccaccatgaacaaggagggaatatccatggacgaatctttagatcagaatcttgggaagcttgagttgatggaggccaagtgcatgcaagaggagaagttcaatcaaatactacagaagttggaggagatagaggcttgtaggagcaaggctaccgaggtgacgattgctgccatcaggacaaccaccgccatcctcaaggcttcatcatctccaacacccatggcaccacctcctccaacaccgaccaagtgtttgacaaaatgccccaacaacaacttcacttgggtgatggcgaattcaagtcacattggtgaggtgcttgctccaacggctgcctgggagctaggagacaacaaggacaagggccacgccccctgcatcgtcaccaacgactcacccaaggtcacgcccgccaagtgctcgaattgttctagccctgacatcatgctagacctcaccgtggctgtgggggtttcatgtgccactacttctatggcctccatggagttgttggttggcgaggatgaaaccagtgtcatctacattgacaaccctcattgttccatagcgacgcatgccaagtgttcgactttgggcctcgatgtcaatggtagcgccaaccaacctgtggtcgtgttccctaccattacagctatgaatgggcatagcatcattccaactctgcctctgaccattatgaatacgtcagtcatccttgttgtcaaatcaagttgtgctagcgacaattctatcagacttatgactctatgttagccactaatggagtatgctgagaggaatccatggccacctcctccttcgaacaagctaacgggtagcatatgtgagctatggccagaaccatggtcatcgtttgcgtgtaatcgatgcaaagtgtggtacttgttccgattggagagcacactattactgtacgtgaatggagttgagcagtttctaaaggaattgccatgctggccaccgcctcaagaagatgtgattaaatctgagttttatcatggagggaatcaattttggttgaggaattcagcttgtgttatttttttttagataatggattcagttgtgttattgcagagacaaaaatgatatacgtagctactgttgtgaggttcagtttgtgctatatgcagatgggtgctatgaaaccttcaagtgttatacaatggttaaatttcccctactgcacatatgacggattcaagcggaagcttcgaggcttgttcacaaatggagccttgtgcatacattcaagtcagtatgatcctccagatgggctttgtgaataatccggttgctatttagtagaactagaaagaaagcccgcgcaaatgcgcgggcatcttattgattgttttataaaaataatgcttaaagaagttacatctcactatttctatttaaatgttataaaataataagaatatatctcagattaaaaatacactttgatcgagtgacatataaattctcctattgtcaccattacttactatgctttaaaacctaataagtaattaatacactaaattatcctctatttaggtttcatatctcattttttttctaaatccatttataaatattataaaaataccaccacttctattcattaatggagtagcaccattaaagttaaacacgaatactactctagtgggtgaagtcgattgtagccaccaagactttctttctctattgccttgaaacatgagtcccgcatcgatgtagccatgctcctgaagaccagcttggagcataattttaatgtatgattcattatcacatgctcatggagtattatattggtaagtagaaagttgagtactattagcgatggtggcctccactggaactgtaacttagtcatatattccattttatacttacgacaccataataaactttgttgtctaagtttagtgtcctttagggaagaacaaagagaagatggaggtgaccaaagtagttttttaaaaatgttttgagtagatttgtggtgcagtgtaaacacaatttctttatggtgttgatcattactactcattttttttatgaaaagatagaatactctcttttgaaaatggccgagtttaataattcgatgatgttttttaaaaaatatagctaatgagacatatcaccacgatagtatccagatcatcatgttattatctatgttttgacaaatatgtatagtcaaatagttctaaaaatataaaaatactttcagaatcttaatctcaaacaaattgtaatttaatcagacctactcgaaaaacacaactaaattgtgttgcttttattttttacatatgcagatttaaattaatgttgtatatttgtgaagtgaaatttccctccgtaaaatatgatgtgatttttttgaaaaattatcatacatatgtcagcctcatgtgccgtggtgtatttaggaccataatataacttttataatttaattaaagaaatataacatgatcacaaattggatatataatttcaaaataatttagaagatggtttaaaaaacatttattgagtattctatgtttttattatagatcttagtttaactatatatatttatattatatttgtgaagtaatatatttcatgtttatattgtggaaaataaccgtccatttttatatatctactagcaaaatgcccgtgcttcgctacgggtaaaggaacggttaaattatatgaagtacatcgttaacatgtatataataatgttccaatataggtaaattgttcattgcgctaatgataatcaagatggataaaaatattcatgtttagctcacatcgcgaaagaaaaaattaaattaaaaaatattaaattctaatttaatgaaatataatttttttgcaatattaattacactctttgaaattatagcaaaagtgctcgtgcattgcaaccggaagtgtatagaccagaaaattgaggaaaagttaagaaaaatctacactatgtaattaattaaaatacaaatttgctgaaatatttaatattttaagtaggtaggtgtaaaactaaattaatttacaagtaaagtaagtgtgagaaataaaatgacatggttaaatttaattttattaaattctccatgattagttatgctctttggaattttatttaaattttcagagcttaattgctaattttaataatacaaacatcatttaacaattatttaattggaaaaagaataaaaatcctcccttttaggtttgggcataatatgaaaaagtttatattacctcccttttgcctatcatatgtatctggactattctttctccgttgaagttcattttacgtcctcatgcaatcacgcagtccgttcggcggcccagtaatgtggtggcccaataggccgacggcccgatgcgggagcagctagagccgtccgatcaaatgaacggtctagattgatcctaacctaaataaatacccaaaacctaaccctagaatacattcccccctccccacccccccggaaacccaaccgaggggtgcaccacccttcccccgcgagcggcggcgtcagcggcggtggcacactatccccgcgagcggcggcggcgcggtgccctcccctcgcgaacggcggcgtcggcggcagtggcgccctccccccgcgagcagcggcgtcggcgacggctcccccaccgagcatcggcggcgcggcgccctctccccagcgagcggcggcggcgccctcccacccccctcactctctccacttctcctcctttctctctgtgtggcggcggcgggagggccggcgacgccctcccctccgctagatcgagggggaggagaggtgcggcggcgggtcggacggcgtggaggcggccggccggacctcgcctccgccacatccggcggcgctgcggctaggacggcgtggaggcggcgggccgggcctcgcctcctccagatccggtggcatggaggcggctgcggcccggcggggcgtgaggggcggcggcccggacagcgtggaggcgggcgatggtggcgccgat

SEQ ID NO: 71129 - DNA, 623 bp, Oryza sativa
tgatggggtgcagcagtaacagggtcactcgcacccatgcttgaatcactctgactatctaataagcatgtcaaagaacacatcccccaagaaattctgcagtgcaatgttctaccaaggtaacaacaatgaagtgtccagaacactgtctcaaagtctaaggatacgtgggttcccatatacattggatgcaaggtctttcaagacatccgccatctgcgcctctgaatacagcgtcgcaccggcatggtccaggtaagccatccctgctcctcaagatcaagaaagaaagaaaattaaaaatctagaaacctgctacaaatacaagcacatttgtttttttatatataatggaaatcaacccggatttgcttcatagaagctatagccaattcttattacatagtttgcagctcacactactgcagttccaaacatcaaaacaagcacaattgttgaagcttatgtagcaaaattcggtaggatgctagattcttcactctccgcaacaacaaacctaatagatttatcgatacaacagtgagttacagcaagaaacgcggtcatctgaccgaacgccacaagttcctatccatccttttgttctcacaaaacactaatag

SEQ ID NO: 71130 - DNA, 529 bp, Oryza sativa
gatgccagacttgagtaatttgtggctcaggccacgattttcattgtttgtggttcaggcttgaagagcgatcaaaaccaacgaagttgcaggtttgatagtgtgacaggttttggtacatttttggtagcacgaatgcacgatcaactaaccaatataaatttaacgccaacattaatcacatcaaaactgtgatcacagctcagatatgatccgttggacaaaatttgtcgttgcatgcaaaatatatcaggcaaaatttgtcgttgcatgcaaaatatatcagggacacaagcacaggaaaccaaacatgacagcgctatcattttgtccctgcatagttgatatattaaatgaagttgcattgacaataattgctgatgatgtaggagtactataaatgtgataaattgtcgaatttactaaggtcagattggaacatcaaaaaagtagtaattccatccaagccattaaaaagcacgcacaggattgcctgtgaaaggcacaccctttgtattctaccattgta

SEQ ID NO: 71131 - DNA, 566 bp, Oryza sativa
tatgatccttttgacgatcctcctcagctcagtgaacttattcctgagaattctcctgtagggaaaccacaggatgaggtaatatgagttctgctattttgctcatgttggaaagatgataaaccaaaattgtctcaccaaaatcacaggctgtcttttgtttaattcgttttacctccacattcttgaaaactatttatttgtgcacatacctttttaaaagaatatggtatgaatttcagttgaggcagccactgggtgtaggtgtattttttttccttgttctgtctgtacaaattatcccgatccctaaaatatctagacaggcatgtttcagattagtcctagaagggtgtggttttgccgtgattctcctgaatgctatgtgttgtccttttaacatggtcatgatattttcttttcactgtcaatgtacagattgcagaagagcgcttagaggatagctgggtccctatggatgaaatggtggctcctgaagaacttgaggagatgatccgctccaaagaagcacatacaaatgctgggattcttgagagcgtgagtcc

SEQ ID NO: 71132 - DNA, 64684 bp, Oryza sativa
cgttcagcagcttcttaggtaatctgtgatgaataaaaaaagttaaggaattagtacgccaaagggaaaaatgtaagatggatctccctcacctgaagccaatggctaagggggccttaaccccgccctgatcgggggcgccaaccccaatggctggtgggcccccgtcacactgtgccatataaagaggggtggaggacgggacggcataacgacacaaggaacgaggttagtcgccgccgccgccactccaccccaaaaaccctaaccgatcgagggggcgcagccagtgacgggaagactccaccgccgcgccacgacctcgccgggatcccctacgaccaccactgccgcgcagcaccgtcgccgtcacgaccgccatcgccgccgccgcccacgtcaagcagagcgacgacaacgacgatggctgggacttcctcttcatccaacgcgtcaaccggtcacatccctaaaccctttcccttattctctattgttgttcaatcatccatcgcaaatagaaccacccgactagatctaaacctaggtgatccaatagacaacactaacagaaactaggcccgtttggttgttctcgagctcacaaattagtactatttctttaaaaataacttttttttaattataaaacaacatatcaactttgtagtgggtactttattgatgccttcaaaattatcataaacttagagtaatccatcattaaaaaaaattaatcgtttcggctataactaagcttatcatcaatgagaaaatgattcatgggtaaaaattttatatatgtattcttaccaattttatataaaactaatacgaagtaatacacaacggtaaaaatcagctctaaaaattaaatttaacaaaggatggcgtgtgttacatatttcgcttttttaacttccactcctattattttttgtgcgctacccaaacagttaaacgatattttttttttgcaaaatttgatagcaacgctgtgtctgaaaaatcatattaaccattttcttaatttttagctaataattactaattactaagtaatacttcctctgtttcacaatgtaagactttctagcactgcccacattcatttagatgttaatgaatctagacatatgtatgtgtttggattcattaacatctatatgcatgtgagcagtgctaaaaagtcttacattgtgaaacgaagggagtagtaatttgttaatcctctgtttcatttttgcttagggatagatttgcaattaaaaatactccctccattctgtaatataagaaacaaccacttttcttagatgttccatgataaaaggcatacaattaattatggtatcttttccattaaattattaccttttaaatcctccactcccatgttatctaattctattgaatgcatgtattatattattaggatgattcaaactataagataataataattatttcttgatttttgagttaaggatggttgtgccttatattttaaaatggagggagtagttggaccagatgagaagtattaccaggtctgaggcctgtggtgcgcagatctttttctccagggagccgtaggcgaatgttccatctctcctctcctcttctcctctttattactgcacgcagagagctccagctcgcgctgctccgaccaccgccgcgccgctcgccgcctccgccaccgcctccgccggcaaaccaccccctcgccatggcctccccctgcgagcaccacgtcccgtacaccctcctgggcgcgctcctcagcggcggcggcccccacgccgccgcgtgcggcggcgccgccttcctccgcgactacgcggagcggggcaccaacgcgctgctgtgggcggccctcctcgccgtcacgtggctgctcgtcctccgcctcgccgcgctgctccgcctctgggccctcggcgcccgcctccccggcccgcccgccttccccgccgaccctggcctcgccgccggtgacatcaccggtaggtttccgtcgtcctcctcctccttcctcccttctcttccctgttcgtgcgagtagcggttggtttggtggtagttccggtgggtacggatgcggagctactgtggaattggatttggcgcgagttcggcgccttcgcagggtagaattattgggcatatggccttctctttttatgcttgctcgggtttccgtgggaactgttcgattgggaggaacgttgccgcagtttgattcgagattcagcaactcatcatcctccagttgctacgcgagcgacctgagtacggtgatttgggaatctgttcttattttgattaattgatgtgggatttgatttagttgggcgctgatctgggtggagttcgattagaatgtcaaatcggctgatttggactgtgtcgaattatttgatctgttttacgacagattcgtgcccaaatttgtagcttcagtggctgtaagcctgtaatatttccgttcctctttgaggaagtggaacctgctggtatgaggtaggggaagacaaaaaaaaaagaagctagtgattgaggtatgaactgtttttggcggatctgttttccagcaactgagcgtgacctataaattgttgcttaatttgttttgccgtttagattctagagtactttttactttttatgtgaggttgtttttgctgaattttcatattttgtaagtcagcaagggaactgaattattaccaagttgaccttgatttgggatatatttccaaaggattggacggtgtagagatctgctacgtattactttgaggtttgtctgattatatgaatatagtagaattcccaggagaattgaattaatactctgtttcctgagaaaaaaaaacacatttctcatgggctcatggcaatcggatcaaatcaaatctgtcatcagtgtatgctgatcttcatgtcaattgtctagatctaatcctccgctcttcaatacatcttggctattggtgctagagaacaatatcggtgcatcatgtaccctatcaaaaacacctgcaaatggtcattaaaaagtgtgaggtaatttgaaaacaatgatactgcatggatctacgctgccacagtttctaaattagtttaacacagggcagaaaattgaatagacagattttagtaaacaataatatagtaccatcctctttttttttcaattatcctctttcagttgattttgcttctttatttcaccttccatgacaaagttcgattttaaactatgtataatgaattgtggtctggtatatccattgtgcctgaatgttttcagtttttctttaaaataaacatttacaccttattttgaatacgatgtacatgaaggtaggatgaaccgtcctaccctgacctgcgccaaactatgatttaggaaatattggacaaaaattgctgaaataacctatctggatgaaaaaaaacatctcccttatatgaataagttgttcattacgattttgccagatgaggattgagttactaacagaattcgctgtgcataaggtaggtgttttgcatataaatataggaatagataggcatcacacgagtattttactaactttaatacggataacttttttttttttgcagggaaatacggataactttttgataccatgctgtcctatgtttgtggcatcatattgtatttctcatttttcctgtttagtcaaatgagcatgtgcgtagactggcctagctcaactctgtagtctttagggcccgattatacaatgctctagcacatggtgcatcaaatactctacataacagatagtcggttgtacattgttacgcataaaaattctggaaagaaatagctaatgcagattttgagcagattcataattgcgatctaccagtatttgttgagtaaaacactaaaactgtggatggtttgatttctgatcatattcccctgaactgctgtatttcaccactgatcatatgttcctttcaactgcattattaaacaggctacctatcgaagttacatggcagttatggcccagttgttcgactgtggctcggaccctctcaactgcttgtctcagttaaagattctagggtaattaaagagttgctaacaaaggctgaagataagttgccgttgactgggaagacatataatttggcttgtggaaaacttggtctgttcatttcctcgttcgagaaggtttgtgtctcaaatgtgataaaataccatatgcagtctgctgtattaatttgtctcgtttgccttgcatatttttggtgatagttatcattcagatggcacatacaattgctgattcatctccgctattcttttaatgcttttctcctgcattttcaggtcaaaagtaggagggaatcactgaagtcattcctggatgaaaaacttagtgttggtactggtggaagttccttcaagatcattcaaattgtccttgatagagttgactccattatggccagggattttctggactgcagatatttttcccaacacatggcatttaacattgttggctcggctctttttggtgatgctttctttgattggtctgatgcttctgcctatgaggagctgatgatgacggttgcaaaggatgcttgtttctgggcttcttatgcagttcccccattttggaaacctgattataggaggtacagaacactatgtgctcgattgaagctattaacacaaggcatcgttgcaaaatcaagaaaccaaaatggtgtacttagccttattgatctgagttcctgtcagagaagtgaaaggatgataaaagatccatgcagaggcttttctctgcttgatggtgtgatttcaagtcgttgtctcaacgaggcagctgaagggcctctcagctcagaagaagaaatatgtggtaacattatgggtttaatgttgcatggaatttccacgtgtgctaacctaattggcaacatcctaacaaggcttgccttgtacccaaacttgcaatgccaggtacacattatttgctttatttctctgttgcaaacaatcctggttgctctttatgtgatgattggtgcttgttactgcttttttgtttcaataggtagttcctttacctaaacagatctctcccagttatatatatgttacaatgttgcatattgtccagtattgctccttgttctttgcttatgcaatatatttctgcccttcatgtagtatcatgatagtctcaagttattctggttttgttatagcattcctttgttaatttgacaaggctgaacttgtttcttcatttatcttcgttgacatggaaactgcttctttcaggcggttgcattgtatttatgctgtttctctgacttacatgtgctgttttcctacagctgcattcggagatagtttcaggtcacagtgaatcatctgagcttaagatagatgatgtgcttaggatgaaattcctacttgctactgtatgtgaatctgctcgacttttgcctgctggacctcttctccagagatgttctttgcaacaaggtatacatatcttttcaataaaacttaaaaagtaccgatcaatgaaaaatgaaaaaatattaatagtgtacatagcaccacgtttcataccctgtatttcttgaggccatttttattaatatataaattttcttatatgtcctgaaatgtcatccatatcatattatcatatgattttaaatggagatgtcttttcttcatcctgatcttgctgtactgtattgagattatgctttggttctgaggttccttaatatatccattatccagttgtaggagaaatcaggtgtacttttatttcatttatttttagctcttgtgtgaagtgtgagctctagaccttttggattacctgctgtacattattgatctccttacaatttccttgagtgcagatgttaatcttaattccagcatcacaataccagctggagcaatattggttattcctttgcatctcgtgcaaatggaagcttctacatggggaaatgatgcttgccagttcaaccctaatcgtttcctcaaaaaggaaattaattttgaaggtctctccctctgctcccttcattttcctttccgcttgttcatttgtgcattatctcaatatgttttcttcttttacttgttttactgcagagatattagcggcagcacataaaggctcaaatgggatcaacctcttcactgacgagtgtgataagactgaatcattccttccatttggctctgggagtcgagcatgtgttgggcagaagtttgcggttcttgggatcgcaatgttgattgcttctctgcttcgcagttacgaggttagatgtgataattttttctgtatcttggcatggccatgtgaagagacacggccacgaactctgttatttattaccctaaaaaaactgttatttatttctattcactatgagctcagcgagtttctttagaacaattcctgactaaattatggttacaccccccttgagttataaaatttggcccttattaaggttgtattctaaacttgtgatgttgcttggaattcgaacctgcaggtacaacctcatccagctttatcccaagaaatggaatcattagttgacagcaacagccttcaccatattccgaacccaaagatcatcctcaagaaaaggagcatctgaagcagcaccttgacaaattaaagcttgacgcatttacccttgattacaatatatgttttttactggtggcatgccaggatatggtctctgttttttttcagaagcaatatggtctccaagcttgctttctttccatcgcagaaaccgcgacgtggatggttttttcctccagatttttaacggccccagtgagcttttctagacctagtttccattaattagcgttttgaggcacttgtgggcggttaaatcacaggaggtgtgtaccgatgtgcataaaccaatagtagcttcttcttttttcttttttttttccggttggtgttttcttctccttctggaggaatgtaatgttttatgatgcactgtatggctgtatcgtgcgcgggagcgcagaatctgttactgagtttagtgtaccatgtacctatatatatggtcacattgtattattgttgattgtttcttccaccgtaactggtgaagtttctcaaaaagaacattggaatttgtattgcctggtttgtggacaaaacatcaacaaaaaaaagagagaagaaaaaacctggtgactttgagtagtacgttatcgaattatgatattttaccatcgtcgtcgtctcatagtagtataccgtagtggtagtatactactagtagtgtgagtgtgtattattttacagagagtccgtgcttggattgcataggcgctgtttttggcttcgtctcgagctgcattgcctgcatcctcttcaaatcttcagagatgagagaggcaacggcgcagagcagccaagcatggacggagccagtcggtggtgtatacgtccaagtgtccaagccgaaagctgcctcaccatctccctatactgctttgattttttgtttttggttaattgtttgtttttgggatgcaagtcatgcaacctgcactgtggcagtggcagtggctagcaggcgagtgtgccgctagcgcgcacttcccacttaactatctctattagttaacattaataacagtaattaggaatttttttaaagattttatcttttttttagatttttttattaacagattgacaaaaatttaaactaaatttgaaacttttgatttaagattcaaattttaaagtcaaattttgaaaacttttaactcagatttgaaactttcaacttgacaagttgatattcgaaaactttaaagtccaggtttgaaaattttgaaaactttcagcttaagatttgaaaatttttaactcgagattcgaaaactttcaactcgagatttgaaaactttcaagttcagatttgaaaattttgaaaactttcaacttgagatttaaaaatttttaactcgaggtttgaaaactttcaactcgagatttgaaaactttcaagaccaaatctgaaaatttttaagttaagatttaaaaattactagtaaactaattatgattttttctcctacccgtgcgacatcgaactgtgaaaaaaaaaggaagaaacatggcggtagcaaatgggggatttacaattatgacactgcaaacattaactgcgccaaaaaaaaaagagaaaaagaaacacgtgtgtgggccggaagtacgcgttgacggcgcatacgcgggaattaggaattctgctggcggtccggcctgcacggtgagttaccacgttggctgttgatcgagagattctccggtcagaattttctctgagaaaaagaaatctgaggatgcccggcccaatatatggggcccaaaacaagcgagcttttatgggccgtgacgagtagccatcggcccatctccgctttcccttgttgaggtcaggaggccgtggcccgtgtgtgcgacatggtcgcacttccagccccatcttttgcttatcagccaaaatttaaatttttaacatttaatttagagttggttttgggatttttttcacctaagtttattttttagcctctacttttggatcgttaagaatacgtatataaaagttgtattcacaaattattttttttatgtaaatatatgaataagccaaacgatgaagcctctcccctcgcccatctcccgacggtcgtctcctccttcctcttaggctcgtcggtcgccaatccccccatctcccgccgcgcgcccgccgccgctccgcccgtcaccaccctgcccggcgtctaccacgctaagatttccgaactacggtatggtacgccgccgctcgcctgtggttactctactcatcttctcgctttcatatactattgtcggttatttttgagtatcctttctcctgcctcctccgaggagaaagtgtgctatttccaggggcagattgtcggatcggcggcgactattggaaccaagaaaatttgggaatatttgggagcccttgggcatatcattattctagtcggactctcaatgctcatgtcccccccacaaaagggcagccgaacctttgtcatgaacaacaaacacgagcattgggtttcttggcttcctaggcgcataaagggctcttaacttcgttgctgcataaaagagtcaggtcgtaagctttgggctttcaacatagcagcttcgctgcagaaggcaagtcagattccacatggagatagataatggacacacctttgtaagttcttggtttcaattataagtactacatccgttttttaatagatgacgccgttaactttttctcacatgtttgaccattcgtcttattaaaaaattttatgcaaatgtataagatataaatcacacttaaagtactatgagtgataaaacaacccataataaaataaattataattacgtaaattttttgaataagacgaacggtcaaacatgtaagaaaaagtcaacggcgttatctattaaaaaacagagggagtattctttagagttttaatgcttcaagccactaacatattttgtgtaatctaattattgtagcaagcggaggagggcgataggctcagcaatctacctgacgatattttgttggatatcttggcgagactcaacattagtacggttgcaaagacaagcgccctgtcaacgcggtggaggcacctaccttggtagttaactaagctggatttggatgttgcagaattcctacatgccccagcgttcagtagcataacgactgtgcacatggatcaagctatgtcagctctcaccaaagcagctacgagtttgctatctgtgccacagagagacacctccatcagaaacctatgcctcaaactctacatgatgggcagccactcaagcaatataggatcagtattaagtcaagcaattgaagctgggatagtaaaagaattggaccttgctgttttgcacgagaagagacatatagattgcaatgacgatgatatgcttcatcaagccagagctgtgaaggtctttgctggtgcttttcctcgtgtgatttgttgcatcacaaggctctctctgtacaatgtgcacctcgatggagacattcatcgtattcttttcgattgttgcactcagttggactatctgaatctcgagcattgcgatgatgggagccgcgatgtttggaagataaatgcgccaaattcaaagctccggcatttggagcttgcagtgtgcttctttgggaggctcgatttagtctgcctcccaaaactcgagtacatttactgggaaatttggttcactccttatgcccccttgtcattcggctcagtcccaagccttagggaattacgtctcgcatgtcctgcccaatctgacttccaaggcttgaagttaagcaaagttttacaaggtgtcccgaacttgcatactttgacaatagatttccaaggagaaaaggtaattgcataatcatttgttatgatctgcttttctattattggtacaactgttacgttgcggcatgttactcagaatgaggatctagcactaaaatgctgtgatagtttcagctggctcagttcaaccacttaggtgtatttaccttcaatttaaaaatgagaaaacctgtgaggtggtcaagtgtgcaaccacaccctcctaaattttggtttaacccctcttttgcttgtaattgcccgcaaggattttattatttaggagtaatcttgtttgtgcaatggattcatatatatttggcaatcactcacgtgcttcatttctgccttttgttttttcagttatggatgcaacctgaacaaaaacagctctgccctgcattcaacaatctaaagaagttatctattctttgcattcatgttgaatttgacctgttatggactataaacctccttgaagctgcaccatccgttgagctcctttgtattgatgtaagtttcctttttttttaatagagcgcaacaatagcatatgacagtaactgcaactggactatcattatgtgcacaaattaacataaccaagtgctcatactaaatgtagacctgggaacatgtatgcttggtaaacaaagaggatgaagatggaagaaagcttgttcatggagaaacaacacatccttcatgggagatatctgagttcactggcaccagaaattggcaattgaaagaactccagttcactggctttaggccactcaagcaacaattggtctttttaaaggccatcatggagcaagctcgcaacctgcagactgttattctgaaagaggaagaaccatgcgaggactgtgaggcattaggcacgcctctttcttgtataaaagatcatgacttcccaaagtcgaaggatgagcaagacaatgtagtcgagcagctcagagagaagatttcttcggattcgcaaataattttccagtgtttgtaacatccccttcccaaattattttcctatagttttggaaaatgaatatatcctatgtacatccccgtgtacttgctacttgcaacggaggagttgtttgtcactgaataaatatctggaatttctattttagcttcatcctgatatccaaatacgtgtggaagtagttcaatgccatacgtactggtagcattaagaagaaccattgtaaatctaaccaaagatattactacctccgtcccaaaataagtgcagctgtaaatattcgtgctcaacgtttgaccgtccgtcttatttaaaaaatttgtgaaaaatttgaaaacatttagtcacacataaagtactattcatgttttatcatctaatagcaataaaaatactaatcataaaaaattttgagtaaggtgtattggcgatccttaaacttgtagggttatatcatatagttccctaaactctcaaaatgcatatccagatcctagaacttgtcaaagtgtatcatctgggtcccaaattaactcatcccctctaggatcctacgtgacgctgatgtggcaatgccacatggacgtgacgtgtccttttctctttttttcttcttttctttttagttttcttctcattcttttttttccttttttctgtacggtccacagcgaaaggagaagaaaggggaaaaaaaagaggaaaaaaagaaaaagaaaaaaattaaatgggtcccatttgtcaatcaaaataatgccatgtcatgtccgtgtggcatgccacatcaacgccacgtaggatcctgaaggggttgtggcgatttgggacctagatgacacaatatgacaagttctgggatttagatatgtattttgagagtttagggatctagatgacacaaccctacaagtttaagaaccgaccgtacactttactcaaaaattttcagataagatgaacagtcaaacgttgaacgtgaatagtgcaaaactatacttattttgggacggagggagtaacagataaaaataatcattacgtttatgttgccaatgaatctctctctagtcacttttcatcggcaaacataaaatgcctaccaacaagattagctaaaaagaaaatagacggtgtactacaacagcacataccactaggaatgggctgggtgtgaatctatcctaaaattactgctccttttgctacgaaaaaccccacaagttgagcccgtgggtcggtgtgcctgatgtcccacatcttgtcacgccctttcgatctcctgggtgcgcacatatgcgaattctccgcccaattccgcatcttccccgacgctctaacgccgccacctgatctcctgccccgatgcaccgcctcatctcttctccctctctcatggcatctgcagcggctagctggtggtcaccattgcttgctcgaggaggacctgtccgtcgtgtttccggtgtgttttcttgtcactcgacgatttcaatcctgactgatggtaccatcttatttattttagatgttgactaggtaggtgtctgtgcgttgcaacgggtaaaaaatatacaccaatttaaaatcacaaagtaaaatgatgttgaataattaaatttgttaggatgaaaaccttattattgcacgaacaataatttcatcacatccttataagttttcacaggttagtaatacaaacagccaaaaaattcaagaatagaatggcacaataggtctcttagggcacgttcaacggttgagcccgccatggactcttgaataggctatgtcagagaaaaacaatagttctacaaaggctggctttccgatcgtctctccactaatatgcagtaattaaatttttgtagcaatggtgtcgtgattttctgcattttggatctaaatacgtgacttttcttgaagatggactatacaacggccattggttatctcgtctgctcgtgtttttctcattgtgagccgatgtcaggccgattgcatgcaaaacatcgatgcatctccattcttttttctctctcttccacatcatcaaatctgcttccatggcaataaagagagcccactaattaatacctttgtacatgccctagtacctcctggccctcttccatagatcctgcacgcacaaataaatgaagaataactgtgcagtaatgcaggaagtaaattaagctgaatcaagttgtatagatgagataggtttatttaaaccatcaagattaatatttgtagcatcatggttgcatgatcttccaaattcaacctgtagcttcgatcgaaaccaaacctgtacaaatggtcttcccagttaaagaaatttcaggctgtgctacttatttcaaactgaaaatttccaacctttgaaaaatatactaatttaaatgagacaaccgatttaagtggttcatagctagaaacaccataccttgatttttcctaataattatgtaatagactaatagttaacagattgagccacaaaactctattgtaataaattgctagattccccaaatttaatcactaagtgcattagttacttgtaacggactcaatttcaggggaaaaatttttacgaaatattttagttgcactcttctcaattcttcttttgaagtgatcttgccttctcttaatttcttttaacttggatttagactttatttgcaaagttaatcgcgctcttttaaattttgcaaaacatttctattattttctttaatctctaactttggctctagattatttttcctttgaatccattcccgaacatctccaacaaatactatttcaattcccactcaaccatctctagagtacaggaaaagttgatacctttcctttggacccccaaatatttcccctttgaaatctcgttcatctaaattatccattcaagattttaaagtctactatttagcttgggccaataattcccgattgacccgactctttgttatattccattaaccattttatccttgggactaaaccagtataatttcctttttgctggaatttattctagatcaaacccttgatctagacctatctttagaaatccttgttctctttcatacaacaccttccacaaactcctctagatgttccacttcttctatctataaattaaaccgccagtttgattcccaaggtttgattctttctagcacaagaataatatttccagaataattgttcttgtgctaacaaaccttttcaatccctcctattcaaaaggtccaaaactcctttaaaacctatttaaaaccctcccgtcaaaattcccttagttttcaattccttaaattctatttaaatttcttgtccaaaattcaaaaggttcacaaatatcttcctttataatttttcccctttgaattctagtcaaattcaaaaagtccacaaacatttcttcctatagatttcatctcctttgaattccattcaaaatcctctacacaaaaattccaaaggtttctattcaaatcgggctgaaattcctttttcttctcccctcagcccatctccctcctcagcccaagcgacccagccccagctgagccgcctccttcctcttccctgtgggcctgccgccgccgccgtctgcaaccacagcgtcgtcgccgtctcgccccttccagatgtgccgccgccgacgccgtgctcctcttctccacgccaccgtcaccgtggccaagtcgccgactgccttcgcaaccgtcattcgccaccgcctctcaccgcctatataagaagacgaaccccctccattttccacacaccaatcgagctcttcgagctctgcctctctctctctctcctgccatgtccggctgccacctaccgtcggccgatctccctcaccggaattccactaattaaatccttgcgccatcgggtttgcctcgacgaggtgaactcattttcctagtttccccttcctttacccttccgaaaccaaccaccacagccacctcctcttgttgccagagctatactcttgcctgcgccgttccggccatctccttcactccctttgccaaccaccgacttccccggatgcgcatcgttcgggaacaccatcctctaccggcgcagtcatatcttagccaccacagcatcggcgcccttcctctcctcctctcggttccctggctaacagagaggaagaaaacgaagcaaggagagaagaaccggaggaagaagagacatatgacatgtgggccccacttctataaagtaaatctttttcctttaatttccatttcaatcttcaagcacccatgtctctccaaccacagatcccatcccagtgagaccttgacctaaattcttctaatttcaaactcttttgttttgatatcaaattcctattttaaaattttatttaaatttctttatttgaatacctttttaatttaaacctatttgatttatcttaaatacctttaattttaaatttcttattttatttaaaaaccttttccttatttatttatttatttatttactttctaattttaaattattttaattaacctttaaaaattattttacatccctttaattttaaatttcttgttttatttaaaaaccttttttaaattttaattatcctttagtttctttaaatacccttttctttaccattttaaattttatttatttaatctatttaaaacccctttttaatttaaattcctttgatttatttaaataccctttttatttctaaatcattcccataccatcccttagccactaaaaatccgccgatagaactttacgccttccatggagacgttcgtgtggtctcaaaccccgacgtcaaaccgttggtcgtaaatcctggcataacctaatcctaaggtcgaagtgttgctcttcgcaccctacgcctcaacgcgtacagtggtcagagcctcactactccctcgacctctacagcatgccacacactagctttcggattctgtgcgatccaagccgctctgctgccactcacggctgtagggtaacactttccacccacaaacctacataaaccctcccaactctctagtcgttgtgccacttgattgtagcatcgactagatgggccgatatttagccgttatgccttaacatcggctaaccactccaaatatctagccgttgtgctgcgttactctaggaccgactagaaaaccaaatccaccaaataaaccctacctatccattctatcctttctttgtttttatttgattcccaacctatagaaaccaaaaacctctcttttgttttcaaattaaaatttattttgaactcattcctttttcctctcgcctcgctccaattttatttattccttggctttatcatttctttgtagcaatttgcttataggctttatttgttatcttttcgtattcgtacattagaccgtacagtaagttttatcagtaacttggataaggaaatccgtctctttgatggtgtcatcagtgagtcacgtggtttaaagaggtcggtggttgctgtaaggagggattctttcatagatttgaagttcgaagtgggcgcgtttccatccagtttcgaccagcattatgtttccttcaaggagaaaatccatggctatgatactcaagaaataaagactgattttgcgttaatctcagtaaaggtgacttggtcggctttgctttctggactagagtgatacctctgtttctgtaacagagtgggccaagagtggctaaaaacctgcggcttactaaacctaggtgcggcaaacttggatagtaaagtattgtaataaatctgtcattgtaattaagccctccgtccctgaaaaaaagtacttttagtaatgcatctgaataagtgtttgttgagatgcatagtcggtcaatctctccgtccctgaaaaactgaacaagaacttttagacatgcataattagtttcgtctctgtattattacttcagcactaggggttgtattaattatatggaggaatcttcaaggcacaaccgtagagtggcttctctgtgatttctgcatttctgaatcgtatgttttgtggttatagttatggttttggtactagtgcatacacgtaagttctcattttatcacaacttttgcgacactatggatgtgcaaagtttcaaaaattttcagaacatttgtgccattttcacatatgactagcttattaagtcgcgcgttcgcgcgactataacctttctttctatttaaatgtgtggatacgttgtttaattagtttaaataagtgtctgtgaaacatactttgcaataattgcagctataagggaacaaatttatcttgatctttttcatgaatagcattattataaaaataaattacttacatttatgaatgtgtcatttgtaatattgcaagtagacttgtaatatgaaatgtcagcccttctttcggcttaacaaaatagtaacatgtactctgtaatggctagggttaaaaacttaaggtttctattcatcttcgccattgtttcgctctcactatgtgtgcaatcataagctctctttctgttgcgcctatcatctaggcaccatattcgctgatgcactaccccatcctcctcttatgcatttcattcatcctcttgtttagcaaatttaatttaattttaaagtaaattgcgttgacggtacaataacttggcaggtgggtgcgattaggtgtaaaaacttgaaaatacactgtccagcgtagcggtacaataacttggctaggtgggtgcgcccatagtgcataagttgccacgtaaacaaaaattgccatgttaccattccaccttatcacaattgccgcatcggctttgacacgaaagacctatctcattttatagaaaaccacttaatatcatttcttgacgtacacatatctcctttcatctttcttaacgtgatcttgaggtggttgcgctggtggcggtggcgacgcagcggcggtgttcaagccctaaaccagtaaccaaaccaattcaagtgtcgacgtgatcgctgcaagctttgggatggctccgactcggcgagtttttggagcatctgctccttgttttggtaaatcacttgctgatggttgtagatttctatttcttgttcaattgatggatggtcgcaaagacatcagccaacactgagaagtggcacttcgtcagtcccaaaatagctcaccagatttgctaacccctgcaacccttgcagcttgttcttcagaataagctcctagaaaaagcaaaaatcagatacaagataaaataaaagtgcaggtaatttgtcgtagcttcaaagtcatgctagtgctagtacagatgaggccgctgcaacagctgatttgagtcccaccgagggcacgaccaccatcgcttgctctgaaaccttatgagtgatgatcgtcgccgccaactgcgagcccaaaccgtcgcggactatagtagtgtggagattatgggtaacccatatctacacggagacggtatttggattgggtaccggatacctaatgtagatagaatatcttatttgtatcttgggtttgtttcttaacttgtgtatcaaggaaacaccctgaaatttagtcggttacgactgtatcttacctatattttcatattccgttagggatatagattatcttttgtaacccggactccttcccatatataaggggggtccgggcgcctctaggggcagttgttgatttttcccgaatcatacaattaataatacactcggcggattcatccccggacaggagtagggtattacttcttttttaagaaggcctgaacctgtataaatcttttgtctccgaacccatacactttccaagcttgatagccacccccttttattattgccgaaatctagtttcgacagttggcgcgccaggtaggggttgcgtcaagcttttcgccgatcagtgcaatgggtcccgtcaccggcatcgacgacctcgtcttcccacccgggcaggcgtttcggttcggcagcctcgacttcatcaccagcaacttcggcaagatttctctccttgactcggaatcgaaccagtcgggagagaaccggatctcagtcccgtttggattcccaaacgcggctgaaacctacttcaagaccatctcactcgagtcggcttcaaaccactcggccgagatcgcatcttctccaacgacaccagatcaagatgatggggcttacccaccagtcctgatgaagctccccgacgatttagcggccgtcttcaccacaacagcgtcttcatcccgtaggcctaggcggaagtcagcttcaacaccgatttcgcctagcttcagggaagtcggcgtcatcctccaaccactcggcacggtttcgacggatcagctagatgactacaacagctctcccaccgtcgactcgcgccccaccgacatcgtggagtacgatgagtttagctctcgctaccacgacccagatctcgacgacttcgacggaagcctagatgacaactacacccctctctactttggcgttttcatggccaataacgagacggaggagcaacgccaagcccgggagactgaagaacgtcgccgactggaggaggagcgtcaagcacaagaacaagaacggctacggcgtgagcagcaggaccgtgagcggatcgccaaggaagctgaagatcgacgtcagcgagctttggaagcagggcgccgagcgcgtgatctcatcggccaacaagacgtcgaagggacgccggttttccgcacccctcagcagaatgcggttgccgcgatcaccctactcgacaccctcctcaaccaaaacgagctcaatcgatccgaccacgtcgtcaacatcttgaaccagaccaagaccatgattgcggcctcggttccagttaactctgaaagcgtccacacgccgactggtagccgagttccacacttccggtctcaagactaccgtcatccaagcctcagcatcaccggcgcaggatccaatcgcaggagcaggggtcacgacgagcggtctgttcactcacctcccgaccttcatagggagcgccgagtggaacggcctcgctcaccacctcgtcgccgccccatcgatcttcgcgatacaatcatacagcgccgagcagctcgaggctaccatcactcgctggaccgccacgacgacgaccttgacggagtagcagccttcaccgacgacctgcgtcgagtggattggccagccggcttcaaaccgactggaatcgagaagtacgacggtaccactaacccagaatcgtggcttaccgtctacggtctcgcaatccgcgcagcaggaggtgacaataaggccatggcgaactatttaccagtggctttagcggattccgcccgatcttggctccatggactgccccgtggtacgatcggatcttgggccgaattacgcgaccacttcatcgccaacttccaaggcaccttcgagcgtcccggcacacaatatgatctctacaacgtcattcagaaatccggagaatcccttcgggagtatatccgacgattttctgaacaacgtaacaagatctccgacatctccgacgacgtcatcatcgccgcattcaccaaagggattcgccacgaagaattggtcggcaaatttgggcgcaaacctcccagaacagtcaagctcatgttcgaaaaagccaacgagtacgccaaagccgaagacgccgttaccgcatcgaagcagtcgggtcccagttggaagccgaaaaatacgccggctacgggaggaggtggaagtaacaatcataaggaccgcaagcgtaagcctgaggaacttgttgcaaccgccgctcattcttctcgacagcgttcgcgcgtcaacaccttcgacaagatcatgaactcccaatgcccgcatcatccaaactccaaccacgtggccaaagagtgcttcatctacaagcagttcgcggagcagtacaccaagtctactcggaagaactccgacgaggaacaaagcacgtcaaggaagaaggacgacggcgacaccccggctggatttcaagaccaccgcaaggagctcaaccatattttcggcggccccatggcttatgagtctaaacggaagcaaaagttgactgaacgggagatcaacgctgttcaacccgacacgccccagtatcttcgatggtcagagattgcaatcaagtttgaccgctcggatcatcctgaccgagtggtccacccggggcggtaccccctggtactagacccagtggtccgtaacgtcaagcttcgcagaaccctcattgatggcggcagtgcactcaatatcctcttcgccaaaaccttggatgatatgcagatccctcgctccgagctgaaaccaagcaatgcgccttttcacggagtaatcccaggattatctgcaactccactcggccagatcactcttccggtcacttttggcactcgggaaaacttccgcacagagaatatcagctttgaagttgccgatttcgagacagcataccacgccatactcggacgcccggcgttagccaagttcatggccgtcccgcactacacgtacatgatgatgaagatgcctggtccccgaggagtcctatccctacggagcgacattaagcaagccgtcacatgcgacaaggagagttgcgacatggcccaaactcgcgagatggcgtctgcccgagaggaaatccgactggctgcaaccacggtgagcgaaggagaagtgcccaccgccaagatttcaaaaagtggggaaaccgaagccaagactaaaaagattcccttagatccttctgatcctaccaaaactgctgtaataggcgccgagttagattgtaaataggaaagcgcgctcatcacctttcttcaaaataataaagatatctttgcgtggaaaccttcggatatgcccggtattcccagagaggtgattgagcactccttacatgtcaaagaagacgccaagcctattaaacaacgactccgtcgatttgcacaagacaggaaggacgcgatcaaggaggaattaaccaagctgttagcagcaggcttcatcaaagaagtccttcatcccgactggctggcaaacccggttctagttcggaagaaaacagggcaatggcgcatgtgtgttgattacactgatctcaacaaatcatgccctaaagatccttgcgggttgcctcgcattgaccaggtagttgactcaaccgctggctgcgagcttctcagttttctggattgctactcggggtatcatcagatccgactgaaggaatccgactgcttgaaaacttcattcatcacgccttttggggcatactgctacgtcaccatgccgtttggattaaaaaatgcaggagcaacttatcaacgtatgattcagagatgcttctcaacacaaatcggccgcaacgttgaagcctatgtggatgatgtagtcgtcaagaccaagcaaaaggatgatctgatctcggatctagaagaaacctttgcgagcatccgtgctttcaggatgaaattaaaccctgaaaagtgcaccttcggagtaccgtcagggaagctgcttggctttatggtgtctcataggggcatccaagccaacccggagaaagttactgctatcctcaacatgaaaccgccaagcacccagaaagatgttcagaagctgactggatgcatggcggcgctcagccgattcgtttcaagacttggcgagcgggggatgcccttcttcaagctactgaagaaaacagataatttccaatggggacccgaagcacagaaggccttcgaagatttcaaacaactcctcaccaagccaccggtcttagcttcaccacacccgcaggagccgttgttgctgtatgtatcagccacctcccaggtcgtgagcacagtcttggttgtcgagcgtgaggaagaaggccatgtccagaaagttcagcgaccaatctacttcgtcagcgaggtcctcgccgactccaaaacaaggtatcctcaggttcagaagctgttatatggtattttaattactaccaggaagctgtctcattattttcaaggtcactcggtaacggtggtcacatcatttccactcggcgatgtactgcacaaccgcgaagcaaatgggcggattgctaagtgggctttggagttgatgtctttggacatatcattcaagccccgcacttcaatcaagtctcaagcgctagctgattttgtcgccgagtggaccgagtgccaagaggatacccccgcggagaaaatagagcactggaccatgcatttcgacgggtcaaaaaggctttcgggcactggagctggagtggttttaatttccccgactggagaaagactaagttatgtgctttggatacatttttcggcgtcccacaacgtcgccgagtatgaagccctccttcatgggctacggattgcaatttccctagggataaagcgtttaatagttcgaggcgattcacagctggttgttaaccaagttatgaaagagtggtcctgcattgacgacaacatgatggcatatcgacaagaggtacgcaaactggaggataagttcgatggactcgagctcagtcatgttcttcgacacaacaatgaagccgccgacagacttgccaattttggatccaaacgtgaggcggcgccctcagacgttttcgtcgaacacctttatacaccgaccgtgcctcataaagatactactcaagatgcggacactcatgacatagccatggttgaagccgactggcgagagcccttcatacgatttttaacttctcaagagctccctcaagataaagatgaagccgagcggatttcaaggcggagcaaactttatgttatgcacgaatctgagttatacaagaaaagcccttcaggaattctgcaacgctgcgtatctttagaggaagggagacaattgctgaaagacatacattctgggatatgcggaaaccacgctgctgcgcgcaccattgtcggcaaagcttaccggcagggttttttctggcctactgcagtatccgacgctgacaaaattgtgcgcacatgtgaaggttgccaatttttcgccagacaaattcatctaccagctcaagagttgcaaactatcccgctgtcttggccgtttgcggtttgggggctcgatatggtcggcccgtttaaaaaggcagtcggcggttacacgcatctctttgtggccattgataaattttccaagtggattgaagctaagcctgttgtcacgattacagcagataatgctcgtgatttcttcatcaacattgtgcacagattcggagtacccaatcgcatcatcaccgataatggcacacaattcaccggcggagttttcaaagacttttgtgaagactttggaatcaagatttgctacgcctcagtggcacaccccatgagcaatggacaggtggagcgagccaatggcatgatacttcaagggattaaagcacgtgtttttgaccggctaaaaccctatgccggcaaatgggtgcaacaattgccatcagtactttggtctttgcgaactacacccagtcgggccacaggccagtcaccttttttccttgtctatggggcagaagcaatgttgccgagtgaggttgaatttgagtctttgtgctttcgaaatttccgtgaagaacgctacgaagaggaccgagtggatgacttgcaccgattggaagaagcccgcgaagcagctttaattcagtcagctcggtacttacaagggttgcgacgttatcataatcgcaatgttcgatctcgtgcctttctagtcggcgacctggttttacggaaaatccaagccacacgagatcggcacaagttatctcctctatgggaagggccattcattatctctgaagttacccggccaggttcatatcgactcaagcgcgaagacggcactctcgttgacaactcttggaacattgaacatcttcgtcgtttctacgcttaacttcatcattgtatttccctattttgactgtcaacatcaagttttcttcttgccgttgtcagtcgggggctatcatcataataatggagtatgattttttatcaattcagtttgcttacttggtttatcattgccttgtttggtttttctacttagtttgcgaggactgaaagtttttaatagcttctttgggttttaggctcaaccaagcttagcaaaaacttttaagaaatcaaaaacttcgcaagaatcatcaagcacagcataaatacaccagtattgtacaaattgagcctccatgtattacatccaaactcaatcagagtcagtcctttcgtcatcagagtcatcattactcggctggaggtcgttgttgcgaaattgttccacaacatcactcgcaattttgtcagccgcagtttgcgcactactgataagatctagggcagcttcttcacttgtcccgtctgcaaacccatcaatggtgtcgacttcaattctcgggtacaaggattttgtcatcgccaaggccatgccagctcccatgcttccagccttcttgatattcttgaaatatacttccggagcaacactcagcttgtcaaatatttcggttgcgtcgagtgtactcggaccaccattattgaggaacatggcttggataattggtgcagcggcattggcgacgtcatcccttgctccttcaagcctcttgatcttaccaactaggacgtcaaactgagcttgagacttgattttccggtctacaaaacacatttataatcagaatctactgcatttaaaagaggaaagttcagatcatcagccggcagtaccttcaacttctttcaaggctgagtccctttctgcagccagttctgttttgtcttttttcaaggcttcaatctgtttttccatctgagctattctggtggcttgcgctgtttgaaatccaagtgtttgaggatgcaattatgacagcataaatcaatggaacagatctggatgattacctttggatgaaccactcagctcatagtttgaatcttggagctgagcgattcggtcccttaactctttttccgtctttttggcgcactccttggcctcatgcagctggtccctaactgcttctagtgttcccaaatgaggaaccagcttttccaaagttgtagtcttggcctcattgcgaagatggattctctgcatgatggatcatggttcagttctgctaaaaagaaaacaaagttaccgaaggccatcactcggaagacttacgtttacaatacgagtggcttctccgagcgctttcttcagctggcacacttcttcatcttctttctgacggtttatgactataccggcggcttgtgagttctcgtcccaccatttgatcaagataggaggacgagagtcgtcggtcgcctttatgcgagggatttcttctccgtcatcacctgatggtcctgatgtgtttccaagacattagacgggtacactgaggttatttaaatcgccattgtttgagaagacaactaacctgaagatgtgcctagctgggcgtgaggtgatctttgttctttacctgaagacccagctatcgagtcgttaccagcctccggtccttgcgaagtcgtcgtctgcgcttctacttcgggaatctcttgatcagggcctgcgtccgactggtttccagtcgggggctcttgagttgttgccgtttcagttgttgccgactggtttccagtcggcggcgggtcactcggattggctctatcgcacgaagcatgggcgccagtcggctgactttcagcggtcggctggttttcagcagtcggctcggggtccttggatatactctgctctgtcatggcaggatcggggtcttttccagatggatctatatcagatggtttcctgcaaagtgttctttcggtattcagcatcatttttatgagcaaaacatgccgaagcggaatcatatcgagagatctaatacctggaagatgttctgatctttggcattgcacggccggccagttttttcctgggcatggtacgctttgggggtttattaggcgaacctttatccccagatttatcatcgtcgccttcatcatcatcaagtaccagctttctcttgcgaggacctgtttgaccagccaatttggaagtctgaggttgcggatctggtctgattgttggccctccacctccctgagtggtgtgttggcgaggagaccggcgctgagagattggtggatctgacttcatcaatgcatattcctacacaagatgcttccatagttagtcaattcagcatgaagataaaactatgttctgatcatggtttgagggtttccgatgcatacctgtggaggcggattgaatgcattatatggcacgactggcagttggtgagagtagctgactacaattgcatttgagaagattttgtacatcctctccttcatgattttgaaatccaaggagtctggttcttcacggttgggatcatgtttgccgtcgaactcgaatgctgtgcgggatctttccttgattggcgccagtcggcatttgatgaagtgccgagtgatttgctctccctgtaagccttgttctttaaggtttaacatacgatccaacaactccaaggcttgtactgcttcatctccgatcggaagagagttccaagtgtcttggtacattggaggaagacaagagtacccgggaagagcaggctcgggattctgaacatagaaccagttcgcatgccatcctttgttcgaagtcttgaagggcatcgagaaatatttttggcttagagttccccttagttggaatcctgcccccccgactacacacggtttgttcttgtttggttggggtttgaggaagaagattcggcggaatagggcaaagtgaggtttgatccccaaaaaggcttcacaagcatggacgaaattggcgatatgcactatggaattcgggtttaggtgatgcaagctgattccatagaaattcaagatcccgcggaaaaattttgaggtcggaagagcaaagccgccgtagaagaaatgcgagaagaccacgatctcatgagtatccggagacgggaaagcctcaccgtgcgctggtcgccacccgatgatttccttggcaggaagaacgccgtgcgccaccatctccttcagattttcttctgtcacgtcggatgtcgcccattggctttcgaagctttctccctcttccgccatcggtttcactcaaatgtgctgatttgattcgagggatggcttgggagaggtgagggattgaggcggtggatcacgggaaggattttgatgcacttttttgaggtggatttggccggagttgtgaaccctagttcgccggcgcagctttgcactgtagcagggagtggggaaaatggcgagagttccggcggggaagacgaagcgtcgcttggatataggatttttcagtttagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgctcaaatcctttttatgcggtcatataattctttggaattattgcaatgcaaattaaaaaggtgcccgacagaaaggcgttatgctatttttgcaagcttttttaggctacaaaagctgtttgggttaactaggaatgacttgtttttattatagtcatttccttggcgtgttatatgcctgttttcacggtaaatagtcatggcctaggctatttgacttttttattaccataatctttataatacttgatgggtaatctttagagtttttatattcggatacctgtcaagtgtgttcattcgtgaactttttagagtgtaaaccactcggatttcttttattatggctaaaaagcagtcggctaacatgcctatttaggcgccgcatacgcttttgtcatataatgcacaactgtgttattattttgtctttcaactatatgtttagtttgttaactaatcacatagttgggggctacacctaattaggtgcatctattcgatgcaccatattctttttcttttcgccctttacagtccacttggcaggttttggcttgaagagttagaagtactcggattattatctttgagaaggctatgatggtcgactgcaaaggactcgggggctactgtggagattatgggtaacccatatctacacggagacggtatttggattgggtaccggatacctaatgtagatagaatatcttatttgtatcttgggtttgtttcttaacttgtgtatcaaggaaacaccctgaaatttagtcggttacgactgtatcttacctatattttcatattccgttagggatatagattatcttttgtaacccggactccttcccatatataaggggggtccgggcgcctctaggggcagttgttgatttttcccgaatcatacaattaataatacactcggcggattcatccccggacaggagtagggtattacttcttttttaagaaggcctgaacctgtataaatcttttgtctccgaacccatacactttccaagcttgatagccacccccttttattattgccgaaatctagtttcgacaagtagggtgaggcatagctcctgcagctgctggttgcttgtcgtgcgcgataggaggtccggcggggatcccctgcactcgtcgtgtccggcggaggcggcgccgctggctgtggacgaggaggggaacagggacttgacgttgtcagagactcgatctgcgcccagcgaatgtggaaggaatgagccagcagcggacgcggagctggtcatggcgctgccggtgttgccgaatccgtaggacgtcgaggtcgcctgctcggtggcctctggctgctccgtcgacgccacgtcgggtggtggtggggcctcagcgcagtcgatcggggagctcgtcgatggcggccttggcgttgcacatgagccagtcgacgaccttgcggggctggtcgtagaaccgaatggcagtgtgccagtgtgcgcggcgaggcggatgcgccggtccccgctgcgtgtcccaaccgttgtccctcttcaaggatccatcgccagttgtttactagccgcgctgccgctgccacgaccaccgccgtctccgcggcttcctccagatctttcccatctttctgccaaacaatgggaaaacagatgaatttgaaaaagaagtaactggaatataaaaattactatggacttttttttgtaaaatgagatggtcaatgctaatgtggcactttcgctgaggtggaacaatggcgtggcaacttttgcatcatgagcgcacccacctagccaagtttttgtaccgctacgctcggttttcaagtttttgcacctaatcgcacccacctgccaaggtcttgtaccgtcaacgcaaattttacatgcttgaatagatgtttggagaacctatttgataggaagtctagatatgacacagagaaatttattttgatccatgataaatgaatcgaataatgataataaattatttactctggctacattaaacctatggaatttatcgtaaaaaacaaaattataaattttcctatatgcatatatatcatgttatcatttttttctatattatgcgtatgtatctgcgcattctaccaaatttcttataataatatgttgtactaaatgtcttaggtattaatttatatctctagaatatgcctaattatttaataacattgacatatatgcattttgtaacttatggggttagtttgtagattatattttattataggactaaaatgcaaaaaggtcattacatccccattcccccattgtacctctacacttccacagccctccttttcctttccattgctgtagctgttcctcattcttttttctctcccgctaatctgttatctgtggaggactccagatgataaaatgatgtggaattgtttgaccgacttcctccttttacatcggacggttaatatccattccaccttttctttgcttcttaatccaatggctatgaattaatacatgacgtggctcagtgttgtgaaatcttgaaatttacttttcacaaatgtagatatgcacagtttatagtcgacctttagattcagtcctcattgtttcgcagttcatgttatgatagataagggctgctgaataataacctggtgatcttaaagtctaatcaattcaattgcctgctcaattcctagcttgcctctaaatattttgagagggattaccagggaattgaatgggctgctgctgccatagcatcacaccccaattttcgttcgggattaaaaatcatttaataatttattttctagaaattaaattaaaattaaaagcaatttaacaggtgaatttaatgagggaaataaaatttacttttaaaatcatggctggaaatatttttgtaatattctccatgccctaaaatagtctctagaatttcccgtggatttttggaggtcaagaagtatttttaaaagcacaaacatcacttaatcaattaattaaattgaaaaacaaataaaaatctccttctttctatttgggccatttggactaagtccacttcgcctcccttgggcccgtccccttctctcttctcccggccggcttcgtccctccctagtgggcctcaagcccgctagcctcctcccttttcctctaagtcgaattgacgtccctccttctttcgtgtcgccaacaggaagagcccacctgtggggctcacctttaacctgcaggcacctctcccgaaactgccggcgttccgtgcctcttctccgcaccccatggaattggtgcggacgcgggtcacctcccttcctccaactttttgcccccatgtcctgcactgaggccctgtttagttagtaaaaaaaaaagttttggctttatgtgccacatcgaatatatagacacacatttgaagtattaaacgtagtctaataataaaacaaaatgcatattccacctgtaaaccgcgagacgaatttattaaacctaattaatcagtcattagcaaatgtttactatagcaccactctgtcaaattatggcgcaattaggtttaaaagattcgtctcgcaatttacacgcaatctgtgtgattgatttttttttctacatttaatactccatgcatatgtacaaacattcgatataatagcgtaaaaagtttctgcgtgagaactaaacagggcctgaatcaaagagaaccaacactatctgtgcttgctgatgcatggtaatgtggactcttttgcggttctatactagaaattttgtggacttgattactacgagaaactttgtggcaagatcatgttatgttgaaaaccatccgtgtagtagtaatttatttactaagagaaatcttgtggtgataccaatacgttaactctaagtaatttatttactaagagaaggtgtacaaaccaattaggagtactactatcctaagtaatttatttactaaagaagagctgagaacgaactaagagtaattcatttactaagaggaggaatcaaattgagaagggttgaaaacaacctgggagtaatacatttacctggtgcagctgacctgcaaagaatgcaaacatcaaaaaagaccagcaacgcataacatggctactaaaagtataattacatccagaaagtatgagattgggcagttagccatgaaagcaagattgcattctagaaattagtcaccttcttttcacccatgctctattgaacatgcaattatatctgtgcttatgttaactttttctgtgacacactagattgaacctaaaacagtatagttaatgcttatgttacattgctggaaagcagcatgagtgaatgctttttaataagtaggctagcaccagattttatgatatctcaggattagatttcacaattattcatcattgttttcatcctgagaaaactaacgagtgaaagaaccttaaacatgtgtcctctcggctctcggccacagcaggaggcatatatgtatgaagcaaaaacatactagtcaataggcattaatcgataagcaataacgcaatcaacagtacggtagaggacatgcgcatggtaagaacgcaatcaaattaggccaagttttagttccaaaatttttcttcaaacttctaacttttccatcacatcaaaactttcctacacacacgaacttgcaacttttccgtcacattgttccaatttcaaccaaactttcaattttagcgtgaactaaacacacccttaaccaaatgatgtaaatactctacaggaaggaatgcccacaatccagcagtacggaatgccacaaccaaattcacacatagccacaaatcaaaaatcaaataaaatctagccaccaagcaagcacacgaccaaaaatatacatcgtgtacgatcctatccgtgctccctcacctcaccggccaatcccccccaagccctagtttccccacacggacacacaacattaattaatgcacgaacaatctcggtgcgccgcgccccggtgagttcatccccggccgcgcgcgccgctcaccatcgatcctcgtctccggaggaatcaatcgccttcaccgccgcccccccccccccccccctccccctaaccgctctctcgtctcctccttcctctcccccaccgatcgacctccaccgtataccaccgcgcgcgagctagcgatcaacaacctcgctctccggtctggagaacaacacctacacaccatttcgagacgagatccaatccaggaaggcagattagccggaggagaactcactttcccatggcagcgacgaaggtgaccggtgacgattgcgagcgattcgctcgaggtggtgggggtttctggggtttctctctctctctcgtctctcccccttctctcacaagtcagaactcaccagcggtcgaggctatatatttgaattctcgatcgttcagatccgaacgtgcggcagcgatgccatcggctcaccgcggcgcacgcgggaatgggcccacctgcttacctttgtgtaattccggtttggctgtgcaggcgcggcaaatatgggaatttctttttactactttactgtagatacatctcagctactgttgtcgctggttgtaaagcagcactacttagtttctaccagccatgttaggggagtttctaccggccacagcttctcagataatctcagcttccctaaacaacccagattatcaaccagattttaaaaatttataattatagaatctataaaataattagaaatcggaatggataacctagcttctctagaaatagggtcttggttgtgttgttcccactcctttcccaactaatctcctcgtttttcgtgcgcacacttcccaaactactaaacaatgtattttttaaaaaagtttttatacgaaaaattcttaaaaaatcatattaattttttaactaatacttaattaattatgaaaataaaccaccgtgtgtttccattcaatcccgaacacaacctaaataaactggtttaattcgttagcatgtaaaaaaagtaaatttcacaaaactacagaatttttatcaaattatcactaaactacatatttagtgtgatatattataaaactacatacttaacactaaatttctcacataactacatctttaaggtggagtatcgtaaaactacatatttagtaacaaaattattacaaaactatatgtttagtgacaatttaatctaaagttacatgtttataactcaaacataacactagtgcgaaggacttaaactctaaaatctatagtttcgtgataactttgttattaaatctgcagttttgtgatactccactttacatctgttgttttgtgataaatttagtgttaaatctgtagttttgtgatacatcatcttaaatatatagttttgtgataatttgatcaaagttttgtgatacgtagttttgtgaaatttacttaaaaaaagtttcaattcgtcgatagaggttccctcacctctcccggtcgcccacattgcctgagcttgagcttaatcggttccctcaccttcctcttctttttctctggaccgtcatagccctcgctcttattgttgtagactttccagtgccactcagtcatctcctacgccggccgccggccctctccccgccaacgggctctagagaaagtgagggggagagatggagagagtgaataggtgggagtggtataagtccatttacatgtgagtattacatattttttttattttttaactaagataccacgtcaaccaaacattgattcgtatgatctgtatgattttattcaacccagttttaaaatatggggttcaaaaatctgattttattctccttaggtttccgccgccaccgctcacggaactacgatccgacacgccctcgccgctcccccgcccgctcgcctgcacacacactctctctctctctcttcatgtatgttgtcggtggatttcccggatcctctttttttttccggctgttcctaagggagaaaacgtgtgattttcggtatcgcgtgagatttaccattctgctgtagttgctagaatgctactccctccatatcaaaatataagtattttttacttctatatagtcttcgagatgttgcttggactaacaatatcttaaaaaaataaaatgttttaaataaaaatgttgcatattatgattgtttgtttaatgataaatctagtaacgtcaattttacatgattgagctttttttctattaatagtcaaagttaaaaatgtttgacttgacaatatgctaaaaatgcttatatgttgggacagatggagtagttgttattattacttactgcaattgaaatgatcataagtagtaggttaagttaagaacaagttggttttgtggttgtatgaattcgttccggaatgtttgggatgccaccatgagcttatcattgttagaatcggactcaacgacccttacaatttacatatcataaacaataagcaggatcgttggtttttccctacaagcattggattttacacttactagttttgttacaaacggcccaacacagattctccatggagttaaacaaagaacatatcctcgtaagttctgctctccagttcccgtcgtaataattatattttttcatttttattaccgatgctttaattcattaatttagcacaatctaattattgtagcaagtggaggatgaagatagactcagcatgcttcatgatgatattttactatcaatcctggggagagttgacatttgtacagctgcaaaaacaagtgtcctgtcaacaaggtggaggcacctaccttggcagttaactaaactggataaccaccgtgtacattgacgaagctatgtcaactctcaccaaagcagcaaggagtctgctagctgtgccgcagagagaaaccttcattacaagtctatgccttaagctctacttgatgggcaattactcgagagataaaggatttctattaagtgaagcgattgatggtggaatagtaaaagatttggaccttgctattttgaacgagaaggaacctgaagattgcgatgacaaagatatgttttgtcaggccagagttctgaaagcctttgctggtgcttttcctcgtgtgcttcacttcctcacaaggctctctgtacaacgtgttatcttcaccgagacattcatcatattctgtttgactgttgcactcagctggacattgtaaggcttagaaattgtgatgctgggtccaatgctgtatggaaaatagatgcgccaaactcgaaactccgacattctggagctttcgttgtgcagcttttggagattcgagttagcctgcctcccatagcttgaggaggtccattgggagatttggttctgttcctatgcccccttgtcatttggcttcgtcccaagcctcagggaactatttcttgcatgtggtgcccaattgggcttcgaaggcttcatgttaagcgaagttttacaaggcaccaaagatttgcatactttgacaatagatttccaaggagaaaaggtaattgaatatgtcattttgatgaatcattattatttttttatactataactgctacagtgagtacatgcttttcattactatgaatctgttaattcagttgtgttggacttttgcacaagtcatgaggatctagcagtagaatgctgtcatagtttcagttggttcagttctagtactacttaggtgcattcaccttcagtttttattttaataaagaaacaacctacttaggagcatgcattcttcattaagaagaagaaagacatctgaatttgagttaaaaggacaccaacctaggtggtgtgctgtgcatctacacctctcagttttggttttaattcctcttcactcaagacttgtaattgtccagaaggattttattattaggaacaaactgagactaacccttgtttgtgcaatcatttaaactcatcggtgtgctttgtttctgttttttttttctcttttcagctttgggtacaacctgaacaaaaacaattctgccctgcattcaacaatctaaagactttatctattctttgtgtttatgttgaatttgacctgttatgggctttaaacctccttgaagctgcgccatccgttgagctacttttcattgatgtaagttttcctttcgttttttcaaaatgtaacaacatgacagtaaatgtagctggaaattctcactatttgcaaaagatttacacaaaccaatttctcacactaaatgcagacctgggaacatatatgcttggtggaccaaatggatgaagagggaagaaaggatatctatggagaaagaacacatccttcatgggagatatccgagtttactggcaccagaaaatggcgattgaaaaaactccagtttgccggctttaggccactcaagcaacagctggtatttttaaaagccatcatggatcttagggacaatatttcatcgccatctcagataattttcctgtgaatcagtagaatttgtgttctatagccgcttcagagttctatatgtaaaaattttactgtgcagcaatgatcagctcttgcatgttaatattatattttaattttgagtaaattgtatgcgatctagtgcaaaaaaattgaaaaatgagcaataccagtacaaaaacttgttcgctttgataagcacatctacaaagcatgcaagtcattgttcaactgcattggttctccaatgatcacaagctgaatacacaccggcagccaactgccaacctaaatatccaaagacatacttcaaatgcatacacttcttttgaacacattgcgtaaggaccattatatattgtagtcaaaggtttaagaaaaaacagtcaaaagaatacgttccgatccatatcctcgtagcaaatactagcaagttgtcaatgagacaaagttcaattcaaatatggacgatccaaaaaaggattacatcaaaagtaaggtacactctctgcagtatgatcaaatctctcaaatcatcagcaaacatacaatgcctaccaacaaaagaatcagttgattgaagggatgaactgaaggagcccagttggagccagggggagcaggggagtaatcacctgaacccgagctcgtgctgaggacaacgaccacccaatctccctcattcgcgatcccaacaccagagaacttggtgtcattcagatactggttgtactgtgacttggtgtagttggtcagaaccacatcaggtacaagtccgggaacgcaggccggcatcacctgaccgtctccggtcaccgacgcgttgagatggcaatggtcgaggtactttgggtagtcggggaactgctgctcggtgccagggacagtgtttgctccggtggtgttggtgcaaggttggtctttgaattgctgtgctagctgctcagccaagcaggcagcattcttgttctcggatagcgcagggactttgagggaagctctgtagctgttgatgcccttgagaagctgtgaatcacttcctggaaatgggaagcagtgtcaaacaaacaatgtaaaacaatgattgtatctccaagttttcctgatttaacagtggaatagtttgcatgcatatcagatctcgaccagcaaaaggtagaattttatcgttcgatcttcagcaaatgataatcgtaataagtactgttaacaaatgacaagtgtatgaataaatgcatctcaataaactatgatacttcatatgtcaccaaaaattttcacttgaaagaattttcattcgaaaccatatgcataaaaactgtgccatatgtacctaaacacatcaactccaatacatagcaattgtgacttaagttactgaaaaattttctccttagcagactaccactgagtcctccccgcaaaaaataaaataaaataaaataaaaaatctaccactgagtcctaaacatcagatcttgcacatcaaaagctggatttgtacgaaaacagcttcccaaacaagattttaactcaaaaaagaggaccaagcaaacctcgaaagtggctcacaaatcatgaccatgtgactagttacatcaaaatgtatagaacaccagtgaccagatctctgaccagcacaaatgcccagtgcaaccgcttgagcgttttctaagcgatcgaacagagacaaactaattcgtacggattgaaacaagaatcatcttctgcagactcccagatcccatgaaccaattaaaactcccagagtaattctcaattgaatttgagcaacagggcagctaaatcattgcactactacacagcagccaagaacacgcactccagcgaatcagatccagacacactacaacaaacaaataatcaaaacaaaactacaacaattctaaccatcgaagcccgaatcagattgcaggaagagcagcgagagccaataagccatttttaccatcagatctggcgcaatgcagcaaggaggaagcgaggacgaggaagcagacgagggagatcctggaatccattctcgccgacacaattcctcgctgctgcagcggtgttactgttgcctcggccggggaggaagaagagtgaggtgcgaggcaggcaagaagtaggagaggagtgaggaggaaggaggcgagttgctgtcaccaaccacttctttttaattttactctttattgaatcttgattaatctttactcttccttccggtctgtcctaaaaactttttagtaaaaagtggtgataaatgtttttattagggtccttattgtatatttacactggcaagataattcgattacttttgtatcttgtaccttctgggccatttttcactggcaagtggtaactttttgggttacagcctagctttagcagttgtagttaatttgcttaaaaattattgtggtcacataacttcaataaattctgaaaggaactgtataacagtttttatttattatatatccaagtcaccttcattacattttttatatatttataaataaatagtgcctaaagaaggtctagaaatagttttgttcctcatgtgaaaaataattatccctagagtcgactgcaggcattagatgctttagtagtcataaatttccctgtataaaatcacggaaaaattgtgaatgatgcataaataacggtaatgatgcatgcgctgagtacattttatttatttatacatacaggtcgatattcatatgaaggaaatacaaatacaataatgtagattctgagaaaaaatagccccttatttcacctgactataactctataagttataacacttattagcgataatatatatatatatatatatatatatatatatatatatatatatatatatatatatatattcttaacgatttaaaaggtagtattgaaaaataaactacgatgaaaaatatcaaaatcaatttaaaattaaattttaaaatttaatttttggttatggctacgagctatttgtgttttaagttaatacatgtttatggcatggtggtcgtatagtactccctccgtcccaaaaatacttaatgagaagtggcaatgaatctgaactaccctttattcagattcgttgttctagtaggggtcacatcccctcgcttgagtttttttcggacgaagagagtatgaccctgtttagattccaatttttttcttcaaactttcaacttttttcgtcacatcgaactttcctacatgcacaaactttcaacttttctgtcacatcgtttcaatttcttcaaacttcaaattttagcgtggaactaaacacaacctatatttgcatgggcccacccccattatattctctgtgcttataaaacaaacttcatatactctacgaaaccccaagctgtcggtgtttctcaagtagttgctacaacgtgatcatctgagatgcggccacaaataacaaatttattcttatcaggaaaagaaaaaagaagcattagttgaattaagccatggacaacgtgaaacaaataaaagaagaaaggtgcttggtcgatgcttttcatcatcaaataattaatttcgctgcgtgtgcgtcttctccggttggtcctgcactgacgttaaaaaggttggtgtagatgatgatgatctgtgcagcgagcgagcgaacggcgggacagagagacagctcaccgtgtggcgacggcgatggtggaaccgacacagcgtacgccaacactcaacacgacgcggcggtgggtaatacgcagcgccagtgcactacgtacgtaccttacctcattgtttgctaaattttaatttcagaattgattttaaaatttttttaatgtagttttaaaatattagtttcctgaccacatatttacccctatattataacttataatcagctcttaataactaaccaatggaagagtgaatcactgtgcagtcgcagttgagtcacttacacaggacatttaaactatttgccacctttaatatgtgatgtttaataatttattactcacaatctatgacgtgcccttttacatatctacaagtacgtagtaaattgttaaatgtccacttacatataagccccgctctaacttttgtgcagttttcgacatttcctgtgaatattataactgtaaactgtgtatctctataactgtgtacaaggaagcctcacccaacaatggagttgtggttcattttagcaatgaagggcttttagtacttccaattctaacgcaacatattgaacgcacttaactgtatgaatatatcggacgcactcctacatcccgctgcgatgcaagtcgaccacggattcacgacccagagatccttttaacccctgactacaattttttgccaagattttcctgactcgtatttgcatacactcgaaaaacaatcgcactggttccaaggctaaacatctgcattcatgctctgaaactaaatctctttataaatatcaaatagagcactaatacgagtaaagctaaaagccgatatttcttatctacatgatgagactacgactagttcacggttgttgccaaataaggttaatatttacatcacctacgagcaatctcggttaggctacaaaaggctatggtaaatatttggccaggcgacaataggctgagtttgttttcacttttcagaaccacgggtgccatgtcggatccatcatgcacaggttcctcgaagataatgccgcttccacgagatccgtgacgcctctttggaccgactgaggtggctcagatgaattctcctcctgaaatagggagagaaaatgctcccagatgtgaatataagagcaggtaaaatagcaggctataagctagctataaacatattttaaagagataaaggaagagagactcccaagaagtaatgtgtatatgacagataggatcaggtattaatagtatagtaagcaactaatgtatgaattgggtattacattggctatagatgatttggagctagcaattggctatactattaaacttgatctaacttgaatgacttgataatgaatttggacttgctaatgttactatccaaaatggttttccagttgattgaagatagcaatcctaaaacatagtactaactgatagtaggtgcgcaacaaggtgaaatcagtagggaatatagtgcagtattggagcattgctatcatgtgaaattgtctaactaggaacaagcgagtgaaacacctcggcttgctgaatatttcactttgtgcataagtggcctctccaaataacaataactaagtaaagaaaggattagcagtgatagcattatcattttaaaagttaacggccagctagggaaataagcatgactgaaatcggaaaaaatgatatatccagagaaacaaaaatcaagtttaaagaaatagtttacctcatcagcaagataatgtggtgatattaatttgatacgggtaatgacatgctccacattgtttatcaccttttgctggaaatccaacgggttaatcattccagcagcaactggaacagaaggaatgccaagtggcctcctccatgaccaagataacagttcatcacggaaaaacatagccaaatggtgccatatatgctggctttgctgaaaatcacaaagaaaacaatccgattacgtaggaaaaatagaaagatgaaccacaagggacaatcctaatattaaccaagacggaaaacaattaacagtaggagtactatcattagcgcatcctactataattcactctttaaagaatgatactcacttttggtgaaaccacagactgggcagcagaacacatggcagacacaatgagaccttcaacaccgaaatttgagaagaaagcttgcatattgcgtgtcagcctaaagggaactagctcattgaactcaatcattccatttggatcataagctgcagataagcaaatgtgagtaataataatttcacgtgcattatttacaattactggtaataatcaagaagagtacctggatggaaatcattctggaagatcttgccagtatttttagcaaataatattttgttaggagccctaccaccaatctgcaacatgtacgacatgaaacaggacagagccacttggattgcaaactgtttcttgaaggtccagaggtgattcccagttggtagaatcttatgcatgtattgagagaagatattatcattaacgatatttttagtaatttcattataggcttgcaagcgtaattccaccactgcttcaggggacacctgccctgagatggcttgatttagctgttctttgaaaattgtaataggtgaatcagcttctctattatgtcgggcacagttaatttcatacacctccaggaaagtgctgtacatcaaatcatcctctaccatccgaacctggatcaagggaaattaaacataaggccaggatattaccttggaagctgaaataaaacagctaaacatgattattatcaggtatggaagaatggaaggtatttcacctgtgaccaaacaggaataatgattggggtgtgaatagcaagatggcgctgcctcgactctttatgtttgtcaaacattttgtttagtacacggaatagctgcagcattctctcatcactccgggcatttggagtcaatgatgtctgaacaataaaatggcgctgtgaaccatcagagccaataagtgtcagacgtcggaagctactaccgtgcctccggacaataggaatatcaggtccaactctgtccaacttgacagtatgatcaggtgcaacctcctgcaaaagacaagtaaaacttaaaactagcacatagagaggtgaggaaccgtgcgagaagcataaaactttcacaagactggctaaccatccatatggtaagagataatgatgagtgacatattgacttcaatactgaggataaaaggtaatcactgtgaccaacctgatctgtgaagtactgcccgggaagttctatatcaacaacatggaagtccctgagaattttactttcttcctctagctttaaaattgcagggaaccgatcctcaacattactctgaagaacattcttccagtgcttcaatctctcagtgagttcagcaagtgttgctggaaaagtagtagcactttctgggtcaagatcacgttcaaaatcttgcttgtactccttgacaaaatcaacatgcttgttaacagcatcttgtgaaaagcaagctcggcatacaccagaaagttccttcttgagagattgtggaacctcgcctgtagttgcagttggatacttgtagcagcggtgaagcaatgcattaaccacagcaagaagtctttcctcgggaagagtaacaaatcttgatccaatttcagacagtaaaacctgaaaccagcaaaaataaaaatattagcatacttagaaacacaaacaacgaaagttctagcactagattgttgtttcttcatgtagatttcttcaagattctgtaatcccaacaattcaaatcaaatagtccctccagtcccattacaaacaatattagatttgttgtcttgtttgaaaatataaggcatacatttaaatttagtgcaagcctttcccccaagtctaaaagtatcccatcctctcttggactcctttaaacatttatgcttgacaaccaacacataccaccattttcgaagcacttaatggaagggcaataaagtcattctcttatggattcctacttcactttttgtccctggccaaaatatgccttactataggaaccaaagggcactgaatatgcatggaattctgttctcttaaatgccagctttgctacaaaataaaattcctggcaagcatgctaaaaatttctattgaaaaaaaggaatgggcaaagaaagaaatggcttattctataccattgtcatacacgttggcctgtatgtatggtaagactctaatttaataaaaaagtaatggtcgtagtcatctccaatttcctaaaggtttataaaccactttgttattacttcttacctcaagctcattggctagattggtatgcttgctcctaagagcttccattatatcctttgcagcatcaaatgcacttgctgcagaagttacccagccaagtccattattgcgtcttgctggcatttgcgaaccatctgcaccagttgaactcggttgaccttgatcatggccagcgcttgtaccaccctcaacattagatctgtctgactcttgtccttggagattacccccatcatgagaaactgccgcaccacctgactgggtagcttgatgaacttggttgtcagaagtcatgttcccacccccaagattagatgtcctcgcgttcccttcagataagttattggcagcattgtttgccagcatagcctgctgcatacgctgctgagctattcttcccatttcagtttttgtagcaacatcacgacgttccatcaagtatgtccgaagccaataatacaatgcctgcaagaaaacctctcagatatgcacatatacgagacaagaatatgcatcgtcaagttcaagaaatcgatatgaaaaaatgacatcacaatcacctgtggataaacttgggctattttcagcaaaactaatttgcagtgttgggcttcacttctctgtaatgatagcaataactgaggtatccacgaaagccaaacccaatggggcaactgctcaagatatttatccaaagcccttccagcaggttcattttgtgtatcgaagctcagaaggtagagaattcgtgcaagatggctccttgagtttgaaactccatatttgatgccttggaagaaacaacttacggcatactcaagccaaatctcatcttttgtctccttgaaaacctggcaacacacacacatcagatctggatgatgaagggatattattaagagcataaaggataacatgcataccatatcgcagtaattcccccagctaatccatgcttttggcaaatgcttaaaaagtgttatagcatttgaataagcaacatttgcattctcgcagtcattcatttttagcaggaagtcacctctcagacgaaatatttctgctttgttcttcacagggaaaaattccaaattggtgttattgattaagttaagaccactgactagttcgcctttcatctctaagtatgccttggcttgttcacatatcttcacaaatgcttcctgtaatcagattagaatgcaaacaggtaaataagatgatattgaacgcacactatgcagtactaaaaatttgatcacaaaggcaagtcacctgaacttccatggtagcatgaccatacatcttatcgagtatagttacacaaacgtcaggaagaccttgtttgcgagctatgtgagcaagcttgttcacattccaagctttgtctcggtaaccaagatgatgaagttgaggatttgtttggccaaaatctttgaatgcgtctattactgaattgtacatctcattcctccactggaggaggtcataccaaacagtcatattatcccattcattaggagttcgaagtctccatgtctcaagaatatccttgaggtcagcaaaggagttgtgatgattggaattggcaccagaatttcctgaagctggtttgttcccatttgcaatgtcaagcagaattttagaggattctttcacttcaaccaactgctgaaactgctgcagcagaggcattcgggactgcacagacatttcaggtaactgccaccattgttctagtgcaagttcaacacctttgctgacaaggttctcagcttcaccaacaccattagtacctttgtcatgaagagtgaaaaatgattgaataaggcgtaactttggtgtctcttctacctgagcttttggaataacattctccttcatatatgtccagtcaggcgccttccaaaggcagtctaagagaatctcgtaattctccacaccttttccaaaatcagccaatacttcccactgacctaattgagtggcacaagacaaccactgttcttcccaaagacacatttcagccttagggactgtgttattatatgtaccttgagttgcttttatcattgcctggtaaaagagattttgtgcctgctgccagtaaccgtgttggacaagtgatagcccagctctagtttctgctgtgattgatcttctcttccataatccatatctcatgtcatcctcattgagaagcctgtataattcagccagtgactctgagcatttggcctcattcatatgcatcatatggctctcgagtaacgcaatcgaagtatgccatgcattgcaggtctttccgatatatttgataagctcactaggcatgcgcggttgaggatggctcaagtgaagaccttcaaggagtgcctgggctacattaggtctgcatccttgctgcctcttatgataatcttttgacagaagcgcaattattggcttagcaagagcaacttgctcctctttgtgtaaggttacccaaacaattgggaatacaagaacccacaaatgatatgcgacgttgggatcagcaaatgcaagttccctcaatggagccatgacatctgccacctacattattaacaaagagtacatatgggttatcaggtcaaagatttcatacaaggagatttgtcataaggaaccaggttattccatttctcatgagcaaaactaacaaattatccatatgcagcagtaaaatgaaaaggcaacaaacatatatggtatgaggcagaaaatactagcagcaaagtagttttgagcacaggtatttaccacaagcttgcttgcctcatttaaaaactgagcatgtcttgtagtcagagaatcaaacgataaagatgtaccatccaagctttcctgagcatcaggagcctgttgtggcataatcatgcgatctgaaactggcccagatgtcataagtgcaggaactcgagcagaatttgcagcgagtgtaattggctcattttcaactaatattgccaaaataagatccaggccttgcttcaaccagaaaacatcactcactgcttcccagtcctgggtctgtattataaactgcaatctagcaaataatgtttttccgacatagtcatggtaaagtttgaagaatcgcttcctcatttctgggtctttagctctaagtccaagcatgtattgcctctccaccttatgaaaatactcttgcctcaaagccatttgatacctgcataaaaagaccgtcaggaacactacaagatactaataagagcttgctgtatgtatgtacttacttagctgtatctccacagagtgagtaaagaagttgcaaatattttgcatcccattcttcttgtacagatgggggaaagctttttctgtcaactactgataacttctgaagataagctattatctcctttggattaagtgaactgacagagccagtagatgaagcaagtctgtagtcatcctcaatccaagcttttatcatgtccagtatgcatagaagaacgctaggatctgtgcctttttctgaaaggagtgcttgaagtgtttggcccatagatcgcctgaactcagaagaggccatcaccctctcacttatgagttttaagacggtcttcatgttagatatgaccatagggtctactgtggggcgtgaattaactgatgaatcctgttcaggcctctgtccctgagattatgccaggtcaatgccaaggtaaatggaccatcatgccaaatggaatcttgccaaaacatttactcatggtgttgatgatcaaatcacatagttaaacactaacaaaaaaaacatcctagatgtatctgtggatttttcatcttaaaaatagtaaacagttcaaaatgataacttcacataagaacctaacttacctatagataccaagacagaacaccaggttaataataatcagcacagtgaaaactagtcaactatacggatcaacaaagttaaataatatagaaatactgtgcaaacatacttgtcgaacatggttgccagcagaagatcccatgtcacgtgcaagacgttgcaggactcgaagaagcaaacctatgaacggatcaataaaattcttctgtacttctgcgagtgcgttgaggacaaacagtgcaaagcttatgatagagttagcattgctaggttcaagtgatatctggggagtggttacagcagcaagatgcttttgaatgagatcttgaactctttggtacaacaactttatatcttgtggtgttgtagctgcttcaaggggaaacgcgctgaataccatctttagcaatgaacaaagagacttgccagcatccaacattttgttgttgaagcaaggttccagtatctaaggaaaagagatcccagaatgtatcaaagagtcaacgtaagaaatatctgcattgatctccataaaatacaaatatagcaaaaagactaatccagagaataaggttcattcaagtaacttacttgagaaatatggttgatgttattccggatgaagaggcggggttgcttttctaagactttgttcataacatctaggccctgagcaagtgctgttgcaggatccttggactgagaaggtgtcaaattcccaagcaatttctcaagataattaaatttaacattggcatttggccagacttccaaagcttgagtcagtagatcaagagcttgcttgtacattgagctagattccttatcctttggttcaatcaccagcgacacctgttcaatcaacaaaactatatgagtattcaagacctcagatcaaaaaagttctgctgaagacactagtaaggtggcacaaagtgatcaacattctcattatatcagaaaggttcacatgagaggatggaaccactaataggaatgccttgtcaatccactactgcaatcaaatgttacactgtgctttgtctcttttcaggagaaaaggcaagccaggccgcatgcctcaaaagcaatcacaatgaattaggcaatgaggcaccaacaacaaaagcaagtaccatcagaatgtccagtattaattttttttaagaacattatcatgaaatctaatgaagcaacttgtaaaatttagagcataaaaggtaaacataaaaaggataatcacccttataaggaatgtaatgatcatctcctccatagcagcgttaggtttgtactcctcatctggttgcccggaagacccaggtgtctcgatattaggtattgatgcccccccaggcgacatcacgcaaaggggttgcaaccctggttcaactttcaccctcttactcaaatcatcaccaaatgtgggaacatccgatgagcgttttggatcaccgccaataacaggactaagcatatcaccaatttgactcgtgttctcactttcctgcacaactttcatctcactttgtctctgtctttcccacgccaccaccagtccagcaagttcaattgccagtcgtctattttctgctgttgtgttgtatggtagtccaagacggctaagggagttgaccatctggggaacaaaatgggctctgcaactgtagaagaggtctgcatgacgaacaataagctggaatatgtgaatcatgttgggaattgaatggccttcctccacaaggattttcttggtgtatctaatccatattggcatgcggctgtcccctggagggagtcttctaggaagggcaggcatgaggatgtcaagagcttgcttcaccagcagcttattttctggttggcatgtccgcagtagagcaataaaaacctggggaaataattcatcatattggctagctcggtgcaatgacctggttaaatgcacaattactcaggaagaatttaatgttatactacctgcagaataatcttttcaggagcttgataggcctctaagaaatgacacacgttcacaaaagcccattgcttgctggaattatcttcacgtttgagatggttccaaccgaactttatgagttcctttcgatggtgaacaagatcgctctgtagatacttcagaagtaatgttgcaagctgaaggagttctatcctcaagggttcatcatattcagcactgacctaaaaatatatacatataaaaaagcattgctgtcatggggaagtaacaaagagaaggctgacaggtattaaggtagagtggttcacttcccacctcttccggaggatcaagaagcttgtcaacaatagttttaataatagatggatcaacaacttcccaactttgcccattttggaaagaatgagctagcattggaaggataagtatctgcatagcaacgactaaatgatcttgtccataatgctttgactggaatatgttcagaaagtgattaagaataattttcttcaaatttggtgcatagccttcagcaacctatatggaaaatgtaaaaatggtaagaaacagaaagaactggagagcgacacaagtaactgtcatgaattagaaaaagaaatggtgtcacctctataacataaaattccttaagaaaactataatcaatgcggctacggtacaagaatattgatagcatatcaaatagcgcaccaacttccgtacgatcatgccttagataatttaggaagcattttatgagccgcttgctttccatcacctgttcagaaagtaagattgttaagatccaaaggtctagacacttgattagtgcagtatggaaagatgcaaggatgctaagaaactttaataaagcaatttattgagatgtaaagcacagataacatgtacgcatcatgtcagcaaaacctaaatcattgaattcaaagaaatcaagcgcataagagaaaataagcacccatactaccggacagtgtttgcccattgaacagaacatcataaaatccagaatgataatcctactagcatggcagagataacagtatataacagatagtagcagtagtaaacaaagatgccaaaatttaaatatcatgattccccgaaataattctatataaagaaccaagtatgcaacttgtccatcaactctaaatatcgcatcatgaatttaacatggcaattaaacaggtgaaagaagataaaaattacgtaatcggaacagggtagcaatagaaatacgtaaatctacgtaattggaagtaaccaattaggttaactatggaacccagaaatcgatcaccgatcaagtaagttattcagcttgagaactactataatttgttacccggataaaggtcactagcaattgaagagcagcaacaagagacaatacaaaaacacaaataaacgggcaatttacaaaggcacccaaagagaaaatgcaaaatgagaaaaataaaaggtaagtaggaacatcaatgactacctgcggtaaactcaattcctgctcattttgcaggcgatcaattcttgagggtgatttccaagcaagcaacaaagtgtcaaagacaacccggttgttacagagccattcaggcatcaattttacaagggttgaaataagttccagtccattaaagtaactgtcagaaccagtagccatgtttgatgatgattggcctgtaaaaccttcagttatggcaccagtaagtccctcatccttcactgaggaagattgattaccagcagcttcagtttgtgaatagaactgtgaaaaggcgctagcaagtattttttgaggcgattttgcaagctggtcccttaactccccagtatcagagcagattatgtacatgaacctgaaattttaaaagggaagtataatcagtctctggacatgtgtagatctgggtgttcacatgttcattaaagtataactttacagaacaagaagagcaagctagtgtgccacttatactacagtatgcatcaaaaataataacagcagggctcaatagctagtctcataaatcccaaggtatatgttaaaaacataaccagaatagcagtaatgatctaatacagactaaaagggaagtacactaatgtaaatgaacagcatgtgaggctaactgaacctttttgtaagtcttgcacaaaagtttcacaaagttgcagctaaacaaataagactaattttggtgaagtgcgtaccttctgaaatactttggatggcttaatcgagcaagaaaatagtcaacggcctccacggcatagcggttcaaaaattttgcaagtggagcacgataaggactgttgatttcactataaaattgatcttcaggaagtgccctctctaaatcaattaccaacgtaacaaggtcatccaaaaatttgctcgccgccgggggaagaaggtgaaaaagctcaatcatagctgcccaaaaaaaatagacattagttatataaactcctgactccaaccaaaggcaacatacaaagacgacagcaattggtcattttgatgtctgtaaacaagagaaaaattggacattttgaaccactttacaacaaggcaagacttgatccatttcatattatctagctcctataaatataagttggaggtgatggtacatccacctagatctttttgcgaatggatatgtgcatgcatatgtaaatccacctagatcttctatgaagcatttctacagtaaaattggaagataccgagagcacaagcatcatttggtacacatttgcgaaaaaaaggtttaagttctgtgtatcaaattagtacaataatatatgaaaagaatgaagatctggtttctaaatctcgtgtgatgtgtcctctttcaaacaaaatattgatagttagagaggaaaatgcaataaaattatgacagacctgcagctatttttggctcatctccagctttccaagatttttgactctgggcaagcttttctggctccagccattttttcaagtgatccaataacttagcacctaaagtgacattaaaccagtttgatagtaattcaagcagacgagccaatccctggagcaacggcatggtaagactccttgtatgtgctaagttaactaagatgggccttaaactgctttgcagaagatcttttggcatcctttgctgctgaacgacctgtaaaatgcaaatcatcaatgagaacatgctagatgctgcaagcgcaatctagaatttgaatttttaaagcaaaacaaaataaattagaaaaggaagaaaataaatattctctgaaattccatgtcaatataagaaagcaattgcagtaaacaccacctgacgaagtccctccttggcaacattgacaatctctgtagtcctgcatgtcagagatttgaagaacattgagataatctttgcacgtaagtcgctatgatttggagctttcagatctccccatgccattgcagtacagagtagttcaatgcatgccgtcctcaatttgttccatgtcataattatttttgcattcatcatcttggtgacccaaacagtctcatcagcctcagcaatttgcagtgcttcttgcaaaaagttcacgagctcaggagacaacttcagaagaggtggtcttagtgctaaacagaaattcaatgctgtaacagtacccacctgagatagaaaaaaaaataagtaaaggatccatcacttatatcatgaacatagaaatcctcagaagttaaaacataaaatatatatcttacctgctgctcaatgttcttggaacgcaaagatcgtgaaatcagaggctggagcaacgggaggtacagaggctccagcaattcagagacctcactgccagttctacttgcaagcagtgataagcatgcctgcacattcttcctcacaacaattgaggtatttgggttaaacagttccactgcaagaaactccacaactccctgaaaactttgtcggcgatgttcactgtttgcttcatctgcattgtttactacccgtagaacttgtgttaggacatggtttgtctcctcctgctctttgtttgcatgcatcgggagcctcttaagaacatggataagcccgcgtacaactctaacctggaaaatgcatagggtatccacagacactttaccaaccagcgctccaaggcccattacaccacccatctgagcttgccatgtgctaccataacaacaatgcaacaggcgtggcaataattcctcaaatactgcaacccgcacacttggaggaggagaataaactggattcaaagatggactagaaactaacatgggggtactaggaccacctcttagcataccagtatgcttcatgcgagcaagaaagagtagtgtctcagcaaaagtatttaaagcagacagagcagcttttgcatgttgacgattttcacttgagagtacttcaaccaatgaatccataaatattaaaggatccaactcacggagattagatgaagagttgttccttgatctagatccaatgctagatgaaagggacgaaccaacaggttgtacatatccagactgactggaggatgaagaatcgatatggaaaagcatagcaaaatgtcgacataaatcaacaacgaagtcatccttctcgtctgtaaggctggtgtcagaattagctgcaatgatagctacaagcagaaccttgaaaacagatttctctgccagtagttgtgtctttgtcttcacacctaaatctccctaaagatcaagtagaaaataaagggaaaaatcaacaaaacacactcaagttagattaggcaaaagatactccctccattccaaattgatctacatatagtttttttgagggtattcctaaatgatctacatatttgtgttcatttattaggtctattcgttatttgtgcattggagtaaatggacattgatgcatgcatccatgcacacatgtatttataacccacatgtaatatcttgatttgctattggctaggaaatagtggggatggtgcatgcattgagtttgttgctagagtaaatatagtatgagagagttattagcttttcttggtcttgatgtacctatgaaatatgtagatcaatttggaatggagggagtacaacacaaataccagaaagaactgctgctccagtcaaatattaatatacataaatacaagtcatcattttggtatgaataaaaatccaaatttttaaataataaaaaggaggtaagaggcaaaagtttcaaacaataatggcatctaaatgcagctggacataattattccaaaaaaggcaacctacagattttagagagtatacgatcacaccgtttattgaacaataatgcggaagtttagcattgctatttgtggtaatacctgatttaccacttttatgcattaccaattagacatcaagagattgaatggaccacaagaaggctgtcactacttaataaaaataaaggtccatttggaacaagaaaccaactatagtccaaagaatggacatgactatgattgtaggttagtttggggaaaagggttaaatgaatacagaaaaatcataatgtgacatgttgtcattagtttacaagataacatggcatgctgaataataagcattaattaatttctgaaatcatgcaatgcagtactccctccgtcccaaaataagtccaattttcaccgattccacacataccaatacacaaccaaaacgactagaatgcccctactttatcaaataccaatgaaactattcttcactttatctactcccaatacaattattccctactttcacgaactccgatgcaatgattactctaataatgaacttatttattttgggacaaatggaaggagctaaaaatgaacttattacgggacagagggagtaaaatgtatcaattatgggagctactggacaatcccataactgcaattgaatgctaatcaatagtcaatacaagcctacgttgattttaacaatttcgatcacgacaaataactttgggacaatgtaagatcgatgatgtcaaatgtcagaagatgatcaagcagcgtgagcaaaatacataagtaatattaacaatatcaatactcaacatatattcaaaccaaccttcatatcagaagcatcattgcgacgccttgatggatccaaagaagatattagcagtgtcccaagaactccagggctcacaccctcaccgggtacattttcccgtaagtttaacaaagaatccaagcacactcgaataaactgaagagcctgtttcctgtagaaagcttccatactattaccttgcataactgcactgactgcaaagtgtatgcatctgtccagtggaactagaaacggtgttgcaggctcaaaagtcagaactaaacgaagtccatgttccgggttttccttgcattcaagtgcgaggggctccttcaaaaatcgcctatttcgaccccctagcttacctaacagttccaaggactttgtaccccatgtgtagggaggaggcctcaagtgagaccataaagcaagaatgacatcagacattaaattggccatgctaggttccaaaaaatcagggttgagactatcaatccaaaattctagtgtacgaagagctaagctcacaaggtcatcactccctttcagagcaagaacgagaggtttcatcaaacgaggaatgtgaggcagcaaagaactcaagcgagcaggtaatatcaggcaaagctccaaaatcaagtctcgcatatcttcactagttggtccatcaagcatggagagcaacatattgaggcaaggctgtaaagacggtataagatcacgcatcaatgaatcaaatttagcaatgttcaatgcacggaacatgctacggagaaggtgcatgtaaccaagaggtttctcaacttcagtggcactcttcatgcaaacttccattattactgggacatgtggctgaagagtgcgctcacaactttctggggcctttgctgcagcgacaaacaaaaagcgaaagagttgcaagacaagctttgctgcaggcgaatctggctgcttcagcgcgtcaagttttgagctaacgaggaaattaatcaatacatctgtgaatggccgaagaaccttgggagcttgcaaaaggctagaaaatatgtgtaacagctggttgtttgttatcatgcaatcaaagaggtctggcatgcaaaaggaaaacatgtccattatatcccgagcttccattatagctagcatttgggaaaaacattgcagaatgtctctctcctcatccttttccttaaaaagagccaaacagtgaaccccagattttagaacacccgaagtcttccgcacctataacatatcacataattttattagcaacagttcagtttaaccaaaagaataaaggtgcatggtgatggtttaatggacctcatcctcccgcagtcccctgaatggttgtactgataaatttgatgattgttgactttgttgctgcagaatacatgattggattataagagctcaaggatgataacatactgaataagatagtacccacaaacttgggatgtcaataatacctgtgggcgtggccaatgagcatgggttatgctccagattattgtcttcattcctggtatgtgtttaacatgaaaacattggagttataaatgcttaaacactttgtatatgtaaatactttattaaaaataaatcatacctagtacgagtgtccttatcagacttttgtaatcattaatctcctttgtgtactccaagggtggttgcaaattcagcacagtctgtaaaattgttggagagatttaaataacccataagtacaaataaacagtagcttgtctctggtttcaccacaggtccctcattttgctgcatggccctatcttattttataggccggatgcaactagccaacaataataactaccagcatatgatgaaaaaattgctatatttgtggtttcgtgtagagcagacaggggcataaatcttttatactcggcatttgccatgaaaggcttgagtataatcaagttattcacttactcatagtagtaacacattaaatgtctggagtgaatgcacaagttaatagactaacacatgccctattattttgttttgagaaactcagctagacaactcactgttttaagtaaattcaattacataaatgcaaagcatctgtgaattgcctccataaagagggcctatgacacacctgtaatgggacttcaagtttcattctcaaattttggtgttccttcccttcctcgccttcttcaagcaactggagaaaaagagagcaagttgaccacacagtgtaacaaaccaaaaaggagatagcattgatctttctgttgagaaaagtctaaaatacacaatagttgggagctccagagaatatttaatgctatacaattaaagtcgatcattagacacatatccttaagcaccaatcatcaaaatctggcattaaattttcgttggatataaactgaggccaaccacagtttgccagaataaaaaaggcacgatagccagcttttaccgttgtcaattatgcagaactgtcccactgttttagaaatagtaccatattataaaatagactaacaggctctgttttatttcttatgcatgtacattgcagtacaccagtgcccaatgcatctgtcctcccatgcgtacaacatgtgccagtgaactgtgcaaggttatattatgccatagcatacactataaaatatcattaaaagcatgccatatacctgaggaattgtgcgcttcaatgtcctgaacttcccaacaaatgcatccagtatacgcccctagtcatttctaaaaatcagtaccaacaaaagaaactaactagcgtatcggaacaggaaagcagttctttttaccaacaaaatccgtgcttcatccatgcttggctgatcaatacctttttcatatataggctcaaccttgaagagttcaccaaagagtagcagttcagttcagtataaaaaaattaattcaccattagtactataattaagtatgaagttctttgtgcacacacaaaatcgtaaaagtaaaagctgaacaaaacacaatatgtagatcctattattactactaaaaacaaatagaacaatagggcataagcataccagattcaacatcaaacgagccgatgtcgtatgaatgacaagggttagcgaagaatcatgcatattccgagagaacaaataaatgatccgcgatagctgcacaaaaatgaggtcactacgttaatgacatctgaacatagaagatcaacctccaagagtggagtttgtactggtgatagtgatatcacccccaatgaagtgcctagttttcataatcttgcagaatgctggatcaagaaaaaatacagtatatttctgcgtctgaatcagcaaaagagagatgtggcacctactcaaactaatgaactaattgtttgagcaatgcattgttcatattgaattacagatggtgtttgcctgtttggcagttccccgtgcaaaaagaatataataaattgccttcctaaacttcaacaatgcaagtgttgacattcttacatagcaacaccagactaacaaaaaatgagcatctataaaaaaaatacatggttcacaaattacacaaactaaggaattctgcaagaatcaagattaacctgcggaagagaaaggtctccacgaacataatgcaccagctcggcaagaagggtataggcaagaggtctcaatgtctcgatgcaaactcggcctgtgcctatcaaaaccctgataaacaagcaaaatgtttggaacaaagagtaagagaatgtgtatgtactcaacatctccacagagacaaaagggacgaaaatactatgcacccagttggtttgagtagtgcacagttatcataatcaaacaagaaaaggagcagcttgacagacacttttctctgcgtactttctagcacaataaacagccagtgtcttattaatagttatagtttctctatttacaactttacaacattttttaagaactaggagctgtttgatctcgaattaaggataagtgctgtctcttttttttctgatgaccccaagtgggaaattaactgctttgaattgcccttgtctcttagcaataaatagcttgtgaccatgggttaggcgcattttgttttaaaaacaagttaacttatcaaaagtgcttaaatagaataccaatgagttcagacatcaggactagcaagaactctctgcatactaaaccatgttacacccttatttacagaacatggaacaagaacttgccagcaagcattcgacatattagtaatcaagaacaactatgcatcagatcccagtaaggcaacattcaaataaaacatgaataaattgggtaatcatataaatgaaaagtgtacctctcatcaagaagtgtgtcaatcaagggaaataaaccacgcctgtactcagtgttgagaacttgcttcaagccaactagcagctcctgcaattccatacacaaaagtttatacaaatgcatttcaacacaatgtatagttcattaactttgagaaagatttagataataacttgccttccttatggaaacagagtccggggggcatgtaacaagcaagttcacaatgctcttgcatatgctttcctcatatgactttatatgatccgcgttgctcttcagaaggtacgtcaggaatgacaatgtctgcaacacaaaaatggttaaccaatcatgacctccacagacaaggaaacaaaattgacagaacctgcagtaccttgacttgtgcaccctttaactcaacaaagggcgtcttcaggtgtggtggcactttgtctggccccttaatagagattgcagacaccatgagtggtagcaagtatgggatatttgtctgcacaagcttagcatacaactggaacaaaaacatcactactagagggctctctgtgactatcttgaatgaccgtgcacttggattgagttgtccaccgcctggcactgccaccgtgcctggggcatcagcagtggggtccaaatgctggttgggcacggcagcagcaatattggcactgacattgggattatcgaagaaatgggtgacagtattgggaaagttgcggtatatggtaacaacaaaatcaaggaacggctgcacctctgcctcgacagtagggcgaaagttacggaggagatcaaatacaatcctgatggcaagaagtgcattgtcctcattgtcctgtgtcaatacacgaagagagagcttgagcaggtcttgcacaaagggtcggagcacctcactgtggggtagccgattgaggatctcaatcaccacattccgcagcttgtgctccgcattctcagtgccctgtggtgcggtgaagttgctgaggatggccgagaatgctctgaagtagcatctaagaaagttaagatagtctggagtatgagtcatctccaggctgtcccgaacttccatggcaagctgcagtcggacttgcacagctgcagagtaatagggcaaaggatcagattattgtgtcaaaacaaaatggcactccaccacaaagactatgtctacaagacagactgtaacaggtttacacagttcaaaaggtcaaaatgaaaccgatgaaaaaccatgtggtggtgttgtgagatagattggtacaatccaaccattgaacagaaaaatagaagcttgatatggtgttcagttcagacaaaaaggtaaatttgaaggcaccgagcctgttctcaaaagaggcagaaaattatattttaaaaaaatgaaaggataaaaatagaaattcggg

SEQ ID NO: 71133 - DNA, 6443 bp, Oryza sativa
tggcctttatactgccgttgttgggcgtctacgtcttcaccgaccggcttgccttcgccgccgccgactggtgtttccgcctgcacgctggcctattatgccgccgttgttgggcgtctacgtcttcaccgaccggcttgccttcgccgctgccgactggtgtttccgcctgcacggctggcctttatgccgccgttgttgggtgtctacgtcttcaccgaccggccgcctcgtccgccgccgactggtgcttccgcctgcacggctggcctattatgccgccgttgttgggcgtctatgtcttcaccgaccggcttgccttcgccgctgccgactggtgtttccgcctgcacggctggcctttatgccgccgttgttgggcgtctacgtcttcaccgaccggccgcctcgtccgccgccgactggtgtttccgcctgcacggctggcctattatgccgccgttgttgggcgtctatgtcttcaccgaccggcttgccttcgccgccgccgactggtgtttccgcctgcacggctggcctattatgccgccgttgttgggcgtctacgtcttcaccgaccggcttgccttcgccgctgccgactggtgtttccgcctgcacggctggcctattatgccgccgttgttgggcgtctacgtcttcaccgaccggcttgccttcgccgctgccgactggtgtttccgcctgcacggctggcctttatgtcgccgttgttgggcgtctacgtcttcaccgaccggccgcctcgtccgccgccgactggtgcttccgcctgcacggctggcctattatgccaccgttgatgggcgtctgcgtcttcaccgaccggccgcctcatccgccgccgactggtgtcaccgcctacacggctggcctattatgccgctgttgttgggcacctacatcttcatcgccggtcgtctcgtctgctgctgactagtgcgcttacctctacgtctggttatacagctaccactactgatggacatcatcgtcttccgtcgccgactggttatgccgccgccgactggtgcttttatcttcacaactgcgcgtcttcaccaccggatttctacttggacatcttcaacacatatcttcaatcaagcaatgactattcgatgacaagaagctacagttctcgactctatgtttagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcagacattctacttcaacaacttcaaatatttcggtttggacgagttagacaacaacatcaactctcctccaagtgaagcatctacaatagccataacattaatttgatggattattgtcactgacatcatcaccagcacctctgcttcatcggccctgacatctccgctgttgctaatggatgattatgttttcgccgacttattatttcaccttgacggttgacctactatgcaaatgctgatgagcgtcttcgtcattatcattggttgcgacactgctattgactggatcaccgacatcgtcatcttcatcatgtcagttgcatttgtcgtcgccaactattttcttcatctccatgattggtggattttgtcatcgcctttgatttgcctcgtctgtcaccgactgattatttcgctgccatggctacacaactttatcgctgggcgctttcatcttcattgatggctgacctgactactgccgactggtttcttcgcctccacggctgtgcaacttcatcacttttgattggtatcattatcttcactaccaccaatatttttgccacctctggtgggcaatattatctctatgttggtcgtcttgtctttatgccaactgcgtcagctaccatcaatggacaattttgactatgacaaaaggacaagctatatgctcaggggctcatcaactcaagcgtgaggattatatctccaatttggacttgttccagatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttaggctgattatatattgtggtcatttttcaggcggttggtaaatcctttatgagtttatttacacggattttataccacatatgccatatattttcaggtgtggtggaaccatgtgtcttttagggacttaagcacatctgttaaagcagtgtgcgcatggcgtatgcccaatactttggaaatttctttattcacaacatacaagcttctttatagctattttgctatgtgaattttcaatgatgtagccaactttaggttacactcatcatattttacaaagcagtcggtatatcacttggatcatattattcgaggattcacaccgcatatgctatatattggtatcaagtcacttggttgactacgattatcaaaaccactcgtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcataggggataacttatatctatggaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatcaatacacactcggtggattcaaatccccaaacaggagtagggtattacctctctttggagtagggtattacctctctttgagagggcctgaacctgtctaaatcttttgtctctgctgtttagatatcttgtcagttgcaggatcaaactgactggcacgcacgcttctcaacaaactttggacctgcactaaagctaagcagatctcccaggccaggcccgtgtgtgtaacaaactttggacctgcactaaagctaagcacgcccgcttctcaacaaactttggacctgcactaaagctaagtagattctcaacaaactttggacctgcactaaagctaagcagatctcccaggccaggcccgtgcgtgtaacaaactttggacctgcactaaagctaagcacgcccgcttctcaacaaactttggacctgcactaaagctaagtagatctcccaggccaggcccgtgcgtgtttttcgcatcaacatgtgacagcccagcccagggtccagaaacggcattggtcccatctcatttagttagaccacacctaacactgcaactcactgggtttttcgtcctcgctttaacgcaaaaattccagaatcggagttgtagtgactgggctgctcatccttataagctgctccctctcttctcaaattggcgaggtgggaactaaagctagctagctgtgacttgcttgctcgctagctgatgctgctgcacttgggccaaaggcccagctactgcttgggctgccggcctgctgctgctagctagcctttttttgtttcttttttcttttttcttttttttagggtgttacacaacaccatcatcaatcccatttaaattggactagggctattacctgataaggggcctgcaccagtataatccttgtcttctgtttcccaattctctaatcatctagtctacaagtatcactcgtcgataatttgattcatttttaaatatatacttttatgtatatatatagttttatggagagccgagggtggagaatagacacagtatgtggtctcttatcaactcaattagacaattctctaatctgccgtggctcgttttgggggacttcaacgaggccttgtggcagtttgaacacttttcagtgagacaaaggaatgaaacacaaatgcaatcctttcgggatgttctgcaaacgtgtgatttacatgccttgggtttttccggagtgccctatacatatgacaacagaagagagggaaggaacaacatcagagttcgtctggacagggctcttgcagataatgactggagggagatgtttggtaatgccagggtgtctcacttaacttcgactcggtcagatcattgcccaatatctgtttgtttctctcctgaggattgtcggccgtttcacacaaaatgtttgcattatgaaatatgctgggaaagggaaccatccctacaggaggtaatcactgatgcctggtcagagggtgtttcaaagtcagatctcggtgaaattagtactgccctccatagagtgatgacaaggttgcattcctggagtaaggtgaaggtcaagaatgttgggaaggaactagagaaagcaaggaagaggcttacttctctccttgtttctgatgcagagagcagtctggttcgtcaggcattggatcatttaaatgaacttctctatcgtgaagaaatgttatggctgcaaagatcacgtatcaactggctaaaggagggagaccgtaacacacgtttctttcacagcaaaggagtatggagagcgaaaaagaacaaaatttctgcactccgggatgccagtggcactgttcaccatttgacaaatgtgatggagcaaatggcaacagactattttaaaaccctgttttctgccgacccaaatttggaccactctagagttacaaccttaatccaagagaaggttacggctgagatgaatgaagctctttgcaaggctttctctgatgaagagatatcccatgccgttttctagattgggccgcttaaggcgcccgggccagatggatttccagcacgtttcttccagcggaattggggtcttttaaaggaggaggtagtgaaggcggtgaaggaatttttcaatacgggggtgatgcctgcgggtgtaaatgaaactgctattgttctcatcccgaaagttgatcagccaatagagctgcgggattataggcccatcagtctgtgcaacgtactgtataaagtggtctctaaatgtttggttaacagacttcgaccgattttagatgaacttatctccccaaatcaaagtgctttcgtccctgggagaatgattacagataatgcgctcattgcctttgagtgctttcattcaattcaaaagaataagaagttgtcatcagctacttgtgcttataaattggatctgtcaaaagcctatgatagggtcgattggaagtttttggagcaatcaatgtacaagctgggtttcgctcattgttgggttaattggataatgtcgtgtataacctcggtgagatattcggttaaatttaatgggaccctgcttagcacatttgctccttcaaggggtttgcgccaaggtgaccccttatctcccttcctcttcctatttgtggtagacggactttcgctgttgcttgaggagagggtagcccaaggagccttgtccccggttcacatctgtcgtcgggctcctggtatatccaacctgctcttcactgatgatacccttctctttttcaaagcaactagtgagcaagcaaatgtagtgatgaatgttctagcagactatgcctggtgcactggtcaactgattaaccaggagaaatgctctattatgtttggtgaagcttctcctcccgatgtccaggaatctgttagaagtgttctgcaagtggggagcaccagctttgatgacaagtatctgggttt

SEQ ID NO: 71134 - DNA, 4427 bp, Oryza sativa
tggtgcctccgcctacacggctggcctattatgccgccgctgttgggcgtatattacttcaccgccggcctgcctccgttgccgctgagtggtgcctccgcgtacacggctggccttttatgccgccgctgttgggagtatatgacttcaccgccggcctccgtcgccgccgactggtgcctccgcctacacggctggcctattatgccgccgctgttgggcgtctacgacttcaccgccggcctgcctccgttgccgccgactggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgttgccgccgagtggtgcctccgcctacacggctggcctattatgccgccgctgttgggcgtctacgacttcatcgccggcctgcctccgtcgccgccgactggtgtcctcgcctatacggttggttggtcacaccaccgttcatgggcgtccacgtcttcgccgaccggctggcctctgccgccactgactggtgtttttgcctatacggttggcggactccgccgctgttaatgggcttcatcatctacaccactggcttggttccactggcgccgactggtgttttttgtcaccattgatggactgctttattcccacatcggctacttctgctgtcatcgagggaatacgacaaagctaagtcatcatttattttattctttatatgatattttgtcttttcctttgcctcactacatcaactggttcgccgttgactagtgagtcgggggctatagatgttatatcgtattttttaaacaattttcataatatttatcttgattgcttgcgacacaatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgagtagtaaattctgattcgtgaaactttgttccattaatggcgaactcatgtcactcatatgcatgtctgggaagtgcctaggccgactcccggtgcttgggggctatgactagtcggacagagcgtttaaacgtaatgaatcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctgcacggctggcctattatgccgccgttgttgggcgtctacgtcttcaccaaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctttatgccgccgttgttgggcgtctatgtcttcaccgaccggccgccttcgccgccgccgactggtgtttccgcctgcacggctggcctttatgccgccgttgttgggcgtctacgtcttcaccgaccggcttgccttcgccgctgccgactggtgtttccacctgcacggctggcctttatgccgccgttgttgggcgtctacgtcttcaccgaccggccgccttcgccgctgccgactggtgcttccgcctgcacggctggcctttatgccaccgttgttgggcgtctacgtcttcaccgaccggccgccttcgccgccgccgactggtgtttccgcctgcacggctggcctattatgccgccgttgttgggcgtctacgtcttcaccgaccggcttgccttcgccgctgccgactggtgtttccgcctgcacggctggcctattatgccgccgttgttgggcgtctacgtcttcaccgaccggcttgccttcgccgctgccgactggtgtttccgcctgcacggctggcctttatgtcgccgttgttgggcgtctacgtcttcaccgaccggccgcctcgtccgccgccgactggtgcttccgcctgcacggctggcctattatgccaccgttgatgggcgtctgcgtcttcaccgaccggccgcctcatccgccgccgactggtgtcaccgcctacacggctggcctattatgccgctgttgttgggcacctacatcttcatcgccggtcgtctcgtctgctgctgactagtgcgcttacctctacgtctggttatacagctaccactactgatggacatcatcgtcttccgtcgccgactggttatgccgccgccgactggtgcttttatcttcacaactgcgcgtcttcaccaccggatttctacttggacatcttcaacacatatcttcaatcaagcaatgactattcgatgacaagaagctacagttctcgactctatgtttagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcagacattctacttcaacaacttcaaatatttcggtttggacgagttagacaacaacatcaactctcctccaagtgaagcatctacaatagccataacattaatttgatggattattgtcactgacatcatcaccagcacctctgcttcatcggccctgacatctccgctgttgctaatggatgattatgttttcgccgacttattatttcaccttgacggttgacctactatgcaaatgctgatgagcgtcttcgtcattatcattggttgcgacactgctattgactggatcaccgacatcgtcatcttcatcatgtcagttgcatttgtcgtcgccaactattttcttcatctccatgattggtggattttgtcatcgcctttgatttgcctcgtctgtcaccgactgattatttcgctgccatggctacacaactttatcgctgggcgctttcatcttcattgatggctgacctgactactgccgactggtttcttcgcctccacggctgtgcaacttcatcacttttgattggtatcattatcttcactaccaccaatatttttgccacctctggtgggcaatattatctctatgttggtcgtcttgtctttatgccaactgcgtcagctaccatcaatggacaattttgactatgacaaaaggacaagctatatgctcaggggctcatcaactcaagcgtgaggattatatctccaatttggacttgttccagatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttaggctgattatatattgtggtcatttttcaggcggttggtaaatcctttatgagtttatttacacggattttataccacatatgccatatattttcaggtgtggtggaaccatgtgtcttttagggacttaagcacatctgttaaagcagtgtgcgcatggcgtatgcccaatactttggaaatttctttattcacaacata

SEQ ID NO: 71135 - DNA, 43139 bp, Oryza sativa
tcggcggcaacgaaggcaggccggcggtgaagtcgtagacgcccaacagcggcggcataataggccagccgtgtaggcggaggcaccagtcggcggcgacggaggcaggccggcggtgaagtcgtagacgcccaacagcggcggcataataggccagccgtgtaggcggaggcaccagtcggcggcgacggaggcaggccggcggtgaagtcgtagacgcccaacagcggcggcataataggccagccgtgtaggcggaggcaccactcggcggcgacggaggcaagccggcggtgaagtcgtagacgcccaacagcggcggtaggggttcgccgagtttcctgtcaacaagtgtgatggaatcaatttcatgattcgtcggcttcgtcttcgattcgtgagttttcacttcctcgctgccgacgacttcaacaatctctctttctccgacttgggttttaaccagtcgagagaacggcgatcaaagatctgtgtcatcaagttggaagcttcaaaccgtcatcgtcaccgataccacggctggctagttgcataagacagctgattggatcaatctcggactcggctgactcaacatggaaaatcaaaaacacggagcagtacatacaagcagcaattttcacttggtcagctcgagtattttttaatgaagacgtatggctgcgggcacacgcgagctatatcaatgctcaaacttatccagcaattactggtcatcgcatgcgtttgtacgtgcctggaacaactatgtacctgtatgcataaacacataccaacagaagatctgcacatgcatatgatttttgctacgagagtctgggccatatatgtcgccgacgactttgtcaagtttctcttcaactcggactggaacacgacagacaacctttaatctaggatacaaaacgggctggactaccctgtcaatattggtggccatcatcatcaccggcttaccttcaccgccgccgactggtgtctctgcctacacagctggcctattatgccaccgttgttggacgtctacgacttcaccctgagcctgcctccgtcaccgccgactggtgccctcgcctatacggttggttggtcacaccaccgttcatgggagcctgcctccgtcaccgccgactggtgtctctgcctacacagctggcctattatgccaccgttgttggacgtctacgacttcaccctgaacctgcctccgtcaccgccgactggtgccctcgcctatacggttggttggtcacaccaccgttcatgggcgtccacgtcttcattgatcggccggacttcaccaccgccgactgctgtccacgcctaagcggttggttggtcacaccaccgttcatgggcgtccacgtcttcaccgaccggcttgactccgccgctgcctactggtgtttccgcctgcacggccggcctattatgccgccgttgtcgggcgtccacgacttcaccgccggcctgcctccgtcgccgccgactggtgtcctcgccgatacggttggttggtcacaccaccgttcatgggagcctgcctccgtcaccgccgactggtgtttccgcctgcacggctggcctttatgccgccgttgttgggcgtctacgtcttcaccgaccggcttgccttcgccgccgccgactggtgtttccgcctgcacggctggcgtttatgccgccgttgttgggcgtctacatcttcaccgaccggcttgcctcgtctgctgccgactggtgtttccgcctgcacggctggcctttatgccgccgttgttgggcgtctacgtcttcaccgaccggcttgccttgaccgctgccgactggtgtttccgcctgcacggctggcctattatgctgccgttgttgggcgtctacgtcttcaccgaccggccgccgcatccgccgctgactggtgtcaccgcctgcacggctggcctgttataacgccaactgatgctatcttcttcacggctggctacatcgctgtcactactaataggcattagtatcttcaacacaagctgcctacgtttgtcatggctgccgactggtttcttcacttccatggctgcatgattctgccagtgttgattggccttaccatcttcatcgctggtcgtctcgtctgctgctgactagtgccctcacctctacgtctggtttatacagctaccactactgatggacatcatcgtcttccgttgccgactggttatgccgccgccaactagtgcttttatcttcacaactgcgcgtcttcgctaccagtttgcttctgttgccgccgactcgtgttcacttcatcacggcaacacaactttgtcaacatggtggagcgacttcatctttattatcttcggtaccagcaaactctattgctgctacttcacaagttttgttacatcaccaaccatgacgttgttgtgaatctcgacatctcggcatgcgatgccgtgttattttactacaacaagtggctctccaacattcatgatttctacttggacatcttcaacacatatcttcaatcaagcaataactattcgacgacaagatgctacagttctcgactctatgttcagttgtttcccaactaatcaaagagtcgggggctacacaaatacaaggctcaaaatttgacaaattttatgtcaagctgaagaaatcaattcatcaacccacgagtcaactccagaagtcattatcttcatctttgcttcggagcagacattctacttcaacaacttcaaatatttcggtttagacgagttgggcaacaacatcaactctcctccaagtgaagcatctacaacagttataacattaatttgatggattattgtcactgacatcatcaccagcacctctgcttcatcgaccctgacatctctgctgttgctaatggatgattatgtttttgccgacttattatttcaccttcacggttgacctactatgcaaatgctgatgagcgtctttgtcattatcattggttgctacactgctgttggctggatcaccgacatcgtcatcttcatcatgtcggttgcgtttgtcgtcgtcaagtattttcttcatcttcatgattggtggatttcgtcatcgcctttgatttgcctcgtctgtcaccgactgattatttcgctgccatagctacacaactttattgctgagcgccttcatattcattgctggctgactgctgccgactggtttcttcgcctccacggctgtgcaacttcatcacttttgattggtatcactatcttcactaccaccaatatttttgccacctctgctgggcaatattatctctgtattggtcgtcttgtctctatgccagttgcgtcagctaccatcaatgaacaattgtgactacgtgctcaggggcttactagttcaaacacaagtatcataccttcaatttggacttgctctggatacatgcaatatgaattcatgatcatgggtctattttctatgtttaaagactggactatttattattccccataagggttacaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttactcgactttttaggagttggtatagcgatagggttttgagttatcggctatatgtccaatgtagagtctaacactcgatgtaaataatgatataaaggcactgatcgatataaaggcaatgatatgatagaataagcactgatccgaaggttaaagcatacatcggctggaggtccgatgtcataaaatccacaattttagataaacagtgaaacctttgttgcgatcggctaagtccaacttatatgtatatgcaatccttacaagccaatgcaacgtccatataacttatcggctagcaccccgataaaacattagcatgaacctatcggcttaacaagacatatatattatcaacaacaatctagtagatcgaacctaaccgatgcagcatgacatcggatcccataagatataatagaaactctatcccctccaagtaagactttagaaatcactcgactcataggaatattttccataatttgtaacggattcctccaacgcatacggaaatcccgagctaattctttttctcttgaaatcacttgactcgatctccttttctttttctcttttggaatcccgagctaattcatttggaaatcgtcggattcgatgccgatttggtttgcttctctttccaaaaccctagagctttcctaatccaccggtgcctccatgggcttagctggcgccctccgccgctataaaaagcacccccctagttgtcctctacccatcccctcaagtcccgtccgccgacgagacccgtagcaccctagccgcgctagctcgtgcgccgccgtcgtcgaagggagtacggtcgtgccgtgccgccgctatagtctccaccatcgctcgaggttgccttcgtcgggttcgcaaggttgccgccgtccccatcccgcccttcgtttccgccgcagacagctagagtgccgccaccaccgtcgacccgaagaccaccgccgtctcgacctcgccgccattgtcgatcgtcaccgtccgtcgtcgttcgagccatcggtgagttggccacgtcacgctctacacgttgatgccctccgtttgcgccaccgcgccgtcgttcgccggctagcatgaggtgccgagccgacgccggtgatgacgtcatcgtaatgtcatttgtagaccgtggtagaccggaacgatctcggccgtccgatttggtcaagtttaggtcaattagatctcggccgtcggtttcgtggaccgcttctgtgaacccggtttagcatggaccgtccttgatgacgcagtaaatctcttttccttttcaaaagtaattctttattgtgtcataattcaattaaaatctttataaatgctttaactcgatttaaacttcaaaaattcgtaactaattcattgtaactcggtttaatgtggttcaagttgcaaaagttgtataaaatgaagatctatatattaaaattatccattatttgtgttaaattcatttaatcctttttaaataggcttcaattatattaaatcttgtaaaattcataactaattcgtacgaagtcggaatgaggccgttcaagtctcataatttatctaaaattatgatctacatgtttgtttactttactagcaaaagtgtccgtgcattgcactgggtgattatggagtgtgtatatcaaccaaaagtgttgtttggtttagcaaaagtgcccgtgcgtagcaatgggaagtgtacagatcagaaaaatatgcaattaattaaaatacaaattctctgaatatttgatatttttaagtaggtatgtatataattaaataaatttacaagtaaagcaattgtgagaaataaaatgacatggttaaatttaattttattaaattcttcatgattagttttgctctttgaaattttattggaattttcagagcttaattgctaactttaataatacaaacatcatttaacaattatttaattggaaatctaatttaagttcttgttgggccggccgacctacgtgcggccaatgaggcgtgcgcggcccagcattgatgcggcccgatgatggagaccggcccgacgcgggagtgatcaaagccgttcgttttgatggacggctcatatcggctcctaatctatcaaaaccctcaacccaaataaaccctaaccctaatttcattcttccccttcctcccctccacgcaggtcgcctttctccccgccgccggccgcgccacacccccaccggcgcacctctccgcgcccctccccaaccggcgacgcctctcaacgcccctcccccaccgccgacacctcttgcccccctccccaccggcggtggctttacctaccgagcagcggcgacggcacccttctcccccacaagcggacagcggcggcgcccttcctcccgcgagcggcgacgatggcggcagcggcgccctgccctcccacgagcggcagcggcggcacactccctcgcggcaggcggctgcggcgacgcggcgatggtgacgccgctccctccccccaccgccggctccttctctcctcgtcgggtggtggccgctgcaccactctctcggtagatccgccggtggtgtcgacggcggcggtagccgcgggtggaaccggatgtggtggtggcggtcgcgggccggcggcagctccctcctcccctctcgcctccctcttgcccctgatccggcggcgatggcggtgttggcggcgtcggcgggtgggtccgtggccgacggcgaggtggcgaggagcagtgcgctgcagcctccggtccggctcgcccctccctctcctcgtcatctcgtgttaatatgatgttttctaatgattccgatttagatttggactgggattttgtgtttgatttggatttggattgtgatgatttgagatttggagagaaggtgtgctcaatgtgggattctatttgtgtgatgatggaattccgactgggatttttgagggaggggagggacgaaaaatcaccgtacggatgtggtgacgaaaggaaaaatccgaatatttatattagttatagatatgtacttttcatttggtttttattagtcttttttctcgttttgcgtgttagcttgtcctttccgtcttttcggaggttcgcgagtgtgtcggaagtattccagaaaactaattgaagaccgattattgcaaggaaagtcacacagatcccaaacacaattcatttgagcatgttgatcctatatttaaattctctatttaattaaatcgtgcatttattttcgaatgtcaccgggtggtgtgaacctattcctttgttatggccaatttgcaatgattaccctatttcttgattacctcgggttataatttgactagtcggatttatatatcggttcaactagatgtattagatataattggttagccatgcttagaaacattagcacacaattgggataactaatgtttcactattacttaatgatggatatttaatgatagctcacgatggttaattgtgattggttaattaattaattcgctaactaaaacttgataatggtgggttgtgagcacgtggttttgatggtcgtgctcatgacaattaaggaccggttcacgagtttcggttgtgaaacattaaccgtgccaaccacaagccagcatgggtaacggctttaccttttgtatagcatggttcattgcggggcaccagactgagaagtggcggagataagcccacgggggtcgctggggagtccatgccttgttttataagggggtgattatgatccaggaacggtgcactgtgggggattgtgttatgcgaggggtactgtcacagctcctttccgaggtaccgtggtggtattaaggcgcatggtgacatgtcgtggggctatgtcttgtgggtacagtggtacatctttggccatagtaaaactattcgaatagccgtgcccgcggttatgggtgggtctaacaatgtatttcgtgattagtatcacacttctcaccataataaatgatgctataactggtaataatttgattagctcttggtttggaatggtacattcctagtttggagatagatctgtacagccgggtatggttgttcaggtttggttgggcctgtgcagcatgggtatgctgttcagtgttgattaatatcgatgattaattactttattgctttacaattctcaaatgtttgctaaatgctccttctgcaaatgagccctatattatgccattctttggtatccttgtgcacttgtgtacatgttgtgtggcttgcggagtattccatgtactcaccttggaataatcaatcaaacctcagttgaagacaagttacaaaggagaaaacatttgacttataccccagttgagctgtctgtgggagtggagctgaaacttcgctagattttatttttctgctacagttttcttcgtggtgaggactaggtacctcttatgtaagtatttattgctttagttcttatgatgaatttgtatattaaattgtcagtttgtatacctcggctgatttctggacaatgattttattcacaaattagttcggaaattactagtgattttctggtcgtgacagaccgccaccgcgccgcaagccgccgcgagccacggtcggtcgcgccccgtacggtgccgctgcacgctgccgcgggccgattgtgcccccgcacggcgccgtcgcaccgctcgccggccgcgcccccgcacggcgtcatcgcacgccgctcatgcgtgccgcgcccgcatagccgccgcgcaacgccgagccgtcccctgccgcgccatcaccgcacacgcacgcctggccggcacaccgcagctgcgctgcccgcacggccgcagcgtgccgccgcgtctcgccggcgtccgcgcctcgccccgcatgtccaccgcatgccgccggccgagccgtgctcgcgcaccgcccgtgccccgcatggacaccgctgccacgcatggctgccgaccgggcgcaccattcacgggaagaagaatagaaagagaagaaagatggaaagagattggcgattttgcaaaagggcccctgaattgtctgaaaattatgcgcatatctctcggcatggaaattccttgcgcgtagactctggaatttcagaaatttccattttcatccctccaccgcatggaaacttagtaaagggccccctgtacttgcatatttcgcctgcatttcttatttaagcattttgtttatgtcatataaatttttaatttgaatttcacgaggcattaattaatgttaattggtattttgaattttcattttcagtatttatatgaatacatgcaacttttgccccccttttatgaatatttgtatgaatttgtatgaactctagtatttctttattgaaaattgcatttactttgaattacctgcgtttctttgtataattagcatttcctttgcataagaaatattggaaaaatcatgaaatatttgtattcatatttgcaaccatgataatagcaagtaacacttgaatgctttgtcgtctttgtaacagaatgttagtaatcacgaacaaggagttcgctgaactggccccgtatgaccagaactacctgacctgggcatccaatgtccagattgtccttggggccaaaaagctcctcaagacatttgggatgggcacagtacaagaacctatgccgacacctgatgagaacgatcaggcgatgtacttcctgcgacaccacctttgtgccacactcaagaatgaacacatggcaacgaagggtctgctcactctttggaccacactaaaggagtggttcgagaagcggaaaaacaccaccttgccccaagcagagcaagagtgggcacacttgaggtttgccaactatataaaagcgttaccgaatacaactccgccttgcatcagatatgtatcaacctctccctgagtggcaaagtagtcacggacaaggagaagattgagaaaacgctctccaccttccacctcagcgctatgcatagcactcgtaaccacaggcggatgacatgcaagaagtatgatgagataatcaacatcacgcagatgtttgagtcccatgacaaggttctttgcaagaacttcatttcccatccatccaacaaaagtattgaccttaaggtcgatactagcagttacaagaatcacaagcccatctaaaagaagaggggcaagcaaggtgggaagaaagcacctaagaatatgcatgaaggaactccagatgcccaggtagcccaaaaagcacatgaaagcaagggcaaatcgaaggccaaggcatccacaaaggcacatttggttccaatcaacaacaccccagtagtagatgccatggcaaccctttccatcaccactccacttgacatccccgctcctgccatagtcgtagcgagcaaagaaaatgtcatataggagaagagtttgcaaagatggaggcttccccagactccgtcttagtccttgatacaataatgtcatataggagaagagtttgcaaagatggaggcttcgccagactccgtcttagtccttatacaattatcttatcttggttgcattatgaacttctttgaataatggatatttaacctctatgagagcataacatttattttgtgattcgccatgcatggctagactttatttccaatattatgttgcattttgctatatgataaagttttacttcttgccttgaagtagtgatgttttactttattcacatagacaatatgcatagcccaaggtgaagaggagcattgtggaacaaaagcaccacaaagtgtaatcttgagagacatgtgacaagttcagtctatgcaaagacgtgaactaccttcacaaccgcacgtaatgattgtaaaggttattgtttttcccgtagaaaagtgattacacctcaaatatcttgggaatggcaaactctcgcaccaaaggtcccttgtaggaattagaagatgagagaagcatactcatcacctaagcacgcgagatcaatgtcctcactaagaaatgtaggctaaagtagactatttcatagtcagtttttcttagaatttagtatcttgcaaatgaacatagcacaaacaatctcacatcatctgtcgtatcgcaacaatgagatatttgtcgcacgcactgccttagcgcctcgcgccagacttgcgccaggcactggcatgcatcatacagcatcatgacgcccactaaggcagctactagcaaccccgctgtactgggggactggacgaatcatgccgcgttagcacgcgccatgcaactcctaccatgcaccatagttgcaccggctgcatatctcgtggtcactctggtcgcgcatgccattgaacatcgaatgcgtgtcaaacgccaaccaccacatgaattccgacgtaccttaaaaggtatatcggaacaaattcgtgcataccacatgaattcgcatgcatatttagtcctttaatggatcatccaatgcatactgcgcttatgaaaaagctgtaattgtgtctaattgacactacgctcttgccaaatcgatcctgcaagatcacgcatgttggcatcagcacattaagaaaagcactaagtaccggacgtccacaagaataggactaaaaatgtccactgcaccattattgaaattcccgccacttcaatggactcttagctccaaaggcaatgaattatcaatatccagactattcaaaatgtgttgtccacttaaaagaatactagtgttgactcgacacatgtgcatatcccacaaccataaggtctccctccgaaaaaaattgaaagtttttaacagaggtatgaacgtagcttaaattccttgacaataagaaggattatttccagtcatttagggggacagaaataacccttaaatgataaatgtcaggaaaaatggtcaaagaaaggatggatgcacatttaatcaagcactagcaaatgcaaagtatgaaaagcacactttgtaattggataactgcctatcagttttgtgatttgcagagcatgactaagttgcattacctgaatataatgcaccggaggagggtgaaataccgaggaatgcaaaggtatacctcatattgtccagaggcctagagaagaataatgggacaagaactccggctccttaaatccctagagtaacaggagacgtctggtgaaaacggaacaaaaaggaactctcaagctcatagtcactaaaaataaccccagaatttgaagggagcgagttcaaagctggcaaatggtatggaaccccagaacaagcataccacatcttcctatcaaggaagaaaaccagcagttggagtgcacaccaacgtcggtaaaatgaaagagtcatgcccatatcaaagaatagaagcataagagaattgcatatccccatatatccatggatactcacataagtgtcacatacaaccaataagaattggtaatgagacctgctatgggcaatattctcttcatacagcaaatcattggcagttaacctggagttgaaaatcaactaaaagatcaaaccgcaaagctgacctatagttgacaatgaatggctagagaaattttggattgggcacccgcatacaagcattaaaaatccgaaaccaagttgatgatccgaatatcatcacataaagaaagaaagctcactctttccgaacgagtttgagataaaatagatagaaacctatgttgcttaggctcgtaaacatacaacacatgaagaagtgaaccatagtatatcagaatgtgaaaatacataggttccatgcatatagttcaccatttctagcaagtaacatggttcgaactttatccaaaccccaaatccattatcaagaagataatgatatgtgcgtcgcacaacactaatagactatacgaactatataagtcatggaaaatcatgcaagatttgaccattggagcatcactcgaactatcttttgaaaaggatacaagcaatgagttttgacggttcacacttaaaagagatgcaaaattcaaggggagaattttgccagtctattaacaaaagcttgaaactaaagaatttagtacccaaaaatcgattaagaaaatcgataaaagaatttgggtagattgtactctttttttttccttggataaattttcctgcagtttcttatcaaggtttttaatgaggcaatctgtgcgacatagatacgtatgccatgtactctttctccaatttttcccactgggtttttatggagttttgacgaggcatggacattacgcggtgagtgctcaagggggagtgttgagaaacttttgggcttggcccatgaaggcctagcctaaatacacttattggccccatcaccgaacctttcatatattagattgcactatataaagagaggagggggctactcattgtacaattgattggaggattgaatagtaaagagagtctcacccctaaaatttgtgtttccactttttgtagaattactggaccctcttgtactgctttgtgtagcatgagagttgcgtaataggacaaagtttatttccgattggttacttgcaagtctgtgaggaaatatagaaaccatcgcaaaatctcatgttctcaacatagttatgtagtgagtttttacttggaattgaagtttgacgatacgactcgaggaactaccgtggcatctcgacaagggtagagggatttgatagctttcgtgggagaaaagaacacaggaagaagaaaacggagttggcaagaggattcggttttctcttatcgcataaactcccaacaaccacagcttctcttataccatgcacacgcacactgatgccactgccagtccagcatggcacatcaaacacacactctcacggcccaaagacatggcccgactaaacatttaacaaggcccaatgtcatggcccagctgaacccataaactcacatataagtcaagtacttcatacaccaaaccgatacaggagtcatgacaattctcccccacttaagaatcggcttgtcttcaagccagtgcatctggaaaacgcttttgaagttgtcgcagatctttccaggtcgccaactacgctgacattcctctctagtgtaccagcccttgatggatcagcgacttgcctctcttgatcaaccgtcgttggagcacctcttcaggaagcacttctgttgttgcatcaatacaggggttaggaagtttaggactcaccactatacctgctttgaccgccttttcagaagtgatacatggaccattgcatgaatctggctattcgggggtaattcgaatttataagccattgctccaatcctgtctatcaccttataaggcccaaaaatacctgaaacttagcttatgacaagtgcgtcgagccacagacatctgcacatagggttgcaatttcaaataaaccatgtctcccacttcaaatttcatgttagttctgtgtttatttgcttgatgagtcattctttgctgtgcacgaagcaactggtgatgcagcatttcattgtacaaagttctgtcttgcaaccaagactgcacatctagtgcaatactctatcctaggtccaaggtccacttcaccaaaatgtgttggcttccttgcaaacaacacttcatagggagatttgcccaaagcagtatggaaagccgtgttataccaatgttgtgcctgggtaaccattgtgaccactttgttgggaaagcatgtactgcatatttaaggaaagcctctacacattgattcagcctctcagtttgtccatctgttaagagggtggtaagaagagctcatattcagctctcttccatttccccaaagtgaccctttcgtgggagagaagaagaacagaggaagaagaagacaaagttggcaggaggattcagttttctcttatcgcataaactcccaaccatgggttctcctcttataccacacacacgcacacggataccaccgctagtctagcacgacacatcaaacacatactctcacagcccaaagacatggcccaactaaacatttaacaaggcccaaagtaatggcccagctgaccccataaacccaaaccgaatttgctatatatttgtcgacaaattttcctccaaaaatttgacagatgtaattacagtataatcgtagtgtaattacactgtaacttgtatgtaattatactgtaactcgcatgtaacttgtatgtaactttcaaaaatctctccgtaacatgttatttcggtaaaatggaggtcgtgggaataaatcctttcacatgtgtgtgctgtgatttttttttcttcctcaccggaacaaatcttgtaatagatctaacgattcaaaattacatgaaacttacatacaagttacactgtagttacatgcaagttatagtgtaattacatacaagttacagtgtaattacaatacggttgtactacattctgtcaaatttttaggagaaaatttgtcgacaaatgtacaggtagtcccaacttatcagacaccacacccgtacaggagtcatgacatttgataagtagatggaacaagatagctagatttcagcacacatgctacagaaacacggaataagtaatttatcctacaagaataccgctaagataattttcagggatcgccaacggtctgcattctgaagatcagcagattagttgataatctactgaatcaactggtttctattcacagactcacagtgctagttgctgtggttgccacattttgttccttcttattctccagaaggacctgtgcttgtttcacttgagaaccgagaatgcttactggattcattgcgctctggtcgctgctagagaacatcatgaacgcttccagttcaaacatctctttggaagccttggacagagattccatcaagctctccagctctgctttggggtagtttccttcgagatttatcagtgatatgatcatcctactggcaatcttcagtattctcaggcaattggctgttggttcactgttttcttctaccaacttcttgagcttcccggcaaagctagatgcagaatctcctgttgcaattgcattagcaagttgagccaaatctgtatcattactgatcaatttttcaaatattgccgcactaagtgacagtaaagctgcatgtagtttcctgtccacgattttcttgttgtcgtccttttgctcattgacgttgccactatctttcgtagcaacggcaccttcgcctatttcaggatcttgtgtcacaaacttggttgcgtctgttcctttttctgtatgcttttctccttgcttcaatggaggagagggaagtatttctttgagcatctgcagtggtagaaattatgcttattaattagtaggtgatgataaagacccaaggtgcgcgtggttagttaaataagtatgaaacaaatgaaatgccttcatttgtttgaaattttatcacacaccgtacctttggcagcacatctttcatggcttccgtcagtttcttgagattgtcatcctcctttgtgtaacaaatgtatagatgcttgaggatttccgccgcacttattctgtatccgctcttggtgcgaacgtcgaggagcgttgtcttgagatcatcgacaacggtgtcactcgccttgaagatgatggcggcgttgctttcgctttggtcgacggaaagcattgccagtgcttcacctgccaattgtctcgtggaggcgtccttgttttctttagtgaagaagatgtcgaccagcagcttggtgattttctccttgctatcggctgtcgaagtcgaaggtgcttccatgggaagctgcgtgaggatcttgatggccaggacgtgtagcttctcgttgcattcgtcgcacccgaggatcttctcgacggtgttgatggcgcgcttgttggaacgcagcttgtcgccggccttcccagggagggcgacaaggcggaacaggagctgcagcgacgcggctacgatgtcggaccacgcgtcgtggccgatgttgtggaggaggtcggcggtgacgggcaccatggccttggagacgaggccctggttgctgccgatggcgctgcagttgtgctcgtcggcggcggcgagcttgtggaggatgtctcggcccagcaccatgagctccttgtagtgacccgacggggcactgtcgccgtcttgctgcttggtggtggtggtggtggtggtggtgtcgagcagcgacgagatgcaccggagcccttgcgggaagctggcgaggctgatctcgccggcgagttgcgccacgatcctggcggcgagcacccggacgtcccggtcgagcgggcttgtggagcgaagcgactgcagaagcctctccaagacctggctagccgacgcggagccgaccagcttcctgatcagcgcgtgctgcccctgcagctcctcctgcgcgaggatcttgtccaggatcctcgcaccggagacgtagtcggcggacgacgactcggacttcatcagctccacggcaaacgtcaccaggttcctctccttgacgaatgatggatccttctcgcaaccgatcttggtcttgcgcatgtaatccctcaccgactcgcgcccctcttcgtcttccttgtcgaacccgtagtcgtcggcgactactcgggccagccgtttcccggcgaagtaggaggctgactggtagcagaagagcacgccctggaagagcgccagtgagtagagcacattgagcgccggggtcaggttagcgccgccgtcctcgccgccgtagtcccgctctatgaggcgccacatggagaggccggtgctgacgagaaggccgaacaggtagagcaacgccagtgggagcagtatgatggcgatcaccagcgcctggaggagcaacacaagaatccccaccagtgcacgccagtactggtccgagtcgtcgtcgtcgtcctctttcctgaacaccatggctacagtaaccaagaggccatcgaacgatttccaagcgtaccgcagcttttcgttcaggaaaacatcgaacaccctgtaaatttagttagatagaggcgccgttagacctggacaagggagatacgacgaaatgggtcggagtgtactggaaatgtttctactttttaggaacttgaaacccataggaaaatgctcgatccgtcctaaaatatggctagattagatatgtagattcatagttgaagcaatagttatattcagtctagattcatagctgaagatagctatattttaagatagaggagtgtttgcaatttcggaacaagtagatacggtcaaaattttcaggataaaaaaatagctataagttaagggactgtctatataggatttgatggattttttccgataagttaagccccccaaaaaagaaccaaacactaatcccactacctcaattccgtctgtggcgcccaaaacactccttgcgacctgaactttccaagcaatggtgatgctacccttactagcggcgacgatgggtcaactactcctggagttggcggcgacggtgccaaaaaccctttctatggcttggactccctaggaggcggcgctcctcctgctagcagtatagttggctaaaagacccgttgcccgatggaccgggccacagcatggagatttagcccagcccaaccattgacgatgcctggtcctctttctcggcacaatgagttggcccggcccggcaagacccaataataagcaggcccaaagagatgagggaggtaaatagacatattccaaggacgagtacagtggactggtcgtgccttctggccgacatggcacggcacggcccaagtgttattgggttgtgcctgcattgaaggtgcagcccatagatgcgcacggcacgatatggctagttggtcctactctcgagccgtgccttggtcgtgcccaggctggaccgtaccgaatggcccatttagccatttataactggcggcgacaacagctcagctgctcctggagtcggtgactcagcgtcaggttcttgaggcagcagcagtcatgatttgctccttcatcctccatccttcctttttcactatcttgatatgtctctccgcctctatgggatttgtccctcagcacttcttctgttcttatagtagtgcgcacactgatttggggtcatggaagaagaagatcctgcatatgttggcagggggagacgcatggggtcatggtggtcctggatcgtcagccgcctgcacagctattgtaactgatttgggcaacaatgatggtagcggggtgggaggaaggggatcagcagcaacaactgttggaagaagaacggagagtgccagtcctaaatggatatgagatgtgtgcaatttatcaatttagcgtgatgtaactgctaaataattcagctgcaataagctcatttttttttctggaaatcatgcattatccgataagaaattaagatttgcgtggactaattattttatcccagaaatttccagaactttgaaattttgattgcattttgttttttgtaacaaaatttcatatttgaattcaaaatattcatacgaataatatccaaatttttgggttttttccgaccccccacgacaacaaaaaaacatttcaaaattgcataccctgcaagggagtacaaaagacgaccttaaaattgaaaactttagccaaagtatagttcagtgaattatacaaattgaatacatattatttattacggtacataataaacatcaaatattaatgctaaaagagtaaatgtcgtactcaagcaatcaattgacctcaaatctatctatctattatattatattattaaaataagaaggcatcatgttcgctgtgtaggctagaaattcctgaattaattgaaaaaaaaagaaaaaggatagtctatatagaaatacaattgagaaatcactgaaattcggaataaaaataagcaatattgcaaaagagttcatataagaacccaatacaaaattaatcgaaattcgaaataaaaaaataaaataaattctgaaattaggaaaagaacaggaagagttcaactagaaatacaatttagaaataattaaaattcggaatacaaaataaggaatattaaattaatagtttagctataacacagcacgagattaaataaattcagagtataaaataaaataaaatacgaaattaaaaaataataagagtctaggtaggaatacaattttgacgtaactgaaatttggaaataagaataaacaatattagaagaatagtacaaataagaatccactacgagattaattaaaattcgaaataaaaaataaaataaaataaattccaaaattaaagaataaaaaggagagttcaaataggaatgcaatttaagaaaaactaaaattggaaataaaaaaaggaatatttttttttgacgtgataaaaaggaatatagaacacaatatgagattaaaataaaataaatttataaattagaaaagtaaaaataactaagattcgtaataacaaataaagaagatatcatagaacacacgatgagattaattaaaataaaaaataaaataaattctaaaaatagagagttcgaataaatgagtagagtggtggtggttgataggacactaaaagatataaacaaaacccaaatagaatgtcactgatgattaagtggagggacgatgggtagaccattaagcatcacggtcacgatggcgggacttatagaaagtaaaaaatataccctaacgataatcatattttatttttaaaatctcatgataaaaaagaggggaggcagcgggtggtccatagaggagtacggtggcaaagccgctgacagtttgataggacttctagaaagtaaaaaatgacctaaatgataattatgtttgtcttttaaaatatcaatcgcaataaagagataagtcggtgggctggtcataaaggagtaaagtggtggcatttgacgagacttctaaaaattataaaacaaaacccaactagacaatgaactctaaaaactacaatgtctaatttttaaacgttccaagaagaatgaatataagcagtcatagatcgcatgcaaataaaggagtgataaaggagtaaggggtagcgactggtgtgacttttaaaaaataaaaaaaattagaaacacgtgaactatttaacaaaatttaagaaaaaatcatatgtaaaaagtagataattttgtatgggtgctagccacgcaattgcgcgggtcacccagtagttctattgaaaagcatcatccttttagtattgggttgaaatgaaatcttcctattggggcaagatgggctttgctttactctagaacttagtggattagaaattatggccccgtgtagtcaggcacctcgcaaatgctacaatattgctagcaaattcctttgcactctatctttccttccaaatgaacatgaacagtactagaaattcctgaagaatgatcttatgaaaatctttgttccgaaagtgtgttttgttagccccttttcagagaaagaaaaattatcattgggagcaataaatggtcagaaaagaaaagaaaaaagtgacgaataggaaatacaacaaatgtatagtagaattaagaagtctaacccagctgtctggacaagggtgataatggtgagactccaaaaatccttcttctcaagcatggagacgaagccaccaaggaggacgacggtggtccataaacctactaggaagcccatccccttgacggccattgacaggtaccccataaacagagcataactgttgataccgtcaacttccttccactcggactgatcaggttcattagccattgtcagttcttcctcaagaaagttgggatcatcgtttgcaaagcagcaagccaatatatatacaagctcctcgagcatatgggatgattaactatcaatacgtagaccaatagccgattaatgaaaaatgttcagatcttgactttacctgcacgaagcgatcgaggtcattgtaaagtatatattgttcatccagcctgttcagttttggaccaagcaattagctaggtctttattatatttatgtattagtagatcaatataaaagacctacaaataaattaaagctagtggcctcacaagttacaatacaatattatgcttctcactgtttgtgtacccacactctagctagattactaatgctgggattattattgtttcttgaatgccgggaaccagacgtaattgatgcacatatgtaacacatggtggactggtcgaggagcgttacatatgtaacaggagctgacaacgatccgctaaactcgcaagagtaaactctagaaaacatcatgaagccttccagttaaaactgtttacaactaaatttgacacctagattcgaattatgaacattgccaaaatttgaaaggcgccgagtttccttcacggggccggtccgaccaccgcctatgggagtccaaaccgattttcatcgggtctcgggtttccttacttggaaaggtatttttcgagtttccattggtttccaccccaaattaaacgtggagaagaacatgtagaagacaagaccaactcctttataatagccaaggtcggttcgacctccctcccccccaaatctcaatccatacataatcgaatcgtttttttacttctacttttagccattttttctactttaccttagttttgtccatctttgtcggtttgcgccgtaaaccgtccgccttcactacgagagtgcgattatctctttgtagatttgtcttataaccttccgttcgcccacgagacgggtggttatcttcaaatcaatctaaatcggccccgaggctaatttgatctctaaatcgcctccactagccggtttaatcttcaaagcccatcttgatttagaattctctagatcgaggtggttggtgactccattaacaccacaaatctttaaatgagtcatggttgggaccgaaaagggtgccaacatgaattggcgactctgctggggaacgtcaagaattttggccataccacggccagaaacaatctactatatttgttgcttacgcatataaattgatcgctcagttgattggatcagatcggcgacatcattctcttaccgccgcgccggtctgaaccagtctaaccgacgttgtaggcccggtctgaccggtgaggtgaccggtctaaccggcagaaagcaccaagataagcagcagcaacattgtttccttttattgctgcacactgttactgagaagaaataggaacagagcggccgattttatttaacatcggttaatttttggtatatttgctacagtaccaaataccctgttacgatcaatcaacaaggctaagtttgataaaattggtccaaatacagtagcataccaagaaaactatagaccgtatattaatctatttggtcaaaatatttcagctataattaatatgatcgaaattcatccacaaacatcttcatcaaccatgacgagtgggaaggagatcgacaagctcaccaaggaggactggaccaaggaggagtggcgagactttgaaaaccaaatggcggcgtgtgagaagacgatgctcgcaagcttcctcaagaccgaccaaggcgtcttcaaaagagacgtgacgtcccgctaccttgttaggagctctattgggccgcatgcagtatggaccatgcattctccagagcaagcccaggctagcccaagcgactgggaacaaaaggatggctgctgctcctacaacaaacattgaacagatcaaacaggcatcggcggcttcagccacggcggcaacggcgtcaaggttctaggctagaacctcgacgatctatcttctctaccgatctcttcctacctccagcttccactgctagttctagaagcttccaaaacttgtattccatagtttcttcttctcttttccccctaaaacaattgttgcttgtatggtggatccttgctattgaattggaagaagtgggttcctaacaatctagtatcagagccgctcggttcgtgggatttctcgtcatgcaggtgttgggaaggcagcagtgcaaggtggaggaagatttgggcaagtgaggtgctcatgaatctagcgcacacaacctgttcgatagaataccaaaccaacataaggtgtttaaggacgatgaaaggatatcagagcccgtttccatcaaatccaccatgaacaaggagggaatatccatggacgaatctttagatcagaatcttgggaagcttgagttgatggaggccaagtgcatgcaagaggagaagttcaatcaaatactacagaagttggaggagatagaggcttgtaggagcaaggctaccgaggtgacgattgctgccatcaggacaaccaccgccatcctcaaggcttcatcatctccaacaccatggcaccacctcctccaacaccgaccaagtgtttgacaaaatgccccaacaacaacttcacttgggtgatggcgaattcaagtcacattggtgaggtgcttgctccaacggctgcctgggagctaggagacaacaaggacaaggggcacgccccctgcatcgtcaccaacgactcacccaaggtcacgcccgccaagtgctcgaattgttctagccctgacatcatgctagacctcaccgtggctgtgggggtttcatgtgccactacttctatggcctccatggagttgttggttggcgaggatgaaaccagtgtcatctacattgacaaccctcattgttccatagcgacgcatgccaagtgttcgactttgggcctcgatgtcaatggtagcgccaaccaacctgtggtcgtgttccctaccattacagctatgaatgggcatagcatcattccaactctgcctctgaccattatgaatacgtcagtcatccttgttgtcaaatcaagttgtgctagcgacaattctatcagacttatgactctatgttagccactaatggagtatgctgagaggaatccatggccacctcctccttcgaacaagctaacgggtagcatatgtgagctatggccagaaccatggtcatcgtttgcgtgtaatcgatgcaaagtgtggtacttgttccgattggagagcacactattactgtacgtgaatggagttgagcagtttctaaaggaattgccatgctggccaccgcctcaagaagatgtgattaaatctgagttttatcatggagggaatcaattttggttgaggaattcagcttgtgttatttttttttagataatggattcagttgtgttattgcagagacaaaaatgatatacgtagctactgttgtgaggttcagtttgtgctatatgcagatgggtgctatgaaaccttcaagtgttatacaatggttaaatttcccctactgcacatatgacggattcaagcggaagcttcgaggcttgttcacaaatggagccttgtgcatacattcaagtcagtatgatcctccagatgggctttgtgaataatccggttgctatttagtagaactagaaagaaagcccgcgcaaatgcgcgggcatcttattgattgttttataaaaataatgcttaaagaagttacatctcactatttctatttaaatgttataaaataataagaatatatctcagattaaaaatacactttgatcgagtgacatataaattctcctattgtcaccattacttactatgctttaaaacctaataagtaattaatacactaaattatcctctatttaggtttcatatctcattttttttctaaatccatttataaatattataaaaataccaccacttctattcattaatggagtagcaccattaaagttaaacacgaatactactctagtgggtgaagtcgattgtagccaccaagactttctttctctattgccttgaaacatgagtcccgcatcgatgtagccatgctcctgaagaccagcttggagcataattttaatgtatgattcattatcacatgctcatggagtattatattggtaagtagaaagttgagtactattagcgatggtggcctccactggaactgtaacttagtcatatattccattttatacttacgacaccataataaactttgttgtctaagtttagtgtcctttagggaagaacaaagagaagatggaggtgaccaaagtagttttttaaaaatgttttgagtagatttgtggtgcagtgtaaacacaatttctttatggtgttgatcattactactcattttttttatgaaaagatagaatactctcttttgaaaatggccgagtttaataattcgatgatgttttttaaaaaatatagctaatgagacatatcaccacgatagtatccagatcatcatgttattatctatgttttgacaaatatgtatagtcaaatagttctaaaaatataaaaatactttcagaatcttaatctcaaacaaattgtaatttaatcagacctactcgaaaaacacaactaaattgtgttgcttttattttttacatatgcagatttaaattaatgttgtatatttgtgaagtgaaatttccctccgtaaaatatgatgtgatttttttgaaaaattatcatacatatgtcagcctcatgtgccgtggtgtatttaggaccataatataacttttataatttaattaaagaaatataacatgatcacaaattggatatataatttcaaaataatttagaagatggtttaaaaaacatttattgagtattctatgtttttattatagatcttagtttaactatatatatttatattatatttgtgaagtaatatatttcatgtttatattgtggaaaataaccgtccatttttatatatctactagcaaaatgcccgtgcttcgctacgggtaaaggaacggttaaattatatgaagtacatcgttaacatgtatataataatgttccaatataggtaaattgttcattgcgctaatgataatcaagatggataaaaatattcatgtttagctcacatcgcgaaagaaaaaattaaattaaaaaatattaaattctaatttaatgaaatataatttttttgcaatattaattacactctttgaaattatagcaaaagtgctcgtgcattgcaaccggaagtgtatagaccagaaaattgaggaaaagttaagaaaaatctacactatgtaattaattaaaatacaaatttgctgaaatatttaatattttaagtaggtaggtgtaaaactaaattaatttacaagtaaagtaagtgtgagaaataaaatgacatggttaaatttaattttattaaattctccatgattagttatgctctttggaattttatttaaattttcagagcttaattgctaattttaataatacaaacatcatttaacaattatttaattggaaaaagaataaaaatcctcccttttaggtttgggcataatatgaaaaagtttatattacctcccttttgcctatcatatgtatctggactattctttctccgttgaagttcattttacgtcctcatgcaatcacgcagtccgttcggcggcccagtaatgtggtggcccaataggccgacggcccgatgcgggagcagctagagccgtccgatcaaatgaacggtctagattgatcctaacctaaataaatacccaaaacctaaccctagaatacattcccccctccccacccccccggaaacccaaccgaggggtgcaccacccttcccccgcgagcggcggcgtcagcggcggtggcacactatccccgcgagcggcggcggcgcggtgccctcccctcgcgaacggcggcgtcggcggcagtggcgccctccccccgcgagcagcggcgtcggcgacggctcccccaccgagcatcggcggcgcggcgccctctccccagcgagcggcggcggcgccctcccacccccctcactctctccacttctcctcctttctctctgtgtggcggcggcgggagggccggcgacgccctcccctccgctagatcgagggggaggagaggtgcggcggcgggtcggacggcgtggaggcggccggccggacctcgcctccgccacatccggcggcgctgcggctaggacggcgtggaggcggcgggccgggcctcgcctcctccagatccggtggcatggaggcggctgcggcccggcggggcgtgaggggcggcggcccggacagcgtggaggcgggcgatggtggcgccgatttttttttttttgcatttttttccatcactattgctaacctaatcggattgcgtatggacgaaaactcggacgaaattagatgtgacgaacggaaaaatacgaatatttatattagttatagatgtgtaccaaaaaattgacgtataaaaaatatacatgtatataaactttatatacgcgtatgcaaactttacatacgcgtatgcaaagttccatttattatatgcggtgcatgcatatataatggcattgacattactttatacagaaatactaatgaggacacctggctcagttcgtttctttgagttcccaactcacactccccgttttttgcttttcaaactactatattcatctcaaaataagtgcagtcgtgggtatccgtgtttaacgttcgaccttttgttttatttaaaaaatttatgaaaaaaattaaaatattagtcacatataaaatactattcatgttttattatcgaataacaataaaaatactaataaaaaaaaaggcgatcgttggacatgaacagtgtaaaactgcacttattttgggacggaggtagtactaaacagtgtgttttatgaaaaaaattctatacgaaaattgcattttaaaaaaaatcatattatccatttttctaaaaattagttaatatttaattaatcatgcgttaatgaactgctcagtacggagaaacacaactaaggccccctttgattcaaaggaattttataggaattttaaaggatttcattcctataggaattttttctatatagccctttgaatcaaaggaatgaatcctatgtaatcccatgaaattcctatggaatgccacttcccatgcaagttttggaggaaatttagcatgaagttctacctcatgttaagaatcttttgttcttgcggctcaatcaaacggtcattcctatatttttcctgtgttttacaatcctttgttttacacttatattcctgtctaaatcctatgtttctcctatttctccattttttcatttctttatttctgtgattcaaaggagtcttaaatgtgtagatttatttaaaaccattgtttaaatagcattttcaaactgccatagtacgtatcttttttattaaaataagcagttatatttgcttttctttaactgccgatcagaggctcagagcggagagagcggcgtccctgcgcctcgataattccgcccgtcattatctcctcgttctcgccgagctcattcctctcggtgtttctctcctctgccgctcgcccttatctcctctcctccgttgcgctctctttcctttcactccttttctccttctctactcacagctagcgacgccctccatctccgcccttccccctctgccccactgcagcgttactccccgtacccctcagccacggcaccctccctccagccggcggcgcccttcctccggcgacgacgccctacccttggcggttggtgccccagccgcggcgccctccccctggccggcgacgtccttcacccggtgggcggctgctcagccccccccccccccggtcgacggcgctcttcccccggcgggtggtgccctacccttggcggtcagcgcctcagccgcgacgccctccccctggctggcagcgccctctcctcggcgacagtaccctcgcggcgcacggcggtgcccccgccaagccaccaaggcctcgggcagcggcgtcctcagcctctaatgagcagtggcgccgagggcggatccggcggtggtggcatcggcgacgtccgcgggtggatcccgcggcggtggcggcagccgagggcggatccggtcgcctttttttttctttttttttttgctcgagtttattttttatttttttggaatcggacattgggattcatgagctcttagattaaaattggcttttttgtgctgtttttggttgtctcattgttcgatttatttggggatcaagctgggggatttttatttttgaaggacgccgtggcggagggcgaggacggcgacgcggtggccggcgaggaggaggaggaggagcggcggcggctaagcgaggaggagcagcggcggcggccgtgaccggccggtggagggcgccgaggccagtgcccggggcgaatggcaggaggtggggccctgtcggccaggctggcggcgcgccgtggtggaggggcgtggcggaggggcgaggacggtgacgcggtggcaggcgagggaggtccctagggtcgtcgggcggcggggaggaccaaattcatgagctctagattaaatttggtattttcgtgctgttttttgttgtgtcgattgattgatttgggtatttttgaagactaccaaaatgcccgcttcgccacggtgtattgaactaaaaatatttgtttttaagtgaagttattttcacactgctttggtatttttgctcgttagaaaaagtctcaaataatagagagaaatatagtagcttaatagtgtgttgcaacggaaaaaattaatgttattaactttttaaagtaataaaaaaggagcattcacattagctcttatagtttagaaattttcatattaatattatttaattttagtctaaatttatatcatgacaaataaataattatatttttagtcgaaaaataaatccatatcatgagaaaaatctagcaaatttttagttaattcaatttagttggaattaaattattaagcagtaataaataattaaaatggtactaatgctatttctgaatatagaaagatgcttaaaattattgagaattattgagagagaaaacactaattttatcctagcccaaacttgcggaccaatttggaggcccaatagtgccgcggcccaatgcgagagaagccaaagccgtctgattgaatggacggttcagattaatcccaacctatagaaatatatgcaaccaaaaccctaaccttaaatttcatttcctccctgccaccgatccctcctctctgtctcgatcgaatagcgacagcggcggcgcccttccccctcacaagcgactgcggcggtgcccttcccccacttcccacgagcggcggaggcggcgtcctctccccaacgagtggctgcggccgcgccctccgccccgtctcacctccctcattggtggccgctctctccgccccatctcgcctccctctccctctcatctccctctccctctcgcagtggcggcgggttggcggcggacgcaggcggatccgaggatggtggcgacgtcgacggcagttgcgggcggatccggcggtagcggctccctccgccccctctcgcctttctcgcgcggtagatccggcggcggtggcagcatcggcggctggatccgtcggtggtgacgacaaccgtgaacggatccagctactatatttctctctatcatttgagactttttctagcgagcaaaagtaccaaagcagtgtaaaaataaacttcggttaaaaaatatttttagttttaatacatcgtagtgaagcatgggcattttgctagtataagatataaattactattagtaaaagaataatatattgtcaaataataatactgcatatttctaatttacaatcataaagggcgtatctaaacatacggtgaaaaatgggtatacatatataatcatgatctaagtagggtataatttcaactattaaaagaaagtttatttgctcagttggcgacagcatgatgtgcccagaacgaaggtcccagggtcgattcttgtctcgtgcgtagcttttttttattttttatattccatgaacacgaatctcaaagtctatctaatagactaaaaatcgaacatttttttttttagcgtttgcggtggcagcagtgatacgtgcccgcaagaggcgaatctatcccagaaaaatcaacggaaaaaaaaaaccggagccggcccacagtgtttaatccctatccatccccacaccgcaccaacccagccgcgactcaactcctctctctctcgttctctccgcctctccgcctccggcgactctttctctccgcctcctctctccttctccctctacctgcgaccccgcacctcctcctcctctccagccgccgtcttcagcccggagctctccttccgcgggtggcaacgggcggcagcgcctctccgcccctcgcctcctctccctcgccatggggccgcgggagggctcacggtggcaggcggcggcggctcggtatcccagatccggcgtcctggatggctggatccagcgcgagcggaaggggaggggaggtggtggtggcctggtttcccagtcgcggcggcacccttttttacggtttttcgtctttttgtttttctcctttcttgtggatttaatctgtgatgaattggcagcgaatccgtgggtgggattgagaatccgttgatgtgaatctgtgatgaattggatttctttttcttttttttttggaatttttccatcgctaacataatcggattgggattgggattgagattgagattgagataggacggacgaaaatacggacgaaaagagatgtgacgaccggaaaaatccgaatatttatattagttatagacgtactcggactcaaaagacgaatgacggacgaagcggaataagtttttaattaggtatgtcttttctatctatgtttgtatggttttttccttccgtgaacagtagaaatttaaattgcatgtactactcgtatgtcgtacgtacgggagaccggtagcagctttttatctaaacaggaggaagttattattttacaataatagatctaatctaatggtgtagaataatgggtctaccaatttaagtgaaaatcaaaggtgagattagatagtgctatatgatggtttaagagtgtttataggagtgccacgtggcggcttaagagcgtttgtaaaaagtttaatggacttttagtatataatagatagattttctcatatcatcacgaacggaagtgggcaaaatgtgtttgtggcattgtcaaaggtgagatcagtgcaactgttttcaaatggagatagaagggagcaccatgtcagtaatagcaaattctggtccaatctcccaataactatccaccaattcttccatacatttgcaattgttgctttagtggtggctctgcaaacacatcagttcagagaatggaatggaggataccttgttctgatcttacgatgtggtttagaaaatgcaatggagatctggtcacatatggacatgagactaatcatgatgtactagtacagtatactgagtcactatctcaccaaataaaggcaattgtgcacttactgatcaggaacaaggtaaacacatggatatctgaaacaatggggagaactaatcattttggtgctaagttcacaattgcttgtcagttctcaagatcacttgaatttgttcctatcgagagtatacataaacagtggggttctaaacagcacctgtgcattctgctgcctattccagttagtacaaggttacggataatttcagcaaacaagcattattgttttcaaggaaaaatatcaaaattgctggtggcattctttgttgttcttaccacagaggggttaactatggttataatggaaaagaaattgtgtgagctgagccattgctatggtttcctgaattatacaaatgcaatggagggtaggcaagcaattccttttggtggagccactaaaccagatacatgaccaattggtagtgttgacaagattcaccttctcaaaattttgctgaatgactggcttcaacaacactacttccattcgagggttgaccagtggagcactgagtttgttatcaaggttggcattccggaagagtccacttggtgtatcagtttgaggcatttgctaccaagaaaagatgtccatggaaattgcattgtcagatatcttttgtcaatttcctattgttaaccggactgaccataggagctatgaggacaacttatctggtaacatcaggatgtgctccattgcaagctaatcatgggggcttgaatggcgaaggaggttgactaaatgtggctgcaagttcttacaccaagacagataagaaacaactacctaatatgtacctctccagtcaacaattcaaatatttagagcagccatgggatccaggaggattacttcatcggcttgaggacaagccgaaacttaagaggggattgttagaagctctattgggtcgcatgcagtatgggctgttgacggtcgttattgatcagtttcgaccgtcaatactactaaaataggagagaactagtgatgcttacaatgcataaaaatgttagagtaataatattccacaagtattaggttactaaccttttgcagagaatgacaataaagtgaaggagaatcgacgtcaacataaacgataaatcaatcggacgatgtcgacaatcagacttatgtatgaatgggccaagaactcagaattgacacgatgaattgggccaaaattcacaagtctgcggagtggagcaatagaggaggccaccagccgaaattgggctggattgggccaaccccaggttcggccgaaccaatcctggcgccgttggatccaggttttggcgtggacgtctaggattgcatcccaatgacggttggagggcactttggacaattccccttccacaaccgtcataactacctctatataaggacttcaccttgtcacttcactcacacacctcaagcaatagctctctcatttctctcaagcttaatttagtagtatctagctggtggaataggaatagagtagaaattaggagtctggaagccttcggaagagttcggatatggctctagcagcttttcttttctcttttataagctttgtacttttattagaatactcttctaaatacatttatggtattgaaatattttccgagtatatgagtacctactttacattatgttcttgttatactgaatatacggctagcttatctgggagatgctttggtgcgggtataatgtttgcttatgcaattactctatgtcatgacgatgatattagagtagtatctggtagtttagacgtggtgtctagattacgagatatcattatttggggttatatattacggatgagaggtgggccgctgatggtgacagctcagtacgatatataatcctaagttaattccctgaggagggtattcctccgtatttagccccggttgtatagtcatgatggactgtcgtaagaaactcgacagtcaggggtggcttctcgaagtaccaggagggtatcagaaagagggtattagctagtatatcagttaactaggatgtatatatactatgtatattagaagtataggaatagattatcttcctcttttctttccacttagcttagataatatattatgagaatgagcagtttatgcttgtgtgtcactatatccttggattatcttaacccctgtttagaatatgattatcacaagcaatatataaattattagtcatgttctctctacatgatcttcccacgggataagataaatacgatatccttggaatactctcggatgaaatgttacaatggtatatccgtgcgcttgcggatggactctgtaaccataatataccagaagtatttctgcgtcattgctaagaattatatttctagtaatgtcgttaagaaataccaacatgggccatgtaatccattctccaaagcaagcctaggctagcccaagcgacagggaacaaaaggatggtactgctcctgcagcaaacatcgaacagatcaagcaggcatcaacggcttcggccacggcggcggcgacaacctgcttctgggatgaacctcagcgaactctcttctctacctctcttcctacctccagcttcctctcctagttctacaagcctcgtccgcgagcgaccgccgccactcgattgccactcctcccaaatccggaagccacctcgcctccgcgacccaccgccgcctctcctccactcacaccaacgggctccgccacccccacactcaccgcttgttgtgcccccaccgctaggagccaaacagcactaacggtcagtgcaaatccgtccatcccatcccacctcaatcccttctaccaaataaaaactataactatcctataccataaaccaaataaataactgaaaccatcccatcccatcccaaaaataggataggtctaacctatcccattttgtccccaaaccaaacacacgctatgaggtaaaatggccgataattatattatcgccctaagattgcatgctatatgctttttggttctcaagttcaccaaaaaggcaggggacatttgagggtgttagcttaatgcaagagttagcttaacgcgtgctccaagacaaataaatcaaatgtttaagtgagagaaagagaggggagaagaaaaattgaagtcagccttatagcctccatattttaatgtatgacaccgttgactttttgtccaacgtttgaccattcgtcttattcaaaaaatttatgtaattatcatttattttattataacttgattcgtcatcaaatgttttttaagcatgacataaatattttcatatttgcacaaaaattttgaataaaacgaatggtcaaacgttggtcgaaaagtcaacggcgtcatatattaaaatacggagggagtatatgtgttagctttaagatggactaatagtagaaagtgagctctacctaaccagctgcgcaggcgcaatgccaacgatcgattgtgccttcctcttctccacgacttctcctgcttctttcacgagggcagcgaaggccgtgttggcagtcgtgttggcagttatacttgaatccaagcagacgtcggctgcgatcttgtcgaaccgatcagccagaactggatccgtggagatcagcttgtcgcataccgtcacgcagagggacgccaacgcctcctgcacttctatttcctctggagtatattgcttgccattctgctgattggaacaagatgaggcgttgttgcctccattgctaactcgtgaaggatcaccgtctggtagggcttctatgtctgcatctggtggcgagaaattcccagaattgttcgcctgtgtagctactgtttgtctctctggtcgtctccagtcacagccaagtaattctctgaggacctgaaacattaaccccaaggtatttcagcataaaactttttcgttttgtacgtgttaatttgacaggtatcgatcattacctttggtattgcaatggtcatggagttcttcagtttgtcccaatgttcatcgtccgtagtgtggttgatacaaagatgtttcaagatatctgccgcacttgtcctgaatgtgttgtcctcgacatctacaaccatctcagaaaggcgatcgacaacaatactatcatttagcttcaacttcaggatgatcgaggcgttgctttcgctctcgagagacagcttcaccagctcttcgcctgcacatttcctgacggagctgcgtttgctgtcatgaacaaagatgtctgtgaggatcctgatgagaccctgtatgttttcactgctcataccaccagaagacttgtcgagagagagaactgtgagcagctgtgcagctagcctccgaagctctgcatcacaaccgtcgcacctgaggatgctctccatggtgctgattgcaggcttgcagctcgtgatttggcggcgtagcttcacgcgggagtcttggaaaggaacagagacaagctgaccaataagtgttatcgacccctttgccatgactgagagttcatatctatggtcgtcgtcgtggtcgtcctccatggtcggagccggagctgataggtgccatgatcgtggagacaaggcctcgggtgtcgctcatgatcctgcagttgtcctcgtcggcggcgagcttcccgaggatgcgctggccctgcaccaccagattcttgtacttctcgagtgacagatggggaggctcacgctcgtagaccagcctgtacatctccacgaactcaacctcctcatcagggcatggtggtggtctcaattgcagcttctcgagcaccaaatcacggtcgtatggctcggcgaggcggtactcgtcgtcgagcagtgaggttacgcagcagagcgctcggggtagccgttctaggtgaacgccaccggcgatgtaagccactatcaccgtggcgcgctccctcgcctccgcgtcgtgcgggcctcgtggctccagcgtctgtatcagtttcagcatcacgacatggtggcgagaaatgagcatatgtttgatcatcctgtgctgctcaacgtgagtcgtggtacaagcgtagctggacgctatctccccgacgagcgtgctcagtatcctgagcccggagaggtagccatcaggtgagctcgacgactccacctgctcaacggcgtaggtgaccatgtttctccctcgagcgaacgaggggtcctcctcgcatccgatcatggtgtcccgcaggtagtcccacaccgactcccgcgcgtccatgtggtaatatcggcatacatcattcactattgcttctgctgcagatgaatagctgaccctgtaggtgaagatgacgccctggaagatagccaacgagtagaagacgtccaaggctggtgttatgttggtgtccccctctcctgttaccgagtagtagtcccgacgcctcgcgaggcgccacagcgagagcgccgtggagatatatatagatcccgaacatgtacagaacaatcagagggcacattaggacggcgatcaccaccacctgaactcccagctttagatagtgcagtagctaggatgtatgtgatgttgaatatgcaggaacccctagctgtgttgcactccaggtagcttaaaacgttcattagtgaaactgatgtccttactgttgtctgtaacaagcctctgtagccatcccaaatactgctcagcttttctttcatgaagacatcgaagaccctgtaagaaaaaaaaatatggagtatcatcaagttttaatgaactcagtagacaggaatagtgaaggcacaacaattcttcttaattaataggcaaatcttgctacaggatatccaaaaaaagtgtaattagctacgagacaacgcaagaacgtgtttctgctatagagcactgtaaaaaactggtaattatagttgttggacacccgcgggattattttattatatctagaagaattggagagagaaacagctgtgtaagtacggttcaaccctttgattttttttcttttctttttcatttttcttccttatccttttctccctctctcattctttctctatttctgtctctgctctcaaccgccgccttcaacctctcccgccgcttcgcctatcatcacggcgctcgctcgccgccgccactcctcccacagcgtgagcagtgtgttcagcatatccaccagcagcctcccggccgccagccgcggcaccgaccgatagtccgcgccgccgtcccgcatcagccccagcaagaacccctcgtcatgcggcacgctcctcgcgtagcacggccacctcgcctccgcggcgcttctgcaggcctcgctcgcgcctgtgtcgacatccttgccaccgcccccatcgtccacaaccctatggaagtagatgcggtgggattcctcctcgaatgcgacgacggtgacggcgcccgcgcggaggccagccaggaggtccgagtaggccacctccttggctgcattcttgggcagcgcgaagcgagcggcgaggaggaggaccgctaggacgatgggcgcggccgccgcgggcggcacgcgtcgaacggctcaccgcagcgcggctgcagcatccccggggaggtcccgcggcaagagccgctggagccacaggcgtatcctcctccgttccggcttgcggaaccccaaaccgacctccttgtccacctcgtccaccttggcacacaccggtgccctccactgcaatcgcattcattccctccgctaagcaacccgcagccattgctcgcggcgaggcagctcgaagaacctgggggactcacgaagcaaacccgagtgcgtgggacggaggcagcggcagcgcagacgggggacaagcaagccgccaccaccaccacggcagccatgccaatctctacggtacactcactttggattaatttgagccaagggcaaaatggtctttaatgattgtttctctctcctattcctctaaaaataataaaataattttgtcggtgtccagcagctaattaccatttttttacgatgttctacagcaaatacacgttcttacaatgtcccctacctaattgcactttttttatgtactatagcaaattttgcctaattaataatgtatggaaacatccctacatccctcttatcctcctgttactggatacgtgttgatggagtcgaattgtccgacaaacatagtgttgacagccacaattggcacatcccaagcaaactggatggtctggtctgctcatccaaatgaccagtttttgggtagttaaagattaccgttccgtcctagctagttttgaagctaccgcatgtgattgtaaacaccctgaaaatgataaaatggttgttcttggcattattgcttcgttttcttgtagtcaacaagaaaatactccctccgtccctaaatatttgacgccgttgagtttttaaacatgtttgaccgttgtcttattcaaaaaatttaagtaattattaattcttttcctatcatttgattcactgttaaatatacttttatatatatatatatatatatatatatatatatatatatatatatatatatatatatatatagttttatatatttcataaaagtttttgaataagacaaacggtcaaacatgttttagaagagtcaacggcgtcaaatatttaggaatggagggagtaaaatatagcggttgcttatgttgaataaagattggattacttttgcatgtgaaattatgaagtgtcttttttttcaaatgatgttctccctcatattgaaatcattacgtaataaacacgtagttgaaatagttagttaacagtttgcttcctgagatttattctcacaaccgtaattacaatctttttatgcacttaatgcggttttgcgcgtgacttatccaagtcgcacgtgtaccacgtggcgggtcatcgtacgatcgatcgtgcacgcttcttttttctttttttccttttttttcggttgcgcaactgctgtgtttttttttcttttttttctttttgccattaactaccacacgcatctaagagtaggagtcaatatttgaaaactttcaagttaaagatttaaaaaacttttaactcagatttgaaaactttcaagtcaagatttaaaaactttcaactcggatttgaaaactttcaattcaaacttgaaaactttcaactcggatttaaaaacgttaaactcggatttgaaaactttcacctcggacttgaaaactttcaactaaagatttgaaactttcaattcaaacttgaaaactttcaagtcggatttgaaaacgttcaactcggatttgaaaacttttaactcagatttgaaaactttcaactctgacttgaaaactttcaactaaagatttgaaactttcaattcaaatttaaaaaattcaagtcaagatttgaaaacttaactcaggtttgaaaacttttagctcaaatttaaaagctttcacttcaaaattcaaaataatcaacttaaatttgaaaactttcatctcaaaattcaaaacattcaacttaaattttagaaacttttcaactcaaattcaaaactctcaactgatgttgaagctgaaagattgaatttataaaatatcgtataaaaatcaagcgcgcaagtggaaaagaaagaagcgattccaaaaaatctggaaattttaaaaaggaaacgaaaaggtgacgccaaaataggagatctagagaaaaaaagaaacgcgtagggacgcggctagcgcgcgccggctcctttcctggcgcgcacgcacgcactagcaaccccctacttaatgtggcatgtgtgcgcgaggaaatgggagtagcagaacgtctgcacgccatgatgtacttattgtgcacagatgagtttgttgatttattggtttaattgaatactagatatgttaatcttggaagggcttgaagttgcaactaaagtaaggtaaatatgttctattatgtaataaggatggcgatcatgcatatctgttaccgtagataccggcactgtgtctgaggattatctgtactggtatcatggctctgtgggacactttatgcgctctcatgtagtaattcctatctacttccttcgtcccactagtctagatttgttgtaataggatatattatattcagtactaggttgatttttttatgggatgaaaggagtgtgttccattgtacgatggcattggggtgggatgcaagagtttagaactaattgcacatttttacaactgcgaggtcatagcactatggtaaaaattaaaaaaaaattgcatcaactatatattcttatgtttgaacgagtgtgtggtacttgagtttgcgggtaacaataattgtgtactacctccgttttttaatagatgatgccgttgactttttctcacatgtttgaccattcgtcttattcaaaaattttatgcaaatatataagatataaatcacggggtgcagg

SEQ ID NO: 71136 - DNA, 15234 bp, Oryza sativa
aaagaatattgtatagtactagaatcgtgtttgcaagaatagccctgagcaactaatgtctttaaatgctgtttactgcaaccctaaccctttatagtgtaactcctttgtactcctttgcatttattctgcacttgtgggtgtgtcttgttgagtacggtggttgtactcagtcttgctcaatttttcccaaacccagaagaggagttcctggaggatgaaggcttcggtgtctagctcgtgcctgccgtcaagtgcctgtggtcgtcgccctagtcttccgctgtttctcgtttgtctttgtgtgtgctgggccttcgctgcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacacctgctgcttgtcatatttcttctaatacttatcgataatcttagtcgaattcacttgaaaacctctagctcttcctgcatcggcagttcgtccagcaatgtgtaccatattgatgggaaaaggattgcaatcgatcttcatcggcctcttggagtcatcaaacttgattttgcctcctttaatagctgcttggatctgctatctaaagacattacaatcattggtagaatgagacccagaattatgccacttgcaatacctcctcttgcctaactcctcagccgatgggattgtgtgcccagcaggaagctgaatctgtttctccagaagtagaaaatcaaagatcttatcagcctttgtgatatcaaagtcatatctttcttcttttccagaactcttcacccattggcatggtataaccttcttgcttctaacccattcggctgctgctatctcagaatcatcatcatcatcatcatcatcagatccatacatatagggacatacatgattgaccttcttaaagcttttcctggcttctgcaaacatctgctcatgcaaggttaccttctgtacaagatgtgacaaactatcaaagtccttggatgagaactttttcctgattggagctgccctgaaaagccaaatcggctaactgagcatcagttaagctcaagctgtagcacttattcctcatctttatgaacgtctgaatgtagtcctgcacaggctcatcatgcctttgccgaatcgctgttaaatcagacaatttcatctcatgaaccccactataaaaatagctatgaaaatgcttctccaaatcggcccaactgttgattgatccacatggcaaagaagaacaccaagtaaaagccgatccagacaaagacaatggaaacaacctaaccctcagagcatccacagccgatgcttcaccacactgagctaagaatcggctaacgtgctcataggttgaaacgctgtcctgtcctgagaattttgaaaaatatgaaaccttgaatcggttaggcaatggaaccctctcaaaccactcagcgtacggatgccgatacaggtttccagcatccttcggcttgagcccaaactgctctctcatcacatctgcaatcatatcggcccatggtctttgctgaggcactccctgcgcttgttgtggcattggctcgaattgattgtattgaggagcgaactggggctgagtcgaccccccttactgatattgaacttgtggtgatggaggctgatactgataattcaaattgcccccttgataattctgaaagtttagttgtatattacgcaccaaatgttcgggaataacttgaggtaccaccattttatctggttgcacattatgaaccaaatgctctgggacaacttgattcgcagcgtgctgtcttagctaattgtcaggtgttccgaacccagccgatgcattcaccaaaccttgatgctgaatcggctgaacaacctgttgcctcggtcttgtctgctgaatcggctacacaacctgctgtcttggtggcatctgctgaatcggttgttgctagattgtgtcaacagtaggctgagctggtaagaacatagcagcaacttggtcttgagttagccgattcacattttgtccattatgctatggctgttctctcaccaacaaccaaggattaattagttgacctggtgccgatgatggtgcagccggtgcaggagccgagactggtgctgtcggttgagccgatggtgcactgtgaggaattggctgaacagctggctgattattagtgaccaagggccgatagtttgggaaaacacctcctggcaaataaaccggtcctgtagcctgatactcagctatcgagcaatcaaccatcgacttcaccatgtttgacaaagtattgactaacacccaagattgattaattaaagcatgttgcacggcatagtcaatcctatcctggaagttgttaaattgtagctgtgccgtgttgccatcttgattatgattctcactgaaagtgcatctaggacccctcatttattttggtgttaatgacaacacaattagagggtaactaatgctttttgttgagacgtatgcaaggatgaaaaagtagtggatgtcaacacaataagtattgcggcatcttttgtggtaattgtcttctaatccatgcatatcttgtgttcttgagtattaggatgccgtactattaagaggaatgccacatgcatataattggtagaacactagtgctcaaaatcatttatttgaagtgttcctgttttatgtctgtcggactatccgatgttgattagactatccgaaatttcacagaactttgctcactgtcttgggtctgagtgttggctaaaaaatatcggactatccgatataaggtcggactatccgatacgtcggactatctgaaatttctcagaacttcactctctgttttgaattgctttttattccttttgagtgagttttaaatcagactatccgatatgatcggagtatctaatgatccagagactaagaaattcaatggaacttgagtctctgtgagaggatgaaattcttggttcaaaaataacggaatatccgatatgacatcagactatccgatcgattggattgtccgaaattctctagaatttcgttctctgtctctggcctgcttgggggtcaaaaacatcggactatccgatgtcacctcagactttccgaggtgggatgaaaagattctctcccaacggccacattttgggggcttctatgaataccccccacctaacccttttctagggttacccaactcattcattcacattcactttgggttgagcttggtgctaaggtgctttggatctttgagctctctctccctctctcaaatcccctcttgttctttgtgtggtcgatcttggtggttgtggatttggggtttgagggcctagtgtgtgtttcactcgatcttgagcactagggttgaccaagagttgtgtgatgtttgttactcttggaggttgaggactcctagacggctaggtgtcactcccgagccaccgatctacgtgtggttggccgggagaagtttgtgaaggccggatctcgcctccacaaggaaagagataccccttagtggaaggaggagtgcttagtgcaacctcttgaggaaagggttagcaaagacccggctcttagtgagctcctcaacggagagtagaatcccctcaaggatttgaactccgggaagaactcggtgaacttcattgttggtgatatctcttcttccattatttagctttgttttttgtgccgctataaatctagtcgctgtttgggccatactcttgtttgtgcactagatctacttgtagtgttcttttagtggatcagacagtctgatccaacatcagactatctgatattttcggatagtctgactgtggatcagactatcagttttagcttcggcataaagttttaaattagcctattcaccccccctctaggcctaattgaccttttcaattggtatcagagcctaatctccaaattaggcttaaccgcttggagggatcatgtcgggccaaatgggggaaggcaaagatggtgataagggagctaagtttccttatcactatccaactacatccacatcttatgtgagtacctatagcagcaaagctccgtacttcaatggtacggactatgccgcttggaagcataagatgaagatgcatttgaagtctattaacccatctatttggagaatagtcgaaaaaggctatgttttgcagaatcccgaagatcccaccaaggaggacgacgagaataagcacaagaacgctcaagccgccaatgcaatacttagtgccttgagtggaagtgagttcaaccgtgtggatggcattgagagtgccaaagtgatttgggacacgcttcggaacttgcatgaaggcacggatagtgttcgtgagtccaaggtggagatcttcaaggggcaatttgagagatttgtgatgttggatggtgagagcccaagtgacatgtatgaccggttgagcaagatcgtcaatgagatcaagggacttggctccaaggacatgaccgatgaggttgtggtcaagaagatggttcgagcaatcactccaaggaactctaccttggttaccatcattcgtgagcgtccggactataagactctcacacctcatgatttgctcggacgcattcttgcccatgacattcttgtgcaagagtccaaggaggtcatccaatacatcaaccaaagctcaacgacaagcatcaagaaggaagacttggcattgaaggcaaaggaagaagaagaagagagccacaagagcaagagcaaggaggagatcgatgatgaagaaatggttctcttcgtcaagaagttcggcaagttcatgaggcgaagcggcttcttcaagggaaattcttccaagcatcactccagcaagtcaagtggaagacattccgcaagagtgtgctacgtgtgcaaagagcccgggcacttcattgcggattgccctcacctcaaggatggttcccacatcaaggaagataagaagaaggatgagaagaaggagaagtataagcatagcaagcgggaacattatggccaagctcaccttgggatgattttcagctccgactccgagtcaagctcaagtgatggagaaggagtcgccacgttcgccgtcaagccttcatcaccaccaagactcttcgactactaaagtgatgaggatgctcccatttgcctcatggcaaaggagcctaaggtaccttctcctctcaagtcatttaatgttgattttattagtgacgaggaggatgaggttgaggatgaagttatggatgatgagttgcttaaatccataaccaaggaatctgtcacaccctgatttttgtttcaggatttataaattatttaataaattattatcagaatttatattaaatgttcattaatttacaagtgaagttaaatgtgggaaataaaatttcctaaatataaagcatggatggatttaatttttattaaattcttcatggttaattatactctctggaattttctcagatttttcggagctcaattcctaatttttaatcatacaaagagcatttcagtaattacccacatattaaattaatcattaaatggtctaattgtaatttttttaagtactttgagtgtccaagtattttcaggatttttcttgaaattatttgagcattggaagtatttttaataatttaaagatcatttaagtgattattttaattgggaaagtaataaaatcctcctcctcagcttgggccattttcagcccattccttcctttccttcctctctcttccgccggcccaacctgagccgcctcctctcctctcagcctagccggaaaagtctattttccctccctgcgctactgttcatcttccaactcaggcagagcccgagccagccgtgccgtgcacagtgccgccgcctcttccttccaaatctcgcctccccgttgctctttttctccaattttgttgaggggaaatattcctcttatcctcctctatctttacccccaagaatcggagcaaaccgttgagtattttatccgaatcgaactcgtttttgagtttatctccaaaaccgagtttttgatttcccggatcgatttcttgcgggaggagtccgatctcttcaatccaaggctataaataggaccccctagtcctcctctttcgtttgccccctctcccgtcctcttccgtgctccgtagctccgtcgccaccgccgccaagcaaacagccgccgccggccatctccagtgccgccgcgccgccgtctccatcgtcgtcgccggtcgccgtcaccaccgttgggtgcgccgtggtgaggggaagctcggccacccttccttttccgtcgccggtcatcggagctccgccgccccgtgcaacccgagccgccgccgtcgcctcctcgtcgccggccgtcgtcggtcgtcgtttggcacgagggtgagtatcgttgggttcgtctcgtcgtcctctacgtgttcatgtcctccaaatccgcagccggtcgctctatctccggcgagcttgccatccgagtcggctgccattgatgacgtcagcatgacgtcatcggtttttctttttcccgtttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcggaagtgatcaagaagattacttgaaggccgattattgcaaggcaagtcacacagatcctaaacacaatcctttgagcatattgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggttaatcgtgattggttaattaattacttgccaactaaaacttcataatggtgggttgtgagcacatggttttgagagtcgtgctcctgacaattaaggaccggttcgcgagctactgttgtgaaacattaaccgtaccaaccacaagccagcatgggcaacggctttatcttttgtatagcatgattcattatagtgcgccagactgagaagtggcgagaagtccatgggggtcgctggggagtccatgccttgtttataagggggtgattatgatccaggaacggtgcactgttttgagttgtgttgtgcgaagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcaatgtttttcgtgattagtctcacacctctcacaataattatggatgttaatacctgataataatttgcttagctcctggtttggagttagatctgtacagccgggtatggttgttcaggatggttgggcctgtacagcatgggtgtgctgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcaatcaacctcagttgaagataaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacagaatccataccacacttgagtgagttgcttgggagaattgaggatcaatatgcaacacttgagaggcaagaggaattgctcattcatgagaaagagcgatctcatgaactcaagtgcgaacttgctaaggagagagaaaaatgaggctttggtacggctttacaagcaaaccaaagagtctcatgctaatcttgaggtggcaaacgctcaacttcaagagagagtggatggcttggataaagcttacctctctcttgaagagaagtttgaaaccttaaagaatagtgtctctctccctagcaaggcatcatgctccaaaattgccccaagcaatgaaccttgtgcaagatgcaaagatattgatattgaagcttgtgctactaactctatttccttgagtgctttgcaaaagcaaaatgagaagcttatgggactccttcacaatggcctacttaagtgccatatgggtagtaaggccctaaaagagtacctaggctatcaaagggacaacttcaaccatgagggtcttgggtatgttcctccaccaaaaggaaaggtggacaagagtgtgatgatcaagaggccccaaggtcttagcaactttgttagggccaaaagtatccttcctaatgattgtgcttcacattgttcttttgatgcatcttatgttcttaggaagaatgctagtggtcgtgttgttgctaagtatgtaggcccaaggggcaagaatatttctatcaagagagttctttgggtgcctaaggcacttgttactaacatgagaggacccaagcaagtatgggtacctaaaactagaaattgatcccttgtaggaatatgtcactggtggaagaagttgggtgattgatagtggatgcaccaatcacatgaccggagaagaatcaatgttttcatctcttgatccaaatggcacttcacaagataacatagtcttcggggacgatggaaagggaaacgttatgggattgggtaagattgcaatctctaatgatctttctattgccaacgttctcttggtaaaatctctaaactacaatcttttgtccgtttctcaattatgttctatgggttacaattgtctttttaccgatgttgatgtgaccgtctatagaaggaatgattcctcggtagtctttaagtgtgttctcaagggaaagctttaccttgtgaattttcctcaagtaaagccaaacatgagacatgcttagtggctaagtccaacacggggtggctttggcatcggaggctagcccatgttggtatgaggaatcttcacaagcttctaaagcacaatcacatccttggactaacaaatgttcaatttgagaaagatagggtgtatagcgcatgtcaagccggcaaacaaattggagcacatcaccccgtcaagaatgtgatgaccactacaagaccattggagcttctccacatggacctcttcggaccaattgcttatctaagcattggaggtaacaaatatggtcttgttattgttgatgactttttacgcttcacgtgggtgttctttttgcatgacaagagtgagacacaagctatcttcaagaagtttgcaagaagagcacaaaacgagttcgacctcaagatcaagaacattcgaagcgacaatggcaaggagttcaagaacacgtgcatcgagagtttccttgatgaagaaggcatcaagcatgagttctcggctccatattcacctcaacaaaatggagtggctgagaggaagaataggactctcattgagatggcgaggaccatgttggatgagtacaagacatcggaccgtttttgggccgaagccgccaacaccgcatgccacgccatcaaccgcctttatcttcaccgccttcttaagaagactccctatgagcttcttaccggtaataaaccaaatgtctcttactttcgtgttatcggtagtaagtgttacattcttaataagaaggctagatcctctaagttcgctcccaaagtggatgagggattcttgcttgggtatgggtcaaatgaatgcgcataccgtgttttcaacaaaacctccggtattgttgaaatcgcgcgtgatgtgacatttgacgaaactaatggctctcaagtagagcaagttgactcacatgtgttaggtgaagaggaggatccaagcgaagcaatcaaaagattggctcttgggaacgtgcgtcctagggagccaagcctcttcctcaacacaagtggagccacctacatcaacccaagccgacgttccctctacctcaagcatggatcaaggtgaagaaggcgagcaagtgccaccctcaccgatcaacttagctcgcccaagaatccaccaaagtatccaaagagatcatcccaccgacaacatcttaggagacatcaacaagggagtatccactcgttctcgtattgcaaatttttgtgagcattactcgtttgtgtcttctcttgaacctctaagggtggaagaagctctaaatgatccggattgggtgatggcaatgcaagaggagttgaacaatttcacccgtaatgaagtgtggactttggtggagcgacctcggcaaaatgtgattggcacaaagtggatcttccgcaacaagcaagacgaggccggggtcataataaggaacaaggcgaggttagtggcgcaagggttcacccaaatcgaaggattagatttcggtgaaacttttgcgccggtagctagacttgagtcgattcgcatattgcttgcttttgctactaacctcaattttaagctatatcaaatggatgtcaaaagcgccttcctcaacgggcctatcaacgagttggtatacgtggagcaaccacctggcttcgaggatccgaagtatcccaaccacgtgtacaaactccacaaggcactctacgtgcttaagcaagcccctagagcttggtatgagtgtcttcgcaattttcttgtgaagaacggctttgaaatcgggaaagccgattcaactctttttactaaaagacatgataatgatatttttgtgtgccaaatatatgtcgatgacattatatttggttctactaacaagtcttttagtgaagagtttagtaggatgatgaccaaacgttttgagatgtccatgatgggtgaattgaagttcttcctcggccttcaaatcaagcaactcaaggaaggaactttcatttgccaaacaaagtatttgaaggacatgctcaagaagtttggaatggagaatgcgaagccaattcacactcccatgccatcaaatggccacctcgacctcaacgagcaaggtaaagacgtcgaccaaaaggtataccgttccatcattggctcactcctttacctttgtgcatctaggcccgatattatgcttagtgtgtgcatgtgtgcaagatttcaagccgctccgaaggtgtgtcaccttgtggccgtgaagagaattcttagatatttagtgcacacacctaatcttagtctttggtatcctaagggagcgaggtttgatctcattggttatgccgatgcggattatgccgggtgcaaagtggataggaaaagcacatcgggtacttgccaattcttgggtaggtcccttgtttcttgatcttccaagaagcaaaactccgtcgccctatccaccgccgaagcggaatacgtttcggcggggagttgttgtgctcaacttctttggatgaagcaaaccttgagagactatggcctaaatgtgtccaaaatcccactcctatgtgacaatgagagcgccattaagttagccaataaccccgtccaacattcccgaaccaagcatatagatattcgccaccatttcttaagagaccattccacaagaggcgacatagacatccaacatgtaagaaccgacaaacaattggtggatatcttcaccaagcctctagatgaagctaggttttgtgagttgagaagtgagctaaatatcttggattctcggaatgtggcttgatcttttgcatgcatttgtttttcatttactagaataggtttgcttgccacatcatgacaaagtgaacattcaattcatgaataaacactagtcataatctatgaggataacttgaatctatgtgtacggggatctcattctctaatgaatcttggtccttgcacaatttcctatagattcgtacattccctctcttgagggtgcctagttttctttcttttgctgcatttgtccaagtaatagtctagccgagttcatcctataaaaatgttgttgaaaaaaaaaatcttccttgagccatcctttattgtctctgccacaaaggatgtcggactgtctgacatcaagtcagactatccggccacaatcggacagtccgatttcaaatcggactatccgacgtggggccaagggcaaggggacttaacctccccgggggtaactctttttttttaccccttcagtcatttgtctcagtcgtttctctctccacccctcttctcctctcaaaaccctagttctaggccaccaaaaatcttcgtttcagagtctctgattgctattccttctctttagggtggtttccctccctcaactccttccaaatcacttgttccccagtgattctcttggtggttcttgaggtatttccttgtttttcctctatctccctcatggtatattatttcaagatttccttcggtgaatcttcttgttttagtgcctagatctagtacctagaagatcctttgattccattggatatttttgtgtgaatcgagatttgttggtctagggcaaaaggccgtcggattgtctaatatgccgccggatagtccaatgtacatcagatagtccgacgtcaaatcagactatccgacctccttttggcccagtccaaatttctccttgcttcacatttaaatattcttcttccacttcttcttaatcattatcctctgttctaaatcagtgtatcctcatgatcaaggatcagttcaagaatcaagtttactctcgccgtgggtcaatgagttctcgaggtcgctctccctcttccaaggctcgtcatgctatacggcgtatgtctgaatcccgcaaagataccattgacgcgcaagctcaagcctctgaccaagcagctcaagtggctaatgtggagcgtggtgctcctcttcctcctcgccgcagccgagttagtggagaaggatcaagtgcacctgctagcaaagtaaggagaggcaatcctacggattcttctgagcctggtcaaggtagtggttctcatgcaccatcctttgaggaagagattcagttagaagaggacattgccgctcagcaagccgctcaggaagaagggcctttctttatcactgctccctctagagatcctaattatcatcggagagtcataaggtggaaccgcaagtggactgaattggagaaagagcgtaagaaagatccctacaaatttcaacagttgtccaccgatcctcggttttggaacctttttcagcaggattactatgagacagtgattgcacctaagaagggggctattcttatgcagtgggttgattggaagtatatggaggagttgcatgatccaattattgatgaagtcattgaagcttgtgctcggcaaaacttgaaggaattcatgggcttgcaatacccatggtgcaaagaaatcattgcacaattctatgccatagtttactttgagcccaacaaagaaaagactattcattggatgacagatggcactatatacttagtgacatatgccaagtttgctgccattttggggtttccggctcgctctcgcaccaatcgtgtcaagattaatgctgagaagcccatggacacaaattctcttcacttcttgtaccaagatgtggactatgagttaggcaccatcaaaggtctccttcccttctatgcctatctcaacaagctcttgcgcaaaactctcaatcccaaggaaggtgatgctagcaacgtccttgcctatacaagaaatttgctttacaagatgaaggctcacccacagctctttgacgcctttgacttcatctttgaagaaatccggcttatctccatgatgcctaagccctaagcgaggacttggctatgggccttacattatgaagatgattgagattatgtccaagaagaagtttcacaaggaggtggcacataccggttaccatgtccgtcccatcaaggctgctgctgtgccggctggacaaaccactcgtgcttcttctcgtgccggtccctccgctaccgtcaccaagccggattccaactcgtccttgaggttcttcaagtccatcttcaacttatgcaagaccatcttagcttggcaagccaaggaacgcagagcaaggaagaaggacactcgacggatcaagaacctccttcgcaacgcccatttgccgtgttcccccgatggttctgaggttgaggacagtggggaggatgtgattgaggacccgtttgcagctgaggcaagctcctctcgtgcggatcgtggcaaggctcctatggaggaagaagaagaggaggaggaaggtgactatgctaaggagtcaagtgaggagggcgaggattctaatgaggatgagtgatcctctttttcccttttggtgccttgatgccaaagggggagaaccacctatcaacaaaaatctctaatctatctcctttcttgatggctagtcgaaccttgggcttttgtgtcttgttatgtgcaattatctattatccatgctcaaatgtgtgaaatatcttgtcattggcatatgcatgaggttatattgtcatttctaatctagtgcatagattgagggggagctctcctatttcatttctagcatatctttagggggagctccaccaaaa

SEQ ID NO: 71137 - DNA, 34268 bp, Oryza sativa
tgactcgtgggttgatgaatggatttcttcagcttgacataaaatttgtcaaattttgagccttgtatttgtgtagcccccgactctttgattagttgggaaacaactgaacatagagtcgagaactgtagcatcttgtcgtcgaatagttattgcttgattgaagatatgtgttgaagatgtccaagtagaaatcatgaatgttggagagccacttgttgtagtaaaataacacggcatcgcatgccgagatgtcgagattcacaacaacgtcatggttggtgatgtaacaaaacttgtgaagtagcagcaatagagtttgctggtaccgaagataataaagatgaagtcgctccaccatgttgacaaagttgtgttgccgtgatgaagtgaacacgagtcggcggcaacagaagcaaactggtagcgaagacgcgcagttgtgaagataaaagcactagttggcggcggcataaccagtcggcaacggaagacgatgatgtccatcagtagtggtagctgtataaaccagacgtagaggtgagggcactagtcagcagcagacgagacgaccagcgatgaagatggtaaggccaatcaacactggcagaatcatgcagccatggaagtgaagaaaccagtcggcagccatgacaaacgtaggcagcttgtgttgaagatactaatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacggcagcataataggccagccgtgcaggcggaaacaccagtcggcggcggtcgaggcggccggtcggtgaagacgtagacgcccaacaacggcggcataaaggccagccgtgcaggcggaagcaccagtcggcggcagacgaggcggccggtcggtgaagacgtagacgcccaacaacagcggcataaaggccagccgtgcaggcggaaacaccagtcggcagcggcgaaggcaagccggtcggtgaagacgtagacgcccaacaacggcggcataaaggccagccgtgcaggcggaaacaccagtcggcggcggacgaggcggccggtcggtgaagacgtagacgcccaacaacggcagcataaaggccagccgtgcaggcggaaacactagtaggcagcggcgaaggcaagccggtcggtgaagacatagacgcccaacaacggcggcataatacgccagccgtgcaggcggaagcaccagtcggcggcggacgaaggcggccggtcggtgaagacgtagacacccaacaacggcggcataaaggccagccgtgcaggcggaaacaccagtcggcagcggcgaaggcaagccggtcggtgaagacgtagacgcccaacaacggcggcataataggccagccgtgcaggcggaaacaccagtcggcggcggcgaaggcggccggtcggtgaagacgtagacgcccatgaacggtggtgtgaccaaccaaccgtataggcgagggcaccagtcggcggtgacggaggcaggctcagggtgaagtcgtagacgtccaacaacggtggcataataggccagctgtgtaggcagagacaccagtcggcggcggtgaaggtaagccggtgatgatgatggccaccaatattgacagggtagtccagcccgttttgtatcctagattaaaggttgtctgtcgtgttccagtccgagttgaagagaaacttgacaaagtcgtcggcgacatatatggcccagactctcgtagcaaaaatcatatgcatgtgcagatcttctgttggtatgtgtttatgcatacaggtacatagttgttccaggcacgtacaaacgcatgcgatgaccagtaattgctggataagtttgagcattgatatagctcgcgtgtgcccgcagccatacgtcttcattaaaaaatactcgagctgaccaagtgaaaattgctgcttgtatgtactgctccgtgtttttgattttccatgttgagtcagccgagtccgagattgatccaatcagctgtcttatgcaactagccagccgtggtatcggtgacgatgacggtttgaagcttccaacttgatgacacagatctttgatcgccgttctctcgactggttaaaacccaagtcggagaaagagagattgttgaagtcgtcggcagcgaggaagtgaaaactcacgaatcgaagacgaagccgacgaatcatgaaattgattccatcacacttgttgacaggaaactcggcgaacccctaccgccgctgttgggcgtctacgacttcaccgccggcttgcctccgtcgccgccgagtggtgcctccgcctacacggctggcctattatgccgccgctgttgggcgtctacgacttcaccgccggcctgcctccgtcgccgccgactggtgcctccgcctacacggctggcctattatgccgccgctgttgggcgtctacgacttcaccgccggcctgcctccgtcgccgccgactggtgcctccgcctacacggctggcctattatgccgccgctgttgggcgtctacgacttcaccgccggcctgcctccgttgccgccgactggtgcctccgcctacacggctggcctattatgccgccgctgttgggcgtctacgacttcaccgccggcctgcctccgttgccgccgactggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgttgccgccgagtggtgcctccgcctacacggctggcctattatgccgccgctgttgggcgtctacgacttcatcgccggcctgcctccgtcgccgccgactggtgtcctcgcctatacggttggttggtcacaccaccgttcatgggcgtccacgtcttcgccgaccggctggcctctgccgccactgactggtgtttttgcctatacggttggcggactccgccgctgttaatgggcttcatcatctacaccactggcttggttccactggcgccgactggtgttttttgtcaccattgatggactgctttattcccacatcggctacttctgctgtcatcgagggaatacgacaaagctaagtcatcatttattttattctttatatgatattttgtcttttcctttgcctcactacatcaactggttcgccgttgactagtgagtcgggggctatagatgttatatcgtattttttaaacaattttcataatatttatcttgattgcttgcgacacaatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgagtagtaaattctgattcgtgaaactttgttccattaatggcgaactcatgtcactcatatgcatgtctgggaagtgcctaggccgactcccggtgcttgggggctatgactagtcggacagagcgtttaaacgtaatgaatcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctgcacggctggcctattatgccgccgttgttgggcgtctacgtcttcaccaaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgctgccgactggtgtttccgcctgcacggctggcctattatgccgccgttgttgggcgtctacgtcttcaccgaccggcttgccttcgccgctgccgactggtgtttccgcctgcacggctggcctttatgtcgccgttgttgggcgtctacgtcttcaccgaccggccgcctcgtccgccgccgactggtgcttccgcctgcacggctggcctattatgccaccgttgatgggcgtctgcgtcttcaccgaccggccgcctcatccgccgccgactggtgtcaccgcctacacggctggcctattatgccgctgttgttgggcacctacatcttcatcgccggtcgtctcgtctgctgctgactagtgcgcttacctctacgtctggttatacagctaccactactgatggacatcatcgtcttccgtcgccgactggttatgccgccgccgactggtgcttttatcttcacaactgcgcgtcttcaccaccggatttctacttggacatcttcaacacatatcttcaatcaagcaatgactattcgatgacaagaagctacagttctcgactctatgtttagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcagacattctacttcaacaacttcaaatatttcggtttggacgagttagacaacaacatcaactctcctccaagtgaagcatctacaatagccataacattaatttgatggattattgtcactgacatcatcaccagcacctctgcttcatcggccctgacatctccgctgttgctaatggatgattatgttttcgccgacttattatttcaccttgacggttgacctactatgcaaatgctgatgagcgtcttcgtcattatcattggttgcgacactgctattgactggatcaccgacatcgtcatcttcatcatgtcagttgcatttgtcgtcgccaactattttcttcatctccatgattggtggattttgtcatcgcctttgatttgcctcgtctgtcaccgactgattatttcgctgccatggctacacaactttatcgctgggcgctttcatcttcattgatggctgacctgactactgccgactggtttcttcgcctccacggctgtgcaacttcatcacttttgattggtatcattatcttcactaccaccaatatttttgccacctctggtgggcaatattatctctatgttggtcgtcttgtctttatgccaactgcgtcagctaccatcaatggacaattttgactatgacaaaaggacaagctatatgctcaggggctcatcaactcaagcgtgaggattatatctccaatttggacttgttccagatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttaggctgattatatattgtggtcatttttcaggcggttggtaaatcctttatgagtttatttacacggattttataccacatatgccatatattttcaggtgtggtggaaccatgtgtcttttagggacttaagcacatctgttaaagcagtgtgcgcatggcgtatgcccaatactttggaaatttctttattcacaacatacaagcttctttatagctattttgctatgtgaattttcaatgatgtagccaactttaggttacactcatcatattttacaaagcagtcggtatatcacttggatcatattattcgaggattcacaccgcatatgctatatattggtatcaagtcacttggttgactacgattatcaaaaccactcgtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcataggggataacttatatctatggaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatcaatacacactcggtggattcaaatccccaaacaggagtagggtattacctctctttggagtagggtattacctctctttgagagggcctgaacctgtctaaatcttttgtctctgctgtttagatatcttgtcagttgcaggatcaaactgactggcacgcacgcttctcaacaaactttggacctgcactaaagctaagcagatctcccaggccaggcccgtgtgtgtaacaaactttggacctgcactaaagctaagcacgcccgcttctcaacaaactttggacctgcactaaagctaagtagattctcaacaaactttggacctgcactaaagctaagcagatctcccaggccaggcccgtgcgtgtaacaaactttggacctgcactaaagctaagcacgcccgcttctcaacaaactttggacctgcactaaagctaagtagatctcccaggccaggcccgtgcgtgtttttcgcatcaacatgtgacagcccagcccagggtccagaaacggcattggtcccatctcatttagttagaccacacctaacactgcaactcactgggtttttcgtcctcgctttaacgcaaaaattccagaatcggagttgtagtgactgggctgctcatccttataagctgctccctctcttctcaaattggcgaggtgggaactaaagctagctagctgtgacttgcttgctcgctagctgatgctgctgcacttgggccaaaggcccagctactgcttgggctgccggcctgctgctgctagctagcctttttttgtttcttttttcttttttcttttttttagggtgttacacaacaccatcatcaatcccatttaaattggactagggctattacctgataaggggcctgcaccagtataatccttgtcttctgtttcccaattctctaatcatctagtctacaagtatcactcgtcgataatttgattcatttttaaatatatacttttatgtatatatatagttttatggagagccgagggtggagaatagacacagtatgtggtctcttatcaactcaattagacaattctctaatctgccgtggctcgttttgggggacttcaacgaggccttgtggcagtttgaacacttttcagtgagacaaaggaatgaaacacaaatgcaatcctttcgggatgttctgcaaacgtgtgatttacatgccttgggtttttccggagtgccctatacatatgacaacagaagagagggaaggaacaacatcagagttcgtctggacagggctcttgcagataatgactggagggagatgtttggtaatgccagggtgtctcacttaacttcgactcggtcagatcattgcccaatatctgtttgtttctctcctgaggattgtcggccgtttcacacaaaatgtttgcattatgaaatatgctgggaaagggaaccatccctacaggaggtaatcactgatgcctggtcagagggtgtttcaaagtcagatctcggtgaaattagtactgccctccatagagtgatgacaaggttgcattcctggagtaaggtgaaggtcaagaatgttgggaaggaactagagaaagcaaggaagaggcttacttctctccttgtttctgatgcagagagcagtctggttcgtcaggcattggatcatttaaatgaacttctctatcgtgaagaaatgttatggctgcaaagatcacgtatcaactggctaaaggagggagaccgtaacacacgtttctttcacagcaaaggagtatggagagcgaaaaagaacaaaatttctgcactccgggatgccagtggcactgttcaccatttgacaaatgtgatggagcaaatggcaacagactattttaaaaccctgttttctgccgacccaaatttggaccactctagagttacaaccttaatccaagagaaggttacggctgagatgaatgaagctctttgcaaggctttctctgatgaagagatatcccatgccgttttctagattgggccgcttaaggcgcccgggccagatggatttccagcacgtttcttccagcggaattggggtcttttaaaggaggaggtagtgaaggcggtgaaggaatttttcaatacgggggtgatgcctgcgggtgtaaatgaaactgctattgttctcatcccgaaagttgatcagccaatagagctgcgggattataggcccatcagtctgtgcaacgtactgtataaagtggtctctaaatgtttggttaacagacttcgaccgattttagatgaacttatctccccaaatcaaagtgctttcgtccctgggagaatgattacagataatgcgctcattgcctttgagtgctttcattcaattcaaaagaataagaagttgtcatcagctacttgtgcttataaattggatctgtcaaaagcctatgatagggtcgattggaagtttttggagcaatcaatgtacaagctgggtttcgctcattgttgggttaattggataatgtcgtgtataacctcggtgagatattcggttaaatttaatgggaccctgcttagcacatttgctccttcaaggggtttgcgccaaggtgaccccttatctcccttcctcttcctatttgtggtagacggactttcgctgttgcttgaggagagggtagcccaaggagccttgtccccggttcacatctgtcgtcgggctcctggtatatccaacctgctcttcactgatgatacccttctctttttcaaagcaactagtgagcaagcaaatgtagtgatgaatgttctagcagactatgcctggtgcactggtcaactgattaaccaggagaaatgctctattatgtttggtgaagcttctcctcccgatgtccaggaatctgttagaagtgttctgcaagtggggagcaccagctttgatgacaagtatctgggttttccaacgccggaaggaaggatgaataaaggcaaatttcaaagcttacaagagaagctgtgcaaaagaatcatgcagtggggtgagaattttctgtccagcggagggaaggaaattttgattaaggctgttttgcaggccataactgtttatgttatggggatttttaaactcccagattcgatctgtgatgagctaactaagctcacccgtaacttctggtggggatctgaaaaggggaagaggaaagcacattggaaatcttgggactgtatcaccaaaccaaaacattgtggtggcttgggttttagggactttagactgtttaaccaagcgctgttggcaagacaggcctggagactaatagaaaatcctcacagcttgtgtgtgcaagttttgaaagctaaatattatccgaatggcagtctgatagacacttctttcggtggaaacgcttcctcgggttggagagcgattgaatatggtttggagctgttgaaaaagggtctcatctagcgagtgggaaatggcaggtcaatcaaaatctggcgagacccatggttgcccagggatttttcacgaagacctattactccaaaaggaaattgtaggttaaaatgggtggctgatttgctagaccaaaatgggagctgggatagggatgtcatctctcagcttttctggcctttggatggtgaaataatcaaatcaataaggctctccagtcggcaggacgaggattttatcgcttggtatcctgataaaatgggtcagttttcgattagaagtgcttatatgttagctgttcagctcgcaaatgctggggagagctctagctcctcaggaaatgatactaagaaagtgtggaatcatgtctggaagtgtaatatcccccaaaaggtcaaagtgttctcatggagagctatctcaaactgtcttcccactatggtgaataaaaagaaacgaaacccggaattgtcggacgtctgcagtttctgcggcctggagcctgaagatgtggcccatgctttgtggcgttgtccgcatgccaggcgatactgggacctaatgagctctgagatgcaagtacaacgtatcctgtatgggtctggggagggttctgattggatccttgactttctggaatcaatttcagaggatgatcgtcctgtctttcttatgtcactgtggcgaatctggtatacacgaaatgagattactcacgataaagcggcgccacctgtggaagtttctaaacgctttgttcggagttatgtaaactctctgaaggaaattaaagctcggccgaatgcaaacttgggatctgggaagcatgtaattggggaagacaggcccaagtgcaagaagcaatctgtcttggcaaaatgggagaaacctccaagtggatggatgaagctgaatgtcgatggctcctatcaggaggataacataggggaaatcagtgctatcctgcggaacagcactggagatgtaatttttgcagcctgtggctttgttgagcagtgccagagtgcgctggaagcagaaattttggcttgcaaggaaggtatcggactggctctccaatggacccttctaccgattatcattgaatctgactgtgcggaggcgttacagctgattctttctgaagggaagctgcgatcggtgaataagtttttagtcagggagatccaaggcatggtgaagggggctagggagatgaaactgaagaaggtgaacaggaactgtaatcacatcagccatgttttagctaataaaggcaggtgtgagtcccttatggacttttggccggacggaagttgtaactttatttccgaagttatgtctatggacagctatggctaagtaataaagttcctgtttttccccgcaaaaaaaaaacactaagtccctatttatatctcaccctaaaatttttcaccctgtcacatcgaacgtttgaacacatgtacgaagtattaaatataggctaaaaaataactaattgcacagattgcgactaatttgctagacgaatcttttaagcctaattgctacgtgatttgacaaagtgatgctacagtaaacattttttaatgacggattaaataggcttaataaattcgtctcgcgggttactgacggattctgtaattagtttttttattagtgcccgaacaccccatgcggcacattatataatacctaatgtgacacgccgaaacattacacccctagatctaaacaccacctaaatgtgacacattctagtacaatgaatctagacagagatatattcaaattcttgtagtaataagatatgtcatatcgttttgttaagacggagagagtacacagtacaattgcgttttttcattgaaaaattaccaacttgttgcttgaagatgcagctacaaactactcccgctgtcccacaaatattcaaaccctagattccgaaggtagaaagaaggagaaggacaatggacaaaaatgtccctatttaatagataagttatgttggtggataggtagttgaggggtattgaaagaataaaatttcttgatttataagtcgatggtagataagaatataggagttgatttattttgggacaaattcaaaatctagaagttgatttattttaagatggagggagtactatacaacaaagtaaacactagcataagaacaattaatgatatagaatctctaagagacttgggagttgggagttaggacagataggtttagggtctattcactgcaactagctgtagccgctacagtgactacattgtttttacacactgttactgttggtgtagttgcagttgctgctgcagcaagctgcacgaacagggccttacacgtgacaaacaggtttggtgacgatccaatcatccaatggaagaatcgttccgtagaattgttaaccgttttaaaatcccttgtcgatcgccacaaaattaaggacgagccagccaagttggctaggatatgcacatacaacttcagttcaatttgggtggtggctactatacggaatcgctaactttcatttaatagaactttcaggtactacaataaatccatcaatctcaagtccacaattaatgtcacgactttatttcttggagtttgaaatcaactatacataaaatactcctagaaagaaaaacataaatacaatgtaatatgtttacttcctacatcctaaaatcaatattttagttacctagtaacctagggcacacgagagtactatcgaaattcgtaatactagtttaatagtatagccaactattagctccaaatcatctatagtaatttaatagcaaattcatacaatagttgtttattatactattaatacatggtcctacttgtcatacacacattacgtcttagagtctgtagccagctgcttttctctcttatcttttatctctttaaaatatttttatagccaactaatagtctgctattgtatctgctcttagttgtattttgggcacttgtattttagaatggaggggtagtatcttatttagtgtccaaactagctagactgataggctagatattaatttgaaaaaactttgtgtacagtaggtcaattttttttttcattctcagtgtattattttccaggttgtctatcaacaactacaacgctgagcttgtgaggttagggcatccacaatgtatcactaaagtgggcattatgcaataaatgcagctctaaggacaggcaatatacattgtggaggtagtccatatggcattaattgctaaagcagtctttagctatatgggctggccacaaggaaataaaatacaatactttttcagttcactgtgtacaaatgaatataaaatctaaagcagttggtgctggtgcgtgagcagccgagcaggtgtccgttgaagtagccattgctgctgggtgttggctctccttctccatgctcctataaaacagaccaacaagagatttcagtttgtatctcttcatttcatcaggagatggattcatccaaccaaaaattcatagatcttctcagtcaagactctccaaaccatgcagaaaagcctagccacaactcccctccccaacaattccccaataattttccccaatctcagtttacccaaagcttcaacccacattttttacacaatttctatccatttcattccccaagcaactatccaccatatggtcattctcctcccagctttcaaggtactcctccaagctttcaaggtattccacatcaaggaaattgggcacaacctaatttagccagcttacaaggtttccatttgcaagaaaatatggtgcactcaccaaatcaggggtttggaactgcaaaccaccaagcaatatttgcactgcaacacccctcagttagagccactcccaacagttctttccatgggtcggagtcatcgactccctgccctgcaagacaacaagaagcgccagttaatctcgagtcgtcaagtgaaagcagcgaagacagaggtgaggagagcaacacgcaccaattggacagaagaggagaacttacggttaattagtgcttggttgagcaactcggttgatcctacagatggaaatgacaaaaagggagagtattattggaaggatgtggctgatgagttcaataacaaccgtcctacaaatggccacaagaggacagtcaagcaattgaagacacactggggaaatgttaagaaggacattgggaagttttgtggagtttatgctcaagttagacgtacctgtaccagtggacactctgatgacatgatcatggaaaaagctcatctatggtacaagaatcaatcaaatcagaagaagcctttcaccttagagtatatgtggagagagctcaaggatcaaccaaaatggcgaagtattatcaaaaaggaagaaaacaagaacaagaggactaagatttctgagtcaggagcttacacatcctcatcaaaccaagagactgaagaagaatcatcaaacaaagagagacaccccgagggacagaagaaagcaaaagagagattaaaaggaaaaggaaaaggaaaagctcaatcttctccgttggggaaccagccatctcagaacatagttttgtacaacgaagctatgaaaattaaagctgaagcattattgaaatcagcagaggcaacagcaaaatcagcagaggcaaaacgggaacaaataaggatggaaaagtggcaggcatacattaaactggaagaaaaagatacctctaattttagtggagaagctgagaaggcatgaagctatgttgaacaaattatctaaagaactagctgaggaataaaggagaagcatgttattgttccactgtagtgcttagtgtatgataagtttagttgtcaaatttggtgtattgctgatgtacttgtcattttcagaatttagctctagtactaatgtaaaagcttagtgtacgattaatttagttggcaaatttttgtgtattgttgatgtacttgtcaatttcagaatttagctctagtactaatgtaaaagcttttactatatccccacttgtattatgcaagaaatcacattttttaccgcacatctctgctcttaatattatttttcattcatgagtcatgataatcttcatgaatacattgcagtacagaaaaacccatacttacaagatgtagggataattttcttcgcaattcagttattactccatacctgcacatataaccataataagaaatatagatgataagcaaaacatagctgttggaatagtgccaaaaggaagaaatagttgtcacaaactagctgttggaatgctgccaaaagtaaaaaatagctgttgcaaactagctgttggaatgctgccaaaagtaaaatatagctgttgcaaacaagctgttggaaatgtatcctacatataagagatgaagtgaggaagacactactcacattctcactacccacttcattcagcctcttggaagataccactcccctctcactgccccctccattcagcctcaaccaacttaggaaaatgtcagccaactcccaagaacaatctaatcgtatagaagattctctcaccagttccaatctagaagagttgatgtgggaagaaatcaatgaccctatggaggctgaaattgaagatcagattgaagcagagctagaggcagaactagctggaccatctactcagcgtgggggctacacacgcaggtacatcaacagggatcatgaagaggatcataacagattgtttgctaaatactattatgacaatcctttgtacactgatgaccaatttcgtcggagatttcgcatgagaaagcatctatttttgcgcattgttgaagctcttggtgtttggtccccatattttcgtctaagacgagatgcatttggcaagatgggtctatcgccactgcagaaatgcacggctgccatcagaatgttggcatatggtacaccagctgaccttatggatgaaacctttggagtagcagaaacaacagcaatggaaagcatgattaattttgttcaaggtgtgaggcatttatttggtcagcaatatcttaggaggcctactcaagaggatactcaacgtttacttcaatttggagaggcacatgggttccctagaatgttaggtagccttgattgcatgcattggcaatgggaaaattgcccggttgcgtggaaagggcaattcccccgtggtgattatggagtatcgactatcatgctagaagcagttgcctctgctgatatatggatttggcatgcattttttggggttgctggttctaacaatgatattaacgtattggaccagtcaccattgttcactgaggtactacaaggaagagcacctactgttcagtttacagttaatgggtctgactataatatgggatattatttagctgatggtatttatccagagtgggcagcatttgtgaaatctatcaagagacctctgaatgacaaagctaaattgttcgcacaacgccaagaatcagcaagaaaagatgtggaacgagcttttggggttttacagaaacgttgggccatcatacgtcacccagcgcgtctttgggaaagggaagaactggctgatatcatgtatgcatgtataattttgcataacatgatagttgaggatgaaagaggcacctatgatataccggatgacaatacatatgagcaaggacatttttcggcacaaatggcagggcttcaccatggcccaatctatggatttgaagacgtcctagagaaaaacttgttgattcgtgatcgagcaacccatcgtcgtctcaagcaagatttgatggaacacatatggcaaaagtttgctggccaacaacattagaatttattacttttatcactcttgactagtttattagtttgttattaatcttgtactttgctagtttgtattcatgctctcatcttaatttgctagtttgtattcaggaaccgaatttaagatttacatgtttcttggactgagattttaactatttgtattttgactccgatttgttctcttttacttttttttaaataactcaagcacaaccagaactggatattcaaccacaagatgaacacatatattattgttgcactaaatgaatcgagctgcatgcatacgacttgcctccagcaaccagatcaggacatcaataacctctagtgccaagcaaatcattaaaatcccaaaggaatatagaactaggtgatgattaacctgcattgcatctgtgctttcgtctcagctgagagacgtgcctgctagcttcttgtcacaagctgcagccttgccgtggccgtccgtcccccgcgcgctagcttgcgggactctagccggccggccgctgcgcgctcgccgctcccgcgatcggccggatggccgtctggccgccacgcgcttgccgccggctgccgagttcacgcgctcgtcgctcccgtggctggccggctcctggcagccgtccgctcctccagatttccgcccggcgacggtagggtttcaccttgctcgcgcgaattggggatctgaggcggaggagagacggggaagttgagaagaagagatattttatttacacgtgggacccaccttatcttcacataggctacaaacattgtgagatttgctataactgatgcctcctgctgtgggacccactcttatgggctgcttcatacatatacattgctcatgcccttatatatttgcttcctacatttctctcctccgaacttctgcacatgagaagaaacaatgggtaggttcattcactattctaagtggcaggaagtaaagactgtcaacaattatgctttgtttataggatacatgtcgatggccgtcagggtgatgggctatcttgtggttttatggacaaccgttatcctccttggcggttttgtatcagcgctagagaagaaggatttttggtgtttcacaataattaccctcgtccagacaatcgggttagtttggttttcaattagtcttgcatattcaatttttcactactagggttgccccgtgtattagaatagctagatttgctattgattatactttttatatataactgatataggaattcagcccccatgtctacatatggatatacacaatcaaagagttgctgcctataccaaatttgctatggaattacaattgtgaatatcaccgctagccatgctcagtatcaataatgaagttataacttatgaaaagaattagacaatatagattattaatgtgtttatcaatacaaaaataaagaaattccaattgatttacactgggaggaaaaggcgccatgcatatactacctctatgcacaaacatatgacattggttagtttaattttgagctaagcaacgtcaaacaaaaaaaatatggagggagcattaatttcctttcactctttcagggtctccactgtatttccgagagaaaatctgaagaaaattgtgttgtcgtacatcctgggctttgtatcgactacatataccttttacgtacccaaaaacagcaaggatgacaagaatattagagctgaaaatatgaaggatgaagatggtgatggtgggcgcaggaccagcaaggaaaaacccaagcattggccacggtggctgcgtagattggcggcatttgtcgcttatctggtacagcagctggtgttcgccgtcgtagcgggcctctcgcgcttgccgtagcggtgctgtacgcttgcgggctggtcatcaccaccggcctcgccgcttggcgcctgctgcatcgcgactacggcgacggcagcaacaacctgcggccggcgctggacgtgctctacaccatggtactcctccagggcgtgctctcctactaccgcttctcctcggacttctggcaatcaaggctgacaaacaacgtggccaaggcgtacaacttccaccactggcgtcatttttatgcattcgtatcgttgcgtaggtacatccatgaaacgaggatcgggtgcgagaaggacccgtccttcgccaaacgaaggaatttggttaagtatgccgtggacaccatgattgagtctgaatttccaaactgctggagcttcgtctgcggggcaagcatcctcggtgcgcttcttgagaaccccaagctggaagagcaacacagcctcatcaaggagcacctggcctggtcgccctccggcgccggcgacttgctccagaagctggttcagtcgttggatcccgcgaggggataccattacataacaagcatctccgcggcgcggatccttgcacacctcgccggtgatctccgccgcgagcagctcaatttcccgcaaggcatccactcgattgcctcgctggtggagccccccggcgatgagaagggtgacgagtacaacgccttggaacacttccaagagctgatggtggagggccttcgtctccttgcgaaactcgtctccgacgaggaatggtgccgtgtcattgctgagaaggaaggcctgctcgccaagatcatggtgccactacgttctgacatgcaccacactaagtaccactccgtttgtagtgattcggagaggccgatctgcagagaaatgatcggcgcgtccatccaagtgatgcgccaatctggtgactactcctggcgccaccggcgagatggtacgctgtgaaatctcaggcaacacggacgcaatgaccagcctggagagtattgtccactgcgaccgatgcgatgattgcctgctcatggaaggagcactggagatctacagccgactgcggcgtggggacgacgcaccttcgaccatagcaacaatgagagagcatttcatcaagagactggtgctcatcttcactcaacataccactgctgaagatgacagagtcgatttgctggctggtgaaatgcttgcgaagctatgttcccatggcaaagaaaacaccaccaaaatcctgcgagcaaaacaagatgtgatcggtgatctcaccggcatgcttgaagacaaaatcaccaagtgcggtataatcgcagcgcaaattctggagcatttgtgtattcatcactctgacgatgatgaatgtgcccagaacctcaaagaacgtataaagtttgggatgctaaaggtaccaaccaaaaaaaaaagaagaagcatgcatatgctttgtttttgtcaacatgttatactgatgatagacttacttttgcaggtgcttgcaaaaccgcgtgacgaatatgtgaatagagaaactctcacagcagttttatctctaagtgtgacgatatcacgcaacttaatgaatgcccgagatttacctcctctgttcgatgctattaccagtgaagccggcggcttcagcattctaggtaaggtccagctccagaagatgatcgagagatcaagttgtttaaatacggccaacgaactgaaaacagtgaagcttgtcgcggatttattaatactaactgttaaacatggaagccgcgacgccatacgggacgcaaaggaattgattgaatcactgtccgaggttgcgaaagaaatatcggatactgagaacttcatggttatcgctggcggtagcgacccaaagacccttgattctttcgtgaaagaagcagaggaccaactcctgcgcagagtcggcagagaggatacacctgaaatggcagtggtaattcaacatcctagctctgtcaacggagcccaggcagagtaaatcatatgcatcatttattcgaaaataaaatcatgttcagcctgtactttgttaatctgtactctaacaatcgttgcaaaaggaattttagtatccttgaagaggtaccattggatgccatctattttgaggtagttgtcacatccaatgttcatttgctaggcatgataggcattaggctgtagacagtgcctatcgctagacatacggctagtcatcgtcttctattttatgatatctccacttctcttccggcgagcaggggcaccggtgtcattgtttaggacaaaaaaatacgaaaatatctccctctatgtttagagagaaaataagtgcgggcgtgccagtgtacctaagtacacaaaataaaacaaaagagatatagaaacacatgatctttattaattgaattaacaacatacattttccatgtataatataaaatgcgcgcgccattgcctgtcgttggacaaatcttgacatcagcgatgtggtcttctgattcccagggcctcgagaagctcctggttaattacctctgcaggtttaggcctgcagagaacctccgattaagctgctagtggtcgtctcattgtctttgcttcgcattcaacatgcatggttgtgatggtgatgtaaatgtgggtgccggcagcgatccacggcctcgtcggtccgtgcgccggtgttggtgacgtagccttagcgtcggcttcgcccgccctcgtcgctccgcctcatcagtcttgagcgacgtggtggtgtagatagattgatcttcagcatgcatggaactcgcgtagcttggacggtagagaagtcacagcagcgacatcgggatagtattaaagggaagaagagttgatgacatcagttggtgtacgcgacagccgaatatacatggctgggcacctcctggctaggtgagatcaaagtgacgaagagttgacaaagacggttggtgtagatggcagccggaataaacatggctgggcacctcctgacccatcatgccccttatacggcagggacttgtaatgaaaatgttgatgaagaagtcggtgcagacaacagccggataaacatggcttagcacctcctttagatgatgggtctactattgatccagttgatatgataacgagcccgtaaaaggggctctatgagggcgccggtaacgacggcgaccttggaagaagtaaatgcctcgtcagcggaaccgttgagggcatttgttggtgtagattaagcatgaatggttccctggcatcacagatgacaccattcttactttatgctgatgtagactagcgacgctccaatacacggacaagcggcgacatctcgatcccaacgaagagggagggaatcacggacggacaacatcgatcgtgattaagaggagagagcacaacagacggatggcatctcatcttggcgtgatgaagtgaaagcattgtagacagatagcgtctcatcatgtggtgtagagagagagatgtcacggatggacggcacgacaactccggcttggcgaagtgcaggcgtcatggaagaacttgatgacgattccgcctagacgaggtgaagtcttcccgaacggacttgatgatggtgtgcgggcaccaagcaatggcgctccggctttctcctcgaacggcatggcgatgagtgtgaggaaagtggcaggaccgtcgaagatgattgagtagacattgacggtgactaaagagaccgcgacgagtgtgaaggcgtcgccggccagtggagtctcagtgagacgtcctcacacaatagtgatcacaacaggggcatctttagggctcggcgtcggtgcgatgatgccggcacaacggcgggctttgatggggtggcactcggtggacagtgctaccagcagcttgatagaacagcgagcgtctgggcgtcgccgatacggtggacgagatgatctcctggttgacgatggctctgatccatcaggatggcatgggcggctcagcgacttgacgacgtccgcggatgcgggtagttcagcgacattccggcagttcgaatgagacttctgtcgggcacggctcagtagtaaccatgcttgctccgatgacattctgcgcgctccggcggggtggcatgatgtcgacctcttacaaattagcatgcccgacgaggtggttgatgtagacggcagccggccatttaaccacagctcagcatcgaattgaaaaagcttgaaatcaacaggatttgtttagccatcgcattgacaacttcttatgcatggcactgaagcatggtgatgatgtgtcaccctccggttggtcggccacgttgccacaccatgtatttgctgaatggagttgactcggcatgctgctgctttgcttcggcttgtgttgctgccatgcgatgtgtgtacatgaggccgccgatcgccgatctgatctgtagcccgacgatatttgttgatgtagatcgataaccaccatcatctgcacgcggcgccgctgccatcgtgaggaagatagtatcgccgtcgtgagaacagtagcagcgccgaacatcggccgcgtcgggggaaagggctgcggccatgatttgatacgctgtgcgtggtggaagcaggagtcttggcagtcgacggtggctccgggcctccggcgatcctggcgtgccccagcagagcagcgtcacgacgactccgacatggtcagtccgccgcggtgaaacttgcagccgacaaagcgaggacgcccgacatctcggcatctcggcgacgccgcagtttcaggtggatgcatcaccggcgactcgattggcggtgtcgactccagggataaccagcatctcgtcgactcggatgagcggtgggcggtggcgccgatacgattacttcccggggagcacgtacagaggatgcaactactacggcagcaacagcacccgcatatgtacatctcctacgcatgcatgcatgttctgcaacaagaaaagaaggaaccaatctaattagttcttttgccttgagcagccattgatctctgcttgccgatgatcagagcgccgcgtctcctgccggacgccggtgctccggccgaagtcgctcgccgccaccgtggatgggttgatcgtcaatggatagatgtgtgttgagtgttttcgggatggatgtgttatgtgtgttgagtgttctcgggatggaagtgtgttgatctatcgatcttgttgatgccaggagttgatggatggatcctctcttttgccgtggttctacatctgtgccccctcgactccatgatcaatctgtaaaaaagaaagaaagagaaggcctggcgtgctggtgtagatgaccgtgcactgcctctctcctctgtcattctgtccagccgccggccggcgtgctgtaccttctcatcaggaagagggatggctggacgaatgtcgatcgcctggcgccgtctcttgggtgaccgcctgtaccctcgccgagcgtcggatgcgccggccggcagccaccggcttctctcgtgccgtcgtgttcttcctccctccgtgttctgccttcggcgcagccgccgccaatggatggattgatgggagttgaatgactgtccatgcatatatgtgctgaaagcctgaaatatacatgtagagagagaaagagataaacagaagaactggacaatgttagatgaaatcgtcctggacggcgtggcgtcgatcttgtcgcagccttcgtctccgggtagattgatcttccagcatcgagcggcgcccccggcgggccacacttttggtgtgccatgctgcgccgccttcggccggccggccgcgcacacgttggcgtgcccttccgccgaggccctgtgttttctcttgcgtgtgttcttcatatatgtgtagatggatctccttcttctctgttgtagttctccatctctgccccccccccttatggctgacgagctgtgccttttataggcggtagccgcgtacgcgagacccggcgccgccagcgtgtatacgactgcgtgatccgatatctccgcacagtcgcgcgcgatggatatatactatccggcagtttgtttggatggatagagcttgaccgtgcttatcttctgatctgtttgttgcttcgatcaacttgtagatgagggcggctatgcgcatgcatgtattagctagactgggctgccattcttgttggtttgccggtctgctgggccatcgacggagctctcgaccacacgcgtgcatgtgtgagactttaattaatttgttggcttgctctctatagctcagtgcgtgcacacacatatatgcttatatgtatagccgagcacacatgcatacgtattcaggctatgtgaatcagtacgtcatagtacatgcatgcatttgcatggcccatgcacgaatcaatatttaatgaactggcttagcacattggcattgctagctaaactggttcctgaaaatgcccatcaatatgcaatatatatgtggttatatattttgaaagtatgtacaaaatccggtcaaacagtcatcaacctgttgaccagtgcgagctcgaacttaacaataacaatacatcatacatgctagtacttgattgttttcggtccaaattttcgaatcgaaatttccagaatttccgaaattttgggtctttctatgggacggacagcgcatggcggtgtggtagccggactgctggagccgaggtggagcgattggctacggcattctccgccagggataaagctatgctgccagaggagcaagagcgacgtgatcctgatcggcgtaccgtagttccagatccgtaaaaaggggagtggtcggatctagctggagcccgggcgatcaccatcacctccctcgatcgcccttcctcaccggcgctggagagagggggcgggcagcggccggcctcaaaccgccaaagaagaagcgacaatgtgaacgtggcctcagaacgacgccttgggtctccctgttggagtgtataaaagtgaattgcccgtctttccttatcagcttaggttttaggtgcaactggttagtgcatgcaacttaatatggtatcagaaccagaggttttgagttcgaatcctggcggccgtcgcgccgcatgaaactaccacatcgccgtcgccccacctcctccaagtagagctccgcccgtggcctgcgagaacggtgccccataccgtgctcgacctacaggctacagatcaaatcctccgcgaatcttcgccggtgcagcgctccacccatcacctaccgcctaggctcgtcgccggcaccttattgccgtcaccactcaccaggtcatgtgacgtggaaccgtgccatgggacattgggacccggttgttggatttcttactagcagaacagaagtttttcgtggaatcctttttcttttcttttcttttcttttttgtaaatcactcaaatctttcgtgggagtactggtttttccacctctattccgcacattgtgtcatcgttgtgcatgcctttctagcttttggggtaaaaggtgactaacctatttctgtttttttttttgttgatgaaaaggcaatttgatttctttaattccctttcatttatacaacagtactggaaaatactaacagagtttacacgactggtttgttatcatccaacacaaatcttctcaaaatgcagataatgatatatcagcaaggcaagaagctaattaaccctctgctcatacgcctacgccattgggtttacctctacagagccacggaggtagattatgccttccttctgtccatccacaatctcctgcgcttcaataaaaagggagacgagagtcttcaacggaggttttgcgccattgttgctatcggctaagctcaggacgccatctacgccgtacatctgaatggaaacttcggacagatagcccatcaactccttcaggttttcctcttctttggcgtagctgctgctccttagtcttaacatcgatatgaacatcataaaaattagcttcacaattctcagccagtgagccgtgagttcatagtttggcaagatgtagatgcataccatctcctttagcttcccaatgggagtaaaggtagcatctccagggaaaaccacatcaaccagttggaccaaatcttgatcttggcttacatcaaatactgttgtaattaaatataggaaagcctccagcaatttgctgtctacacggagccaattgtctccatcttggacttcaatacttacgctaccgggtggtgaaaacatagctttatctgcttttgttcccgccgtttggatgtctccacacccaaacatttctccaagcacctgaaataataaatttgtacagaagtttaatttgacagactatataggtgcgtggctaggaattgagataagagttcagatcacactatatatgtgctcccttcgttccaaaatataagaacctagtatcagatatgatattttatagtactacgaatctgcacaaacaacttatctagattagtagtaataggaaatatctaatccagtcctaggttcttatattttgggacggagagagtattaccaatggttcactatttgatacaaggattaattacctttggcatcacatccttgatgactttgttcaattcaccgaggtactcgtcgtcataggtgtagtggttatataggtgagctaggatttccgctgcacttattctgctctcgttttctttagagtgtagaagcatgtctttgagcacaccaacgacattgccgtctgcctggaggatgaccacggcaatgctttggctttcgacgcagagcatcgccaatgcttgagcagccgattttctgacagacatatccttgttatcatcggtgaagatgcacagcatatacttggctaattcttctctgcttgccacgctcgtactcatagataaagatttatcaaaggctagctggctgaggatcttgatggccatgatttgcagcagtggcttgcatttgctacacttgggaatgctgtccatggtggtgacagcctccttgttgccagagatctcacggcggagcctgacgccggtcactccgggagcaacgacgagaagtgccaccagttgcatcgactcctctacaaccgagtgccacacctcgtggtcgatgcggtggagcaggtcggagctcatgggcgccatgatccttgagaggagaccttcagtgtcgcagatgactctacaattgtcactgtgagcagcgaggatccggaggattttcaggccccagtgaagcatctccatacactggtcaagcttcagggtgtccttgaactgctccagctgtggacctgtggtcgatagctcgagcatgtctgatatgcattcgatgcctcctggcagcttcttgaggtggatgtcgacagcgaagtattcgactatcctcgctgcactctttgtcatattgttctgagttgggctgcacctggtcgcagcctctaggagcttgacgagtatgtgggaagaagacgcggatccggtgagcagctgcctcatcagcgcatggtgtccctgcaactggctttgcacgagagagtcgataatcctcacgccattgatgaaattgtcagtgtcgatcgacgaagattctatcagtccaatggcatgtgtgaccatgttccttcctctgacgaacgacgggtccttcatgcatccagccatggtttcgaccgcgtactcacgaacaggtgattttgccccataattgagattgtacttgtcggccactttcctctccatcttccttcccgttgtgatgaaggtcatgccgtagaagtaaagcacgccctgggcaagagccatcaggtagaggacgcgcaacgccggcttctgcaggttggcgccgccatcggcggcggcgttggccatgccgaagcccaagtcacgccgtgtgaggcggaacagcgagatcgcggtggagatgtacatgcccaacgtgtagacaaacaccagagggacaacaatggtggtgaacacaaggagccgaaacaactgcaacgtagcatacgctacgatgggcccatggtcaagtatatagtgtttcaaccactcggccacaatcttggccggagtcttggccggagtctcggccggagtctctgccggatcagtctctatcttgcgaagtgaagaatatgcaagagtatctgccgtaatctcggccttttgctcggtcgaagttggaggcgacttgggtgtgctaaatgctgtagcgagtaagcgggtgactccagaaaacccctctataactccaccagtaatggcaccggatgccctgttgttaatttatatttgatctcagctcataagttttctcgagagagggtcaacggataaacataaactacattaggcgattttcatatgcaattttgcacgaaattcattttgcatgtagaataggattcgagttgcatctcgacccagtgattagcctgtcctcaccagatctgatggctgcgaagatttcactgtcacgccatttctccatgacagggaggtggcatcaactccatctgtcctaaaataaatccaatattggatttatatgtgtgaccaccttcatttttaggattagatttattttagaacaaagggagtagagacgacaagagggtagatctggtcaccaagtcacatcttgccgacaaagacaggttgacggttgaattttgatttggctggacttttcactttttggttctttttgaaaacttatttaatttgtaaataaatccctaaaaaagcttattctgggaatggatgcttttcgccgagtcaacatcgtcattgtattggtccaagataacagagccaatagcattgataacgtccccctaacctcctcgtgaaaggtaggtggtcacttatatgaagggggctaattaagtaaggggggcgacgccattgtttttggcgccgatgacatatttgtacatatttttttattataaataggtccctttttaattataaataggtcatttttcaaattgttttacaagtaggtcctcgacgtcaataacattgacattgtcccttttctacaagtgacttagctttcgcggcaagcctatagagatgacgtcaatgtcattggcaccgtcatgttgttagactaaggtgctgaaacgttgacgttgcaaaaggattcatttccgaaataagtttttagggtctatttgtaaaataaatttttaaaatctattatattattaaaggaatagaaaaaggagcctccacgttcgctctcatggcctagaaattctcacattaatcggagaaaaagaaaaagcagagtccatatagaaatacaatttagaaatagctgaaattcggaattaaaaaataagaaatattagaagaggagactatagtccatatagaaatacctataggaaataactgaaattcggaattaaaaataaggaatattagaagtagagtatagagtccatatagaaatacaattaggaaataatagaaattcggaattaaaaaataaggaatattagaagtagagtatatagtccatatagaaatacaattaagaaaaaaatagaaattcagaattaaaaataaggaatattagaagtagagtatagagcctatatagaaatacaattaagaaaaattagaaattcggaaataaaaaataaggaatattagaagtagagtatagagtccatataggaatttaaaactaaaattcagaataaacataatgaaattaaaagtagtgtttagagtccgtacaaaaatacaatttacaaataactaaaattcaaaattaagaaaaatatgggaagaagagtttaaagtcaatataggaataaaatttagtagtaactgaaatttgaaattaaaaattaaagaatattgaaagatgagtttagagtccacatagaaatacaattagaaatattaaaaattcagaattaaaaaaatatattaaaagacgagtctagagtccatataggaatatatataatttacaaataactataatttgatattaaaaataattaataactaacacgtatataaaatacaatatgaatattacacattagtagtttcgtaaagttattgcaaaatttaaaattatgttgtcattttgatatatttgaataatacaattcccacgttcactatcaccatctaaaaattcccacgttaactgataaaaagaaaaaaaagtccacgtagatatacaatttatatctaaaattcagaatagaaaataaaaaagagttcatgtaaaaatacattttagaaagaactacaatttgtataaaaatttaaaaataattaatattgagagaagagttcatgtagaaatacaattctgaaatatctaaacttcggattaaaattaaatggtattaagagaaagagtccacataaaaatataatttaggaacatgtaaaattcgcattaaaaaataaatatctgataagcaaagattcatgaaggagttcagtttggaaatattttaaattaggatgaaaaataaataatattatgagaaaaaaagtgtagtttctaagaaatgccattacaaatatcttcaacacagggtaaagtgaaatattattaagtaaatatttggtgtaaaaatacaatttaaaatatatgaaattcagattaagatgtgaaagtatgtacgctattatgtgagaaaaatattataatgatgatatccttgtaatctgttggggacaaaggaagtaagtaaacatattgtagaggccggcggccaccaagctaataagcaagtaaacaacaaaaatattcataagaggtacagggggactaactcttttgtctggcagagggtaatcatcgtgagacaccaaaagtccttcttgtcgagcagggagacgaagccaccaagcaggacaacggtagaccaggtgaaaatcaggacgccgagcccagccacgaccctcgacaagtattctttgaacacagcatggctgttgatataccgcacttcaggccattcttcggaattttgatttacttcaccggccattcttgccctgaacataaagctccaaaacctaacacataatagcaacctctagctagctagccaggcccttaagtactcagctaacgctgcttcagggtataactgacgacatatgattgtttacaccaagaactaaccatattagatcttgaccaaattacaccaattaatctatcctaggtcgctattaaatagacttagccaggccttttagtcatgtgtattaaggtggtcgatttagatcgccacttgaaatcgtcgtcgtttgtactaatggagcatgcatctttcagactacttgaatttttcttgacgatcgagttgacaaggctttgttaacatctctgtacgtgaatcatgtgttggactctctggcatgcatggtatagtatgcccatatgctctgacaaaatgcatgtgctgcttctgtaagctacttcctctatcccaaaatgtaagcatttttgaggttagcacgggtattaagaaagtaggtgagaataattgaagaaggtgtgtgattggttgaaaagagaaagtaggtgaaaaagaatggttgtgattggttgagaggagaaggtaggtaaaaaaatagctttattttgggataaagtattgtgctagaaatagctatattttaggacggaggtagtaagctataggttaattgatttggaataaacttgtttatgttcatgtggagcgagaggcctgagccctgccaatttaaaaatgtacgatgatgttgctcaaagggcacgtgtgggacgataaacggcgaacatcgctgcctctggcactgtcgatcagttggagaagaggaagaaccatttgttgtcgaagatgaatcacaaggaaacacatactaatctagaatgaaaacatgctatagagcaggtacaatagcaggctataagccagctgcaaacatattttaagaagataaattaggagagagaagagcagtgggctacagatttgtagccagctgtagcacggactccaagacgcagtgtgtctatgacaggtgggactagatattaatagtgtagtatgtaactattgtatgaatgaactactagattggctatggatgaattggagctagtagttggctatactattgaacttgctctaaggggtggtctaaaatttgtaaaagtatatagcccaacatacagtttactttaaaaaaatcttctcgaaacgggaaataatctcgcatgcatgataattccattccaataattatctccaatgtcctacaacaaatagccataaaattgtttttatgatactcgctccgttttataatgtaagactttccagcattgcccatattcatatagacatctatatgaatatgggcaatgctgaaaagtcttatattatgaaatggaggaagtatctttccgcatgtacgaactcttagtgtcctctagaaaaaaaatgccttgtactatttcttaatagagctctaccaggatgttctagaacgccttaaaaagaaagctagctaaaaattgcacagcgttgctcaagtcgcacccatgttataatatagacaatattgttgctgatcaacgtttcttcaatacgccagaggagcatcacgtgtgagtaatgtacaaatgtaaacgtgagttcaatgtaagtgagaatgtcagaataacatacaaaaccacgccaccaaatctgaaa

SEQ ID NO: 71138 - DNA, 4150 bp, Oryza sativa
ttaaaattggatttattgcgtcagccgagggcaggggcgctcggaccgggtccacgggagtggggcccacgcggcagcctcacggtccacggtggaccgggtgcacgcggcttacgccggccggcgccgtgggtcccacgcgtcagccgcacccgagggcgcgggcggctgacggccgggccccacatggcagccgcggggcgcgcccgaaggcggcctcgccggcacagccgacgggaggcgacgcacccgcaccccgatggtcgccgccggcgaccaccggcgcggcggagcggcgctcgagagaggggagggaagggggaagtgaaatggcggtccacggctcaccccgggtcgatggcgacgacgggaacggcgaccggagcggaggaaggcggcggcgcggctcgggtcgacgaggacggcggcgttccggcggtcggcgggcgaaacggaggggtggacgaggtcggcgaggttgcggcgaacccgaagaaggcgacgccgaaacgggagagggtccggggcgacgacggcggcggaccggagctcggcggcgacggcggagagagagagcgacggcgcgagctcgattccgacggggagagagagcggcgagggtcggaaacggcggagggaggcacggggagcgtttatatagggttgggagggggagagagcggccggatgagggggaatcggccacggaagatccggccgccattgatgcgccggcgaagttagggggaaactttccgaacgaatccgagggagagagagagggaaaagtggggggaaagagggagggaatcatggggagtgatttccccctctttattgcgcgcggggacggcggggaagcggctcggattcgcggacgtcggacgcgctagggcacaggcgacgcggcgggagcggcgggaggaatgggatgacgggtgggccccacccgtcagcgagggtggcgtgcgggcacgcccgtcagcggcacgcacgcgcgggaagggggccggatgggccgcgggtgagaggagagagagggagggaggtggtccgctccggcccaagagggagagggggagggaaaagaaactttttagggtttttcttttttataaaacctttttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacatggattttacttattctatgcatagttttgaggatgtattttagagtcgttttgggacgcgacagcaggagaggcgttatgaagaagatgatggcggttttggtcctcattggggttgtgagttctttagattttgctggaatgaaggtatgaggctgccatctattgaagactgtcctgggtgtagcaatgttgcagaaagttcaagccaatcgtataatagaggcaatcggctaaggcaaacaagagttcctgttcatcaaagattgagtccagtgaaccaagactgtgaccaagaagacagtgaagacaggaagacccaatggtgtccttctggtatttttacaaataatcagaagagaagggttcaaaggttgaggaatagggaacgtttttaggaggttgagcaagagatcaaccatcggctgaagaaaacgaattcgaagcaggaatggcgcattaagaaacaagttcctacagccgatgaagtaaagagattggctagaggaaaaagtgttgtgactgcctcggttaacatggattttatactacctgcggaatttgggatcaagcaagccgatgttgatgaaattgaggaagaatcggctagattgattttatcaccagaacaagcagtctttgagaaactggaagggacagagaatcggcatcttaagccattgtatgtaaacggctatgtcaatgggaagcctatgtctaaaatgatggtcgatggtggggctgcagtgaatttgatgccttatgctacatttaggaagctaggcaggaatgctgaggatctcatcaagacaaacatggtgctcaaagactatggtggcaatccatcagaaaccaaaggagttttgaatgtagagctaacggtcagcagcaagactatccctacaacattttttgttatcgatgggaagggttcctacagcttgttgcttggaagggattggattgatgccaattgttgtattccttcaaccatgcatcaatgcttgattcaatggcaaggcgacaagattgaaatcgtgccagccgacaggtcagtcaacgttgccagtgccgatttagctctttgggagatggatggtttcgattgcttatctggaaaagtttgggatggagaatttctaaaagtatccgattgtgatatacagccaattgaagatggagagcccaagttattattttgagggcatcgtggagggttcaaacgtctataacaaggatacagtagatcatctcgatgacaagtaagaacagggtttcttgttggccgatgatttggaagaaattgacataggtccaggtgatcgaccaaggccgacatttatcagtaagaacttatctccagaatttagaaccaagttgacagagctcttaaaggaattcaaagattgctttgcttgggagtattataagatgccaggactcagccgatcgattgttgaacatcggctacctatcaaaccaggggttagaccacaccagcaacctccgagaagatgcaaagccgatatgctcgaacctgtcaaggctgagattaaacgtttatatgatgctggttttattcatccttgccgatatgccgagtgggtttctagtatagttcctgttatcaagaaaaatggcaaggttagggtgtgcattgatttcagagatttaaacaaagctaccccaaaggatgagtatccaatgccagtagccgatcagttggttgacgctgcttcagggcacaaaatattgagtttcatggatggaaatgcaggatacaatcagatcttcatggccgaagaagatatccatcagacagcttttaggtgtcatggtgcaatcggcttgtttgagtgggttgtaatgacttttggcttgaaaagtgctggagctacatatcaacgggctatgaattatatataccatgatttgatcggctggttggttgaggtctacattgacgatgtggttgttaagtctaaagagatagaggaccacatagccaatttgaggaagtttttcgagagaactaggaaatatggccaaaagatgaacccaacaaagtgtgctttcggtgtatcggctggccagtttttgggatttcttgttcatgagaggggaattgacataactcaaaggagtgttattgcaatcaagaaaattcagcctccagagaacaagacggagttacaggagatgatcggcaagataaatttcgctagaagatttatttctaatttgtctggaacattagagccttttatgccattgttaagattgaaagctgatcaaaagtttacttgggggctgacggagctcgtggctcctcaccgggagaccgcgcaggcccccctttgccagttcggccgggggcttagggtgaaatctcaagctctcgctctctctgtatgtggaaatatcgtctgccagccagaaaacacgagacaccgacgatctatacaggttcgggccgctgagaagcgtaataccctactcctgtgttttggtggatctgtgtatgaatgagctacaagtgtcagctgacttctcccccgttctaagctcataatctgggaaagaatcaaccaaccccctctctatgggcaaggtcctcccctccttttatacttcaaggggataccacatgcacccttctcttcaaactggactgttctttttctcttgaatgggcggagatcagcacggttgctgtccgaatgacgctccgatgggacagcccacacctaccttcacttccgccgggggtgagcgcgtcgtgggagcatggctgtgcgctgacgatatggtcagtgtcagacccgtcgcaaatcggtcattcttgtccaccgcgtgtaatcttggcaacg

SEQ ID NO: 71139 - DNA, 14270 bp, Oryza sativa
cgtgcaaggagcgagaagatcagttcaaagtcgtcgttccgcgatgatcaagtgaagttttctcggagatgacctaaacccaatcctccccgagagggtagtttcgttagcttctagatcgtgtgttgcttgcttgtgtgtaggggtatggtttgcatcattggtggggatgcgaccatactaggttgtttgcttaaacaacttgaatcataaaatccattcacaacagatcaataggcaagtggtttagtaccttatctttagtaacccctctcatctccccctccctctcttgtgcccgcagcaattggtcagcatgagggacaatttcaacggatcaggatcccgtcagtttcatggatcaactcagctcacttctaatagtattccacgtcagcctcttgaagatcagcctcaaccccaagtcatggctaatcaaactcagacagtggaagagttgttacaacagatgcgatgtcggtaccaaatataccagatgcaacagatgcaacaacaatgtcaggagtcacgtcaatgtcacccaccgcaggtgcgagatcagatgccagcccggaacccgaatcagagtcagagtcaggagttcccaatatcggcaccgaagacccctgtcaaaatgcggtcaagatccccgaagataacgacagccaagtcaacgtcagaccaaaggaaagtaagtgctacctgttatgactgtggtgagcaaggtcattatgtaaggaactgtccatggaaggtgttcgccaggtcacctgaaaaagacgagaagcagtgcccagggagtaaccaagctccaagtcagtctaccgacaagaaggatggtactttgcagcgcaactctggagcgaataggacagtgatatggaagatggataatggcaggaccatcatcatcaccagttcagaatttactcctgaagatgcagcaaggatacccaagcgtcagagaggaagaaataccttccgaggagcgcgtcagctaacccgtcatctcataaagtacggtccgcccagacccgaagatgatgaatcaggagaacggttttctgctgacgacgatgacgacaacgatgatgataatgatgacaatgatgatgcgacccttgacagtttcagggaaagagagttgaagttcaaagcatgtgctagatgtgggatagtcggacacactgctagtttatgcctccccacctgccgctgtggtgaatatacccattactcagatgcatgccctttgaggaaggtaacatgtttcttgtgtgaaggaacagatcatgtgcctaaggactgtcagttgaacgcggtcatagctaagaccaagaaagaacaagggacaaccgtgcaacccattcgtcaaccaatgacaatcgacaacagcggtcacaatccttctgctctttctctaactccagctccagtggaagccaaccatggaagaagcaacgtcaccaaggatgttcataagcctctgcttgttcccgtttcagctgccaaagtgcataatcagaagcctgcaccccaagaccaagcaagtcgattatgtcgcaactgtcgtaagccaggacatcgtttcagtgattgtcctcttccaagagcagcaaaggcagttcgtcgtgattcacaagttaccagcactgcccacgacaccaaacgacacctgaatgtgcaacctccgccccaacggattatcgtcaagggcaccgtcaaaggtcgcattgttccaccggcaatcgtttcaagcctacaacaccaacgccagcagggtaagcaatgccaggagaacaacagctcgctacagctacaaagaggcggtacgctccttcgtcagcacccgcagcaagtgttgtcagcaccgggtcgcccaactgttgtcagttctagcaatgcacctggtattgctccaatctggaggcccatcgacaaatcaccgctcggtaaccccacgggcaagaagatcctacccgttacagctgacaagatagttgcccctccaccatcgaagatcaacaagcagagcaacgttcccggtgagacttctggtagtaggaactaaagaaaaaagtcagtcaggtttgaataatggaagcaatagcagttctagacaagacttctacttttcaagttcagtcgtgaaaagggcagttctaatcagcagcagtctacaattgtttgattttgtagtactcctcattgtacatatatgtttatggcagccatgtaatgaaaaggaaatattgaataaaatatgagtcagccagttcttctccttttatgattcaccttcagcatgcaaaagcaaatcaaaatgggtatctgtcagtgtctcaagaaaccaagggtttctcttctaactcatcgcaattctattgagctccaaaacctgtttgtgagccaatagaggaatggttaaccaacggagtgaaaatggttagaccctcaacactcgacataatgagatctctctaaaggcaacatcagtggtaccccaatgaaaagagggatggaatatttgaatgtgacatcatatagagactcttgggaactccctaaccttggaagctgttacaggatggtaagcggcaattacaccctagtggtgtgattatgaaacaagaatggtttccatagttcaaggcaaccgctataagttccagaaaaaaaaaatttctcatgaggtttcccagaagttgaaagagaaattgttccaatacatgggtcagaagatatagagtcgagtccagaaatgtgtagtcagtagggtatatggtagagaatcccttttcaacggaacatctttaccgaacatatgaaagcgaagttgttatgatcaaagaacaggaactctcggcagcatcaaagtcggtttccgatagttgttcagattgcagtattttccgaaaagctgttgcaggatctataatccgttaacccaggaagagttagcaaaggatggtcgaagaagtgaaatgtcatgccatggaaaggacctcttgagttggatctgttgggtgatcagtgcttgtttcaaggaatgttaactatgcaatctgtttaggcatatgacaccaaaaatcaagtcagaagcaagaaagttgtaccagcagttagaactggttggggaagtagtcaagagttagtaagatcaggagctaaatgagaatttctttatgtggaatctcccatcagcaactaaggattaagttccaaatcttgctgggatgaaagtgcgccgtcattactctattttgatgaatcggtgaagtttcagtttgcaaagtgagggcctttgtaagcaagagaagtgttggttatttttcaaggacaatagtccaattgttcctagtcaggagaaagtaagactactccctgtaaggggggtaggtctcggagatgagttttggctcacttcgtcgctgttttagttgaaggttcaacccagtgcaacaatccgggtagtacttgaagaagccagttgcaaggtgtcagcagagttacaccgatctcaagttatctgattgaattctgaggtacaccggtgaggccaggtcaatagctcagctttgagaagcagcatcagggacggttgcagttcagacaaaagacaggtcaagcaggtttcctggaattacgtgtcattcgagccaggacccgttcaagcggacgtaggatcaatgagttacaaatgccagatgcaagtcttaggaacaacttcacccttctctagccagcttggggaattgtcaggttatcagactgccagtatcaacagttcagatcaagataagtaagtttcgtgagcagccacagttctggtctgggtcagttcaagcagaactagccggtctagttttggcaaagcaaaggaatagaaaggtcgaatccagccatttcaatggtgcaggtttcatcaatcagtcaatcagccagttcaagatagaaaggggcagtgcagtgtgcagacccgtcagatcagtcagaccgacagcctacaccagctttctttctagccatcccagaatctcgggacgagattcctgtaaggggggtagatttgtaacgccccgattttcgttcgggtttaaaaatcattaaataatgcactctctagaaattaaataaaagttaaagcaatttaatcaagtgaaataatgggagagtttgaaattttcctttaaaaatcattggccgagaatattttgtaatattctttgtgccctaatatactctccgataatttcccgtgaattttcggagctcaataaataattttaataatacaaagttcattaaaccaattaaataaaaaaaagacaacgaattaaagtcctccttctttgctttgggccacttccggcccaagttcccttcccccccaggccggccttccctccctcggcccgctcggctctctctctcgaagtctacttggcctcccccaaccgtctcctcctctctccttccccccgagccgccgacaggtgggtcccacctgtcagggccatccctaacctccggctccctcagctgaaaccgccgccacggcctccccacgtcgccgccgattccgcctcctcctccacccgcgcgctcgccccgaccgcgggaccgcgtcgccccacctcctccactctcctccccactttccccctccaaaaccggcgccgaaccaccccacttcgcccacgtcgccggagcccactccgaagaccgttgccggtcgattccgccctccgcggccatgatcccaccgccccgagccaataaaaacgatccccgtggtctcctctcccatttccccaactttcccgagctcccggcgccctcgcccgctctcccctcgccaagccgagcagccgccgctcgccggagttcaccggccgctttttcccgccgccccagccaccaccgcgccgcgccgtgtgtgccgtcggcttcgcctcgccgtgccgcgccccggcctccactccttttcccccaaaccaccaccgaaataccaccccaccgtgaaaaccgagccgccgctcttccctccgtctccagccgctccccgccggcgataccgacctcgcccggtcgtgcggctgcctcccacagcgccgccgctccgtgccgcatcccggccaccggcccactcctcaaatccacccccgaagcaccattcccgccgcaaacccgagccccaccactaactgccgccaaccggccgcctcttgccgccattcccatctacctcacgccgcgccaccgcctccaccgcattcgctgcatcccatcgcccctcggccgtggctccgccgtggtcgggcgtcatcggaacgccgttctcgtcgcctcccgtgccgaccgccgccatcctttccgccgccggtcgcctctccgtggtcgtctcgcaaggaagatcgcgttcgcaaggataagagttcagaagatccaagtgaagaagcaaggcaagtcacacattctccttgagcatgttgattccaatttataaatgttttaccgtttacaaataaatatgcatgttttgctaattacatgggatccgggtattacctatctgttcgcttgtgccatgtttacttgatgtatgttctttgtcaaccttgggtaatgaatcaactagctcatgttacttatgtgacctagctagaactatatgcttagccatgcttaattaccactagctcagttgatgggataattacagtattagacctttttagtatcagaatgagctgcgtgctcaagacacctggccatgcttcatggtcataattatccaactaaaatgcgactgaatgatgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggtctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccaccttaataaatcgactcaatgcactatagttcaggtgggttggttgggcctgttcaacgtggtgtagcgttgatcagtggagatttaatgttactttaattactcaacagttttactattttgctcaataaaatgttttacaaccgcctttatgcaaatagccacaaaccgtccttgtgttccccttgcacgtctgcatcgttggtgtggcttgctgagtacggtggttgtactcagccttgctattattcccccttttcagaagtgtagtgcttctgagttgaagacgaagttagaagaccaaggctcagaccccagttgagttttgcctgtggagtggagctaaagccccgctaggatcgcctttttccgctgctgctgctttcgtttcggtgcgaggactaagcgcctcttttgtaagtattttacgctttatttacgtttggaactgtatattacttgtcgttttgtgtaccctagctggtcctggacagggatttaatacacaaaatagtctggaaatttgggctaaatttctgggcgtgacacacatcttcttagtaagccatcggagcagaccctttacagctatggctcatcccatatatgacggcgactctcgcatttcagcttccgttgattttctcccggtggtatgtatttggataccatgtagttcactatgttggcataccatgggttggagtcgcgaaccgtcatcagcatgtcatctctcaagaaatcatttatcggctattcctgcgtgttagtgatttgcagcctagacaaatgatccgctacgaaattttctactccctttttatccttaatttctaagtcaaattcttggagcagcaagatccatcttaagagacatggtttagcatctttcttagtgagcaggtactttagagtagcatcatcagtataaactatcaccttagctcctaccaagtaagatctaaacttatcgatagcaaaaacaaccgcgacaagttccttttcagtagttgcataattgaactgagctccggttagagttttcctagcgtagcagattgcatgatgctttttatctttggtttggcccaagaccgcactaatagcgaaatcgcttgcatcacacataatcttgaagggcagagtccaatcaggaggttgaatgattggagcggagacgagtgcctttttgagaatttcaaaggattttaggcatgcgttttcgaactcaaagggagcatccatagctaaaaggttggtcaaaggtcgggcgattgtagaaaagtccttgagaaaccttctataaagcgggcatgtccaagaaaactgtggatctccttgatgtcacaggaggaggaagatgatctattacatcgattttggcacgatcaacttcgattcctcattcggacactcgatgaccaagaactatctcttcacggaccatgaaatggcactttccccaattgagtaccaggtccttctcttggaatcattgtaagactttgtctaaattctgcagacaatgaccgaaggtgtttccatagacagagaagtcatccatgaaaacttccataatgtccttgatcatgtccgagaaaatagacatcatacacctttgaaaagatgcaggagtgttgcacagtccgaaggacatcctacgataagcataggtaccgtatggacatgtgaatgtagttatactttggtcctctggatggataggaatttgatgatacccggaatacccatcaaggaaacaaaaaaaaaagaatgacgttccaacatctcatcaacgaagggtagtggaaaatgatcctttttcgtagctgttgacggtcgttagcgatcagtttcgaccgtcaatattataaaaatagaggagaactagttatgcttgcaatgcatatatatactagaataataatattccactagtatttggttcagtaacccttttgcagagaataatcataaagtgaagtagaatcgacatcaaatcagacgatacatcaatcgaacgatgttgaggatcaaacttatgtatgaatgggttaagaactcagaattaacacgacgaatagctacgaagtgaagcaacggaggaggctgccagccaaaacttggacaagttcggccaaacctcccgtggcgccaatggatgcagggtttggatggacggctgggattgatcccgaatgatggttggagggtattaccgaccattccaaccgtcacaaccgtcattacctgcctataaaaggagatcctcttctcacttcactcacacacctcaagcaagagctctctcatattctctcaagttagtttagtgttcttaagctagtggaataggaatagagtagaaatcaggagtccggaagtcttcggaagagtttgggtatggctctagtatttagtatactcttctttatacatttatggtattgaaatactttccgagtatatgaatgtctactttacaatatgttcatgttatacagaatatgatgctagcttatctgggagatgctttggtgcgggtataatgtttgcatatgcaattactctatgtgacgatgatattcgagtagtatctggtaatttagacgtggtgtctagattacaggatatcattatttgggattatatgctgtggatgagaggtgggtcgctgatggtgacagctcagtacgggtattcctccgtgcatgtatatagtcctaagttaattccctggggagggtactcctccgtatttagccccggttgtatggtcatgatgggctgtcgtaaggaactcggcagtcaggggtggcttcttgaagtaccaggagggcatcggatcgagggtattagctagtatatcagataactacgatgtatgtatactatgtatactagaagtataggaatatactgtttttctcttttctttccacttagcttagatattttaatatgagaatgagtagcttcctgcttgtgtttcactctacccttgaattatcttttcccctacttagactatgattattacaagtaatatataaattattagtcaagttctcactaccatgatcttcccacgggattaaataaatacgatacccttggaatactctcgggggaaatgctacaatgatatatccttgcgcttgtggatgaactctgtaaccataatataccaggagtatttctgcgccattgctcggaattatatttcttgtaatgtcgttaagaaataccaacaagcatttctagcgccgttattgcctgggaagattcataatagagattacctgaactaatactttatatttacctctgtataatcactgccctttgcaagctaatcttggttgttttaacttttgttttggaaacagggtagtgcatgactggtttcaacttgccggaaaacttcaaagaaaatccagaagctttctttcggagcgtcagacagtgagtcgttgctccgcagaaaactctaccgacaaagaaaccagccgtaccaatgccaccgactttcaagactatggctgacaagaccctccgcgagttcactgctccctctgctgacaatgtggccatcgggccgcagatcaacatgggagacgtggatttcgatctgaagtcccgcctcatcacaatggcttaggctagcccattctgtggcaagcctaacgaggatgccaacgctcatctgtagcagttcttggagatctgtagcacgtacactataaagggtgtcagtccagacgctgtcaggctgaggctgtttccgttttcccttctcaggaaagggaagtagtggttttacgctaaccgtgctgctgtcaacacctgggacaaatgctctatggcattcctctcgaaattctttccgatgggcaaaaccaatgcccttcgtggaaggatttccaatttccagcagacgagagacgagtccattcctgaagcatgggaacgtcctcatcatgggatggacaactcgctaatcctgcaaaatttctataatggactcactacaatgtcccatgaccatctggacgcggcagctggaggagcgttcttctctaagacggttcgaggagccattgatctaatagagaagatggtctccaatatgggttggagcaaggaacgactccaaacccgacagcaaggtatacacacagtcaaggagacggaattactcgctgccaagctagacctcctcatgaagcgattggacgaccacgacaatcggccacaagacaccgtcaaggccttggacttacacgtcacgtgtgaggtttgcggtggcacgggtcattctgggaacgactgcccggaaacccatgaagaggcgatgtacatgggcaaaaacaacaacgagtatcgtccacaaggaggtcaggggtggaaccagccacgcccgtactatcaaggagaaaacaacaacagtaacttctctaaccaaccctccttgaaggatctcatttttgtgcaagctaaaaccactgatgctttaagcaaaaagctagctgccaatgacaagatcctagagaacatcaacgttcagctagatggtttcacttcctcttttcaaaaccaactgatcttcaataaaatgatagaaacccagctagctcaattggcttctctagtccctgcaaatgaaattgggaggattccgaggcggggaggtaagtccactcgtgatcggccgtatcctaaccctgcaggaactaatggggtagctagagaagcgccatctagtgactcggctaacaaagaggttcaaccagaaaaggccgtgccgcaagaatactacgacacacgattgttgtcgtttcctcaacggagtaggaaaccatcagtagacgagcagttcgctcgttttgttgaagtaatccaaaagattcacatcaacgtgtcgttgttcgatgctatgcaagtgccaacatatgcccgttatctcaaggatatactcaacaacaagagaccgctcccaacaacggaggtgattgagctgacggagcaatgcagcaacgtcatactccacaagctctcggaaaagaggaagcatccagggtgtcccacgatcacttgctcgattggggcacagcagttcaaccaagcactccgtgatctcggtgtcagtgttagtgtcattccaatggacgtctttgacaagctcaacttcacggtgttggcaccaacaccgatgcgcctacaactggctgactcgtcagtccgttaaccggcagggatagcggaggatgtgccggtcaagattcgggatttcttcatcccagttgattttgtggtgctggacatggacacaggaaaggaaacgccactcatcctggggcatccgtgtcacaccctaaaaatccaaaatatataaattgttgtttaattggaattattagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaattgaaaaaggtttttaaaagtctcttttggctttgggccgaaagtcggcccaaaaacctcccctctctctctccccggcccaagtcggcccagtccgcagtccgcagccgccgcgcgcgcgcgttcggtcgctgacaggtgggtctcgcctgtcggagtcgtcgtcttcctccggccgccgctgcccaaaaccctagcgccgctccgccgccgccgcttcccaaattcggccgcgcctttccttctccggtgaaatcaattgaggggaaacgatcttcgggatctcctctaccttttctcttttggaatctgtcgcgaccgagaaaaatacattttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactaaaggggggggaggtagagcaagaatgagtacaaccacagtactcagcaagccacaccggagatgcatgattaatgcaaggggggtacaaggggtaataatacaggggttaagttttgcagaaaacagcatttaaaggtcacttagttgcccaaagccattttataaagacaatcctagagttacacagtgttattaatcaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattccaatagattatactctgatcagaggtgtacatctttacccacaagacacatcttcctcacgtgtaaccacatgccacataccaccacggtatacggacggaagacgtgacatagtttccaacccatcctagccatagacaagagtaccgacccaaccccacctacggccggaacctccgggacaggcaggcaggattgagcccctagcagtaggacaccatccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtacgactaacaaaacccaaccacgcacctcgagcccagcctaaaaccattttgggggttttgaatagagggggaggtgtgtgtccaattccaacataagccaaccattccatagtgtccaagtgatatgagaattcccaaagtctaaagttataaaaccacctaatgttgcctaattaatcagcgaagcatctacctaaattcatactagtggaaccatgaatagagtacccactagctagggttttattttcctagggtgaacaagataatagtaacaatagcaataacaatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctcgctttcccaaacgtcggcttcaacttccacgaagagcggatcttccgaagctgcagcgtctacacgaccaacggaaaagaaaaggcttttactctaataaactccatataacaagcaggaacaaagcacaaaaatgggttcttgacttgttaaggaaaaattagagacttcaacggtccaattacgagttcaaatggccaagttatggccatttgaagtttatatgctctttaaatgaatatttgcgaatttcttcatttaaattttaatttaaaaagggtttattgcgtcagccgagggggaggggcgcgcggaccgggtccacgggagtggggcccacgcggcagcctcacggtccacggtggaccgggcgcacccgggctcacaccggccggcgccgtgggccccacgcgtcagccgcacccgagggcgcgggcggctgacggccgggccccacgcggcagccgctaggcgcgcccggaggcggccacgtcggtgcgggctgcag

SEQ ID NO: 71140 - DNA, 11054 bp, Oryza sativa
  unsure (1)..(11054): unsure at all n locations
accgagttcatctccatggggagctccggttatttttgtggaaaagaaagatcatacccagaggatgtgtgtggactatcgtgcactaaatgatgtgactatcaagaataagtacccgctacccagaattgatgatttgtttgatcagcttaaaggtgccaccgttttctccaaggtagatcttcgatcagggtatcaccagttgagaatcaaagaggaagatatacctaagacagcttttaccactaggtatgggttgtttgaatgtactgttatgtcttttggacttaccaatgcccctgctttcttcacgaatttgatgaataaggtgtttatggaatacctagacaagttcgtggtggtctttattgatgacattcttatctactcccgaacaaaagaagagcatgaagaacatcttcgccttgcactagagaagctatgagaacatcaactgtatgctaagtttagcaagtgtgaattttggttgtctgaagtgaagtttcttggtcacgtcatctcagcaggaggagttgccgtcgatcctagtaatgtggaatccgtaaccaactggaaacaaccaaagacagtttcagagattcgcagtttcttaggcctcgcaggttattatcggaggtttatagagaatttttccaagattgctaagcccatgacacgactgcttcagaaagatgtgaagtacaagtggttagaagaatgtgagcagagttttcaagagttgaagaatcgcttaatatcagctcctattttgattttgcctgatccaaagaagggtttccaagtgtattgtgatgcatccaaacttgggttaggatgtgttctgatgcaagatgggaaggtggttgcctatgcatctcgtcagttacgtccgcatgagaagaactaccctactcatgatcttgagttagctgtagtggttcatgcgttgaaaatttggcgtcattatctttttggtactcgtacagaggtatataccgatcacaagagtttaaagtatatctttactcagccagatctgaacatgagacaacggagatggttggaattaattaaggattatgacatgggaattcattatcacccaggaaaggctaatgttgtagcagacgctcttagtaggaaaggctattgcaatgctacggaaggacgatagttgccattggagttatgcaaggaattagaaagattaaatttaggaattgtcagtagaggtttcgttgcagccttagaagcgaagcccactttaattgatcaagttagagaagcccaaattaatgatccggatattcaagaaattaagaagaatatgagaagaggaaaggctatcggtttcttggaagatgagcaaggaactgtatggttgggcgagagaatctgcgttcccgacaacaaagatttaaaagatgcaattctaaaagaagctcatgatactttatactccattcaccctggtagtaccaaaatgtaccaggatctcaaggaaaggttttggtgggcaagtatgaagcgtgaaatcgcagaatacgtagcagtatgtgatgtttgtcagcgagtcaaggcagaacatcagaaacccgccggtttgttgcagcctttgaagattcctgaatggaaatgggaggaaatcggtatggatttcatcactggtttacccagaacgtcatcaggccattactctatttgggtgatagtcgacagacttaccaaagtggctcatttcatcccagtaaagacaacttattctggaagtcggttggcggaattgtatatggcaaggattgtgtgtttgcatggcgtccctaagaaaatagtgtctgatcgaggcagtcagtttacttcaaatttttggaagaagcttcaggaagagatgggttctaagctgaactttagtactgcttatcatccgcagacagacggacaaaccgaaaggtgaatcagattttggaagacatgttgagagcttgtgctttagacttcggtggaagttgggataagaatctaccttatgcggaattctcgtacaacaacagttatcaagctagtcttcagatggctccgtacgaagcactgtatggtcggaagtgccgcactccgcttttgtgggatcaaacgggagcacgtcaggttttcgggactgatatcctgagggaagcagaagaaaaggtgaaaatcattcaagaaagattgcgtgtggcttagtctcgtcataagagttatgccgacaatcgccacagagatttgagttttgaagaaggagattatgtgtaccttcgtgtcacgcctcttcgaggagttcatcgttttcacaccaaaggaaaattggcaccgcgttttgtgggaccttataagattgtcagtagaagaggagaggttgcttatcagttggagttacctcaatctttggcaggagtccataatgtgttccatgtgtcgcaattgaagaagtgtttaagggtacctactgaagaagctaatcttgaacagatagaagttcaagaggatctgacttatattgagaaaccagtccgtatcttggaaatagatgagaggagaaccagaaatcgagttatccgtttttgcaaagtccaatggagtaatcactcggaagaagaatcaacttgggaacgggaagatgaattgaagtcagctcatccgcatctgttcgccagttcttccgaatctcgaggacgagattctgtttaaggggggtaggtttgtcacaccctaaaaatccaaaatatataaattgttgtttaattggaattattagaatttattttaaaagcctagaagagaagatctaattttaattaataaattccaatataaaatggggccagataaaatttcattaaatactttgcttaattctacaattcctagatttttctgggatttatttgagctaaggaagtatttttaataaatggaattgcatttcatgaggggaaacgatcttcgggatctcctctaccttttctcttttggaatcatcggctaattttgtttggaaattcgaggattcgagttcgattcggatcgatctctctcctccgagccctagactttccttctcgtcgccggtcgccgtgggcctccgacgctgccttctagcccctataaaaggacccccggtgtcgccgctacccgtcgccaccctcgccttcgtctctcgtcgtcggaagcgccctagcaccgtgtagccccgcgccaccatcgtcgccgtcgctccagccgtgcgccgctgccgttccggtcgtcgtcgtcgctcggggaggtcgccgtcgtggtcgccgtcgcgtcgccgtcctcgtccgccccttcgccgtcgttgaagaccgtcggagcaccgtcgccgtcgtcaacccgaagagtgccgccgcttcttcctcgacgccgtcgccgtccgttgatcttccgccgccgttttggtcaccggtgagttcgccgcatcgccctctacgtgctggtgccctccgttcgcgtcgccgcgccgtcgttcgccggcgagtttgcaagcccgagtcgccgctggtgatgacgtcatcgccgacgtcatcgttgccgttcgtcgtggtccggccgtggaccggtcaatctcggccgtccgttcccgtgaaccgctgccgtgcacccggtccaccgcaaaccctagccgctgacgcaataaacccctttttccttttcaaaaataattcattattgcgtcataattcaattaaaatccacataagtgttttaatccgatttaaacttcaaaaattcataactaattcatcttagctcggatttagttggttcaagtctctaaatttttctaaaattgagatctacatgttaaaaatatccacatgtactgttcatgcttgtttatgtgctgtttggtgattttgctctttcctgtttagattccgacgtttccggagagtccgttttcgcaggagaagaatttgaagagttccaaggctagcaaggcaagtcacacagatcccaaataatcctttgagcatgttgaacccgtttaaagctactgtttctattcaactattgcatttattttcgaatgtcattgggtggaattaacctattgtttgttatagccctttttgttcttgattactttattccttgatactctgggttattaaaacctgactagttgggctgtatatattggttccactagatattagatatgatttcttagccatgcttagaaacattagcacattattgggataacttatgactcactattaattaatgatggcttaatgatagttcacgatggtcaatcgtgattggttaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtacagcatggttcattgcggagcaccaaactgagaagtggcggagataagcccacgggggtcgctgaggagtccatgccttgtttataagggggtgattatgatccaggaatggtgcgctgtggtggattgtgttgtgcgaggggtactgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatatcattcgtgattagtctcacacctctcatcataataaaagatgctataactggtaataatttgtttagctcctggtttggaatggtatattcctggtttggagatagatctgtacagccggctatggttgttcagaaaggttgggcctatacaacagggtatgttgtatagcgttggattaatattgtttaattattacttaactgttttattaaattcttaaatatttcttaaatgctgtttatgcaaatgaaaccctattatgccatcctttgttatcctgtgcacttgcatatttgctgagtggcttgctgagtatgtcatatactcaccttgcaatcattcatcagaggaagagttctacaatgatgctgatggtgtggaggattaggtgtagccctggtcaagctgcctgtggggtggagccgtctgcgccgtttatttttttttccgctgcttagatctttaatgattgagaggaactatctacctctgtaatgacattttgttcgcttattaactagagtaataattgtactctattatcaatttgttattgtgtgcctcggctgattcctggacgatggttcacacacatgtaagcgtttggaattttggatggaaattccgggcgtgacaatccgttccttagcaccgcaggagccaacactgacgtgggaacaggaagtatccgtttccatatcaacgggaaggaggaaaagtttgagttccagccaaagactgaacaatgctccatggtcagaataaagtatgggccaaacctgcaaaacattcaaatggtcgaagtggagccacccaaaaaggacagcctggtaaagttcatgcagaatttcctggaaaaggaaacaacgatgcctaggaaccgttattggaaaacgccggtgaaatcaagcacaccggccaagaagctagaggagccggctcaaaggaagccttctcccgccccatcacctccagagacggtggaaaatccgtgcactaaacggaagggaggtacggtcttgcacgtcggacccaaaatgacgcgaccttcgccaacaggtaaattggtatgtatccacttatttgctttcaacaatttaaatttttgcatcaacacatgtttgaatttcaaatttgcatttaggatttttgaattttgaggaaacccttcaaatgaattttttagagcaaccaaaataaaattttcaacgaaaattcactgtgccatgaccacactgatcattggaacccaacggccgaaagtggggccagttgggttcaccaggggttcggccgaaccccctggtttggccgaaccggccaggcaacggtcagctgcgtcccttttcgaggcaacggctagtgggccccacaggtcagttttgaccgttgtgggagcactacttaagccaaccagccaggagcgggaaatccatcccatttcaacacattttcattccctctccaaagtttgctctcaaattcattcaggctttgatagtttccctcaaattcaaatacatagttgcatatatacaagttgctttagtgaaactgatcggcgggtgaaactcttgctattctaacccccgctgagttagtccgttcttgctccattgtgtagaatgaggaggcgattgtctcgtctgttcaaggggtccggctcttcgtcaagttgtcatgatgagtctagtactcattcatcagctgacctcgaccatgttcaagaggatgccgaagctccacgacgtttcctgaacgacaccgacctcgaccttatcgatgatcgggaaagacaagcctactacatgctgagtgaccgggagtatgctcacatgcgagaatactctccggagctgctgaaaaagataggtatggatgttgattttcgtgctatttggaaagctgttggttggcagagatttgctgtggtagataagcctagttctcgtttgcttactttgcaatttctgtgcactttgaaagaaatagaagatggaatttcctttcactttttccataaggaatacacatttacatggaaaggattaagtaaacttcttggttttcacgattcttgtaaaatcgatctccagaaaggaatttctgggttcgagaaaaataggttttgggaagatatttctggtgctccaatttgcaagaaacctaggacgaatgatatccataatcctgatcttaggctcatgcacaattgattgctatgactttgtttcctagaggtgatcttagacccattaggggggataaatttactatcatgtttgccatggttaggaagataaaaatttctcttgtgaaatgcatgataagacaatggttagaaagtatgaggttttctgctcctattgaatgcacttctccgattgctcggatagcgaaagggctgggggtcgttagtgaccagattgctttcatctctactgcttgtccatgtattgatgagaattatctagtgcaaggacatattatgaaacatggagtaggtggatctttgatatactttttcctcggttgtataaatgaaatcctattgccaaatgcggggtatcatttgtacaactgccatgaactaaccattccctgcagaccatagaagaatctcgtgcaggtggagcatacagggagacgcgcagcatggcaaggaacgaacgagaaagttcatcatcctcaacacccgtgcagatgtatgaggcaggttaggaaccaactgggcaagtgccagtgaggaacggtggcatgcgcctcatgacatagaatggggggacaaccaaccccccagatcaagtggtatgctcccatctccaagtgaatggcgctcaagttcctctcgttgggactagggtgaaatcaccaggagaatggatacccttgatgtgcagacgggagagatccaatataacctcacagaacacatagcccagacgcaagagtggcaacagactgctgatgctcaatttgccaacatcaacaacatgatccagcaacagcacgatgaccttcaagcgtacttccgcttccaggagttcaatccttatcaaggaccctaagcgtaagccaagcttggagggagacatctctccccctgctgagctaacttgtatcacattgcatatttccctttccaattgcatatttgcttcttacttgcctcctataaacctgaaaacaacataaaaatttgcaaaataaaaaataccaaaagatatgataggtntgagtcatgctaggtaagacaagctagctctctttgttgaaatgatgaatagttgctctgttttatatctcttatatatgggttcataggtaagtgctctctcaaagattaaatataagtagccaataaatctaggaacctaaggtaaatgagctgcacttgctgatcttagtctaagttgttgcaagatatgagatagtaaataagagttactatgatcctggtcctagtttgacttaaattccggatgttttgtttttcaaaatgataaatttggaagttcctcatttgatataaattcctaccagagccaaaaatgtgccatcataattgaactatatacattttggttgcttgtcattccattgaactttgtcaaactcttctgacttgtgtagatacttctcatgctctatgaccaagatcatacacccacatatatgcacatgctaaactcctacatcgggagctagcaatattccattccatttccatattaccaccaaaataaattctccatgctttcatatgctttcttctcctaaaaagaaaatccttttgaaaaaaaagagaaggagggaaatgcatggttatgaaaaaaaaaataaagttatgctctcacaagcatgggaatgatactgaaaaaaaatgttagccatgccctctcttaattaataaaacaaggatttttttggagaagaaagtaagcacaaaggagaagcattttctttatatgtcatttccaccatatatcacacacacactttgcacgatcttaatcttgagtatgtttagttatctgctttagtctgagtttttgacttagtaataaatgtgaatgcaagtatgccatgtttgatctctaccgagctccacatatcaaatcttagagtaggaatcaagaaggcaaaaatagcgaggaattcattttgatacacttagagagaatgagtgaatcatttgaggaacttggctttcttttgcaaaatcattttgaaaacttccgggacgaaagttgaataaagattgggtgattggtactctaattgctattctgtctttcaaccgcccaagacaaggagaagcagtgtctcgtgggaatcaggggtaagggtaagccaccgtgccaaagattatttaatctgagagagagtacatataccttgcacctgtacctttgagatatacagcatagtagcaacacctaatcaacaacaaagtttttgtttcctttcgtccttcactcgggacgagtgaagattcaagcttggggggttttgttgacggtcgttagcaatcagttttaccgtcaacattatcaaaatagaggagaactagttatgcttgcaatgcatatatgcgctagaataataatattccactagtatttggttcattaacccttctgcagagaataatcataaagtgaaggagaatcgacatcaaatcagacgataaatcaatcggacgatgtcgaggattagacttatgtatgaatgggccaagatctcagaattaacacgatgaattgggccaaaatttacaagtctacgaagtgaagcaacagaggatgccgccagccaaaacatgggctggttgggccggcccctagttcggccgaaccagggggttcggccgaacctcccgtggcgccaatggatgcagggtttggatggatggctaggattgatccgcaatgacggttggagggtattaccgaccattccaaccgtcacaaccgtcattacctgcctataaaaggagctcctcttctcacttcactcacacacctcaagcatgagctctctcatattctctcaagttaggccttgtttgtttcagcttatgattattataatctagattattaaaccaaattactataagctggattataataagctgacatagaataagctgtgagttgtttgtttgtccggattattggaggtatggattattgggtttgtaaggctgaagtctataataccctcagctattttggatgccttattcatccttgtcactatataaaacaaatacgtaatttaaataatgtcatctattaataaataaaacattcatgaatatgttttttttacaacagactgaacaataaattattatctcctagcaaataaagcatcggtaatattatcacgaaagatatttgcgtcgccctcttcgtctcccaattgactagcattccctcgagatgaaggcatcggcatatagttttcatcgttatcacaccgatcgaactcctcgtcactcaatttactatctcgaatgaaattatgaagcgccatgcatgcatgtattatttttgtttgcttgagcatcggataactcgtaagtccaatagaattctccatttcatcttcaaaacgccaaaagaacgctcaatcacgttacgaagagatgaatgtaagtggttgaacacctccttcttgccactaggacgtggacccgctcgaaactctggtaaatggtatttggtccctttatatggagctagaaatcccattcgatttggatagcccgagtcaacaaggtaaaatttccctgttgatataaacataaacatactttattagacatcactttaacactgaaactagtaagaaaagtgaaaagatatatgtgaaattacctggtggaggatgagggaagatagtggcatatttgcataaagcatcattaaacaccctcatatcatgtgccgatccgggccatcccgcaacaatgaatgtaaacctcatatcaaagtcacaaacagccaaaacattttgagtgggatacttgttcctacccacatgctgaaccacctttgatgcgggcacaacaactagtatatgcgtcccatctattgcacctatgcaattattgaaatgaggctgaaaccgatcaccatgtagtcttgggtgaatcgttgtgaagtgtggatctctaggtttgactagatcttttgagagaaggtaaacactctgcaacacttcctcaaatttcacgctgattgttccttttgat

SEQ ID NO: 71141 - DNA, 54619 bp, Oryza sativa
cagcccatgcaaatatataagatataaatcacacttaaagtactatgagtgataaaaaaacccataataaaataaattataattacataaattttttgaataagacgaatggtcaaacatgtgagaaaaagtcaacggcgtcatctattaaaaaatggagggagtattaaccagtgtccaaatcattcatggtgcttacaattaaatggtacggttatgcgtattcataggttggtatagattaacgaatatatagttctatgtttcccaatcgactttcgacttggaagaatttaaatatatgcatgcatcctactgccatactatacactttatggtttttcctgattgagttcctgtttcccactttaaataatgagaaattttatggtacataagaaagtaactagaggtattaagattttacgctaaaaattttggtacctcaagaagatacttggtacctgtaggtatttacgctacaagtgtgatacatctcaataccttatcaagaatagtatctaatcaggaatagtaaaattagccttgaataattcatgcgtatgcatgcatcctatcccagagcatatgcatatgagtgtgggagaagggaagtaaagatcaggaagaggaaactaacaaccagatcgacaagagaaactgaaaataactgaaacaatggacaaaataactcgatgtaatagctatggggaggatcgtcggaggcaagacgactaacccggcagtctggatgagggtaatcatcgtgagacaccaaaagtccttcttgttcaacgcagagacgaagccaccaaggagaacaacggtggtccaggtgaacatcaagaaggccaggcccctgactgccatcgacaagtaccccatgagcaccgcatacttgttgatgttgactacttccggccacagctcgtccatgggctgccgctgccgctggccgtggcgatttgttcgctcagatcgactgtaactgatcagctccgactcctcatcacctagctcggacattcttgtttctttccctctcataccagcagaagcagattcgatcgatcgaatgaagcatgcagcagcaatccaatgtgactgtgtatacactactagaaaattaagctgatcgatgaaggcatggatctgcctgctgctgctacttaattagctacctaccatgggcatgggttttttttccagttatatataaacgacctgcagaaattaaatgatagatggtttaccttgaagaataaaatagtgggaaacgagtattgtatatatgcttgcttaccgcatgattgggaaggaattaaaccaaggtctagctaggccagctcactccatgatgggaaagcaaacaccttgttgatcttgcttgtcgctgagctcaacacgttagcagctggctggagaatggagatacaaatagtagtagtaattaacgaaaaaaaataaaacctcgaccactttctcctctgaccacataaacaaatactccctccgtttcgaaatgtttgacgccgttgactttttatcacatgtttgaccattcgtcttattaaaaaaattaattaattattaattcttttcctatcatttgattcgttgttaaatatatttttatgtaggcatataattttacatatctcacataagtttttaaataagacgaacggtcaaacatatgctaaaaagtcaacggtgtcaaatatttcgaaacggagggagtatatcgtttactcagatcgaatcccaatcaatcagcttgccattatatatgtactccacatgatgtgaaagcaaaaacatggatcacttgctgcatgtcaatacctaatctcgcgctcagcataaataaatattccaatatcatcgtttacttcaaatccaatcctaatcgagatcagctcgctattatgtagtcagcttgaagttcaaagctggccctgctaacaacagagctcaattcaatgaaattagcctagtcttttcttttctttccctttatagatttatacttgtacggttttcctcctgttctattcagtgaaattggcactttctagtgccggttccttaaaaacaacaacaatagagctcaaccaatgagaggaagaacagccaaccggaggaccgagagcagagcggatttgggtgtcgtcgatgctaggctgctagtcatggtcgcaagtaacgttttctgaactcgagatatcattaaaggaaatacatcattttttcaatgattttgtaggaaatatacacgtttagaatgcagaaatataacattatcgcagaatggaagtgcgagaccaaggtcttgcgcggcgagcatgcgacactgcacaatctcgcgcagcacaagaccgcgcgaactcgcacgattagttaagttttcgcttatactccctccatctacttttgatagtcatatttcattttaacacacagatcaaggataagtaattctacttatcatctatttaaacatgctactagacattcatcgtaaacaagcgattcattaatatttgcatttctcgatgtccatgtagccaattttatgtggaagaatgaagagtcatgcattaaatttgagaaagttattaagataataggttgttggattgaaatatgcctatctccactacttaaaaaattgaaaacgtttccatcgtccgtaataacgaaaaagggcgaaaaaaaacattaaaacaaaaaaaagaaagtccgattcaatttacttccgtcgtccgtgaaaatcttatcttatcttaatctcaatctttccgaggggactgaccgcgccctccgtcaccacccgcgcgatgaaacgccggccaaagcaaaaaaaagtaattaagcaaagggataaactagattaaagttcctaaaattaaaagtggataaacgatattgaaactcccataactagaaaaaaaagaaataaaatagattgcaatttcccaacaaaattccccaaattcgaagaaccctaatttcgggtaagaaccctaagaatcaaaatccaaatcaattaagctaagggtttgggttacttaccggacttgaagcccctaagctcaccggaactttctgggaagcggcacctccactccttcaccttctcgcagtcgcgtcgggttccccgtgcacgcgctgtcctggagtactcctccaccgtcccttgccgaagacgggaagcgtcggcttggcatcgcccctcccaccgacgaggtccaggccactcggcgcttgtcgccgtttgcgcgcccgcctggtcggaccgctgacgtcgtggcatggctttccgccaccctcgggtccgtcccccatccgccaaagcaggagccgcttggcggtcgtcaccgcacgcgtgccgccttcgccgttgtaccgctcgctcgtcgccagagagaaaggggatcgggagagagggatttgggagctagggttttgcccctctctcccggtcggtgcttcatccgacgcggggacgatcggagccatccaatagatcggacggctcagattcgtccaacatcgggccgctaccaccgctgattacgctgcgcaatgggccacggaagtgcatcgtcgccgcgtatgtgggccgcgctcatgtgctcggcttgtgggccatcgaatggactcagctcgcgtgaagatgggccagcccaagtttgggccggcttgggatgacctgggccgaaagcaaatttgatcaatcaatgtggctcagatttttaaattaaagttagataaactcctaagtagcctcgaaaaataaatctaagactaaagcctaaatccgatgctaattcatcaaattagactcgattctaccgatttggtaatatatcaaattagacttgatttttactgatttgagattctcaaggtgtcacactatcaaacggtgttttttccgttgcaatgcacgggcactattgctagtcaaaaataaatttttcagatttagaaatatgcctatcaaaagtagatggagagagtattgtttatacaaagatttgaaaaacaaaatatcccaacctccatctcccctcacatatgcacattactgctcaccccttcccttctcttgctcgagttgtatcctcttcatttgtaacatcctgaaaattaagtatattatctaagggtgtgtttggttggtgggatatacctggataggacatggccgccgctctttggagggtgtttgtttgctggacgaaagtgggatagggcggcccagaggggaatatacccccccagatgctggatagagggatctggccgatttggccggatgcaaccactcgaggctcgggcgagtcgggcgagtgagtcgcgtgactcgcgtcaccccttaccacgacgacacgagcgaggcggcggatagggcggccggcgcgagcgacgagcatggcagccgtgggtgacgagcgcggcggctggcgagagaggaggcgagctcggtagccagcgcgggtcacaagagaggaaggcgacggcgggaggaggcggccagcgggaggaaggcgtccggcgggaggaaggcggccggcgggaggtggctgccggcgggagtaggcggccgacgggaggaagtggcggcggcgagcccagatctggccctatttttttttcttttttctttttctttttttcttttttctatgtgtatttataatagaggtagtggagtaaaattgtattatgtattaatttgatgggggtattgttaacaacgaaatttggtaagcccaaagttatcatcggcctaaagtcagtatcggcttcagagtcctggaatcggccgatgagaattatcaagccgccagttgtcggattcttgctaaggaaattgatctagtaaagaaagcttatccagaagagaccgagttcaaagagaatgcggcatggcaagttgtctattaattaggaatagtttggtagtttcctttttatctttaggaaagtgtgtttagtgtcctataaggactttatgttttccttttatctttaggaaagtttctttcttgtcctacaaggattagtatctacccatgggtataaatatgtacacgcggggtcattgtaatctatcctcacgatcaatacaattcggcgcatcgccaccctttttacttttacttttgtttctacgttctggcggaacttggcacccgacgcggggctgcatcggtgttcgatctccggctaaggggtaagtccaatgttccgtcggcccaggcaattatatcgtctacgtcggcgtcgttcaaggctgcatcaggacattcgacctcttagattgctctggtttggatgatatacttgcctacctatttatcatatgtctctgttaatctagtcttagcatatcaatttagctctatcggctgcttcttgttttagggtttctgccggtatcagctaaatcgcgttgctagattagattagcttagacatctaccaccctgaaaactcattcaacggtttgattgtctagattgtgtatcttttcatacttaatgctgtatcagttaagtttgatctactaagtcgtgcttagaaccataatctctatcctgcttcttgattgccaataagggtttcatcggggtttcagccggtgagttatctagacgttgcatcggctcataaggattgcatatacatataagttggatttagccgatgacaacaaaggtttcactgtttaatctaatcttgtggattttatgacattggacctccagtcgatgtatgctttaaccatcggatcagtgcttattctatcatgtcattgttagccgattggtttctactggattatattattgttatattttaatatcatcagctgattgtctttgcatcattatctacattggacacatagccgattgctcaaaccctatcgctatcggctagtatcggcatcggctggaatcactacattggcttgtcagccgatcggctatttgatctactgtttacatatcttgtcagttgcaggatcaaactgactagcacgcccgcatctcaacaatctttagacctgcacaggatttaagcagatctctcaggccggtgtgttcaattttttcgtcaacgggtatattcaccatctcaagtgagaggtgaccacacctacaaatccaccatacttcctccaaccaaacaaaaaaattagatcaccaactccaccttcgtccctacaaccaaataaaaaactggatcgccatattcacataaccaaacaaaaaactggaccgccatatcccatccaatcttagaaaccaaacacaccctaaaactacatcgagttgtattccgattctaaacctgcgctgcggcaccaccggtcaagtaccagctgcctatagctagtcccctcacggagacccaccatgcatatcgcctgaatttggatctgcagaaaaagagaaagggaaagggaaggaaatggagggggaaggaagagggtgggagaaaggatggggacagggaaggaggtgccatcgctggcggtcacgccgacggtggcgagtcaaggtggaacagaagaaaacgaggaaaggaaagggagagggaaggaggaaaggggaaaaggggtgggaggcgccaccaccgccgcaccgccgtcgccggtggcagcgacgcgagcggacgtggctggggagcattcgctcggggctgttcgcctccagtgtcgtcgcccatggagagcggcgcgggagtcgctccactttcacgaatatcgggacaacaaaactttctgaacttcccactattccgttttattacgaaaaagcactgatcaagcgatcgatcggttatctcgttgaggccatcgccgccggcgacgcaccggaacgaggcggtggcagggacaggcagtgacgcgcacaggaaatcgacaccgcttcttgctgctgggctcagtcatttcggtagtaccgaaatttcggaaatttcagcattttttggaccgaaatttttgacacagtttaactgaacttgactaaattttgatcaaattcacaaaaatttcagccgagatattgacttaccggggggtccgaaattttgtttcaaaatttcaatcactggctgggctgctggcagctaagaaatggatcacaagatgagactggttctgtttggggaggttaagatcacaggccgtcgccgttgatgtactagtgcagccagctaatgtcatcctgctatctactctctccatggccgctgcaagtacttgttgatggtgaatggactgtatgggttagtgtggttgtggtcgattgtaatggccccaaatggtttggaaattggaagggtggattgaacccatagatgggaaatggtttggtttagattctaaaagaagacttctggattgttgggttggtctggactactttagctggctgttgtggtttggattgggaacagggcgggttttaacctcattggcaggcctacagtcaagctgcatacagttctaccaaaaataaaatacgatacaattatattataagttcataattttttgaacaaagaaagttaacctctagttggtcaagaaagaacattattattgctgaatattttgcattcaatgaccaatgcataggacgcaagcacaaaaaactaacgattttcacacaaatactatatatatgtggtttcatatattaggaaagtccaaatagttgcccgagaatccatctcctaatccaaaaggtttagcgcctgaacttgctagccccccttgttaggctggctgtctaggcgattttggctgtgcggtgtgctgactggacgcactttccacgtcatcttgcctattgtaccactgactgaataagatgaatgggaatagtagacttagagtcatttcttcggtaaagctttcctcattccatctttccctctgaatgttgttttctctgtttagagtcctagatggactcttgggtaaagttcagaggatatttggacttctccttcctgcagagattacatttttttcgcggtaagaaatctaaataataagagaacagaaacaacatcattttccatgtagcattaagaggcttaacatcaacaccgtgaatgcagggcatgtaacactcagcttgccagagagaggaacccaaaaaaaaaagatgttctacaaatgcacgagtaaacataagaacgtagagccagctctaccttatagccatttcattgatagaaatgataagttacattgttacatgattgggaaagagtagaaaaaaagaagagaagaacagcaaaatggaatgtacaaaagtgtaagaaaaaaaatactatacattggcctcagatgattaaaggccgattttcactttgattttattactgaccggcacgagtaatttttaatttcggttttcagatcgattatcagatttccccggcacacagttttccaatgagggtatggattaaaataatacagattatgtacgatttaattaatctgatttcgattgacacagctaggatgctcaattatcacttccatttcggatgcccttgctctaggcaggagttcctcagcttctttcacgagggaaccaagagtctttaggctgctgctacagccagagataaccatgatgtcctcgatttccgacatgttcctcgcagccttcgacagtgatttaatcaagttctctgcttcttctacggtgtaacggcttccatgtctaacgattagtatgaatatctcagtgataagcttcaatgtgttcaatctgttcactatagtcaccttactcttcattgacagctttgtgaccatcgattggagctccgttaagatgctgaagccgttggctgccctgttaattgcatcgataagaggaggcaaatcttcagcatccattaagtttcgtgtcatcgtcacaatcagagataaaactgccgccagcatttgtctgtccacagattcggcacgaagtgttctcacaagcacctgcaacattatgtttatcttcagtatgacaagcgtaacgatccaacacaaagactaattatcaccctatatatgatgctgataaaaataaagcaagtgtttcttttcttgcctcaaacagactatacctctggactcttaacctttaaggcttccttgaggctctggatatattcatcatcatcagtgtgatgaacacacagctgctcgaggatttgcgcggcgcttattctgtattccttgggatatctgtcttgtacaagtatttttgtgagatcaccaacgacatcatctttcacttgtaagattaacttggcatttgctttgccatgggaacatagcgtcgcaagcttttcacctaccactgccaacccaaaaatgatgttggcctccttataaactttgtgagtgaagatgagtaacaatttctcaatgaaatattccctcgtcactatgttagaaagcgtgtgctcgtgcattcgtgtgtaaatgtccaatgcttgcataaacagggaactatcatggaacgatccgagcccacatccttggcaacctagaatcctctccatactagccatggcttccacgtctcctgagattttgcggcggagttccttgccagtctggccaggagcatccacaagccggagaatcacaaccatcgaagcatgcactgttctgaaccacgcactattagggtcatcgttgtggttgagcaggccagaccgcagaggcgccatgatcttggctagcaggccctccgtcttgttgatggatcgctgacagtcctcgtgtgcagcgagcttcatgaggatactcaggccctgcagcatcagttctcggtaatttacagggatgttgccatcacaatccttagggggaccttcgagcagagaagctatgcaatggatcccttgtggaaactgctccaggtggaggtcaccagcaaggtgcgccacgatccttgcagcgtgctccctcgcctcggcattgtatgccctcgtacaatcaagtgactgcagcagtgtgtgcaggccgccatcttggctgtaggatgccgataggaggagctgctttaccattgctttctgctcttcgacctcgacctcaacctcgagaaagaaattgtacttgtacattggcgtattcaggagggagtccaggatcctcaccccagagaggaagccatcaggggatccagacttggttaaaccgacggcatatgtgaccaggttccttcctttgacgaatgacgggtccttctcacacccgatcatcgtctcttgcatgtacgccatcactgactcgctcaaactagtaacaaagcgatatttgttaaccaccaaatccaccagccttttctgctcatagcacaatgtgaaccggtaacagaagagcacaccctggagcaaggcgatggagtagacgaacttcagcgcagatttcaggttggcgccgccattgttgacctcacccccgtagtcatgctgtatcagacgacacgcggatatggcagtggtgatgatcagcccaaacatgtagagcaccgctagagggcagatgatggtggcaaacacgaacaaatggagcagccatatgacaactactactaggttgttcaggtagtaggagcgtgaccgtgatcggccatagaaccagctaatggcacccctttccgtttccaatgtatccgtagctgagaaaaagcctaaaaacgacctccaagtatatcgtagcttttcgttcagaaagatgtcggagactctgtgggtaaatttcattgttccagttagatggtgagataagtaatcaagagctatataggctggtggtaaatctgtgcatttcacacttatcaggatatattacatagattttgaacctatctagcactaatatttttttttggaaaatacatatcaacagccatcggatacttacatttttcatatgtattcatatacaaaataaactttcaaatctctatccttgcaggggaaaaaaaccgatccattataattttgaagtttgaaatggattaatgtaagttttctattcattctggcctttgtgtgtcttcgacacaacagccctgatccattatactaaaaagttcaataataattcaaagttcaaaaaataattattaaaaatatgtatttggcttcaaaattacatgggcaatccatcctaaagtgttctcaccaatgtattaggataatgtcgaccccacgatggagtttggcacttggtgttgcacaaacgaccttgtcagcggtggaggaatttggagcttggcactgaggcactagtggagtttgaagatcagtgcactgcatggacgcactgagtaatggtggaatttcatgctcaggtaggacgatatatagaggtatgttttcctaattgaggaaatgaagctcttctcacaattgagagagattacaagataaagaatacaatcgtgtttggaataggccagattgtgcatatgctcatcgcggtattagtgtggccgtttttgtattggtcatagcctgaagtttgtaccaaaactaataaagttgacaaaaggtcaaaaagcacttacaccaaaagtgagacctttctaactcgcaatgaattcaattgttgaggtttgctagctctagaattcgactcaaaaaggagaattgtccaatactcgaatagttgttaagctattgagatttgctagctctagattttagctcctgatgtcctacatgccagtgactgaatggatatgcccacatgaactttcatcaggggatgtaaactacttgccagtgactgaatatttagaaagtggaactgtcttagcagaaaatatagctccaaaataaatgttttatgcgagcttaaaatataaaattaagatattgagcagtgcaaagagactaacccagcggtctggacaagggtaattattgtgagacaccaaaaatccttcttccccagtatggagacgaagccaccaagaaggataacagtggtccataaaacaagaagataacctagccccttgacggccatagacatgtgtcccatgaacagcgcgtagttgttgatggagctaacttcctcccactctgagtcatcaacgggctccattccactagtcattcttcccttgcagatgtgcagagtggaggtcaactgcaagtctgcaacgcaacaaagccaatatgtaagcccgcatgctcagaactctattcgttgtatactcgtacataataaagcctggagatgcacgccaagaatggaaaaaaaaactgatctacaagaagcatggtcattcttaacataaatatgtccatcctattaaatttaatcagttttgattagcatcaagcaaggtaggctgactttggttttgtcaaaatctgttcagttgattgtttgagaaagtcaaaggaaaaaaaatcatatggtgaggaagcaaaggcctcggctagctggctggagttagtgtaactaaagaagaacagcccagatcagtggatcacagatgttaccgtaattcgtaaacatataatctggttgtcagcataaataattgttggtgccttttcgggccaatacagattcacctaaatatttgttgcaaatttggcctagtgccaaattgtggtggtcaacaataatattccgttttctcaaatcgaatcccaatagatcaagttgacattatatatgtgtacgatgggaaagcaaataccatggcgtctgagctgaacagcagaatagtcaagctaactgttggggactttggaacagtcagtcacctgtttaaaacaagaaaaataaaattgattcgatagcatcaaaatttcacgatttcagttccatatagcacataaagtcagtgatttcagttcccttttccgaattggttgacttgcgttgaccggctcacaaatccaaacagcccatttcgctgcccaataaagcaaaaaaagattatccatctagggagcaacatgcgagagaactgcaataccttctcgtcggcgatgggcgaggagggacaaggcagccgggacgagggacggcggggtgaggctgatgctgccggagagccgcgagcccgcgacggacgaagctgatgcggggcgaggagcacgccggcggacggagatgaacgccggggacgatggccgccggcggtggggatcgactgataaaaggttgtgcagccaagggcagtatagtaaaaaccgagtcactcggctaggtcaacacaagtcaaccaaaacgggtaagcaagcagaatgactgatagggatatataccactaataaagtgaaatgcggagtttgtatgcaataaaactgaaattactacgaaatttcgacgatattataataccaatttcacctatgaaagcgattttgggtggaatttgccgtacgtgtatggcaactttggttaagtatgcgctccctctgtgatcaatctatctatacctctatactcgtattaattaggtactttctacgagcttttacgttaacatgaaagatccgaccattagattagattgatggtatactagggccgtagatttaaactgtaaacatggacttttttaagggaaactacggtgggtgtttaaggcaccagcctgaagttttattgaaatgaagaaacatttacaggagaggggttacaggggatgagagggggagaattaaattaagaattaattacaaagaggtataaggcccacttgcggagctattgtttgctcttaacatttttacatcgatgggaccaaatgtcaatgtcgctagcacaacgccggagaactaacttagcaggttcatcaagagaattgaagaccttgttgttgtgtcgtttccaaatattccacatgacggcaaggaggatagagcgccagactcgtggagtggcgggttgtctgggtggagggatgtcccagacaccttcaagctgcggcagggaggcgatctgttgttcgtccaggccaaaggtgtgccatattgttgccactccggtgcagcgtaggaagaggtgctccacatctttaacagaggagcaaaaaggacaacgtgcggatgctactaatccacatcgagcttgtctctcattggtgaagatgcgcctcttgtgtgtagtacaaaggaagatcttgcatttgacttgagcgtggttgtcccaaatgggcttagcgaaaaggtcatcctataaccctaagaagcttaagtcgtaggctgtttttgctgtgagggggcgatttgtggacaaggtgcgtctgttttttatctctgggtctagctttaggtggcataccagggcttggatattggccaattcgtgtatggccactgtcgacacagtcggggccggagatgaaggagcaattcaggagcggtctgttagaataattgggctaggcccaacttataatattaaatctcaaaggcccataatacatgttgaggataataataccacctctggatttaagcgagaaatatctcaacctaaatagggagttattagaggctccctgttgaccagttgaggtgggggtcggaatgccacacgcgcgcgcgcgcgccgggccgggccgtgggcgaggcgaggcgaggcgtggctggctggcggcgtgcgtgcgtgcgtcacgtcgctatccttttgcagccactaacccacgttcccacgattccctccgcaacagcgcgtccacgttctttctcctgatagataaggaggccgcgagtccgatccgagttcctcgcttctttcccggtgttagtttctccttctccgcgcctgagttgctctcgcttccccgcttctgatctcttgcgcgcacgagagattggaagaagcagtgcctccgaaaccacaccttcgcctgatatctgcaccgggtaggcgggtgatcaggtttttggggagtgcctcctgcacgactgctcatcgccatgtctggagttgctgccgccgctattggcggaggtggtgcgccgccgccgacaggagctgcgccgccgccgacgccgacaggagctggatccggagctggtgcgccaggaggaggtgccgtgaacgactacaacaacggaggcaattctgcctcaccatccagcggagggccattctcggggtataatcttctccttctactgctgttagcgctactcctgttcccattgttagcgctatactgtgtgcgctatgttcttgtttctgttctacatgatgcctctagcatgttatcgcattactggtatgttcctgtttctgacattcatgatgcgcatagtatgctactggttatgttaagatcaccctacactgcttatgccatgatcatagtttcaatttcttggattaaaatatgccgaataatgactatatttccaacattccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggtaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttctgacgccggcagtgagctgtatgtcatggagcagttctatgactacaagatggttgatgaccgttctgtagtagaacaagctcatgagattcagatgctggctaaggaacttgagaacaacaactgtgagttgccggacaagtttgtggcgggtggcattattgccaaactaccaccttcttggtcggactttgccacttctctaaagcacaagagacaagagttcagtgttcctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaagaaaggcaagggaaaggcaaagggagactgctttgtgtgtggcaagtctgggcattgggccaaggactgtcctgagcgcaaagacaggaagtctgccaacatgatcattagcgagggcggaggaacatcggggtacggtaaaatattacctacagttctctctgtttttcattcacctgattggtgggtggatactggtgctaatattcatgtatgtgctgacatttctctgttttcttcttatcaggtcgggagaggttcctccttgttgatgggaaacgggtcgcttgcagttgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgagacttttgttggaaaaggttatgacagcggaggcttgttccgcttttctttgaatgacatgtgtaataatcataacgctgtgaaccatattagcgagaatgatgagtctaatgtgtggcattcgcgactctgtcatgtgaatttcggttgtatgatgcgcttagctaacatgagtttaattccaaaattcactttggtcaaaggttccaagtgccatacttgtgttcaatcgaaacagcctcgtaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcattactttaaaatctataaagctgaggtagaaaaccaacttgaaaggaaaatcaaacggttgaggtctgatagaggtggggagtatttttccaatgagtttgcatccttttgcgaagagtttggaattattcatgagatgacgcctccctattcaccccaatcaaatggggtggccgaaagaaagaaccgtactctaactgagatggtgaatgccatgttagacactgcggggctttccaaggaatggtggggtgaggcagttctgactgcgtgtcatgtcctgaataaaattccaatgaagcacaaggaagtaacaccattcgaggaatgggaaaggaagaaattaaatctctcatacctacgaacatggggctgtttggccaaggtaaatgtacctatagtcaaaaagcggaaacttggaccaaaaactgttgattgtgtgtttcttggttatgctatccacagtgtgggttatagattcttaatagtaaactctggagtacccgacatgcatgctggtacaatttttgagtccagagatgctactttctttgagaatgaatttcctatgaaatatacacctagcacttctagtaaagaaactgtcatgccccatgagcactttgcaccgatagaacacaatgatcaaacgcctgaggaaaatcctgaggaggacaacattgtagatactcgcaagagtaagagacaaagggttgcaaaatcctttggagatgactacattgtatacctcgtggatgacaccccaagaaccatagaagaggcatatttatctcctgacgctgactactggaaggaagcagtacgcagtgaaatggactcgattatgtctaatggtacttgggaagtcgttgagcgtccatatggatgtaagcccgtaggatgcaaatgggttttcaagaaaaagcttaggcctgatggtacaatcgaaaagtataaggcaaggcttgtggccaagggttatacccaaaaggaaggcgaggatttcttcgacacatattcaccagttgctcgcttgactacgattcgagtactacttgctctggcagcctctcatggtcttctcgtccatcagatggacgttaagacagctttcctaaatggagagctggaggaggagatctatatggatcaaccagacgggtatgtactagaaggtcaggagggaatggtgtgtaaactattgaaatccttgtatggcctcaagcaagcacctaagcaatggcatgagaagtttgacaccacgcttacatctgcaggctttgttgtgaacgaagctgacaaatgtgtatactatcgctatggtgggggagaaggggtgatcttatgcttgtatgtcgatgacatactgatctttgggaccagccttaatgtgattgaggaggtcaaagactatctgtccaagagtgatttgggagaggctgatgttattcttaacatcaaactacaaagaggagatgagggtgggattacacttgtgcaatcccactatgtggacaaggttttgagtcgctttggatatagtgactgtaagccagctcctactccttatgatcccagcgtgctattaaggaaaaaccgaagaatagcaagggatcaactgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgcgttcacacttggaggtggcgctgtttcctggaagtcttgcaagcagaccatcttaacgaggtcaacaatggaagcagaacttacagcactagatactgcgacagttgaggctgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattgtgatcggagatcccgtgaatttggatggtgaaacaaattattgtgtgactgagagaagagacccttgaaaggggctcattttcatgatgtgcttctcttctttcctgcatggtaggatggcttatgtcttaatgtgatccgagtggcttttccaagcagagatgttgacctgcagaacatctcagaaggaacacacctatatgagttcgactgctagtcacagtctatgaggtttgggcaatctctagatactcatgaaaggcctggagtttgacttatatgctccaaacagaggggatgcgaacggcagcccagtaccagtcaaggttctgagtgaaacctgatcacacaaaacttacaattcaaggcatagtccattgttcagttgtggtctgatgtagctcatttcctaggtggaagttcaacttaacagtctccaccaaaaccctggtatatcaaacaggcacagccttgagaacatttcttatgagccttgaaatttggtggggattgttagaataattgggctaggcccaacttataatattaaatctcaaaggcccataataaatgttgaggataataataccacctctggatttaagcgagaaatatctcaacctaaatagggagttattagaggctccctgttgaccagttgaggtgggggtcggaatgccacacgcgcgcgcgcgccgggccgggccggggcgtgggcgtggcgtggcgtggctggctggcggcgggcgtgcgtgcgtgcgtcacgtcgctatccttttgcagccactaacccacgttcccacgattccctccgcaacagcgcgtccacgttctttctcctgatagataaggaggccgcgagtctgatccgagttcctcgcttctttcccggtgttagtttctccttctccgcgcctgagttgctctcgcttccccgcttctgatctcttgcgcgcacgagagattggaagaagcagtgcctccgaaaccacaccttcgcctgagatctgcaccgggtaggcgggtgatcaggtttttggggagtgcctcctgcacgactgctcatcgccatgtctggagttgctgccgccgctattggcggaggtggtgcgccgccgccgacgccgacaggagctggatccggagctggtgcgccaggaggaggtgccgtgaacgactacaacaacggaggcaattctgcctcaccatccagtggagggccattctcggggtataatcttctccttctactgctgttagcgctatactgtgtgcgctatgttcttggttctgttctacatgatgcctctagcatgttatcgcattactggtatgttcctgtttctgacattcatgatgcgcatagtatgctactggttatgttaagatcaccctacactgcttatgccatgatcatagtttcaatttcttggattaaaatatgccgaataatgactatatttccaacacggtctagggcgtccgtgatagagatgttgggggcgagttgcatgtgagaacaaggcaaggaacagttgaaagagggcgccgcctaaaatccaattatcaaaccagaaggaagtggaccgaccatctccaatgatggatttcgaaacactacggaagtgtgtaaggcccgcgacgatgtccttccagatgatcgtgtcaaggcgcaaaagatcgcctagatcacacgaggcagaccatccgtagtgatcgcgaaagcaatcgatccacggtgcagaatcaccctcgtgcattttgaggagaaatttttggagaagacatatgttctgtgtcttgagattttttatccagcaccacctttcgctttcggagagcaaactatgttacacgcaattttgcaattgccgctgtgacagttttcttcccccgtccagaagaaggcccttcagcgcttgtcaatagtggtaatcacttctttaggaggaaggatagcccccatcatgtatgatgggagggccgagagcaccgaattgatgagggcaagccgaccatcggaagacagaaggtgaccgcgccaaccggcaagtcgcttgtcaatcctagcgatgagaggttgacagtttgcaagacaaagcttggtaacaaacagagagagggaggcataaataaggttgggggaaggaagctatggagcaaccaagaatccccgccaactgaaacgccacgtcatgctgaacgttaatggggaggaaggtgcttttacccatgtcaattccttctttttaccatgcatcccccgttcgttttcccatgattttagatactttttttttgtccccgatcgaatcacagatcatttttcattactgcagttgcaaggatgtggcaaaaaatatcatctagaccagttggttgatttgtcacctacatttattcagatctaataagaatataagtcaacaagttggtttttaaattcgatgtgtatatatctttaagccgacgatatgtatttcagtaatgacctttacccggtgaagcttttttttcttaattggtatatacaggataatagtatgttttaaactctctatcaagaaagagcagctaagctggatgggctctccaatttatgttaatttaataattccctcgataacaagataaatgatctccagtcatttcttgaccattgttctactttacctatgactttataaaatcctgtagcaacgtgctgagtatcacccaataaacataagaaaacacaccatgcatgttctagtgagcatcttgatgctggtaggataactagcgagctaaataaagctaagggtcggatgcgacatgggtgctagcgaatagagcttttctgccttgttagggtgcgtttggaatcagctgttgcatgtccgagcagtatatgagcgcgtgattaattaagtattttcttttttttcaaaaatagataatataattttttaagcaactttcgtatataaactttttttaaaaaacacgccgtttagtagtttaaaaaacgtgcgcgcgaaatacaacggagagggattggaaacacaggattccaaacacagcctgaatcgtcattgatacaaggaaagatgggaggaggaacaagagggagaggagcaatagtttgggggatgatcccctccattaatttctcattctggatctgtgctacttcctccgtttcataatataagtcattctagcatttatctatctagattcattaatatcaatatgaatgtggaaaataccagaatgacttacattgtgaaacgggggagagtagctaggaatggataaataaataatgttatcccaaacagaaaaagttacgtacggccgggtatgtgcttcacgtgaaatgggaaatatatacaatcaatgacgactaatttggcagcaaacatgcatgcatgggccagttaattaattatgctaaatggatagtttgattcgatgagcagccggacgactgaggctttcttttgttgggaaaaaaattaggtttgattgtcacatcagatatacggatatacatttgaagtattaaacgtagtttaaaaacaaaataaattatagattctactaaaaaactgcgagataaatttattaagcctaattaattcgttattagcaaatgcttactgtagcaccacattgtcaaatcatggtgcaatttggtttaaaaattttgtctcgtaatttacacgtaatatgtgtaattggttttttcctacattaaatacttcatgcgtatgtctaaacatttgatgtgacagtgtgaaattttttttttaaatagggcctgagagcaaaacacatgctgcatgaatagtagtcgctcgctcgtgtatcatacttaaagaaagtttaactaggaaaaaaaaacctacttcatatataaaatcacaagaccttttatccaaaaattgaaactttcaactaaaagttcaaaaaaattatactcttggctcaaactttcaatataaaaacccaaaacttctaatccaaaaactgaaacttcccaaaaaaatcaaaaactttgtgctcatggctctcaatctttcgatacgaagttacagaatcatggtagggtagctagctaaataaagggacggatgcgatatgggtgctagcgaatagagcctttctaccttgctgaatcgtcattgataattaggggaggaggaacaagagggaaaggagcaatagtttggggatgatcccctccattgaataatttctcattctggatccgtgctagggatggatcaataatgttatcccaaacagaaacagctagtgttaggtacgggtatgtgcttcacgtgaaatgggaaatatatacaatcaacgatgactaatttggtagtaagcatacatgcatgggccaattaattaattatgctaaatggatatagtttgattcgatcagcagctgaacgactgatcgagagcaaaacacatgcataatgcataatgcattaatttatatatatgaatagtagtcgctcgctcgtgtatcacgcataaattatatatcaatgatcgatcacatgcaacaccggcaaattaaattgacccatcatcgatccatctagctagctatgcctatatatatacgccatatgcatgataaatacgcaagctaattaagctagctacatatatactctctcaaaagtttacattaattgctgatagctcatcatcagtttgatcgtgtccggaggtgtgaggtcgtcggcgagatgagctccggcggcgaggaggggaagacgtcgtggccggaggtggtggggctgcgggcggaggaggcgaagaaggtgatcctcaaggacatgcccgacgccgacatcgtcgtggttccggtggggacgccggtgaccatggacttccgccccaaccgcgtccgcatcttcgtcgacaccgtcgccggcacccccaccatcggctagagctagctactagcctcatctgcctgccttcagcatcctgcttatcttaattaaataatcacatgcacgcaagtgatatgtactgtgcatgtttcgatcgatccatcccccatctgaataatgttggttttaccctacgcacgtgttaatgtttttctcctacgaataaataaagagaccttcatttaatgcatggtagccaactactccctccgtttcacaatgtaagtcattctaacatttcccacattcatattcatattaatgaatctagacatatatatctatctagatttattaacatcaatacaaatgtgggaaatattagaatgacttacattgtgaaacagaggaagtacctagctaatctttaggaaacaactacaaatagaacgtcccattttattatttttctttaaaaaaatttggcggtgtttcgcctctcataaactaatgttgtagcatttagtgaaaaaatgttttagttcttaaaaagaagtagaacacaattggatagtcatatgaaacaatttgtttcaacatataaaacaaattttttaaaaccattcaaacatcaacaagatccaagtgaaaatcgaagagaatgaaacactataaaaatacccactaaaacacttcgatctaactaataaaacatctaaaccatttttgttcgctggcatcgtgtttcgcaagcaggcatgctaagacagccgctagcaaaaataccatttttgtaggcagcaaactaaagaggacaatagatgaaaacattttttgggataaaacagttgaaaatcgagatgtcgtcgtatagcggcagggcagggtcgacgatagcggtcggcctgcgagggtcaacggccgtggtccggaggaccaccgctgccggatctacctccttcaccgcccctcatcttcgccgctgatggaccctaagttcctctcgacactcaaggctgttgttggcccgatctttcggtgagttgtgataactacgatttgggagaaacgttaacgatccgactacaaccgtacgagacgttgtgttgcgccttagcgatcgatacacctctccgtgggttgttgatcttgctggtgcagatcaaccctattcctgcaagcaaatcgaagaaacaagcaagaacaagataaaagcaatctgatattgcaaataggaatttaatacaaatgataagttggggttccgaatacaagcagacggacggtctagccgacacgcgcgctacaaggaagtagcaatagctaaactttcatctaaacaaaacctgactaaccctggaggggttactagctatttaagggatggaggaggtcagaagggcgtcctccctctgtttggggcacagccccccttgggccccacttgggccggggtcccagacgaagttacaggcccataggcccattacagacaatgcagccccttgtttcttcaattgcggctcactgagatggaatatcacaatgaggctggatccgttggaaagaggactctgagagctttccatcaagtactcacgggacgaaaacggagctcgaatggagatttggcggccgtttgaagtcagcaatgttgcaggtggccgaattggattccagcacttggaagacttgatcttgatatcttcttgttcatccatgatgtgaacaatgattgtatccatagtagccatgatcacatcagccgcagtcgaatctatcccctacactatcgccacccgtctccattgccactatggaggaggatatatgccaaggggaagccatagccgggaggaagtcgttgctgccagatccccaccatcgtcacctgccgccatcggattcgcgccaccgtgacccgctgtcgccggatccatgcccccgtgactcgtcgccgtcggatccatgcccccgtgactcgctgctgccagatctgcaccgtcacgacctgccgtcgccagatccggaccgagccaccccctcccctccaaccaaatctaggagggggaggggagagccaggccaccgcaactgctctgatccctacagtgcgaccgtctcgtcgtcgtggtcgcgtcctggacggaagcacaccgccgcctcccctccgctgctgccgacctccactacgtggctctccttgcctccgccaagcatggccaagtcgtgctgccgctgccgccgagcgccgccatcattgaccgccgccgctgcaccccttcgctgctactagctagagagagagagataaagaaagaaagaaagaaagaaagaaagagagaagggttggatctgaggggtcgaggaaaaaaagagggagcacgtgatgtttattccctcccacgatttttgcaagcgaggctcccaacaccccgccagtaaaaaatagtttttttttactggctgcatcttaagagcaccacttgcaaaaatacctctatttttgctggcggccctcttaacctggccaccaaggacgatccattttcgctgctggccattagcccccaacccttgttataattccactggtggttttcacgtatggccgccagagaaaaaaataagttgacgccatgaaaaatcaattttgtagtagtgagcgtgaggagcgggtggagagaaacggttgagagagaggaggggaatgcataatatggaaggtgggggtgcgagggctgggcagcgggtggagcgaggcgtggggcgcgggcgcccaatattcttgttcccatcgggcgcccgagtcaaagggttttcgtaatctttaccacatcgggagcagagaagttgtttttatcgaagtaaattgtttactccgataatggtggaagcaggatggcaggacgtgcggtggggtggggagcagggaagttgtttttatcaaagtaaatcgtttactctgataatggtgggagcaagatgatgggacgtggggtgaggtgggcttgggctgatgcatgcttggcgctcggaatactaggagcatgctgcgctcctagtagtatctctatataattcatagatttttcttttgttttgtaaggagtactccctccatttcatattataaattgttttaacttttttgggtttaaccaagtttatagaaatattagcaacatctataataccagattagttttattaaatgtagcattgtatgtattttgataatatgttgttttgtgttgaaaatattgctatatttttctacaaacttggtcatacttaaagcaagtttaactaggaaaaaataaacctacttcatatataaagtcacaagaccttttatccaaaaattgaaactttcaactaaaagttcaaaaaaattatactcttggctcaaactttcaatataaaatccaaaaactgaaacttcccaaaaaaaaatcaaaaactttgtgctcttggctctcaatctttcgatacgaagttacagaatttgagaaaactttcaactgaaactcctcacgagggtgtcaagtagggatgaaaacggtcggaaacaatcggaaaaaaggctcaaccattaccataaccatatttttctcagaaacaaaaacgatatcggaaatatcgaaaaaccagaaagggcagctacgctggatgggctctccaatttatcttaatttaataattccctcaataagaagaaaaattatcctcagtcaatttcttgaccattgttctacaattttacttataaccaaattttacttataaccaaatattacttatgactttatagtaataaaatcccgtaggctgcagcaacgtgctggatatcacccaacaaacataaaaaaaaaacatgccatgttctagtgagcatcttgatcgtggtaggatagctagctaaataaagggtcggatgcgatatggatgctagcgaatagagcttttctgaatcgtcattaatacaaggaaagagggaggaggaaccagaaggagaggagcaatagtttgggggatgatcccctccattaatttctcattctggatctttgctagggatggataaataatcttatcccaaacagaaaaggctagagtacgggtatgtgcttcacgtgaaatgggaaatatatatactatcaatgacgactaatttggcagcatacatgcgtgcatgggccagttaattaattatatatgctaaatggattgtttgcctcgatcagctgccggacgactgagagcaaaacataatgcatttatatactcgctcgtgtatcacgcataataatactatactactcctatgtatcaatgatcgatcacatgcaacaccgacaaattaaattacccaccatcgatccatctatctagctatgcctatatatatacgccatatgtatgacatatacgcaagctacatatacactctctccaaagtttacattcctgatatatagctcatcatcagttgatcgtgtccggaggtgtgagaggtcggcgatgagctccggcggcaagcaggacggtgcggcggcggcgggcgaggaggagcggaagacgtcgtggccggaggtggtggggctgccggtggaggaggcgaagaaggtgatcctcaaggacatgcccgacgccgacatcgtcgtgcttccggcggggtcgccggccggtgaccaaggacttccgccccaaccgcgtccgcatcttcgtcgacaccgtcgccggcacccccaccatcggctagcctgcctcatctgcctgccttcagcatcctgcttatcttaattaaataatgatcacatgcactcaagtgatatgtactgtgcatgttccgatcgatccatcctcatctgaatcatgttttacctacgtgttaatgttttttttcctacgaataaataaagagaccttcatttaatgcatggtagccaactacctagctaaaaacaactacaaatcgcacatcccattttattatttttctcttaaaaaaaatcggacggtgtttcgcctctcataaactaatgttgcagcatttagtgaaaaaaatatttcagttcttaaaaagaagtggaatacaatcggatagtcatatgaaacaatttgcttcaacatataaacaaatgatttaaaaagaagtggttataagaggctcagtagcaccataggtcgtggattcgactcctcatgggagcgaatttttcagaatttaatggctttgtgcagccctggattcaactccccatgggagcgaatttttcaagatttaacggctttgtgctttcagtggtaggtaacgtatccgtcgacagcgaggcgcctgtgatgactttgtccactccaggatgaatttgccggcccagtcttcaaaaatgctcatagggatagggtttgcgtgcgtgcgatcataggggtgattgtgcgtgcgttgtgagtgtctgttttgtaccatgtaattctaaaaaaaaaccatcaacaagatccaagtgaaaaccgaagagaaaaaatgaaacactaaaaaaaacccattaaaacacttcgatctaactaatgaaacatccaaaccatttttgttcactggcatcgagtttcgcaagcaggcgtgctaagacagccgctagcaaaaataccatttttgcaggtggcaaactaaagaggatagccaatgaaaacatgttttgggataaaaaaaatttgaaattcgagatgtcatcgtatgagggtagggtagggtcgacgacagcggtcggcctgcgaggatcaacggccgtggtccagaggaccaccgctgcctgatctacctccttcaccgcccctcatcttcgccgccgtggaggcggatccagtggtatcgaacaccaccccagtcagatctatcccctacactatcgccacccgtctcctttgccgctatggaggaggatatatgccaaggggaaaccatagccgagaggaagtcgttgccaccagatccatgccatcgtcacccgccgccatcggattcgcgccgccgcaacccactgtcgccggatccacgcccccgtgactcgtcgccgccggatccgtgcccccgtgacctgctgctgccgaatctgcaccctcacgacccacgatcgctagatccggaccgagccacccctgccctccagccaaatctaggagggaggggagagccgggccaccgtagcttctccctgcagcgcgaccgtctcgttgtcgcggccgcgtacgggacagaaccacaccaccgcctcccctccgctgccgccgacctccactacgtggctctccttgccgcccccaagcatggccaagtcatgtcgctgccgctgagcgccgccatcgttgaccgctgctcctgcaccacttcaccgctactagctatacagagagagaaatcgcgagagattcagagagagaaaaataaagaaagaaagaaagaaagaaagaaagagagaagggttggatctggggggttgagaaaaaaaagagggagcacgtgctgtttattctctcccactacttttgcaagcggagctcccaacaccccgccagtaaaaattgttttttttactggcagcatcttaagagcaccgcctgcaaaaatacctctatttttgtcggcggccctcttaacccggccgccaacgaagatccattttcgctgccgacccttgttaaaatttcgctggttgttttcacgtatggccgccagagaaaacaaataagttgatgccatgaaaaatcgattttgtagtagtgagcgtgaggaacgggtggagagaaatggttgagagagaggaggggaatggataagatggagggggtgcgagggtgtgggcggtgggtggagcgaggcgtggggcgcgggtgcccgatattctcgttcccatcgggcgcccgagtccaagggttttcgtaatctttacctattattaaaatttaagatgattatgtaggcacccaccttttcgtccgttgtgacattagtttactgatttttcgtaacctttacctattattaaaataatcttcctaggtggccatacgtgaaaatgatcttcacctggaaaaataaatgcaccccgtctaagaaaattgtattcataatagtgggtcctcccactgcagccaccaccgctgcccaatgcagttgcgtgccgcggcctgacagagccgacacctgctgcagtccacgtcaggagcagagaagttgtttttatcaaagtaaattgtttactccgataattgttggagcgggatggcaggacgtggggtggggtggggagcagggaagttgtttttatcaaagtaaatcgtttactctgataatggtgggagcgggatgacagaacatggattgaggtggacttgatgcatcaagagcgggatgacgggacatggattgaggtggacttgggctgatgcatgcttggcgctcggaatactaggagcacactgcgctcctagtagtatctctatataattcatagatttttcttttgttttgtaatgagtactccctccatttcatattataaattgttttgacttttttttgtttaaccaagtttatagaaatattagcaacatctataataccaaattagttttataaaatgtagcattggatatattttgatactatgtttttgtgttaaaaatattgctatattttactacaaacttggtcatacttaaagaaagtttaactaggaaaaaaataaacctacttcatatataaaatcacataccttttatccaaaaattgaaactttcaactaaaagatcaaaaaaaatattcttggctcaaactttcaatataatatcccaaaacttttaatccaaaaactgaaacttcccaaaaaaaaaaatcaaaaactttgtgctcatggctctcaatcttttgatacgaagttacaaaatttgggaaaacttccaaactcctcacgtgtcaagttgggatgaaaacggtcggaaacgatcataaaacaggctcaaccattaccataaccatatttttctcagaaacaaaaacgatatcggaaatatcgaaaaaccagaaagggcagctacgttggatgggctctccaatttatcttaatttaataattccctcaataacaagaaaaatgatctccagtcaatttcttgaccattgttctataattttacttataacaaaattttacttatgactttataaaatcccgcagctaggggtgaaaacggtcacggaaattcccaatcgaccgggcgctgtttctgtttaaggggtaccgtttccgaccataacgtttttggctattttaaaattttgttttttctaatttctttctgtgtcgtattaatgtcgatattgagtagtttaaatgataaatatgttcaattaccgaccgatcgagcatcgtttctgaagagatgctactgattccgactgttttcacccctacccgcagcaacttgctggataccacccaacaaacatataaaaaaaacacaccatgttctagtgagcatcttgatcgtggtaggatagctagctaaataaagggacggatgcgacaatgggtgctagcgaatagagcttttctgccttgctgaatcgtcattgatacaaggaaagatgggaggaggaacaagctagagggagaggagcaatagtttgggggatgatcccctccattaaataatttctcattctggatgtgtgctagggatggataaataatgttatcccaaacagaaaaagttacgtacggccgggtatgtgcttcacgtgaaatgggaaatatatgtacaatcaatgacgactaatttggcagcatgcatacgcgcatgggccagtttgattcgatcagcaaccggaccactgagagcaaaacacatgctgcatgcataatgcgtttatatactcgctcgtgtatcacgcatatcaatgatcgatcacatgcaacaccgacatattaaattgacccatgcatcgatcaatccatctctctagctatgcctataaatatacgccatattaagcaagctaattaagctagctacatatatatatatatatatatatatatatactctctccaaagtttacattgctgatatatagctcatcatcatcaatcgatcatggccggagttgtgaggtcggcggcgtgcagcggcggcgagggggagcggaagacgtcgtggccggaggtggtggggctgtcggcggaggaggcgaagaaggtgatcctcaaggacatgcccgacgccgacatcgtcgtgcttccggcggggtcgccggtgaccctcgacttccgctccaaccgcgtccgcatcttcgttgacaccgtcgccggcacccccaccatcggctagcctccctcatctgccttccttcagcgcccgggcccccggccatctttatcttaattaaataatgatcacatgcacgcaagtgatatgtactgtgtgcatgtttcgatcgatccatccccatctgaataatgttttaccgtcaatgtttttttcctatgaataaatatggaagaatcttctcccatcgaacgtccgacgtcccaaaaaaaaatcagacggtattccggtgaccaacgagtgaaacatcaaattatatatgactagtaatatacccgtgctaacgcaacggtgatatttagtagagtaaaatggacgggcggctcttaaacttgtagaggtgtatcatctaggtccctaaactcttaaaatgcatatccaagtatcagaacttgtcatagtatgttctctaggtcccaaatcgctacaaccttctggatcctacatgatactgatgtggcatgccatacgtgcatgacatggcataattttgactgacaaatgagacccatttaaaaaaaattctttttctttttttcttctttcttctcttttatttttcctttcttctcctttctctatgacccaagcagaagaaagaaaaaaaaaagaagaatgagaagaaaaccaaaaaaaagaaaaagaaaaagaaaagaagaaaaaaaagacccatcatgtccatgtggcatgccacattagtgccacataggatcttagaggggctgtgtcgatttgggacctagatgatacactttgataagttccgagacgtggatccattttaagagtttggggatctagataacataaccctacaagtgtaaggaccgtctatgtactttactctgtaatctccaaaagttaatattgtttttagtcaaaaagaagttaatattgttttaattataaagcatagaataaggctgctggatttattgaagaaatagcacctatagaacctttcaactgatatttgtaactattggttctatagaaatagcacctatagaacctttcaactatttgtataataataactttgggatttgaaggatcaaataacagtgacttcacagtcgaagtatgtgctgaaaaaggaaaaatagaaacgttgttgctaaatgaatagaaatgcccaatccccagctctcaaaaacaaatagaatgaaaaaaaaattgagaaaccgaggttaacttcaactgcttctctgtgtcagacttggcgagcgaaaccttcagccggtggcgagcgcacattactcttcactatgtgtaggtatcagctaaataccagaagcgtccgtattctattctaacaaaatacatatattatctaccctgcttatcccttgaaatgacaaattgaactgcagtctgaaaatgagacataattttatcaaaatactaatagtaattagagaagagtggcacttacattgtactcggaacaattctgcaagcctctctacatataaaagcatccggtcaaatatcaatggttgatatacatgcatgcatggttgctttttgcaaaacattcgatcaataaaggaaagggctctttatattttcttcggtacaacatctaacaaaaaataaaacacaacactaaatgctgtagcaattaccagtgtacatattctgtaaacatatacttatagtaatatgcctgtgctaatgcttcaaagccaatcagtaatgtaaattaaaagcataggatgagatggatttaagttagtatattgttgattccatagccgcatgcataaaataaaatcacaatttttatacatttctaactatctacaacacatataaattcgaccagctattaatttatcgtgttcaatacagtgtattacaaaaatatttttcctcacttttattcccagtgcagcctctcttctccactctacatatccatgatatgtacattttcttcagagaacaagtactacagtgttaatcagaaaaaaaaaggaccgtggaattgatatgcataacatcatttggaaaatgcttagtaataggacaaatctgcccgaaaaaaagattaccaatatttgactctggcatgccaacaacgagaagaaatgtttacataatcaattgatactttatttattacagttctaatccaaagcccaaaggtcaataatattagctcgtaggcagctacatatatcactacattcgtcatctgccctcttagccttgaagcctagtcattcattgatggaacatattaccaatctcacgaaccacatagtaaatattcagaaggtaccaagtagccaagcactgattattatcagtttgctgctctatgcaaaaagtaaaatataataaataataaataagaagaagaaagaaagaaaaaggagaatggaagttcaagaaatattaaataccaaggtgcatctttattttttacacatatgtacatgtaatggccaatcacattccagcattttttactgctgttacagcagaaggtgcattttgaaaaatcaagaaattatctggtttcgaattgcactgaacaacacgcaatgcacctgcatcaggtaaaattataacaccgtgtttagtccaaagaacattttaaaggaaatagcacttacatggcaatacctcagattgagggcaaattaccctgttgcaacaaccattagtaatccatcaatttcgtcccaaatcaatttccggagaggaagatatctgatgcattcagatccaattgataagccaaaaccataatgtcttgcttgcaattcctatcaggcaggatcagagaaatggacctgctcacgcgcatgagcttggaagtagatcagccagtggcctggttggtgtcgactcgggatcagcggcgtccgcgccgacggctgcaacgtcaggcggatggatgcctccacacttgcaggcttgcgtttccccaatcttcggaaggggaggagatcgcgttcgcgtgggggagggggaggaaatcacgcgcttgcgttgcggcgaggcgatctgcagccggccggctcagggagcaatagccaggcttggggagggggaggcgctactgcggccagggcgacgattgtgagggacatcggcgctgggagaggggcggattggcggattgcgggatggcgaccgtattctcgggcgtttgacgcgcgtgggaggtggagacgatcctgagcattggatttcacagaggtgatctgaaccgttgagtgatgaatgtaagagtgtaggagagaaagatgagtaaaatgagttggtgaattataaggtagatgaaataaaaaaaatcagcaactgacacatttaaaaattttaccattttcattttcgttccaatcgattaccattttcatatggcttggccggtagaaagtcggaaacgaacatcggtcagctaagaatttccgttaccgttttcatcccagtatcaagatttgacgaagaagttgtcgggtctccttaacgtcgctgaggagtgactagtgaggaagggctcgtaacgcctcgccgagtagagtagcgaggaagaagggaacccgggctcgcccaaatatcactgcgtgccattgggccgtgcttgggccggcacgaagcacgatgggccatgccgtgctagaccggcacggcccaagtccccacaattacctgagtgtgcccaacgctccagatttaatttcgcatgttgagccaatatgctttatggctaatctcaaacacaagcacttagctggtttttcacctatagtcttgattttgagattttatttattttcggctatgaagtaagaaaattatcaatgccttcagtgtccagactttcaggtgttgagaggctgaggtacaaatgagagcttctgggatgaaatatcaagcagtaaaacattatctcaagaaatgcaagcaccaaaaaagatcaaacgagtatcccttagcctcctcatttgtgggttgaacaccaatacggtgacaatttcataactgctgatcaagatatggctcatcagccaaatgaactctgcaactctgcacgagttcacctctgctgggagctatagtacaacagtgacaatcagtcatcggtcaactgcctgagataattttgaacgcattcatctgcataatgacttggaagttggagctttgctggtattgttctgaaccaattacagacatgccaggagatttgacaacagagagtaatcggtcaaacgcaaaaaagggaatgttgggtattacaaaaaaggggaatgtcagggtgtacagtcatgagaaggccgagctttggtataagctactttactctgctgatctgaactcatacataacccctcaaatcaagaacaagcactgcatccagttcttgcactgatctgggagcattactctacaagccatggtgtcagaacagattcccattcgcagagttcgccttctttgaaccatagagctacagacagaaaatgtgtaatgagtttatcatctgtttgtaaagaacaaaatagcaggtcacaataaagttaagtccaagctaacaaacatgcacgtctctaagcacatagtgctgctgaattattatttttaaaaaaaaaaaacatgatcctaatcactgtgtcaactacttcattcttcgtagtacttaaaactcatgattctatgcaccttatattgttataccatgactactgggaaaaggagtagaacttaccgatttcacgcttgccgttatcaggactgtcacttccatggacaacattcctggaaagcagagtccataagaaatttaatttctttgacagagatatatatgcagagatatccgctaaaatgtgaaagatgtggtagatataataatgttaaaacatgaaaggttgtttgattccaaccttcctgtttgaactgcaagatcgccccgtatggtccctggttcagcttgaaggggattagtagctcctattaacttgcgagctgatgcaacaacaccattcccctcccaagccttacagaacagaacaacaataaatttaattgaaaacagtttactgatcaaagtgcagagttacaaatatgtttggttctttacaaatatatataccatgcaaacaacagggccagaagttatgtactcgatcagaccgggaaagaaaggtttttccttcaaatccttgtagtgctcctgtgcacataagagagaattagcagctcgttgattaaacataatatactcctggtgattcccttcctatgtgaaaacaaagataatactgtatgctctgacggtgagcagaaaccaggtttaaccacaaatttcgatggcatttctacaaaattttctccagctgcttggatatttaatggatcacttttcgttggctgaatacaagaaaaagtgactcgaaagaactatctcagcagtcagcaaagaatgagtactttggatgatcaaggctgtcctgaaataacataccagacagacatgctatttatcatttattcgattgtgaaatttccattcacaacaataaaactgtgatctcctcaaataagtccattcaagtcttggcaaattgcccactaccaagaaaataaactgggcatgatattttgtcatgccacgcaaccatggtatattttgaaatggcaccattgctctccaacgatgattaaatggtgagtccccagatggtggaagaaaacactttacttttgaagaaaacggtggatattaagaggcaaacctgtgccaagtccttggggcactgaaaaagctttaagcccttcaacacaaagcctttcttctcgaaacgggaaataatctcgccaacctatatgaacgaatcgacaggagtgtttatctgagctgaaagaaactataatggaactacagtattcagtaatggaatatattacgtcaaaaaaaagtaatggaatctaaagttagaaaagtaagtaaaatgatataccaggcctcgctgaacaccatcaggcttgatcataatataggattgctcaacctacagaaaaaatagatttaatcttatggttgatcaggaagagatcacctaagtggagagttctcaacttctaactgaaataacagaatattgaggtaatcagaaatgtctgacatctattatataataaaagtccattaaacttcctacaaatgctcccaaactgccacgtgtaccctacaaacgctcccaagctgccacttggcactatgataaattatagaaattcttaaaattctaaaaaaaaagacaacacccaaccgttgattttcatttaatctggtggacccgatatttttaaccattagatcaatctataaagaaaaaataatcctccaatccctatcagtattgtacctacgtggagtcgtagtaggtatacgtacgtacttggacccgtatgcctcctctcttcctcctctgttccctctcttatttcttattcctattcttatgcaatattaggtagaaagcacaataggtgagcacaattgacaattaaacaaatataacatctaaactgcttatatttaatctttcaaaaagaatgtcatgttttggttacaatttctgacttttacgtgccatttaaataattccaaaatattatgaaaaaataacgatatagattttatcatcaaacataattacacaataattaaattagaaaataaattactccccggtaagtcaaaataatataattatacgtgtcttatattatattatatactataaacgcttataaattgccacatgactctttaataaattagaaaaattcctacaaattctaagaaaaaaagaaaaatatctttagcattgattttcatttaaaatgttagaccaattaattttaaccattagatctatataaaataatataatggtgtggaccatgcgtacatcgatctaatgtaaaggatatgagaatggttatagcttcgttcgtacacttacggaagaagaaaacattatatagtagtctaaaaaatcgagattcatttttctttctgaaacttaaaaaaatactaaaagtccattatacttccaataaacattatcaagccaccacatgcatattctacaaatgctcctaaatcatcactttacgctataataaattaggtaaaatcctataaattctaaaaaaaagaaaaatatcttaccatcggttttcattcaaatcggtggacctattaattttaaccattagatatatataaattaatggtgtgggccatatacattgatctaacgcaaaggaaaagagatcggttatagcttcgttcgtacatatagagtacaagacattggatagtagtctaaaaaattgagattcatttttttttcttgaactgaaaaaaattaagactttgatcggtcacaattttgcccccatcgacattactcaggacactgtcagcgtgagggggcaaattagcttgggactacatgtatgtatcatgcatgaccgagctaaaagctttatctaccaattattttagaaacttaaaagttaaaaactatttagtatttaaactaccatggttgtataaatggctaattctttcaaacaacaaagataaaataggataagcattgtaggcttcatatttaggattatgcaatataaacataatcactaaaggcctaatgcatgttagctaagataaaatcacaaagtgattgtttgcattatgtaaaatcctaatgtttaatcataaattttagagtaaaaatatttaaatcatgacaacaatcataccacactacataataatcacacatgcggagttatttttcgcaatgaaaattatgttcctgctaagctacatggagtctcacacactctacacgaaacaataaactatctcctacgctgcaaaatcaatttagactcgagaaggctttttatttgaaatatatattgtgtcacgtggaccgaaggcatccattaataaacaatgagacaatcaagtatacagagaaaaaaaagcaagtgcatctcagcaaaggatacagtaagttgtaaaatatgtagccaatttgctacataccaaaaggaacaccaaaagtaactatcaagttcgttgattgttggcaaacaatgatatcggcacaaagatttatatataccattattttcataaccaatcaatgtgaaatgacaactttaagccacttttctaacgtttttaattgaatatacaattatgttcatcacattctaaacaaatgatttccgcgagaatattgttctcatgttcctcaaatgtgcagcctcctatgtgatgagccttttgcctcggactcatgggctacctttagaaataacttttgtaatgtgtttacatataactactttagtggagtacttaacccagaaggtagagttgaagcttttacacagtgaactattttagtggagcacttaacccgcaaaagtagtattgaatcaatctattccattggttacagaggaaaaaaaagttcattttacatcctaacgatattttattcttttaaactttttttcttctctacatacaagtcatatttcactttgacacatcaggagatgaaggtcaatgataattaaacgaatacactaaattccacgacctgcatgtaaatgcctctaaggtgtcaatacaaaatcaataagcatttcgtataacgatatgattagaaatttcctactaatttttattttaagactcatattaacttggtatttttcttaaaaatactgtaggatcctacgcataagaatcactatcttacatatgtatatttggtcaatttaaaaaggtgatagcaggttagtaaaaaatatatatttatgagcaattaaagtttctcaagatttttaaagaaaaaatacaatgaacattcaattaagaagggaaacacctcactttaatttaaacttattttgttagacatgttttcgaaacgaaataaaaacatgcccgcgcaaatgcgcgggctaccttcctagtttcataaatagacagatccacacttattctgtgaaaatagaagcgacgaactcaggttccatacttaagctaagtcaaacagcatccgtaatacctctcagatataggcatatatcgtgccatgaaaagaataagtggacataaaaaatgaaacagttctacaagttctgctgatctgcatctttgatttcagggattaaatgcgtaagattaataaaaccaacattgatgcactaacacgttactgagattagcaaacagaaaatggctttatgcttgaggggaataatgaaaaactacaagaataaatttggcatcccttcaacataactcaattttctcaactatgcataaacagatttagattgttctacagtaccccttcactgtgtatttaagacattgcaagttgcaacaactgtcatgctgcatcgcaaaatgagattgcctaaggaaacttggacctgttcaagtactggaatttgaaacacgttgttgaataattcaaacaatctcacagtagaaccacagagatcattgcatttattaacaaaaagagtaaaaaaaatgaagaccaaattttggaattctgatgggcacaaaaattctacataatgacatatatagcaaacatcttcaattgtactgcacgaactaggcagcaaattagatggttatcagagcatccaaaataattgccatgaccatttccatatgcgcatcacggtacaaaagcaactcctacttggcaatcaacacaatgtagcatgcctaagtgccatattttcatcagtactgtctgccgctgacagcagcaaggcaaaattcttactttcagttcaagttcgcttcctttttttccaataacttatgtcaataaccatagaatattccagaaacgggtactaaaattttagactgactcttctcaacaaaaaaggaaattcagactggccaaagcaacgtatgaatatgtgggacatttcagtgaattatctgttcagtttttgcaatcaatagggagccaaaaaaacgattatcttcatctgtgctcagctagtagcatgtctttttcttccccaatctatcaaaaaaaatacgactcgggccaatacaacagtagagtaaaagtctgaaaccaacatcacaaccaaaccaaattgcccctctcaacccacaaaaaaggaactaatcttttcctgcaatttggaccaaacgcgagtaggtaaaaacaaggggattaattcgagaggtgaccaaccgacgacgcgacgatgcggccggcggcggagacgcgccccctggccgccctcccgccccacgcggcgctcagcgcgacgcggccgcgggaccccggggaggcggcggcggcgaaggagacggccgccgggcgccgggacaccgcgggggaggtcgcggcgaggagggtcggggcggggcgggaggtcctcgcgagcacggccatggcgtccatcccggtagctgcttctcctccaacgtccgcgcgagcgagcgagcgaccaaagcagccgcctttttttggattagggagagcggagaagaagaagatgatgagcaggagcagagcagagcagcggccatcttgtcacatttttcaagatttgtttattctcgagttgtgaagtgccgaaaatacccctgcctctcattttcctcctgcatgggggtgaaaaaatggacctgatttgtcctcatttcgagtcgctatatacctcgttcgtttatgaaaattatattaggagtagtctttttaaggttagctgaacataaaattaataatttctatgcaatgtcgaagagtcctcgtttagtgggattgttcatattgttacaacctctagcatatggtcaatgatttgttgtcataagtttgctcgattgaatttagtactaagatgtttgaattttttcaataaaagtactttttcgagataaatctatttatattgttttatgttttcaaactaaaagttatcccgattattgataggccaagcaataaaaaataaccagatttatcatagagcacaaatatttgtgatcacagggtgtacgcacccttgtttcaaacagaaatgaatgtatacgtgcttcatacaccactatcgactccttgattgatctcgcctctaccatgtacaacatgttattagtcgttttagattgtttttcctagtcccgtttctctctggttgaaatcaataaggttaatatggtatgagtttttgatatagccgtgttctatatggttttattcatcgggagataccattcttctataaattaaggtaagatgtacaccgctcttctacactatgctggtcctcgaatcatcgctaaacggtgatgcttaccttcttggcatggtacatgtatatacatgtgatgtgatgcttattttacaagtatatgcattgatacttggagcgaagaataacatacttttcttcaatgttcacttcattagaagagaaaaaagatgcctctccatccaaatgcccaataaaccatagctgcacaatgattgactttccttacaccccttatggttgcatacttaatcaacaattgccatccaaaaaagtgtgattccacaaagaaaaattgtgagcatctatcataaatgtatatctacttcatcctagtatcatatatgtacggcaagtataataaccttagtttacatgcaaacgttatcactcaagccatatcaacctacatcctacatgaatgagaaagaagtaatcatatgttcgttgagtgtgagcgcatagccaccaagtactagctgttgtgcatgagctagtccaaagtaaaagagaaagatttgagactcggtaaaagataaaataatttttaaagaaagcattgagaaatattgttgtatatgtatatggctttcaaatttaggtgattattctttagagccaacaaaaggtcatcttattggctgttgccaatttgaaagtgagtttagcttttgcaactcgttcgtttactatgagtatgtttcctaaattattagacggtgtatttttaaaataaatttttatataaaagcttattttaaaaaaaatcaaacaaatctagcttatcgatttaatacttaattaataatatgttaaatgtttttatttcacgtgcagaaaaaagctaagtcaaattgttgccactgcttcctccacactgcccacttgtccagtggttgccgaggtgcttattcctacacctaatttatggaggtcaataacaaaattattattgtaatatacttttttttatatagtactagctcatttcacccgttgttatgtaaactctttagcccatattgtatatgtggcatctgacgaccgtccagtataaaaagcatgaggcctactggcctacttaccgtaaaaagtcaaatgatacactttgtattcaaaacacatgttaccggtgtacacatgcatagaccaaacggaacacctcattttagtaaacctagtctgacgctttctatacagcaacgcggtacctcaaggtttacgccttcaggcggatcacgcacggtggagacggacgagcgcgagaaaggaacaaaccgaacaagtggacccacccacccgtgggcccatccacttcgtccaccacaccgcatcgcacaaaccacacaacaccggttccgaccaatcacatccgtccacgtaccccccaaacatcccccggccccacacaccgaatccccccgcacagcgcgtaagccgccaccgacgcgctggcactcccacgttcaagccctcctcaccaccctcacacctcacagacaggtgggaccaacaaaaaccagacccacctgtcagtgacgcggttcggacgaatcccccgtagccgtaacacgatctccaactttcctcgtgggctccacgtggcagtggggaaagcacgggtcccgatgatatcgcccacacaccacctctctctcttctctctctccccatctctctctctcctcctcgactcaccgtctctctctctcccctcccgtctccggcgatctctccggcggcgtctccggcgaccgggccaccgccgccgccgccaaggagcgctccccctcattccccagatcggtagctgtctcgtcgccgtccccgatcctcctcctcttcctttcccccagatccacaccccccccctcgcgtactcgctcttagcctccgcggcgggaggtggtggtggtgtgggcggggggtgagctcgtgagtcagatccggtgatctgtgcgctgttgcggttgccatggacgacttccagggcctcctggcccgcgactttgggctgcgcccgcaggggaaggcggcgcccatgtcggccgcccgcgccgccgcgtcctccggatccgcctggtccaactccagatccgcatcggcgtcctccgccgccgccgccaccgccccgcccgcgcccttgtacgatgacctcttcggggccgcggcgccctccgccccgccgcccaaggccgcgccctcgccctccctcgacgccatctttgactccttcaaggagccctccgccccggatgccccacccaagccgaagcactcgtccatgccggtgtttgacaagccggtctacgatgacgacatcttcgatggggttcccggggtgaagagcagctcctcggcgcggtttgacgatgtattcggtggcagccacgcgccgccgccacctgcgtacgatgatctgcttgggggatttgggagcaagccggaggtgaaggaggtgctgccggaggagaagaggaagcctgagccggccgcttcatcggctgggtttgatgatttgatcccagggtttggcgggaggatcccgatgcgtgccaggtgagcacacctttttgcatgggaatttcgggcattatgttgtctacatgtgcaatctaggagtaaatttagtagtagtttggatcaagcggaagctttgtcggtatgagccaactcggcaacgagagaaccatgtgataattcagttgagttggacaaattatggactcccatatctaatttatgttgcatttgcttagattttagcttgttaatgtgcacgtgcgattgtttgaattggtaacttataccagttgaggtaggaaattcattgatggcttatatcttcaaatctatttggtaattgaatttataggctattttccattaggtatgatctgtgttgaccattgaatatcaatggcatcttgtggataaacttatgggcatcttgtgaattttatgggctctacttcgattttactattagaaacgcctaggaacatatgctatgctttttataagcattccctactttcctaaagataccagtgcactttctcaggcaaacttgctttggcctctatattgcgttatgtggataatacagtgtatgctaggtttattatggtttatttaaattgcacatagttcatagagaatgttcagcatgcattaatgaccggatgtggtaggttcataggctgcacaactttgattgcaaattaccttaggttcaaatataacgctttatagtgatggaatatgtagtgagttatgcaagaagaatatctacgaggttctgaaattgctttgtttaaagaatgatttggatctttttaatctaaaatatgtcaatcatatacagatttgttaccataaattccctcatcctttttttttttgaatcatagggagactgttggaactaaagataagaatgtgtccatgtcaacgtctaagccagctagcatggcaagtgacccatttgatgttcttggtacaacttcaacctcaaagcatacatcttcagggatattcacggatcccttggatgaactgggcaggcctgcaaaatctcaagggaaaaaacatgataatactgctgttgacagtggcctattcgaggactcaagcacttttaatcaggtcccaaaatcagaacctctgtttacctcagagttgaatgatgacttgaaagataggaatggctccaccaaagatcgagattcaagtcctgtgcaaaatttttccagaaaaaatacaacccaaaaaccttctgtggagaacttcgaaaatatctttcctaagtcacagtctgctcgatattctgatgttcatgttgacattggtgcctctggttcagagaaatacagtgggaatggtatggatgaccagtctccaagatctgatgagtccgaagatgagatctggcttacagtttctgagattcccctcttcacacagccaactagtgccccaccaccttcaagaacaccaccacctcttgctgttaagcaaaaaccacatggatcacaagcaaaaagaaaagatgacaattatccacgccggtctaaccaaaaccacaatcatcacagaagctcgtcaaatcaagctggttcttcttcaatagatgaactggaagattttgccatgggcaagtctcaaagttctgcctatgacaatgcaaatccttttaatgaggaagaatttgagcatagttcatcagcagcagcatctgcagctgctatgaaggaagcaatggataaagctgaggcaaagttcaagcatgcgaaggttgtacgggaaagggaacgcgatgcaaaacatagaaatagagaacagcaggaacaagatgatgaagcaaggttcaacacccaggatcatgaagagagagataggcaggaaagactagaacgggagagagagatgagacaaagggaggaaaaggagagagagcaaagaagacttgaagaggagagggaacttgagaaacagagagaaagagagagggctgctaggcaagctgtggaaagggctacaaaggaagcacgggaaagagcagctgcagaagcacgtgcaaaagcagagagggaggcacgccagcgtgcagagcgggctgctgttcaaagagctcaaaaggaagcacgtgagagggctgctgtagacgctagggaacgagctgagagggcagctgctgaagcgaaggagagggctgctgctgaagccaaggagaaggttgcaactcaagccagggatagggctgcagcagaaagagctgcagtggagagagctcaacaagaagcaaggaggagagctgaaagagcagcagtagagagggctgcttctgaggctcgggaacgtcaagctgctgaggctcgagaaaggcaggctgctgctgctgctgctgcagcagctgcagcaaaagaaaaacagagtaaaccggacgatcttgagtccttctttggtatgggagctcgagccaatagtgcgccgaagcaaagggctccaacagcggtgattactctaccaaaacatgcatgctaaaattttgttcatggcaatttttgggttattgttttaccaactgtggacgtttcaggattcgatgttcaattctcaaactcaaaatagaggggcagcatcttctgcttcagcatctatgcggaaggcatcatcaacaacaaatattgcagatgacctatctgcaatatttggaggaggtacggatcaacccaaatgcagcagttctgaacatacaaggttttgcaatattattggctatcgctataactcatttggttgatttcttttcttttagctcccacatcatctgaagaatttcaagaaattgaaggagagagtgaagaaagaagacgtgctaggttcgaacggcatcaaaggacccgtgaacgagcggtaatgttgctaatgattttagtaactaaaatagatatttgtttgtaacttgctgttataatttggtactgtggacattcattttatgttcctgaattttatcatttacatgttatttttttctatttattaagagttgtgatgcatgaatttgagttgcagtgccatttattaacttcaccgtgtatgcaggcaaaagccctggctgaaaagaatgaacgggatatgcaggttcaaagggagcaggctgaaagacatgtaagtactttttatctttcaattgcccaattttacttcttttaaatacttgtcatactggttagtctccatttattttcatatacaagtttactgatgatgttgtggtgcattttatttgttgagtaaattacactcacggtacatggaacttgtgtggtgggtgcaaatagatacaaccacttgcaaattgctcactttgatacaataacttggctagttggtgtttaccgggccaaaatgatccacacaagtaaaattgctctaaattagcacacactaatgatatgacagcatacacgtatgactgtgatttggagatcttatttcgaatccaaataaaaagaggaattagatgtgcaaaagtttatttttcatgtccaggatagagtatttatttcatttattgggaaaatttgatcctctatataactcgtctaatgtttatttatctgttcaagaccaagacaatttttatctgtacatttaactcctaaaagaacactttaattttcatgttcatgttcagatactctttcatcgaaagtgtatttaatgattgggcatttttaattattttacttttttgttggtctaaatcttgaaaatatacgttgtcagtataaaattttgatgtgtaacaataattacacaccagtatgtaatgtatcatatttgatcaattttacttgtggatcggtttggcccaggtttgcacaaactggccaagttattgtactggaataagcaatttgcaagttattgtacctatttgcacccaccatacaagttagtgtaccatgaatgcactctctatcaatattttgctaatggctagttcctttgtttcgttatctgttaatccagagaatttcagaaacaatggactttgagattaagcgatgggctgctggaaaagaaggcaatttgcgtgcattgctatcaactttgcaatatgtaagtccttattcctgatgctgctaaaaattgaatcaattatccttgtcttctcaatttttctattcattctctcggtgttattcttgcaaagaaagttgcttgactcttttgcttgtcttctggaagccatacttttccctgatcagtttggtagtgcaatttttaacgtagagtgtgttcctttatcatggtcacatttcaacacatgatattttctatccaagggtagttccgaggtaattttgttaagcatgcaggttccagtaattgtattccctgctacagctttttgtaagctttgttttcacctgtggtgaccaaaaccatggtattgaggtgaataggtgatatcagatagttttggtttcttgctgatgtttgaatgtaacatagctgagtggctcaaagaccagattgctggatgggctgaatatcttttgtttttctaagtcttccagtaaaaacgtttatctggtgttattctcttggtttgccattacctgcatacagtagctccttcctcgcaagctataatacatactctgtatgtaagtaaatagaaaattgtgaaggactaataattactcctattcaacaaacattgcattttagggctagtttgaagagaattattattaattctgttctttctgacaggtactttggccagaatgtggatggcaacctgtatccctgactgacttgattactgctgctgcggttaaaaaggtatatagaaaggcaacattgtgcatacatcctgacaaggtgcagcaaaagggggcaaatctacagcagaaatatgttgccgagaaggtgtttgatctccttaaggtgtgtatgctgccaaaatatattcacaaaccataatagcagcatgctgcttcacactaacaattggtcaaccgtatgtttttatttcccttttagtttattgtggagaaattagggactgcctagctacagagcctaacaggacttattaatgtgtttttccaattttaggacattggcctctacatggaaactgactatttgtcaattatgaatatttaggatctttcactgtacattttgagatattattattcatgtgtggtccattgagccaaataaggcttcctctatgatttcacatggaaagtgccaaggtttgacagttttcatatgattgatggtacactagaataacccatattaatgcaaactttggtttgtgtccacctggaccaccacctggtgccaacgcaagtatatctggcatgccctgcctactatgcccacaaccaaattaatgcaaaccttagtaatggcctgatagtctgcctagaggaacccaaaagcaaatgcttgacatatacacgatacgataatttaatacatcagattgatcttgttgatatttagtactttggctagtatatcttacattagcttacttctttatacaatgttgcatatttaggatcttattatttatttttagcaagaaaaaagagcttgtactcaattgttttccctaaaattgtttaccaagtgccgggacttttaaagagttctattttctagtgtttcccattacatccttttggtataaactttaattaaacctcctctatgtttgcacaaaacaggaggcatggaacaaattcaactcagaggaactcttctaaacggcctgcgcaaatgaaacatattgctcaccaatcttcacctgcatgaggcaatcggggtgggacagcacctcatagaacaaccgagctggagcagtcggtcggcggacccatgaaacgatgaagtgaaagttccaccataattacaattgtattgttattaccaatattgtttgttttattatacaccctcatcttctcccttctgtatgtgttgattcaaatgacatttcacagccacatgtggtggccctgcggcagaccctcatccagtaggtgtatattagcgttctttttgctcggttgatccagggttgtgtagcagcggatttggggtggccagtgttgtggtttttggattaggcacagggtttatttaccatggagggcccaaattgcatggatcatgaatgttgccagtttgatgccatgggcttttcgtaagttcaattatcttgtttatagtgaacttctggaacacacattggggatgttcctctgattcctgtgtgattttgtataaagttgatctggaattttgatttcctcttgttctctgttaccgcttcgttatttgctcgttccttgaacgtataacgctagtatcacaaaatcctgtagagtttcctttaaagagtaaattttacggaacttcatgtattaaccaattgtgcataagtcatttgttttggcatgttgcttataatggtattatgctcctataacttcagaaaacagcagcagtaaccaaaatttcatctgagttctttaattcgatcatataaaagttatagtaatctaagttaattcttttttattttgctatagtgttaattcagattgattactagtagtgtggttttgtgaaatctaataccgatggtcactgtgcaatatgccaaaacccatatatcttgttccatttaaaaccataataaatagggttatgtgatatttaataaaacagatctgttaactcaaataaagattgaattgggaagtgttttaatagtttattaaaggttggattgggaagtgttttatagtgtagtggcttgatgaaatcatgggtctgccaccgtgttgcatcgatctcccaaattcttttctcgtttcactcgcatcctcatcatcttcatgttacttctacctacaagtatattgttttctcactattttatatcttttgctcgttaaaggacaatgatttgggtgtattcccaatttcccatcggatccagtaactcgtgtaat

SEQ ID NO: 71142 - DNA, 577 bp, Oryza sativa
gtaaaatatcgagttcgcacattttgttgtctgattattgatttttggcgaaaccatttgatcatatgacaagatgtgtatctaccttaacttaatgattttgataaaaatcattaggggattcatcagagcaaagcatgtaagtatgtcacatactcatccactagcaattattactattctagagtatctggaaacttatgtgcaagtatgacatatcatctagagtataatgttttagagctcaacatataatgatatcaaattatcttccttatatcatttctataatatttagggcctctttgactcgcaggattgaaaaaaacagagggatcagaaaaacacgggattctaataggaatataattcaagtataaaacagaggattgcaaaacgttgaaaaaacacaggaatgagtgttcgattggactgtaagaaaaacgaatttcataggatttggaaaaccgcaatcctttgaataaaatggtcacatagaaaaaattcctataggatttgaattatacgaaattccttcttaattaaaatcttttgattcaaaggacccttaacatat

SEQ ID NO: 71143 - DNA, 661 bp, Oryza sativa
attttgaatccaaatgggcaaagagatatacatgaatcaatttgtcaaagtacgttaggattattacaaccacaaatgggattattgagggaacaacttgaattatatgcaaagcaaatggctgtagaagctgaatcgcaatttgaaagttttgaagctaatattcaaacacaaataaacgatttattagcatttgatttagatacaacacttatcaatcaattgaaagataaacatcaacaactgaaaactattttatattaagaaagaaggaacgttttaaatgccaaataaaatattacttgtagatggtatggcgctattatttagacatttctatgctacaagtcttcataaacaatttatgtacaattcacaaggtgtacctacaaatggaatacaaggatttgtgcgtcatatctttacggcaatacatgaaatacgccctacacatgtagctgtatgttgggatatgggacaatcaacttttagaaatgatatgtttgatggttataagcaaaatcgttctgcaccaccagaagaattgataccacaatttgattatgttaaagaaatttcagagcaatttggctttgtaaatattggcgttaaaaactatgaagcggatgatgttataggtacatgtgcacaacgtaagggc

SEQ ID NO: 71144 - DNA, 4111 bp, Oryza sativa
aaggggttatgaacagtatactctccccattactccgcaaatgtgtgttggtgtttgtcaacgatattcttatatacagtaagaccctacaggagcatgtgcagcaccttcagcaggtttttcacattttgtcaaagcatcagttacaagttaagcgcagtaaatgttcctttgctcaacagcgtttggcttatcttggacatattatcacccccaacggagtttccactgatgatgacaagattaaagtggtgcagtagtggccgacccctcaatctgtcaaagaactgcgcagtttctttggcttggctggctattaccgcaagttcgtccgacactatggtatcatcagtaagcccctcactaacttgttgcgcaaaggtcagttatatttgtggaattctgacaccgagcaagcatttcaaactctgaaacatgctcttgtcactgccccggtgttggctatgccaaattttgatgaaacatttgtggtcgaaactgatgcttccgacaaaggcattggggctgttctaattcaaaaaggtcacccgattgccttcttaagcagagctttgggtcctcgtcatcagggtctgtccacgtatgacaaggagagcttggctattatgttagcagttgaacattggcgaccttatttacaacatgctgagttcctcattcgaacagaccatcgcagcttgtccttcttggatgatcaacgtctcactactccgtggcagcacaaggctttgactaagttgcttgggctgcggtataaaatcatctataagaagggttgtgacaatggtgtagcggatgccctttctcgtcaccctttacctgattctttggaactctcggccctgtcagtggttattcccgattggattcaagaagtggttgctggttatgcttctgacccggatgcttgcagtaaagttcaaacattgtgtatcagtgtaggagctgttcctaatttcactttgaaagatggtgtgttgtattttaaagatcgcatgtggattggtcataacaaggctgttcagcagaaaatcattgctaatttgcataccgcagctattgggggccattcgggtataaatgtcacttatcaacagattaagcaattgtttgcttggcctcaattacgagctacagtcacagaatttgtgtcggcctgttcagtttgtcaacaagccaaatctgaacatgtgaagtaccctggtctgttgcaaactctaccagttcctgagcactcttggcaaatggtttcattggattttatcgaaggattgcctcgatcagcttcctttaattgcatattggtggtagtggataaattctccaaatatgcccactttgctcccaccatttttccgtgcggtctgacttacggaccgcatggaaacaaaatggagcggcgtccagaaaaatcaatcctgtaatagtgttattgacatgtggatcccactgttttattttactatgtgccatatggaacgaggaaccagtcaaactagacaacgtcacagccgaaaccgctattcaaaccgtcttgggactaattttgtatcggttttaggagttgaacaatacattatatctagtattggttcggggataatttcacattgtaggcggctcctgaataaaattcgactggctttgagtgaagaatatcttttcttaaagggctagaattaattacaaatgttgaacccaatcattggttgtcgttatttttatcacatgttgcaactcacggacaatttgtaattagtctcacaaaatattggacaaaatttggttaatataaatgtgttgaaatagaatcaggtctaaacacagcctaactctacaattaggaatggcaatggggaccggaaccagatctaaacacagcctaactctacaattaggaatgacaatggggacccgaacccagatctccgttgggtaaaacatccattagaggccacagttattaaaaccagaccggaccggtggttgtgttagttgtaactcacgagactaagtactccctccatttctaaatatatttgataccgttgactttttagcacatattagactgttcgtcttattcgaaaacttttgtgaaatatatatgtaaaactatatgtctacataaaaatatatttaacaatgaatcaaatgataggaaaagaatcaataattacttaaatttttttaataagatgaacgatcaaatatatttaaaaaagttaacggcgtcaaatatttagaaacgaagggagtatataagatttgctctggtctggtctagtaaaagttcatatcttgtggagatcaatagtttcaaactttggagcaaaactttaaaaaaatcagttcagcacttgagcatgatctggagttgtgtcctcgtcgacgccgataccttcctcaccggcggtgccactgccatcgacggaacgtggcggatgccagcaccgccaccgccatctgtgctcgcttaattcgtctcgtttccgtgcacagcagcacaggcaataagatggccaaaacgagcagccggagagcgcgcgcggcgagttcgccgccaacccgccgacggccttgccgccacggcggcgcgaggacatcaccgcgcgcggcttcctcctcacgccgaagtgtccctgtgcaccatgagcgcgtctcagtccgtgcacgcggcgtgggcgaggcggcgtacgtgcacatacatcgggcgcgaacggctgtagtccaatttttcgagaggcgagaatccgatttgatgacatgacgtacttacggatgttagattcgggattatcaaaaaacaaaaagtactaaaaaaagaatatgttagattcggacaaggatcatcctttcctataaaagtcttgcttgttttagttacagggaattcgcttgctatcgatggcttgtgcgagcgcgggaaaacgtgatatgatgaatcagccgggacatggtggtgatgtgcccgtggccaagcggcggcggtgcgtcgaacccaccggcgccgccgcggccggcatcccggaagacattgtggaggaaatcctcctccgcctccctgtcaagtccatcctgcggttcagatccgtgtgcaagtcgtggcgcgccatggtcgccgacccgcgcttcgtgcgcctccagctacaccactccaccacggcggcgcgccattacccaccgtccatgctcatcctggcagactggtgtttgccagagcaacggaggggagcgatcgacttctttagctatccgggccatggcgtcgccgcggactccgcgcttgggatgacatggtcctcgaagtcgaccgtcgccgccgccgcagacgggtacgctgggctgatggggacgccgtggacgtcgggaacgccgacgacaacttggacgccgccgtcgacgacgggaacgccgccgcggactgggacgacgacgacgactgggacatcgacgttggcgccatcggctgggccttgcatctgcactgcaacgggctcgtgtatagttggccatatgggccgcccggcacggtacggcccaggcacggccgggcctgggccgaggtcagttgggccggcacggcttgacgaacaagccgtgccgtgccgtaccagcccacgggctacaaccacggcctaggcacggcccaagtagcctcgggccgtgccgggctggcccgacggcccggctagcccattgtgcccgtgccggcctaggcacgccctggcaaaaaaaccccttcaaaggttcaattcaacacaacaaattgacataacacatcaaattcatgaaattcacatgtaattcatcaaataagtcaaagaatcacaaacaattcatcaagtcaccagttcatcaaatcatgcatacatcacgtcacagatttacaagcacagatttacaaacaaatgaacaattcttcaagtcaccaattcatcaagtgtaacgctccgcttttcgtgaggcgttaaaaactaattcggcaaaaatcctaattgcgaaaatttcgttctttgagtgttgagtctaagttgtgccaaggatctcaatttaatcccgttattccctctcatcgagggcgcaggaa

SEQ ID NO: 71145 - DNA, 564 bp, Oryza sativa
tcttgtgtaggagacataccacatcgtttcatcgtatccatcatctgaattagccttcacttgctggatatggctgatcttgttccactcaggacctgtatctcccatggctatggaactaagaagctcaaagctgcagtccacgaacaaattcctcatgcttacttgctgcaaataaccagggagtgtttcaatactatagtccttaagtgtgaggattctgagttctggcacattctccaatacttccattttggggcagaacataatgtcaagcttccgcaatttgggaaaattagatatcctctgcagatcagggttgtcatccacactgagctcaacaacacaagcgaagttatcaagagacttgaggttctggacctcacatatccatagtttcttcagagcccttgcatggaaggcaaggccaggaggaaggcacctcaatttgcaacgctcaagtaaaaagctcctccaagacaagcattgcttgcacttgttcctcccacttccacttcttccattccaccatccccacgaagaatagcacttgcaatcttggaa

SEQ ID NO: 71146 - DNA, 1428 bp, Oryza sativa
ttcctgcaccctctcagaactcaaatccccaccctcgaactcaaaattttccaaggaattcataggaactgcatgagtttcgaacgtacccttgcccggagttgggatcagggtggtgaccacccccgatgccctcctccggaaattttgtggaatgccgtggccactggtccatttgccatcgccctccgctgcggtggggtgagcagcaagcggcggtgtgggcagcaacggcgccttcctttcctcgtccgtcaacggaactcgaggggaagacgtcgtcggagaggcttgtttcgtcttgccgacgaggtccagctgctggcggagatctcccacctcctcccgcagttcctggattgccgactccacttggggtttccatccgccgaaccccgcgtccagcttgttcacgatcgcttgcgtctccgtttgcttgttgttcaacgccaccagcgactcatggatgtcgccgaggattttgccgaaatcgaggttctgcttttccattgcctcaacctgtgactgcaaacgagatgtataccttggcttctccaggatcgatgctctgataccaaatttttcgggagaatagctactgtagttcctaatgtttcactctagggtcagtttagtccccgaatctttcaaatggtccaaagaaacccttaaattttgtcatatggctcagaaatagttattggatcaaccgaaatcgccatatatacatgccatgtcattattcatgtaaaatccatgatgaattgttcaatttatccttaagtatgtcatagaaaaataaatgtaagtgtgaattagtcataatcataggaaaaaaataatttccctttttttcacccttctgacatatatttttgctcttatatataccatatttttttaaaaaaaaattgcctattgttttttattttactatgatatatgtaagcgaaaattgcacaaatcattatgattttttcatttttgcataggagggtgattttgcataggagacgtacgaagcgcgtgttggcgaccatggcacgccacgacttgcacaaggacctgaacctcaggatggacttgactggaggtggacaaggatctgcgagccaagaccggcgcggacgacataggatgccggagatcggtggagtcgccgagaaggtcctggtcgattccgcttcactactccatccatcccatcgccacctagttagcagcagatcgaccgttccccgccgctgctgcgaccggccgcttcaccgcgttggcatctaccttggcgaccccatctcgctgccacagcggagaagagaacgagaagaagcatcgaaaaagaaaaagagaatgaaagaaaagaaaaggaaggtgggacattacgtatattttttattttaaattggatacttattgacatatggatct

SEQ ID NO: 71147 - DNA, 11883 bp, Oryza sativa
  unsure (1)..(11883): unsure at all n locations
tcctgcagcccgaatagtgttttgtttttaattcgcagacacatttgtgcgagataatttagaaacagttccaaatcgttttgcatagactgcccttttagggagaggactatgacacgaacgcccaattttattcaaatcattgaacggcaaataaatgtttcacatgtttgagcaatcgatgaaaaatgtttcaataaaaactgtttcctgtcttcctgatgtttcattactcagtcaataaatgttttatcacttaatccaaagatgttccaatcatatatacaacatccgaaaatgctgactgcaatagacaaaatctataagtgcaacatccgaagaaaaccgactgcaatataaaaaacaaatggtgcaacattcaaaagagagaaattgcaacatccaattcattgtctacattcatggtttgcaacatctttgctagctcttcaccagcctcactttcacctgtgctggctcctacctatccaccacctcaaacagcagtgagcaacaccaagaaggagacggtgactgcaggaaaccctaacctgaagcaatctcccaatcttcgtccccctctccagtctccatggcggccctcccctagatccgatactctaaagttgtgggtggctagatctgctcggaggagatcccgtgaagattagggagaagaggtacgagaggagagggaacgattagagaggagaacaatgagggaaatgccctagatggcggtgacagggatagaataaagagaactgagcgagaggggaaggaagcgggcaagatgggtgcggctacaagcataagatggattctgtcacatcggatggtcgatctgaagccccccccccaacacacaccccccccccggcccctagtggtgtctgtacaaagaaatcttcttttacacatatttatcacatttgtggctttgtgggtgtggtcttcccttgtgctgttgatggtatctatagatttgaaatgaggtttcgcccacaataagatccaatcatagtgtttcatgtacatcgaagcaacttatttgtagtagtaagtagtaactcatgtgcatagcttctcaaaatttaggatcattaaaaataggctttcgtgcatttaagcacaatacatcacagtagtcttttatttatatataatcatatataaaccacatacatatgtagcgaatgtagcacaacacataaatgtatacagcatgagagaaacataacggggcactagtgaggtaaacttttgggcctaggccacatacacatgcacactatatatgtataggtatatagagtgattgaaagaaatgtcacccttaggacttaggtcttgtgcgattcatccccaaaagagagattggaggggaggtgtagaattaatctcctacaaatctccttcaacctcttgtgtgagggattatacaaacaagactttaggggtgaatttatcatgagcactgatccaacatatatccaattggatatattcatatgtagatgacatatatcatatgtggacataaactccgatagagtccacaagtgcgcccgagcgaccaaagaaaccaaccacactgccgctctgcagcgggaggctaaaagcagttccaccaccttgtccaaaattataagtggtgacattggtgacaanntttgaagggttttttttgggttttcccaccgaaaccgttttttttggnggnttaaaanaaattggtttttttccggagattcccttcacgaattcctgagatccaagtgtaatctatatgcaaggatgtgcgaaatatcatcattaattgatttaattccaccagtgaatgaacttgaataatactcctttattttctttatatatgatgctagttagttttaacactaagcaatgtcatatataaaaagaaagataggaacatgtaataacggcagcaatcataatattcacgaagaatattaatgggcagcaatcataatattcagttttacctgtgctagctagctaactactggcactacgtgttgtttaaggtcaatatatatgacatgcatctacacgtatactccctccaattttataattcttaatattttgaacaaagttgagtcaaacttttataactttaattatcaatgacattaaaaatatttagtttaatttgaagtcgcttgaacaacatatatagaaactagtcctaaaaattactataaacaaaagtaaataatttatttattatatatattataacagaaaattatagttaaaaatattttttggagaccatatcgttgtttaaaacgtcaagaattatataactaggagagtagctagctacggggtttacatttttttctcaacaatgtaaattaactgctaccttcgtccctgaaagactatttttaagtataaatccaaattcacgattgaaaacagagccttttgtgaaactaaaaacacaatattttatatgtaccgtagttggatttccaccaccaccaccccaaggacctgcaagatgttcattcccgtccgtgccaacgtatgtaaaggcaatagcatcaatggctgctccactacggatcgtcacgttcttcaggctatttgggggtacagatatgtctacagaacctcctccatttccaccccatggaccaatcttaacaagctttgtgctctgcaaacaaacacatcacatatcaaacataaaattaattgaattatatcatatatataatactacagcgaacatttttgcaggcaaatcataacggatgcaattaaaacatgggcatgcgtttcggaaaaaaaaagtgtattgaagcaaacgagatgaggactacttaataattaactaaccattttaatttgtagccttaatttctgccctatatatctgtgattacttgtagggagctatagttctttgcgtggataggccagccagggaatgccgatcctatttatagtgctggatttgtttaacaaagcaaaatttgtttatcaacttggtttgtaaattctactataagcaacgttttcttttataagcaacttgctttgtttgcttcatgatgggtgaggaaatgttcatcctaagaaaatgttgctttataagattaaattctttcttagaagcaaaatttgctcacccgttattagaagcaaacatttgtctcgcccacgacttttttagtgttgtgatacaatataatgtgaccttacttgtcgtcctctgtggctagcttaatttgttcataaaagctgcaacacgtccatatattatacaaagattctgctacattttggactaatgtctgctcttgaatatgtttgatgagattattcacaagagcgtgtcacactctatcaagttgtcttttttatataggtatgaaattgtcatttgtgaaatatcccattggtcctcccaccaacaattgtaaaattgaaaaaaaaaactaaatgtactctcatccactatgcgtacctaaacaatagaaaaacaaaattagagttcatgtaaaatgccaaagttttcctgataattaacaagtttccaaccctcatttattttcgaataaatttaactttgggtcaccttttattgccggtgtttcattttggaccactattcaactaatgtttcactttggactagataattttaccttatgatactttggaccaacctcaacttttttatccatctacatccaatttatcataagtcaaaaaaaaggtctacttatagctgagtaagtttactgacgaataggagccatcatactcgaggttgttcatatgcttgatgagtgagttgggggtggtccaaagtgaaacaaaggcaaaattaccagcccaaagtaaaaaaaaaaataagaggtgaactaaagtgaaacattaataataaaagatggtcaaaaatgaaatttactcatagtttttccttggataaaagcatctccaaccgaatgatcaaattaaactctccaaatacttatatagccggttctccaactgatttaaagagtcaaactcgttacttactccaatagtctattcatctacactattttaagtctatgacaatgagacccacatgtcagcctcttctttttcctcctcctccttctcttcttcatctttctccagcatccatcgccgagctcctcttgagcaacggcgatggcggaaccgtgcgcacgcgaggcgacgatgagaggggagaagccggcagcggcaatccgtgcacacacgagtcgacgacgatggtgtgtggcatcttggcccaattaggatatggtttgtgtggcccatgagagttttgtgcatacctccttgttagtttagcaagagtggaaccaacttataagggtttatcctttcaaccatgtcactcccgaattaactcttttacacaaagcgaggacgaaagtgtaagtggagtgatatgtgtaagtggagagctatttaaccattctcttcgagatctctaaggacgacttgctagtagcagctaagataggagtactagcaaataaaacgacaaaaaaagggcttaggccaatagcccagcccatggctcgtggcgtgtccgataaacgagaccatgaagaacgtcgcgggcaccgtcacggctgccggccactggcgccatgccgccatccagcatccatatctttcctctctagaaataaagccatagagttattctagtgtaccgtgttgtgattgggcaggcgcgattaagcttcatggaccaacacggtttggattgggaagcgaaccatccaattttgattggttcttctagcccactcactgtaatgggatgggtatttggccttggaataagttcactttgggtccctctatttgtcgctcagtccgattttcgtcccttggtcgcaaaaccggttacgacgggtcccccaactttcgaaaccgtttaaatgaggtccctcggcagtattgcatctagtttttgctaaggtggcacctacgtggcttcttttgactagttctttgttcaacgtgtcaatgacgtggcaattagatccgcaaaaaataatagtacacgtgggacccacatgttagtcgcacacaactaataaaaaatggtgggcccatgaggacccacacgtcatcctctctatccctcttctatcgctctcttgccggcggaacgggatgggtggcggccggagcgggcgatggcggggcggagcggcggcggaggcagagcggggcggagccgaggggcgaagcggggtggagcgggggcgagcggatgtcgtcgagccgtcgccatctcgccgcggcggacgccgtgaacgatgacgtgctcgcgcgggtggtcttcaactcgggggtgtccgacccggggaagggaggaggggggggggctcctggcgccgtggttggaggacgccgaccgcacccaacgacgacgagcgtgcggagaaggattaggcggcggaggctgtggttttcatcaacggggaggacgacgaggcgacgatctgtccgggttcaggggcctggttcttgatctctcttataggtgacctcaacgacctcaacttgatccgacgatatcatccaaagttgcaaactattttgtttatgatagaccaaaatttgcagtgatcgtgttagaaagagatgaaaacaatttgaaggaattttgcatttttacctcgaaatataaccaggcctgtgaacgttgtctgctggaagcgcgcaatttgtttggaattcatggcgaaggttagattctctgcttccaaaatcatttttaacttcaccatcagttattcaaagttcattatttgatccaaaaacatgcaacagcagcgctcagaggggcagagcagacggcggcgatggcgggagcttggcgcttcgacggcgtcggttcttaaccccgtagccaacaacggcgaggagcacgacggcggtttggaagacgtagtgacgacgacgacgccgtcaccagcagtagcctccgccgccgcccacggccgtgctgccccgcgtccccctcgaggaggggaccgacctcgccgctgtcgtcacgcacgagggctccggctactacgtcctcaccgtcctccgccgcgccctccgtcctcgccggaagcaggaaaggtgccgccagggtcgtcatgcgcgccgcccattctctccatcggccgccgctcgtcggtcgtcctccccattggtcgccgcccatcttggcgccccttctccccgccggtcgccgcccatcccggccccttctccccgtcagtcgccgcccgtcgcgcattctcctcgccgacagtcacccatctcttcgctgcctgtcacgccgtccaccccgccggccgctgctcgtctcggtgccctggctgcatctcctcctcctccggcagccaccgccgcacactgccccttctccccgctggccaccgcccgtcggccgtcgcgcccgagaaaggaggggagggagagagacggagagaggggagatggggagtgaggagtaagaagaggggagtgagattgacatatgtgggccccaccttttttaattattgttttgtgtagctgacatgtgggtcccacgggtattttttttccaaatcgaattgccacgtaagcgccacgtcaatgccacgtggatggagacctagtcaaaccagccacgtaggcgccacgtcagccaaaaccgctacccaaaccgccttaggaccttatgtgtccggttttcgtaagttggggggcggttcgtacccggttttgtggttcaaggacgaaaatcggactggacgacaaatagagggacttgagtgaacttattcctttggccttgcaaagaagaaatggccagataagctttgggatagggaataaatctattttggttccctcatcttttgcggtgggtcaaatcgcatccctcaaccacatcctcgtcccaagcgatcgttaacctccttggtgctcatcatcttcccacagaacatatggctgaggtcgtacgaaggggtgtaagtgggtcaaccacgaaccacttatagatcaaaataagcggattcacggcttattttagcctataagtaaattttacgggctagccacgtacaccttagccgtacgtgaggcagcagcctgaggtaggtggcacaaatgatgttcttggagtcccacatctgctgggttagcttgggaaccgtgagggcgcggtactgctgggtccccttagggtgtgtgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcttttgcaaaagcagcatttagcaaacatttgagaatttgataaaacagttaagtaattaaacaatattaagccaacgctatacaacatgccctattgtataggcccaaccattctgaacaaccaccccggctgcacagttctatctccaaaccaggaatgtaccattccaaaccaggagctaatcaaattattaccagttatagcatcttttactatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcaccccctcataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgccatgagcacgaccatcaaaaccatgtgctcacaacccaccattaccaggttttagttggcacattaattaattaactaatcacgatcgaccatcgtgaactatcaataagccatcatgaaataatagtgaatcattagttatcccataagtgtactaatgtttctaagcagggctaagcaattgtatctaatatctagttgaaccaatataaataaagctcaactagtcaaattaatataacccaaggtatcaaggaataaggtaatcaagtacgaaagggccatagcaatcaataggttaattccacccaatgacattcgaaaatagatgcaatagttgaatagaaacaatagctttaaataggatcaacatgctcaaagggttgtttgggatctgtgtgacttgccttgctggccttggaactcttcaaactcttctccggcgaaaacggactctccggaaacgacggaatctaagcaaaaagaagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaaccggattaaaacacttaaatcggtttaaattgaattatgacgcaataatgaattatttttgaaaaggaaaagagggtttattgcgtcagcgggctagggtttggtggaccgggcgcacgggcgacggttcacgcgaacggacggccgagattgatccgatccaaatcggacggccgagatcgaacgagtccacggcggctcacgggagaggggcttgatgacgccagcgatgacgtcaccgacggcggcggcagctcggcaaagaagacggctcgggcggcggactctcgccggcgaacggcggcactaggacgcaaacggaggacaccaacgggtagcggacggcacggcgaactcaccggcgaccaaagcgacggcggaggaccaacggacggcgacagcgacgaggttgaaacggcggcggtcttcggcttgacgacggcgacgatgcttcggcggtctccgacggcagcgaaggggcggacgaggacggcggcgacttggcgatgacgacggcggtcttcccgagtggcggcgacggctggaacgacggcggcgcacggctgaagcggcggcggcgacggcgaagctagggcacacggtgctagggctactccggcgacgagaggcgaaggcgagggtggcggcggaaagagaagaacacggggatccttttaaaggggctcggaggcgacggcggaggcccacggcgacggcaacggcgaaggaaacttgcggcttggagaggaagaaaaccaaaccgaatcgaactcgattcaaagctttccaaagcgattcaaccgacgattccaaaggagaaaaggtagaggagatcccggagattgtttcccctcaaccaattcgaccggagaaggaaagagacggccggatttggaagggaaacggcggcggcggcgctagggtttgcgggcgacggcagccgaaggaggacgaaggatctgacaggtgggacccacctgtcagcgtccgaacgcgcgcgcgcgcgggcggctgcggactgggccggactgggccgaaggaaagagagagagaagaggggttttgggccgactttcggcccaaagccaaaagaagactttttaaaaccttttcaatttaaattatttcttaaatgcaattccatttattaaaaatacttccttagctcaaataaatcccagaaaaatctaggaattatagaattaagcaaagtatttaatgaaattttatctggccactttttatattggaatttattaattaaacttagattttcttttcaagacttttaaaataaattctagaaattccatttaaacaacaatttatatattttgaattttcagggtgtgacagtgtgtttagttcacgtcaaaattgaaagtttgattgaaattaaaacgatgtgatggaaaagttaaaagtttgtgtgtgtaggaaagttttgatgtgatgaaaaagtttgaagtttgaagaaaaagtttgaaactaaactcagcctaagctagccgaccatgaagagatggagacgcgggaacggaattgaatcaaggtgtctgcaaagcttccggaggccagagttaagctgttccggccgggaagagctggcagcaggtgacaccactcatggttgcagaaataagatggttcagatcaccaactgcagaaggaaagaaacaaagtagagtcagaatcatgcatatagaaacacatacatgaaacgaggtagaacagcatgattcatgaagaacaccgtatccatatcaacacgtactgtagaccatacatgtattttacagacaaacgtatagatagatcatttattcagcagtatcgtcagtgtagctgaatgcaagtgccagacatactcattatgaccatgcactcaatagcgttctcaagtctcaacaagctgatggacagatagtgtgctgctccaccatagtgtatcagaaacctctggtgaggggaaaacttctcagagaatgtcagcatcatcctgtctgggtactcctccctgatctttgagatgagcagggtacccatgctaaaaccagttgctccttccagagagtggcaaatgaatcgcacacattaatttctacccaattttcagttgattatgaacacaaactgcaacacatcagtgtgaatcataagcacttcgctcgaggcaccaccagtgaactactgatgcgacgatgtgacagaaatcacataacaaacttattcttcatggtgatgtcaaaacctccaacgtacttcttgacgagaactatgccgcaattttggtgccaactgacgaggcccaatttgtcaccttggtgcaaggaacctgcgggtacctagatcttgagtacatgcagacctgccaactgacagataagagtgatgcatatagctttggtgtgcgccatcctcgcttcgccactgccggagtgagccgtcggtaagctgtggcgagacggcgagctgggacggctacagcggggcaacacctagggtgaggtaacaggttgtggtgaaggtggagtctggtgaggcgctgggaggtccatgatggccagcgaggagcggcgtggtgcatcaaggcggcggtcgacgaggagcagtgggcacatgaaggtggccatcggcgaggcggcacggctagatccggcgtttcctcgcttggatggcgcctcctggcctcgtttcgccatctggtcggagtggaaccgtcatcgaggaggcagggtggagctcgccggcgcatacggagcggaggtggctagccaggtagttggggagcggccggcgaggaggctggttggagctcggcggtgcagatggagggttagctgcagcgacaagactccgtggtaacgagaaaattgcatatctaccatcgcataagtttggattcgctgaaataccatcccttgatcaggcttcgctagaataccatcctcaacca

SEQ ID NO: 71148 - DNA, 14340 bp, Oryza sativa
aatgggagatgtcttggcagtgaagacagcggccaagtcatcaggaagtttcatcaggattgagggataggacccatcgtcttgatctggtcgcggaagagtagattggatctcgcccgagtggtttgaagccgactcgggagagatgatcttggagtaggcctcggccgagttcggaataccgaagggcacggggacctggtctctccccgactggtttgaatccgagtcaaggagagagatcttgccgaagtcgttggtgatgaagttgaggctgccgaactgaaacgcctgcccgggggggaaggcgaagtcgtcgatgccagaaatgaaacccatcgcacttagtcggcgagaacttgacggacccctacctggcgcgccaactgtcgaaacaagatttcggcaataataaaagggggtggctatcaagctaggaaagtggatgggtttagagataaggaattttatacaggttcaggccttcttattcaagaagtaataccctactcctgtccggggataattccgccaagtgtgttattgattgtatgattgggagaaaaaagaatcgtcccaagaggaacccggacctctccttatataggggaagggatccgtattacaaagtacagtccatatcctaacggaatatgggattacagataaaatacaatcgtaaccgactaggatcccgggtattttcttgacatacaagtttagaatctaacccgagtcctcataaagatattctatctatatttggtaccgtatatccagctggaatataaccgctatgtagatatggggtaaccataatctccacagatatacaattctttttcttaaaaaaaagaacaacgttaattaattaatccattttgctttctgatttcagctttgactagttgatagagggaaatcgtccacccaagagaacggtagcaaaatctggtttactgccgcttactccatatttgtacgatagcagcttcctgtgtttccatcttgtcatcttattcagaattagatattccactcctgtgctttccatcattttaactttgcataaaaatgtaaccattcattaccgaagactggccctctcgatcatattcatcgatcgagcgaagcaatgcaccagccggtaagaggcagaagatgaaatggcatgctgataacccactcataaatcacaccaacacaaaagaagatacatcattatttaagaagcactcgtattgatgagtctcaatctaaagttaatgaaaatttgcataaccttatgcttcaaattaattcaatccccttttcgattgttatactttttttttgttgtgttgtaagaatgggtcaaactattatttctgcataagtatagcatatgcgtacgacggaaccatcgtcacccacctttacaacagaacaagtttacaaagtttagagggaaactcttttaatccctcgatagtatgttttgtagttctaatctaccagttccaaaacctgacccctataacctcgtcccatccccctgacgttgaaacttggtggaatggaaccaaccatgtgggaagcaaagctcaaatacggattatcagaggctcgctacttactacttggtggaacatcttgcaagaaagaaacagaagattttttcaaaatttttacttctcagtaaatgaagtagcacatcttatcaagcaagatttggatttgcgcaaactagcttttaagccccccctgatttactttgcttcttaagctgtatttcatctctattacagtccctgtaaactctttgctaggcttcggccttttccctaatttaaattccagcagaacttatgccgtcgttcttctaaaaaaaagtatgttttgccgttcttagttaaaatttaatttgttgtttttttagaacttatgcagaccgaatatgaacttgcatattggtgaactcatatatcagatattaaaggagtgtttggcatagctctagatccaagatttcttagagctgggtatttcaacctctatccatggacctggaactataattaaattgataacatttgaattaatcattttattttcattttaggtgaaatatagaattttgaaccactataaataaacatacaaacttcaaatccaatgtggatatgagaactgtaattgtgccaaacaagacctaatatgaattgaacatttcctcaattctttattatcatcaaatctgatcaaagaattttacatggctttcaagtatgaatacaaaatttttaaaaaatgaagtattacaaacatgcacttgacacatacataccaaagggcttagcgcctcttgttcttgctgccaaagtgcagcacgatatagaacagaaaccggaaaaagaaaccaaacgccacggtgaccagcaagcacttccacctgccgatgtccgtgacagcctgctgcgccagcacgtcggcgccggtcaccacgcacgtctccgccgtcaatggcgcgccgagcgtggcgccgatggcgtcgagcaccttgagcttgacggccttggacatggcgccgatcggcgtcccgtcgaacatctcgacgccgcgggagaagcaccgcgccgcgtcgcggaactcgttctggagcaccgcctggtacggatacttgaccagcgacaggtagtggaaccagatccagtagctggggatgcggtcgcggttgatgaagaagccggagaagagcaggaagtaggcgaggatggcgacgaccaccgtgtatcccagcatgacgtgcggcaccaccgcggacaggaacgtcacgaacccgctccccgcccagaacgacgccagcacggtcagcgcgaagaaggcgaacgacgcgccaccgccggagagcctgacggcgaagaaggtggtcaccgcgaacgccagcgacagcaccaccagcggcgggaacgcgacggcggtgttggccaccacgtaggagagtctccggtacgcgttgtgcgccgtttcccggaggtagatgtggcgctcctggacgaacaccggcagcgcgtcggcgcagacgtagaacatggtggacatggccatggcgaagaagccgagacgctcctggactcccttgggcgtgtcgtcgaggcgccagaagatggtggcgaggatgaaccccgtcaccatgatcgtgccgagccgcatcacgaacagctccggcatgcgcctcgtgttggtgaacgccctcttcatcagcacccacacctccacgtaccacgggttcgcgtacgtcggcaccgacgtcgatgacaatgtccccgagccgctgccggcgacgagcttccccctcgacacgctctccgcgatggcgagctcgagcggcatggtgcatcgctgactgcggtccttgtcgtccttggtgtccaggagagcgccgagcgatgattgccatcttgagctgaacttgacgagcatggcggcgccgtcgggctggtgctcgagctcgcggatggtgtcgagtgcgaactcgacgaggttctcgttgtccgggatggggtagccgaacacggagaagaagggcttgagccccgacggcgagccggcgtagacggtgcggccgcgggagaggaggaggaggcggtcgaggatgttgaggatgcgcgcgctgggctggtggatggtcatgacgatgacgctgccgctctgcgcgatgcggcggagcacctgcaccaccatgaacgcgctcgccgagtccagcccggaggtgggctcgtcgaggaacagcaggatggggtcgtggacgatgtccgtgccgatggagacgcggcggcgctcgccgccggacacgccgcggtgggcctcgtcgccgacgatggtgtccgcggcgcgggcgaggccgagctggccgatgagcgcgtcgacgcgggcgcgcttcttgtccggcgagagcgcgcgcgggaggcggaactcggcggcgaacatgagcgtctcccgcaccgtgagcatcgggtacagcacgtcgtcctgcatgacgtacgcggagatcgcccggacgcggcggccgtggagcgcctcgccgttgagctccaccctgccgcggaggctcccccgcgcgatgcgcccggcgagcgcatcgagcagcgtcgactttccggacccgctggcgcccatgacggccaggacctcgccgtcgcgcgcctcgccggagatgccgtcgagcagcgccttggccggcggcgcgtccgtcggcaacggcggcagcaggccggcgcggcggctgccgacggtgtaggagaggtcggtgaacgtgagggcgtacggcaccggcgtggattgggcggcggcgtcgtcgatgtcgagcacgacgcagtcgccggggaggatcgccatgtgtgtgttgtgtagagtggcacaaaactcgggcttgtcttgttgacttggatgatggatggatgggagagcgcgcggagtgatggcgatttaaatgggatcgattagtccgaggtggagtccgactcggtcggacgagtccggctcggtcggggctctatagaccgagaccgattcggcacgtcagtagtacaagagagctatattacggcgaaaatgatatacgtgccggtacaaccttgttgtccagctattgtgtcctccatactattctaagtgcaaccataaattttcgtgtttaaatttgatcgtccatgttgtttaattttttttaattagtattttattgttatgggatgataaaacataaataatattttaggtatgattttttttaaaaaataaataaaacgaatgaacaaaatttagtacggaaaagcatgattgtacattaaatgggacgaagagagtatgaccatagccacaatgaaaggctcagacggcaaatgtctcattctgtaatagaatctgacacgcgcaggtgatgccgtaatgaagtcggccatcagtcgaacactggcgtcgtatatatacatccatatatgaccactggcgttcatattactgtggagtagtgctatacatccaactctcatacaactgcgctgaaccaatcaatcacggagttcataagcattcacttggacctgtcaaaacgatttaaaacttgagcttatgtacagtgatatgcaggtcgaacaggtgcagtcgtacgcacacttagggcctatttggttgatgccctcaccaacatgcctgaaaaatttgggtgcctgagagctacctgataggatgataaattttgcctgctcaggcagcctgaacacttgtctcacttgtctgtttggttgttcttccgcgcctgtgaaaactaaacgtgattaagcttttaattattacggttgttataaagtgttagcaaaaaaataaaatatttggatgtgttgtatccctccttgaaagcacaaataaaatatatttgtatggtcggttgcttctacaatttacagtacctatactacattattataagcggtaattaggattaatgagcgtagctgcgccgccctggagctcgcctgactcaggctaataaggctccaaaagagctcaggccagggaaggagaaactaaggtcaggacaccaaccaaacaaggtcccggctggtctcaggcttacgtctggtgtccaaccaaacatgcccttattccgattactgcgtgctttactgcttttaggctctgcttgttaagtgctactccaaatgcccgctgcaaagcgtgttagtgatggtctctttatggggtaactggggtaatcttgacagctgcaaagcgtgttagcgttagtaactggggtaatccttccttatgctctctttatgggcattaattccaagcatgtttctgaccaacagaaacacgagacaagagtacaagacaaatgtagctgtttacagtagctactagctgcacacatttgttgccacgagctgacatgagatgagattcagagtacgaagacgagaagtcgagaacacctgagccaccacaaacttccaaagcagcttctgaggtctacaacaacatttagcacttcaaagataaaaggtaactgccatcgacgtcgttcagcgcgcaaagcaacaaaattttcaatctgaagatacaaatctatctgcaaaaacaatgtgatttggaagttcaacggaccatccatcgtacaccaatagcaaaatacgctgtcgttttgagaaaagaaccaaatacacttatctcgtcttaaaacaggactgtgactattacaaccatagcatgacattcacaaagtaacaaaatacgctgtcgtttttgagaaaagagcaaatacactcatctcgtcttaaaccgggaatgtaaccattacaaccatagcatgacgaacgccatagactgcgattaaatttcaggcttcaggagactcgctcggtctaggtgagcgtgagccaccacggctaccaccgtcaccatttccatccctaggacttcggctaccgttgtccattgggctagggcttccattgttccttgggcttgggctgcgcccgttggcagctgcagggctacggtagccatcagacgggctcctgctgttctccctgccccgggggctgtcaccgtgatctgagccattacgctcagcattatccttgggtggtgggctcacctggtcctgtggactccttggactacggctaccatcaggggtggggctgcgcttcttttcatttgctgctggggagatggatcgcctgggactcctgctgtaactaagactccttgatctttcaagctctctgcgtgccctgggagatccagacagggatctggacctagaccggctgatataaagaatgtaaaagaagcagggtgaggtcaacataacatatctgtgatttggacagacagcatggtgtattataatttgaacatgtggcgtttgaagcatacctgtaactgcggctccggctccggctccggctatagctccgactgcgaccacgtccacggcgtggcgatggagagcatgaataacttctctcacgcctgaaaaaaaaagaagtatgcattggagaaatctaagttaaattattcaaatacagtacctcggaacaattgcaagtgctgctctttatcagatcaacttatcaatcaatacctgagatttcttgggctgttttgacagtttctttctatgtgacctctctccccacagcggtaacatttgttcttccagtcaccagccttgcagtctcttgcccagtgaccatcaatcccacagttaaaacaccgacctgttccaggaggaggtcctctccccatatattcacgtgaaccaccaggaccacgtggaacctgcatgctcaatttgttgaaaagagcatcagtcaacaaaaaatacagatcaattcagcagcagcttcatattaaagaaaaaaaatagaatcaggatgtgcttagagaagcaaccgaagaacagcatacccctttagcaaactcaacaagaatgcggcttccatcaacatccctgccatcaaggttgtaccttgcttcctcagcatcacggggatcactgaactcctgtttggtaaaagagacatccgaaaaatgttggacttgtgaactaaaaggtacaatttagaaaagagagaaaaaaatgagggaagaataattcacatacaataaatgcgtagtcgcgcttcaactccacttcacgtattctgcaccaatggttgccaaacagtaagccatcatgattcaagtactcaaatgcatcaccgacttgcaacgtccactaaaacagtcaataacattacaccaagggcgcccttcaacaaagtcctcgacaaactttggaagaatggccaccaattccaccaagggcaccccttccaccagaccatcacagacctcccggtttgtgtaaaaaaccgaaaaaccttcaacaagatcattcaagtcaaacacacaagacccggggggtacttctacagcatactttaagaattaatagaaaatgccacaccaaaaggcttcaaggaactcgtccacaaagtagctgaaaaaagagtggtaccactgaacccaacaactgctatgagctggcccattggaaagggtaggaaggatccagtgcttactagtctatgctcagcacagaagactcgcacacaatttggaaaggttacaattttaatgggaaataattaaatttctacagtgaaatttgaacgtaccaagttgttgtaatatcaactgtttagcaagtgttatcatagtaatagtgttttacatttatacacagaaaatgcagcttattacaaatttaacagaaaaaaaatccataaacttctgcaaaaaatctgcgcttcagagaaataaaatcttaaggaccatggttctgtccgtaccttccatatctgctgaaatggtattctaggtcacgagaacgagtgcgggaagacagtctaccaacatacaagcgcgtgcttccataacgatcatcatagcgcggcatctcctgaagacaacagcaaaaatacatcagtactattcaaaatctaatgaatgattggaaggaggatgaatactggtacaaatgaagatctacagttagtggatgcttttttatgcaggaaaaactaacggaatagaagtttttgataattacaacatccatttcactacagaatagactcatatttagggggcctagcaagtaatcacattagaggatgagctatggcatgattagataggccttgccgcccagagcagcatacacaagatcaacaggcatagatgcagccattaaagttcacaaagaatcagttaaggcaagtctagccatagcatcccctataagaacctgtaatcttaggactaacatgaaataaatctacttgacgtgcctgcaaacaattcaatgtaactacaaagaatcacaatatgagcaattgtagcatcttaggttgcatgaactaattaacacatagcagagactaaaaactggggcgcttgcactatatgatagaatcatcaatgtccacttacaaagaaagcagcgcgtcaccaacagtctatgctatcattaatactcacataaacctatacataagaggggtttaagcacaagggtgggggtttaaacatatgggtttaagaggcttcacagctttaccctttttacttgagctttctgatttcaggtcaaaaattatctagagcttgttacttgttgccctcggcgaaaagtaaatccaatcagatgcaacatgaccaaatcctctctgcgagcggcacacaggcgacgcgaagctctacaaacccgcgccggcgatcgatggggcagccatggtcgatggcctccaaatctgacatgttcgattccgatttcgctcctatcccttccttccccacactaggttgctataatcgatgaaacaaacgaacctacggcgagcgcgcgcgcgcgcgcgtgcaggaacggaatcgaacaacagcgagagaaaaattgagaaaaaaaaatccggagctcggggaggaggatctcgaaccttggaggagaatggcggcgaaatcctaggtcgggggcggcgcggatgcggcggctgtcagaagggcggagctcgggatgtgggaggaggagggctatttattcggcgtcgcagatctggatggacgggtcagattgtctacgggatgaatggacggacaggattggtttgagttgtcgtgtttcctctcggcggcgcggggcacgtgcacgttcacgccttctatgcttcacaccaacgttcaccgagtcactgaatggtgggccgagcaggcccagagcccagcccaattgtgatgagaatggcccatgtatagttcattattttaggctttgaactttataaatactactcaaattttcatcaagaaatattcatattgatggtgctatattttccatcagaaaatattcaagtttttagacatctgtttatactataaactccatatcatagactacaaattttttatatacttacgatgcaaattccaaattgtacgctacaaatttaaaatctcacactataatttccgtaattctccgtatatagaacagttgtaagaaaagcaattgattgcgcacttgatccataccttacattcttgattacacattgctgactttatcgtgatgagtaaattaaatttgcacagtcgattgtttagcctgacacgagtcttcaagtctgaacccaaatcgagccaaccaaacacgctcctatataaaggccgcgaccaacacgcaccgcaccgcaaactaacaccgcggtgtgatccattctgcaagtgatccgttctgcatggcgacctccgcccacacggtgctcgacgtcgactccggcggcggcgcggcgaccgcggcggccggcccgccggtgccgtacctgctgtccttcaccgacctctcgtacagcgtcaggaagggcggcggcggggtcctgtcgtgcctgccgtcgagccgccgccgccgccacagcaaccgcctggcgtccgcggacgcgccggcgccgcccgacgcgcccaccaaggcgctgctcgacggcatctccggcgaggcgcgggacggcgagctgttcgccgtcatgggggccagcgggtccggcaagtccacgctggtcgacgcgctcgccggccgcatcgcgcgggagagcctccgcggcgccgtcgagcttaacggcgagccgcttcatggggcgccgcttcgcgccatcttcgcgtacgtaatgcaggacgacctggttgtcccgatgctcaccgtgcgggagacgctgctgttcgccgccgagttccgcctcccgcgcgcgctctcgccggacaagaagcgcgcccgcgtcgacgcgctcatcgaccagctcggcctcgcgcgcgccgcggacaccatcatcggcgacgaggcccaccgcggcgtgtccggcggggagcgccgccgcgtgtccatcggcacggacatcgtccacgaccccatcctgctgttcctcgacgagcccacctccgggctggactcggcgagcgcgttcatggtggtgcaggtgctccgccgcatcgcgcagagcggcagcgtcgtcatcatgaccatccaccagcccagcgcgcgcatcctcaacatcctcgaccgcctcctcctcctctcccgcggccgcaccgtctacgccggcacgccggtggggctcaagcccttcttctccgagttcggcgaccccatcccggacaacgagaacccggccgagttcgcgctcgacaccatccgcgagctcgagcaccagcccgacggcgccgccccgctcgccgacttcaacgtcaagtggcagtccatgcacgccgcactcccggcagctgacagcaaggacagcaagcgatgcaccatgccactcgagctcgccatcacggagagcgtgtcgagggggaagctcgtcgccggcagcggctcggggacggcgtcgtcgacctcggtgccgacgttcgcgaacccgctgtccgtcgaggtgtgggtgctgatgaagcgatccttcacgaacacggggcgcatgccggagctgttcgtgatgcggctcggcacgatcatggtgacggggttcatcctcgccaccatcttctggcgcctcgacgacacgcccaagggagtccaggagcgtctcggcttcttcgccatggcgatgtccaccatgttctacgtctgcgccgacgcgctgccggtgttcgtccaggagcgccacatctacctccgagagacagcgcacaacgcgtaccggagactctcctacgtgttcgccaacgccgtcgtcgcgttcccgccgctggtgttcctgtcgctggcgttcgcggtgaccaccttcttcgccgtcggcctcgccggcggcggcggttcgttcctgttcttcgtgctgatcatcctggcgtcgttctgggcggggagcgggttcgtgacgttcctgtccgcggtggtgccgcacgtcatgctgggatacacggtggtcgtcgccatcctcgcctacttcctgctcttctccggcttcttcatcaaccgcgaccgcatcccgagctactggatctggttccactacctgtcgctcgtcaagtacccgtaccaggcggtgctccagaacgagttccgcgacgcgacgcggtgcttctcccgcggcgtcgagatgttcgacgggacgccgatcggcgccatgtccagggccgtcaagctcaaggtgctcgatgccatcagcaagacgctcggcaccaacatgacggcgaacacctgcgtcaccaccggcgccgacgtgctggcgcagcaggccgtcactgacattggcaagtggaagtgcctgctggtcaccgtggcgtgggggttcttcttccgggctctcttctacgtcgtcttgctcgtcggcagcaagaacaagaggaggtagagagagaggggccgatcatgttcagctgatatgatgtctgaattaatgacagcaagaaatgtgtgatatgctagtagtgtatttgtttgtgtaattttctcattttgttgaagatgcagttcatgtatgtgaatgtgttcagttttactggctgttatacactaaaacatacagaattacatgttgatatactgtttctcaatgacccttctgttctgaggctctctctgattttatttttatgccttctactattattattttttcaagggaacggcaaggagctcctgcatttcactatagaagaagagagttgatcaatgataaacagatgttaaaaaatgagtagctctttttgaacaaatgtgcaaaactatatgttctgtaacagtatatgttcaatagtaagaaactatatttcacagctacgataaagaaatgtgcagttgtatatgttgtgtacaactgagagttacactgttattagttaatagttattatcaacaataaatatgtcacacagttaagaagatgggcagcattgaaaatatcaaaagtaaaaaaaaaaaggcatggtatactgaattttgtaccatttgacgtatgctacctaactctgttttaataatcatatatttccttcctctatctgtttttagctggtgccttgctcctggctaaatgataatgacaaggatgcaacaagttgttgcacatttgggtttcctcaaggaaactgaaattaaaagatgttcggttgcattgatccttttgttgaattggtgctgccaaaaaggcatggttttctatcatcattcggatggttagttctgccaaacagtttaaatttgtagtattgaaaaggttgcaccacacatgatttacttgctcaatcttcaggttcaggtcagcagatgggtcagagggagacgtctgtcctactagcttatttggtcagtatgaaatggcggcttaaagtttcagacacttcagctcaaattcttctgatatggtacatgtgtacaaccagctgttacactgtcttcagagacttgtatttccaaacttcctttttcttctgaagcaggttggtgcaaacttaacttctcaactttgccaaatactagggctcttgtgctagtagaaacatctgtcttgtcaagttgaacatgcattactaattcaagaaacttaccatggagttccatgttgctgaaatcatgcaatggattatggatgtacatgtttcagacaccttttctgacagtaagaaaaacccaaaaatgtttcataagattgttaacccagaagtaatagttaagtactattggcagattcgactgtatacatcgatccactttggatgtagaggctgagttttaatctttttttaaaaaaaatgttatagtataaggcagctgaaatgcaaccgtagttttcttgtacacgacatgtatgtacatatatctgtggtcaaatacctgtcgtgacggcgacacatgagactagtggtttggcctgtagctgcaagtcaagagcgaggcaggcaaggcaacctgaattttgagaaacacagatgtcacaaatttgccggtttgttcatcacaaggaaaatgtggcttcagaaaggagaattcgacaagatgccaatgccaaatggatccagagaaagatgatggatagatatccattcgtccatcatgctaagtaggattagtatctatcagctaaatctcatctccttacgtttctcaatgaggatgcaacgccattggctgatccatgttttgttcaggtgtttgggctacctctgatggctcctgcagccacaccttttgccttgctttcaaaagggtctcggagaagaaaccaactaaagctattttgttttaaagaatctagggga

SEQ ID NO: 71149 - DNA, 3637 bp, Oryza sativa
aactgatatggggaaggagctatttgtgagggattcggacgcgaaaattggtcgctagatttgggagggagcgatctgagtggggatcggatagaaaatttggagcgttctggggatggagtcggacaaaaaaaaatcgctacggatgtgatctgaaagaaaaaaaaggcgtgcgctattacggatgcgatatgagaaaggaaaaaaccatgtgctaggtagaactaattaattatgaacgattacttagtccaactaattaaaaaaaaggcgatgggaaaaaactggacccacaaaaaaatccacaaaataaaacctcgtgcacgaaccggtgacggaaagaaactcggacccaaaaaaatgcgaagaaaacactggacaaaaaaaccgcatgcgtgaaccggtgatggaaaaaaccggacctactcgaaaatagccgcgtcaagaaaacgcgctattggccagtcggacaaaaaaaaccaagcgctattccaattgtgggcgatatccaaaatttgtggggagtaaaaaaaaccagtcgctaaaaaaacccggcgttaggtgacgtacgaaattttttaggcaaaaacatcttcaacttttataataggtaaagataaagattatgtatagtgattccaatgtttcactttatcgcttggactctaatagctattatatcactgaaaaaacatctttatctgttgcaacgtacatgcatctatatatctatctatcttctattatatactaaaagtccattaaactttttacaaatgctcctaagctgccatgtggcatcctataaacactctcgagtcgccacatatcactctaataaaatagaaaaatctgaccatcgattttcatttaaattggtggacccattaattttgattgttagatttatctttccaataaaataaaatcttcctccatccacgtaacgtacgactatccatctgtagagcaacgtgcgtacatccatccgtttcctttttttccttttttatctcgataataataataataattagaattaaaaaatatgggcctgaaaagcccatcaacctactagctagcatctcctaataagtttattaaacatcatataaatatttctaaacatctatatcgcattcctaaattagagaaaatctagaaatactaaaacatttgaccatcgatttacattattttagattattagatatatctttttcttatggaaaaacatctcaaacttccttgcgctcccatgcggcgttaaaacccattcaccacccttataaatatttctaaaccactatataacacttctaaattagataaaatcataaaccattagtttcaacttaaattgatagacataccatttaggttgttattagatttttgcttaaaaaaaactagcaaacctcctttcctccctcccgcccctataatgttaaagacttaaattacattaaacattctataaatatttctaagccactatggatctctttaagtttaaagaatcatacagaattatgaaaaaaaaacatctgaccgtcgatttcgacttgaacatctaatacattattttaggtcattatatcaatcatttttttaagaaaaaacatcctgcctctctgtcctcatgtggtgtgtgtcgttcatccttttctcttatttttatccttatgataattgaaattaaaattatttttatgaggagaaaaccacaaatggacctccacatatcaggtctagccagctcttctacagttccttttcttctctttctcttcttactagcacttatagaaacaatataaataaaataattataatattttaaatcatatattcagcttatgatctgtttgagctatttttttagtgaaaacaatactttaatatccatattgactatatttaaatgctaacataaaatttacattccggacccacatcaatcttgaggcctccactaaataaaaaaacctaaattcgtcattataaatcaaaatatcccatttttatatacaacattttaaaaattaaaacgtgctcggttgaacatcaaactgatcgtaccaaacatgtaagattgcaccgagaaatcttagcagtgaaacaaccatgaggtctctttttggtaaaacttgctatgctacattgtaaattcctaaaatttagcatataataatctagaaatgtatatttattatataacctctatttttcatatttcttactcacaattgagagataatttagaatagatgactttaccccatgttaggttataggttcaacccgcatatatttttagcccaaattgtagagatcaaatcatttcaaagatgcttgatagagtggatttctccaaaaaaaaatttaaaaaaatggatgtgaaaagagttcaaaatttttgtaaatgtttttaaaaaattgttgggattaaaacccattctatatagaaatattcaaatattttagcacgataaacagaatgaaaatatctaaaattttgaatagaatcttaaaaaaatggactttttatcaaatgtttgggggtgagaaatccccgtggggattcaaaatacccaaaattttctcatagaaactacatctattgttttgacataatattatttcataaattgaaaactgtacggtttcgagtagttttagtttagaatttatgtgctacatgggtaattagaagaaaattataaccaacattcaaagcgcaataaataagttaaattataatttagatatagtaaaataatattttaatacaaaatcacctatatatggacattcgtaataaaatttgacacatattaaattaggtgcacgcgcatgtgcgcgggctacatttctagtttttttatagtacaaacttacaacgaccacggaccatcgagatatctttagaaaaatccatagtatccggtctctctgattaagttgaattagaaatttctgaactttgcatccacatggtgttgtagttcttttcttttcgaagtttttgacattgtcaattaatttgacaatcaactacttctgaattaactaagagagaaaatggacgtatttttcatttactaaggaaggaggacgatcgcatttaaggtggtagagatattttcctcttcgtgagctgtgagcaccaacttacaaggctatgttgtttcttctattttgatacaaacttgcaacgaccacggaccatcgagaaaaagcacaagctttagtcgaataattcagtggagccatcgttgtgtccatagcatatatatccggccactctgattatgttgaactagatatttctgaacttcgcatctacatggtgttttagttcttttcttttcgccactctgattatgttgaactagatatttctgaactttgcatgtacatggcgttttagttcttttcttttcgaagtttttgacattgtcaattaagttgacaatcaactacttctgaattaacaaagagagaaattggacctttttttttcattaattaacgagctttctgaactttgcatctacatggcgttttagttcttttcttttcgaagtttttgacattgtcaattaagttgacaatcaactacttctgaattaac

SEQ ID NO: 71150 - DNA, 4495 bp, Oryza sativa
aaaaagaataacatggcgtagctaatcgcagtcatggagtcactttctcatctgcatgaaaaccatcgtaagccgtaggaacatgggcttctttggttaggtttaggtttattggcttaaacttttaagtcaacttattggcttatatgatttataagttgatggatttactgtcctaagtttaatgatggagtcatatatctatcgtacataagtaaaaaccttctccatctaacttttagcttaataatgtttggtttatggcttaaaaaaaccaaacgaaaaaactaggttagacttttcgacttataagctaacttataaatcttgaccaagagggcctatattcaacacatattagtatatgatatatacgggttctggttagcgaataagccaatgtatcagtgtcaaggaggttggttaatcactctatccatctgcctgttaaatttctaacaccaatgagttcatatctctttattttataaaactaaaatggtataaagctatagcttctggcttattcttaattttcagtatgtaatcaatattcaatcgatttttttaaaaaaaaggtccagctacttcatatatatgtatgtaaattaattactgtgtacagtactaggtacattctctagctacatgcatgcaaatgtgggccatacacaataatataatcgcacatgtcaccactgatcagtgttagttacgctatggtgtttatactaccctggcatacagtactttatatgcccatctgtccccataattatttctacctcattatctttgctttgaaaccatgcttaattaattcttgatcatatccggcccaattaattaattaattaattaagtaatttatgccttgcataatgcatcacatgacattatggtagtggtacgtgtatatagagctggcgtcatcatgcaattaaataattaattaagcaggtactagtacatacagttatatactactgatggtgaatgctattactcgcgtgtgtgcatagtttacgtacattctgtttcgttgtcaaattaaagaggaattttctttgctaccaagcacacaactcgtacaagtactccacttgtactgtcgattgatcttccttacaagttttgtttggttggcagtcacagcttgcaaagcgtgatgcgtcgcaattgtgtgatcattaaccttaaattatgttcaaaattaagttgatattgctttgcttttgaaacttatttattttataaagccttggtgatactacatttatatttttcctctacacgaaagataactgcacacatatcgttctacacgcacgacttacatgcacccccggacacacgtttaaagatacggatatcaaccatccatgatttcactgaatttctatcaaaagcgcactcgtgtgtacatagtattcgacgacatcaaaatttttatctttgatagattaagtcatgcacccacgactgcactataataccagcggtgctttctctcatttttttcaaatccaccatgatgaaaaccttacatttctaactctattttttatggtatttaccggattgtgagagcgtacataatggctttctttagcttgtgtcaattgtattataatatagatttattctacctccgtcccaagaaaattgcatttctagctctaaggctttgtcccataaaaattgtatttctagccatgtgggtcctaacaaattgattcatctagataagtttccttaagttctctcagcttgtaattaaagtatgctaattatatgggttaattctctcaaacttccttttaatcatttatatatatggaatgtgtgtatgcaatgggttcattaaataaggtcattggggtcatttttcaatcctattgttttgtcctaaattagctagaaatgtaatttttatgggatggagggagtaaattctctactatacacaaaccccagtatttatatagatatggttgatcaaccttacctcacttagccaaatgcctccaaagatcagtccaaatggtttcccaccatcttaattaaagaaaaagaagaagagttgagagtccaaacagtgccactactcactagtactactactgcttgtttctacttaccaccacagttccataataatcaatttaatcatgcatacaatggtttggtgggcaatgctaattgctatggcatcgggatgcaatcaccatcagtaggtgaagggagttgatccatgattagcactcaccagctagcttagctaatcgctcgccgctgccgctgccgctgctggtggtggccgtgacggtggcgctggtggtggtggtagcatcatccatcatctttgtctttggcatgtgcctccttttgcctttggctccctcctctccttccttccttcccttgtttgccttttgcctttgcagcctttttcgcaagggagcccacgcctccctctcgcttcttctcctcctcctccttctttgaagagcgaagagtgaagtgtgaagagttctctcttcttcttcttcctcagccatgtccacaatgctgccctccaaatccaggtgtgttcttggtagttctctctttgtgtgtgtatggattggttgatgttggtttgtttggttgggggatttgttttttgttgccttgtgttcttggcagatctaaaccggtcactgcgttcactcagatttgtttttattttttttccctcgcgctgttcgttccaattgagtactggattgtgctcgctctcggaatctggaaaatgtggcatcttgaacgaattggataggtttcagttggaacggcttcttgatccgctcgattcctcttgttcttgctgaagtttctgttttttatcccatcgatcgcgggatgaaaatgcggcttgctcgaacctcgttgatttggattggagctttccgtgaatcgcaattaatggcggtgacattgacagatctgggccgaacgagtcccccatcagcagggggcggccgagcacgccgtcgtccaaccaccggccatccacgccgtcctccatccaccgcccctccactcccggcgccaccaggaggagcatcggcggcacgccgtccacgccgcgctcccgcaacaacggcgtcggcggcggcggcggcggcccgttcaagtccgagcccaactcgccgccgtcggccaccgcccgcccccgcctctccttcgaccgctcgccgagatccgtcgactccaagcccgtcgtcgagcgccgggttcccaagatcggcactccacctgatgtaagtgcattcatatatgcaagcattgttgtgtgagttgttgatgctaattgtgtgaattttttgttgtgtgagttgttgatgctaattgagtgaaatttttgttgtgtgagttgttgatggtgattgtgtgaaatttttgttgtgtgagttgttgatggtgattgtgtgaaatttggtggaatgcagaagcagccgaggaaggaggcggagctgcaggcgcggctcgagtccgcgcaggaggatctcaagaaggccaaggatcagctggccttcgccgttggcgagagggatcgccttgtcggggagctgaatgaggcgaagagggttgctgatgagacgcatgagaagctccaggatgcgctcatggcgaagaggtgggccgaggaggcaacggagatcgagaagttccgggcggatgagctcgagcaggcgggcatcgatgaggcgcagaagcgggaggaggagtggcagagggagatcgagtgcgtgcgtggccagcacgccgccgatttggagacgttggtcactacgacggaggagctggagagattcaggcgtgagcttgcgatggcgaatgaggccaagaaagctgcacttggccacgcagacgatgccatgaagatcgctgaggtcaatgcggagaaggtggagatcctctccagtgaagttgtccgcttgaaaggactgcttgattcgactgcagagagcgaggagagtaaaaaccgtgaaaccgaggagcttgttaagaatctggagtccgaggtttcagttctgaagggcaaactagaggaagccagaattattgaggagaggttagccgagacggaaaaactgattgaggagcttaaatcagaggttgctgatgcgaagaaggccgaatcagaagcccgtcagctattcgaagaatggaagcacaaggcaggattgcttgaaatggaattggaggcagttactctctcagataagttcaaaggtgaatcgcttgcctccacaacagaagaattgggtaagatccagtctgcattacaagatagagaatctgaaattgaagtgctcaaaggaaagacaactgccttggaaattgaggtagcaaggcttttagcagatgtcaacgaatccaacgagcaatttgatgcatctcagcaagaggtgtttgggctacagacgactatagatgttctgagaaa

SEQ ID NO: 71151 - DNA, 665 bp, Oryza sativa
aggatatacaaatcaaaatggtgggctaattattcctctcatttgcttcaatatatatttgttattttctgaaatgcatgcatggatgcatgttttaattgcattgttaagatttgcctctggacgtgtacactattttatataggatttttaattaatttttatctgtcattatcattgatgtgttcatttgcagagcacacaacttgttaagatcgggacatggggtggaaatggaggaggtcgtgtagacctatctgtactcccaaggagcttgaaaagtgtgacaatccgtagtggtgcagccattgatactaggggcaggagcgcgcaaagcgcgctgcacttgtggagttggaagttttttcatcgtttatatgtataggaatatagatagtgtagtgtatttcaaaaatctttccatcccataggattgaggcaatggagtttacttgtttcaataatttgtgctatttatcatgtaatccctccgtttcacaatgtaaatcattctagtattttccatattcatgttgatgttaatgaatctagatagatatatatgtctagattcattaacatcaatatgaatgtgggaaaaaaaaaaatttgctagaatgacttacattgtgaaacgaaggaagtagtatattgtatggttcgat

SEQ ID NO: 71152 - DNA, 4388 bp, Oryza sativa
  unsure (1)..(4388): unsure at all n locations
ctgagatgacgtgaccaaggaatttcacttcagacaaccaaaattcacacttgctaaacttagcatacagttgatgttctcgtagcttctccaatgcaaggcgaagatgttcctcatgctcttctttgattcgagagtagataggaatatcatctataaagaccaccacgaacttgtctaagtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcttggagaaaacagtggctcctttaagctgatcaaacaaatcatcaatcctgggtaatggatacttattcttaatagtcacatcgtttagtgcacgatagtccacacacattctctgagtatggtctttcttttccacaaaaataaccggagctccccatggtgatgaactcggtctgatgtatcctttctgtagcaattcatctacttgcctcttaacttctgccaactcattggctgccattcgataaggtctcttatggatcggagttgttccaggtaccaaatctattctgaactctatatcccttttaggcggcataccaggtaaatcatctgggaacacatcaggatactcccggactataggaatctcttccaaagttatctggttcagtcttgaccttaaagactcagatgacaatgcatgaacagttacaactcgaccatcatagctgttgagagttacttttctgttggcacagtctatcacacctttatgtctggctaaccagtccatccctaggatgacatcaaggtctttggattctaacaagataagattggccagaaatggtactccttgaatttctattctgacagaggggctacgttgcaaagagagtgcttgattacttggggtactaaccatcaaaggacgtctaagatcttctacttccatcccatgatttcccgcaaaactcatagataagaatgaatgtgtagcaccagaatcgaaaagtactgttgcaggaactgagttaacaaggaacgtacccaaaatcacatctggagcatcttgagcttctgcagcagcaacatgattgacacgggcctttgatgctggtacagcagagttattctgagcaggaacaaccttcacgcgtcggggcttcggacacttgtcagcataatgtcctggatctccacagttgaaacacaccacgggcttgttgccttgctccctcttggcaggctgttgctgtgctggaactgcaacaggacgtggagcttgattacggatgttgttgccagcattgttgttgaagaactgacgttgcggacgaacaacagacgaagaacctccctgtggcatgggctggggtcctaaagtaagacgcggcttctgattatttccctgttgtgtcttgaattgagcaatccgacgtttcttctgctccatgcgattgtacttgtcctcctgacgaatggccttatccactaatttctggaaatcaggataatctccaaccatgagtaggtaagaaagctcatcattaagtcctcccaaaaacttctcctggcgctcttcatcattgcgcacatcttccggagcataacgagcaagacgattgaactcgtgcagatactccgtaacagagcgagatccctgggaaagcgacctgaactccttcttcttgagagacactactcccgatggtatatgcgtcttccggaaagcagcggtgaattcaagccaagtgataggttcagcagtagtcctgttaaggcggaagtgatcccaccattcagaggcagggccatgcaactgatgtgatgcaaatgagaccttctcctgatcagtacactgaagtaaatccaacttcttctctatggcatgcagccaatcactagcttcaacaggattagtggtactagagaaaacaggcggcctcacacgaagaaattctgctaacttgttctgtggaggtgcatgattattcccttggttttgctgattctgaaattgctgcatcatcatgttcataagctgtgtctgttgagcaagaacttgggccagagtgggattctctccattgttgttgctattggggttgttgggaccattcccattgctacgagtgttcaccatctggcatgggcaggataagaagagaaaacgggggaaactacttaggacagagaattactttaacttttattgatcttaactgagtttcattattacaaactgaagactctcacaccactaaactcaccaacttcctaacactcagaagcaaacaaacacatgcaattacatcccaccactgatgtaaatcacatgcaagacccacacacacgaacaaacttaaaacaagcaaactaacacaacgatctaagacaacgacttaacaagtcactctagttcttccgagcataggagatcgatcgaaggctcgttcggctcatcttcctcatctttgatagctacccactcaaacttggaattgttgcgcttgggttcttcttcttcatcactacttatgatgatgacgggaggatttgctggggcaacttctttctccaccacgcggatctttggcgccaattgataacgagggacaaacaaagctctcttccttgcggtgagacgaatcctggccttctgcggcggtgcttctcccttcaatgcggctaattccttctccaagcgatccaccttgtcttctaacttgcaaatcttaccacgattccgatcttcacgatcttgagctgctaacacagtctccgcacgactttcatccatagcccacaacatctcaaccaaatgtcttgtggtaacatcattctcaattccttcagtctcaaggtaactgccacggtcacttccctgaggttggcgaggatgatagcgatactcagtgtcggccaactgatcactgtagctatcacggagttctcctgtggcgatccttgccacttcctgacatgcatggatgtagtttcttcctccagcttcaaacatcactgaggggacctcttcactattgctgttcaaggtgactttgactcggcacttctcttcatgacgatcatgacgaatctgggcataaaaaggggcagtcccaaatccaatgacaaaggacatcgtacgcaactcctggacaaaaccctcaacaccaaacaggtactcaggcttgtaacgcggcatctaaagacaagtgaaaggagggagttaagacctttatccaattaatagcacaagttntnntnntngnngnanntntnanatnntntgannataaagttntagaaatcaaagtagaagggaagtaaataaagtaaaccaagctttgcaagataagttaaaacagttggaaatgaggtcacaaattttgtaattttgaataactggtttcaaaagaaagttataaaatcaacatactaaatttattttattgcagcaagattaaataaaacagtattgtaaaacttttgctgaaaaatgagccattagtacagtaatggatgtacagtactaataatactggaataaattttcgaatgagaaccattaaaagagatttaagaagtgcatgtgccattagtttggtttaattaaaagagaaagggaggagaacagttctacttttccaatatttttcagagggcttctatgggtaaccatttggcataacctagggtcaaagatgctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcttttgcaaaagcagcatttagcaaacatttgagaatttgataaaacagttaagtaattaaacaatattaagccaacgctatacaacatgccctattgtataggcccaaccattctgaacaaccaccccggctgcacagttctatctccaaaccaggaatgtaccattccaaaccaggagctaatcaaattattaccagttat

SEQ ID NO: 71153 - DNA, 13075 bp, Oryza sativa
cagcctagaaacatgaatatgccaatttgtagctgggcatgccaatttgtagctaatcgcagaaagctggctgcttaggcctttgggtgggtataatcagagcaacgtttagccagctcggggatggaactaggctactggcagaatttccgaccaaacacgcgcggcacagccagctttcccaatcactctcctctccaccgtagcaacacaggggaacacccaacatcccgcggattcacggattcgagtacgaaccgaggtgcgtgttgacgcagtaatccgtgccgcggatggactcgccgcagacggggcacgccacccaccccgccgcgccggcggcgtcgccccctcccgacgaagaaccacccgccgcggcttccctctccgcatcggccgcatcatcctggagaacacagaaggagccggagcagaagcggtgagaacggtggaaccggcgatgccgcgggtgggtgagttcgccgcgccgcgcgaggtttgaccaaacctgaagggagcgggaggggggcacggcgagggcgagggcggcggggagaggggagcggcggcgccgcccgatgaggcggacaaggctctcccgcccggtcagcatggcctccttcgccgccgccgcgggggagacgaggtggcggcgcggcgagcccgggaaggaatggaagtggtcgagagagccgcggcgcgcggttttttttcttttttttttttttttttggaattgctataaaacttctgcaagttttttttctaataaaacttttaaatttatgattatcgaattatctcgagatatgtacatgaaattaaaatactagaaaaaattttcgcacaaatcatgtgtaagatatcggtgctaaccaaccaatccatagttgatatatcgtatttatggtgtaattataagggcatccacaatgtatcatatgaatgagctataaaactttatgactagccatatatattgcagcactagccataagacattaaatgctaaaactagccatagacttatggttcaaccttaagaaataaaataatgagaaaaacacacctgcaatgcagttataatatagttattgggtaattacagtataattatattttaatcataattaattatattatgagtgtatttcaaatataattacatttaattataatatgtatgacagttttataaacctaccgcagtttttaaattatttttatttggaattctgtttttcgcggggtagggtggttttggtacatggaggggtgcaccgtggcagagattgttacgaaagattgcaggtttcgtgcacgttgtttttgactttgagccagctatgagctaacccttgtccttcagagggaaaagagagatcatcagtactgaagcttgtacgataccacacaactttcttgtgtacattgaaatttatgctatggtatttgtatatagttttcttgttgaaatggtttgtcttagagattttacaaggaccacattttttatcatcaaaagaatttttgtagttaaatatatcaaataaatatttgtgtataccatccactatgctttggagtttagtatgtcatattgtcacgaacaatataaatccagatttatttgtgtttcacatttagggttcagcatttaacttggacattgaaactacatgttacgaaaaaaatatatatagataaatatagtatggatttgttgtgacatatatgggtgagcgattgtttgacttggctatatcaatttgcatatgtgaaggtttaacatgcgaaaaaagtttataaaaatataaacaatataaagtgttgtcttaactgagaaatctgattttatccccgttacttaaaagcgcatacatctatccattctcctcccctatattacagtcacacgaacaatgctccttctaaagaaaaacagaaaaatcgtttcccttagaaacaacgtgctctaaaaaagctctacatgcaaccgttaactcatagaaaactaaaccattgatcaatttccatcatattacaacacacgttcaaggagtctttagtaataagaagagcacaaaacattttactacaagaaacttaatgaagaaaatgcaagagctatatatcgtgaataagaccatcaataacacatgaaatttgcccctttcaaccaaaacctttctttctttaggatatatatatatatatatatatatatatatatatatatatatatatatatatatatatatatatcatattttgcttcacacctaaaataaaagctacacaatattatctcacttatagtgtgacggagctcgtggcccctcaccgggaggccgcacaggcccccctttgccggttcggccgggggctcagggtgagatctcaagctctctcggtacgtggaaagatcgccacctctcaagaacgcgagacacgggcgatgtatacaggttcgggccgctgagaagcgtaataccctactcctgtgtttttggtggatctgtgtatgaaggagctacaaagtgcgagccgacctctcctttgttctaaactctgaatcttcagagaatcaaccccccaccacctatggcaaggtcctccttttatacttcaaggggataccacatgcacccctccctttccaaactggacttttcttcttttcataaatggacggagatttgcacggtcgtcctccgaacatccttctgatgggacggcacatacctacctccacttctgactgaggcgggcacgttgcgggaaggcggctgtgtactgacggcatgagcagtgtcagaccggtcacaaatcggtcattcttgtccaccacacgccggctcagcaacgtgcatgtttgccctttttcaaacaacatcttgcttgtaatggttaggatgaagcctggcatatatcgatcggggctaacgtgtcatctctgggacgtaacacgctagctccagccggggacgagtgcctaggagctctcgtctagacaggatggggcgaagcatgcgtctgaccgcctgtcgccacctaacccgcgatttgaccggtctgtgactggtcacagaccggataatcgagtgcactgcactgcatttcgtgcggcgtgacacgcttagccgtggtgcaataaatgcggttaggtgagccccgctgtgctcacctaacccatacacgtggagtaaaaaacgcgaggggtcggggcgcctccaccctcgggggcgaggctggagtggcccgccccccccccctcgggaagaccaagaggtgggcgcacacatcaccctcgggcccgacgtcccccgagggtgccaggccacgtgggcgattgtgtctgcctcaagcctcgagtcatgatactcccggtcccatgtcaccgacagtagcccccggcgttacgcctgggcgatcgtccttcttatggggagcggccgggcgtgacgccattcctaaagcctggtgacaggtgggaccggtctccatggttgggcaaaaacccaacggtctcaaaccatgcacaccagtaatggtaatttggctgtcaataatgggcggtctcttcaagactgccacatcaactgagtggcgcacgaatctgggcgagctgatttgcctcgcctggagatacgggaatgtcgcttcggtcggcgagcgtaattaacgcgcgcacgatacgatctatctcgactgccgcaaccgcatatccatctcacgcgccataggcgggcgaatgggattagtggaagcgtgggcgcgagaaacgagggggcgaaataatgggcgcgagaaacgaggagccgggcgcagcgtttggcaagggtataaaagcactgaggatgggatttgtctctttcctttcgccatcatttcccttgccttcgccgcttgcgtcctaactccttcttccctgcgcccttctttcgccgcacgcgctcgctcttcatcttctcttcgtccggcgccatggcacggggctccgcactgcttgatggtagcgtgctgccgccttctcgcattgtgagcgagaagcaggctgggttgccgcgccgcttcatgccggaatccgcctccggccgtgagatagtaatgctgggtgagggacgcccggcgccagactacccggggcggtccgtcttctttctccccttcgcaatggcggggctggttccgccattttcttctttcttcatggatgtcctggagttctgcgatctccagatggcgcaccttacccccaacgcagtgatgacattgggcatcttcgcacacctgtgcgagatgttcattggggtgcgcccatctctccggctgttccggtggttctttaccgtgcagtcggtatcgccaccgtcggtggtcggcggctgctatttcctgccgcgggggccggtgttgaaccgctacatcccctgcgtcctccgtaaaaagtgggatgactggaagagcgactggttctacacccccctcgccgacgaagcgcgcctccgacttccaagtcagcccccggcgcaggcctccagctggcgggcgccggtagatctgggggatggctatgacgccgtccttgaccgcctcgcgggcctgcgatcccaggggctcaccggggccatggtgtacggcgactacctccgtcgtcggattgcgccgctccagcggcgcgctcgggccgcctgggagtacaccgggtccgaagactacatgcggactcaccagggagccagatgggattgggcccccgaggacttcaagatactggtccaacgggtgctaaatctcaactccgtggaggcgtcccttatcccccacggtatcctccccctctgcagcgacccagatcgcacctccatcttgaccattatgacggcggtcggggcctcagaggagcaggctcctaagggccatgacggcgcaggtggaagccgccggggggatcaatctacccccggagggggtcgtgcttctgggccccgcgttgggggctcggggagcaaccgccctaccgacgcccgggggaagaggaaattgggaggaacacctcccccatctcctccccgagggggcggggcggtgcgtgccagcagcaggcgcccggagggggccgcgccaacatcgcagcccgagggggagcgcaagaagaagcggctgcgcaagatgggggagacagaaccatcccggggaaacctaatttcccctccaaggtggtcatttaaccgaccccctcgcaggttcgtcccacgctcattgcgaccgtcttttcttctatcccaaaagcaagttttctcttacccatcttgtttgccttctggtttttctttctgcttcagtgatatcccatcgcgttcctcccaccatcccaagtccggccagtccgaggccgaagatccggcggctacagaggcacggaggcgggaatctgaccggcgggaggccgcagaccgcctacgggaagctgaagaggccgcccgggaagccgcccgggcccgccaggctaaggataccgctcgggaggaggccgcccgggcccgccaagccgaggaagccgctcgggaggaggccgcccgggttcgcctggccgaagaagccgctcgggaggaggccgcccgggcccgccaagccgaggaagccgctcgggaggaggccgcccgggaggaggccgcccgggaagccgcccgggaggaggccgcccgggttcgccgggctgaggcgatggcggcttccgaggcagttcacgatgaggccgtggacgcctcgcttgggcccaccccttcgggcgacgcccaagaccaaacaggtccgggggtggcccgcgatgaagccggcgcgtccatgggcgggttgagccacgcggcgtcttcttcaaggcagctcttccccacgccttccgccgccccgctgagcgcagagccccttctgcaggccttagccgccgccaataccgcggtgttggacgggctcaatgcccaggtggtggccctgcaggcggagcgcgcggagctcgacgccgcatgggcgcgtgtcgaggaggggcggcgctcggtggaggccatggtagaagcgggccgcaaggcacaccgccggcacgtctcagatcttgagacccgcaagacggcactggcggagatcgcccgagaggtggaggaggagcggggggctgccctcatcgccacctctgtgatgatcgaggcgcaggactccctcctccttcagcacgggaactgggaggcggagctgaagaaaaagctcgacgccgcccagggggttcttgatgccgccgctgcccgagagcagcgagcgacggagaccgaagcggcgctccggcggcgcgaagaggtcctcgaggcgcgcgccatggcgctggaggagcgcgcctgcgtcgcggagaaagtcctggcggaccgcgagaccgccgtcacctcccgggaggcaacgctggcggcgcacgagtctgcctgcgccgaagaggagtccgcactccgcctccgcgaagacgcgcttgccgagcgggagcgagctctcgaagaggccgaggccgaagcgcaacggttggcggactccctgtccctccgtgaggcggcgctgacggaacaggcgcgccgtaatctagaatgtgtccgcgccgagagggccgcactggaccagcgggccgctgacctcgaggcgcgggagaaggaggtggacgcgagggcgcgcagcggcggggtggccgcaggcgaaagcgagttaactgcccgcctcgcagctgccgaacacaccatcgccgatctgcagggcgcgctggactcgtccgccggggaggccgaggccctccgcctggcaagcgaggtagggcccggcatgcttcgggacgccgtctcccgtctagaccgcgccggtcggcaggcgggcctctggggcaggcggactgcgaagtacgccgccaaccaggggggcctcgcccagcgcctttcggagatagccgggactctccaacggctccccgaggagctcgagaggacgattaagtcatcctcgagggacctcgcccaaggagcggtggaactcgttctagcgagttaccaggccaggaaccccaacttctccccatggatggcgctggatgaattccctcccgggaccgaggacgacgcgcgcgcgcgggtccgggatgccgccgaccacatcgtccacagcttcgaggggtcggcccctcggctcgcgttcgcccccaactccgacgaggagggcgatctcagcggtgcagacgaccgtgacgacgaggccgacgacccgggcgcatcggactgagcccccaggcccccgccagtcttcaattttcttcttttttctttcttctaaggcccttgggcctgttttttgtataaatcatcttacaatctgcaatcaaaaatgatgaaaaaactctttatgttaattttattttgctatgcgaatgagatgaggatgatctgtgccgtgatcctctttttgtgtcttagcttgatttaagggcccgtgcccaagtcccagtcctcgaaaagcgcgggtcggggctagtgcctggggagatccgcatgtcgagactggccaggccgggaacgtggcgaccgagggttatgggtgacccgattgtgggtttttgccgattcccccccggagttcaccacgccccggggcacggctcggttttgggccccgtttggcgattttagctgaccgacccgagcccccgagggcaaggttgagcacgagtgaccttatttcaagtcaaaattcttcaaaaggaaaaaacggcacagacacaaccttcaggaaattgaaactgcttttattgaaatactgaaaagagagaaatgagaatgtgcatgcgtggtagcccccggccaaccctgcacacccgagggggggtgcggggttggcccgagcccgaaacctgacacccgacccccccctcctcaggggtagaaacgacgaaggtgttcgatgttccatgggttaggcagctcagtgccgtcgcccgtggccagccgtacggagcccggccgggggacaccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccttcttcgctcttccaagtagtcgaggtcatctctgcgaagctgatcttgatcagcttcgcagtacatggtggcccgaggagacctcagggtgagctcggatgggagaaccgcttctgcgccgtagacgaggaagaagggcgtttccccggttgctcggcttggtgtggttcggtgtcacgccccgaaattctcaaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgttgcaggatataacccaaggaggctagaggttcttttgcataaagctagcatttaaaagcagtagttgaaagcagtaaaacagctgtagtaattaatcaatattaaccaaacactgtccaacgctacaccacgttgcaacaggcccaaccaacctcctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacagcccaccattcagtgtattttaattaactaacaccattgcggtggcaccaatctaaagctatgccaatagacaaagtctatgtaataaggtgatccccatttgtgtgctagttgaactaagcatggctaagcatttcctaaccaacatctagtcattttgatacccaggttatcaatggcataaggtaaacaataaatggctgagtattaggacccatcccacatgatattgtaaaagaatgcaacatttaatagaaatgcgggatatttgtaaattgggtacaatatgatcaaacgtaaagcatgacttgccttgctctcgcactgatgagatcacagcaacgtcttcgagaaactgcggatcgacgaaacggccgaaacctacgcgacaaacaaagcacacaagcaaaacatgctataagactactgaaacaggaaacaaaaccatttttaatggattctttgcatttttcttgatttactgagacttgaatggacttaaacggagctcggatgaattacttatgaattttagaagataaactgtgtttttactaataaagaaaagtccttaattaattattgcgcaataaagcccagggctgacgtcagcgaggggaggggcgggcgccgacaggcgggccccactggtcagcgacactaagagagggaaaggagggtggctggcaagcgggccgtactggcagcggcacaaggggaaaggagagggaggcgccggcatgtgggccccacgggcagtggctcaagggggagggagtgggcggcggcatgctcggcacggctcaagccggccggccatggcgaggcgacgacggcgcacgaccgccggcggtgaccggcggcgcggggagacggcggcggccggcgcgaaggcggcggcggcagccgaagacgacggcgcacgcgcggagggcggcggcgctcacgggggagaggaaaggaaggaggaaaagggattcctcaccgaggcgatggcggcgaccggcgtgggaagagacgagcggcgatgaccggcgacgcggaggcacggacgggcggcggcgacaccctaggagaagatggagaggcgttaggagaggagacgacgaccacggcggcttgaattgccggccggagatggaggggagggaaaaactcaccggctcgcgaggggagaggtgctccggtgggattccggcgacgcgaggcggcggccgggaaagctcttgcggcggcgaagctaacggcggcggcggtttggcgcggcgggactctagcggcggcggctcgcggccgaaggcggcggccagcggcggagctcgggtgcgacggcgcgagggcggtagacggcacgggagagcgcggcgagtgcgaaaaacgagagaggaagacgcggggaacgatttataggcggagggggaggcggacgtggccgggaacccatcctattgcgccggcgacgtgggaaggtgggggagagagagaggggtgggattcaaattcgaatcccgcccatttgcgaggcgcgcgagggcgggagacgcgggggagaggcggcgacgtgggagggggacgcgggagcggcgcggcgtgggcgcgggaagagcggaggaggcggcgacgtggcggattcggcggcggttgccgtcggaggcgggtggctggaggaaggggacgacctgacaggtgggccccacctgtcagcgtcccggagagagggggaaggggaacgggccggcccaaaggaaaagaggccgagcgcgggagatgtgggccgacggcccaatagagaaaaaaagaaggaaaagaaaaggaaaaagaagaaaggatttttcctgggattaaaaattgcactttggtgatttttaattggttaaaattatttccaaggctctgaaaattccactaaaaatcctgttaatatattgtgacatgtagaatccaagaaaaattccacatgccgattccgattattatttgcatttattaattagggaattagctctaggttaattaagataatttcttcggacgatttatttagtcaattttttttaaagcaagcaaaagggggaaaacttcagggcgtgacattcggtttgcccagagcaccgctggcaactcctcgatccacgaatcgccatgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagtgcagagtgcttatcgatcttgacgaccggataagcctcgggccacttagtgaacttgtcgatcgcgacatacaggtactcaaacccgcccggggcccgcttaaacggtcccaggatatcgagcccccagacagcaaatggccacgaaagtggtatgatctgcagggcctgggccggctgatggatttgcttggcgtgaaactgacacgctttgcatcgccggaccaaatcaactgcatcattgagagctgtcggccaatagaacccttgacgaaaggccttgccaaccaaggtgcgcgaggcggaatgggctccgcactcgccttcatggatgtcggcaagaagctcaacgccttgttcctgaggaatgcacttcaggaggattccgttggccgcgcgccgatagagggtcccttctaccagcacgtagcgtttggaaatgcgttggacgcgttcactcccttcacggtcctcaggtagagtcttatctgcgaggtatgcttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggcaaccatgttatcccgtctgggtacatgccgaagctctatcccgtcaaaatggcgctccatacgccgcacttggcgtacgtaagcgtccatctgtgggtcagagcaccggtactccttacagacctggttaacgaccagctgggagtcgcctaacaccaagaggcggcggatccccagtccagctgccactctgagtccggcaaggagtccctcgtactctgccatattattagtcgctcgaaagtcgagacggaccaagtatctgaggaagtctccgttcggagaggtcaacatgacccccgcaccggcgccctggagagacagcgaaccgtcgaactgcatcacccagtgggcggcgtgaggcagctgagaggggtccgtgccggcctcggggattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgaggcggggctgcagga

SEQ ID NO: 71154 - DNA, 4579 bp, Oryza sativa
tttcaatttcaaccaaactttcaattttaatatgaacgaaacgcagcctcaatggaatatactaaatgaaattgaaattttatagtcctcccagtctcccatgctactgacgcaagatgtcaaagcacctttctgtctcaaagtgctgagtctgttcctgacacttccaaatccacagctccatcgagctgtctgattcccatgtcgtcggaaggaacagttgccaatgatatcccaccgtccgattcgtgccacgtgtcgtacgcttcatgtatacttgtacatcagactgtatattcatgttagcatgtatgatgtatacgtatctctatgccattcatgccttgcttgaagtatggaccaaggtttgcaacagcagatcagcagagcagagagaaaagaactggtctgaaaaattttgcctttttgccatgaacaatgatgctgtctcatgacactgtattagtactccaagatgcataatcttttttgcctttttttagatcttggtgaaatggtgatcggtgagtgctgtactactactagtctctggaaggaagaacacatcatcaacctggcattgacaagagtgattatctatcagtgacactgaagagagaggcagaactggcaatggcgtgcgtggtgactataatcatatcccatgcatgtgtagtgttgcctgcgccttcttgatgatggccattcgttttcagttcatcatcgatctagtgcttcacccatgtcctttgctttgacacatctttgtgcacaatggtattgtttatctcaacaacttgggggattgcagaaggtcaattgattaaattaactgttgctacttggtatctgttctgaattctgactgaaaacaggtattgctcttctcttgtctctccgtttcagggagggtgcagcaatttatgaaattgagatgagagaaataacaacagagaatgttgtagcttactctctgtttctgttttccaatatacttttacagggggagaagggatagatctcattactctgcttaaagatatgtacgcctgaatcattctgaataacagtgctacctgattattacctacctgaactttcagaaagtccctctatgtaatgtaacacttgacccctgcatatcacacacaatagaatcatcaatgaaacacaagcacacatgtacacaatgcaatagtgttcatgtccaccctataaatatattgacaaatgacagctgatctaagcacctggaaatgctgtcttgcacaacagaaattacttcattgattgatatccccagtctgaataaactaaaccagatcaaaatgctgataaatctagctcttattcctgctgtttttgagattcattttacttttagtccatgcatgaaaaaaaggcatgctacagagacctgttactttcagacttcagtgctggaaattacttaaaaggtgtaccagacttttgtctgtcctgatagctgctcatgcttaatgtttctttcctgcaattgtgcagtactactgctagctattgctcgctggcctaccattaattagtatactgtcctatcccctaactaagccaaataagcaaaggtttataagtagtgttcattgttaatagtcagcgtggttctcggtatacgcaccggcttatggtaattagtacttaaccacaagtgtcaatcatgtcaatccctgctcaattgttccataagcctaccatattttacagatcaatattactctgcaccatcacacagtgttgttgattgcacttgcatgaactgcacaaagttattacacacacaacattacaagctaatgcaaattccacgcaactacgtttaattaactgcacatgttgaataacaatcctgtcattcaatggatcaaaactagcatgacaatgacagtgctctgcttctataacctctcttgtttacttaagctcaaagattcagacagttcaggcagtttgcagaaggccacaaaatttgaccatggttaatcaatcaatcagttaattacacaattactcacatgtatgcatgggccgaccaggatggcattggcattggcatgcatccatgagcagcaatgcagcatcattggaggggatgcagccaccatcatgacaacacataattctcacagcctaaatcgcaacacctttccttgcaaccaaagccaaccttctagctagctagctaatctaagctatagtgtgttgttgtgaagtggagtactagctagctaccactctatcttcttcttcttctacctcctcctttatatcttgcccctcacatgcacgcatgcctctccatctccattgccgtcctagctagctagctaagctagtacactagctaggccatggcatggtggtgatcaagaaagcgagagaggtggagcggcaatggcgggcgggtgcaaggcggcgatcgggtgcgtggacgcgcgtgtgccggtgagggcgagctacgtgagcctgtacaagtggccggagtcggacgcggagttcgtcaggtcggtggccatggcgcggcgccacggcggcgaggcggcggcggcggcgccgccgccggagagccccgccgtgccgaccactactactacaacggcagcggcagcgcgcggcgcggcggcggcgaggggtggtactactgcagcccgaggtggtggacagctactcgtgccggcagatctacctccgcagctacaccttctccaagaagaaggagacggtgccggagcgcacaatggcgtgcctcggccgcgtcagggaccgcggcgccgccgtcttccccttgttcatcccgcaccgcgccggcagcggcggcggcggcggctccgacgccggctctgtcaacagcgcgagcagcatcaccagggagacggcctccaccgccggtgacaggaagaggatcaggcggcggcggagcagcaaggggtgcgccgtggcgcggaggctgcaggaggcgtcgtgcggcgccgtgcgcgcgctcttccaccgcctcctcgcctgcaccaccagcgtcgaggtcgccgacgccggcgagccgacgtcatcacgctgaacactaggcgcgcgcatgcgagctagctgctctagctaagcttgtgtgtttcaccgtgttttttcgtgtgctatacagtaaattaaattaaaattcctcctctcgagttaagttaagtacagtagctagcaagcagtaattttatttatttccacgagtagtaattaaactagcaatatgtatgcttggacacgtatcgatcggctgcctacttgtattgtgaatttgtgatgtaagttatttgtgtttatgttactctatttattaccacttgtcatatatatgtggaatttgcatggataattaaatatacttgtttagcggattcatttttgtcgtgttcgtcataactagtcatttgagaccgtttaccttttgtcacgtgggctaagaggtacttgggctgttgcgcctgttgggcagttggtgtaggcccaggcctacggccgaccggcatatagggtttgtgttataaaaccggtcttgaaatcacatcggaaaccaaacgcgaaagaaacatcataggagatccaaacatgatgacgacaccgaggtacgatatttgataacggagttcagccgaggcctacatctctggggcactgattacgagcgctcctcccctatccagcatatacagcgtatcagagttacaacgactcacggccagtcaccgccggcagccgctccctctcgctatgctatgtcgccatgcggttacaacaggcacgcccctctatttatgagagattctatgacagagtccgactcttactctagtcctaatacctattacaactacaagtcctaaactgtaacggattacgtacacatattcgacacaaactctgacaaactccaccttgacgaatatgccacgccaacctgaattcattacttgtttgaacctttgtgtacccggacttgagttgatcctattttgccgctcacgtcgagcagccccgacaagtctccaccaggctcaccgtgaacaagagactccgctatccctataatttctttctcctgactccacctgcaatagtgctctaccttctctcatatcactacagtcgtcttgccaaacgaaattgaattccttcatagctgtcacatcctaaacttctcgaagaccatgttcaactccatctaccgtcttaaatttgacttgatctaatccatggtcagataacccacgtcatcaccaaatagataaatcaaactcaccagacacaaagagaaccctttcttccttgtcgtcttgtgaccgagctaaaaatccaacatccatgcttcttcgcatccgtagactgagtatccgataatttgagaaaatcaccattgccttgaatcatccgaagatattaccaccatagcgcttactcttctccttcagtaacgtagattctatatatcctcatcatgcaaaccccgcagattctgaatataccctgtgctgctaaacagaccgttgacaccctcaacgat

SEQ ID NO: 71155 - DNA, 6090 bp, Oryza sativa
ctagcccaaaaacttgccggcccaagttcccctctttgttttctttttcttgccggtcaaaaaagaaacgaggttagcagccatctcacggtacatttgactcctgttctcctcggtcaggtaccgaaacgtacatgttcgagtcgatctcctctgcgcctcgacccgcctgcaccaagaagccgtgtccgacctggaaagcacatccgccacatgatccttcaccgcctccaccccacacgggtacgtgctgcttcccttcgccggaaacagcccgcgacgacctccgccagcacctacacgatgacgacaccaaaccgtgttcctgccgcccagacttcatcgcaaataaatccgctccgacctccgattgaccacccgtcaatctagccacgagccgaagccaacaaatcacatgtcgtcttcctagccaccgaacgacccgagcgctacatctagccgtctccgtgtcgaacgcagctcatcgaaaggcctgggccaccccgcctagagtgttcgattccaccaatcgagaacgccgatcgcctctagcttcaatcaaccctgagcgtcacgcctgactgtctccccattgaaagtagctcaccggaaagtccgagccacccgcccggagtgtccgacccaccgactggatcgccaatcgcttccgccaccatcaacccgagcaccacgtctggtcgtctccctgttgattgtagccatcgaacggttcagaccgccgcctgatttcaccaatcaaattccgttgatcgccgccacgctccaccttgcgtccatgtccgtccctggacaccctgtgtagtcgtcgcggcgtggagcacctcccttgtacctctaccatggatctcatgcaggctctaataccacttgttagaaaccgggtccgatttcacgtcggaaaccaatctcctgtggcgtttcttccgcgtttggtctcctgtggcgtttcttccgcgtttggtttccgacgtgaattcggcgttggtttccgacatgaattcggagccggtttctaacagtttgtttagttccacacgatcccctgtgaccaaatggcccagtatcatctgggcctgtcagcccaacacggcctatgaccgcttcagcatttcggcccgatatgcgctgccggaattccgccggtttgattcattttgacaaaaacatatggaagtagagctcgccgggaaggatcaggtggagaataaactgatcggatgcacatccattcttaatttcttagtattattcatagcagttatatctaaattcagcatccattccttgtaataaaaaatctaaacaaaattcaattacatctgcagcataatttctctgaccatgtcgccataagcagagcaagacaaccttgctactactactgctcactccactccaatccaggtattaatcgatcttgtattgatcatgcatatgagaattatccttggcctctctgtcctgtctgctcatcaccaagcaaccaatgcaacctcctgtctgaccctaagccatctaatctaattaactaattaacacaagatcatgagctcatcacacagatcagatcaccagagacaagctagcactcacatggagtactgcactgtactactgtcctgcccattcgtgtgctgaattgctgattataattagcagctctctcagtttctggagcagtaaccaccaaccaagctgcctctgctgtctgctgctcgtgtgcacggcactgtactacttgctcgtaccacacaaggacagctgcactacaacctctaatttgatccataatttagttaattaattaatcagtctcttggcagaattaagctgagctgagctgcatgcctccgagactcaaggttattcctcaacgatgtggttaatctaatctctattattcgagctgttggtttcactccagccatgagctctgcagactctgaactgccactctgtgatgcctgcttaacacagctggcctccctgctcacgtgcggataaactaagcgctaattctgcactaagtactccactgacactatcttaatcactttcgaatccattatgcttgcatcacttcacatgcaaattgtgtactccaatgttcagttctccaatgctaatatgtcagttcagttgtccaatgttaaggtcgaatttgcgattatttgtctactacttgaattatttacttgaatttggatctgttttatttctaggtgcatgtaggatttggacagaaaaagtagtactttcagtcatttatgctgaaaaagatttgagctgttgagcaagtaaattagcaatttattagcagtcactcctcactaacaagtgtccgtacagatagatagggacttaggaagctcacaggaaggagctgcaatggagacagcatccaaccagagaattgttagcctcttaagtcaccgaattaattaaaccaaacaagtaatcctgcagatcaagacgtcccctttgatagacagaaacctaattacaataacattagttgccatgcatgattacacactccttcagatctatagtttgtgccacctttagttgatcattattagaatgatataattgagatcgatctgatccatccaaattaattacatttacatcacctttgcttacatcttatatttgcttgtcatctgcttgatcatgttaattttcttttgcgaaataacgaaagcctcactctcattcttttcatcctttccttttcttacatttactgaactgttattaattcagagatgctgattgacaaggatgcccatgtacataggacggtcgagatcgaggcaaggaagaatcatgaccgttggatcgaaccgggcgtaaactagaaggctcctcgtggccgttggatcgctgtcaatgttcacctactcttttggttctttcgtgtatcatctcatctgaaatctgaacctgaccaagaaattactttacaaaaaaaatggagtaaaataacccattcggttcaagtttcaccgtcttgtacggacattacggacggctccgtacataaaggcatcaatttgatgactgcatttcactgattaatcagttaaaagttcattaactaatccatcacatgcatttcaaaatcatgcaaatctttcttccacaagcaacccaacctgacaggccaatacatacaggtcatcagaccaagagctttctcctgatttatctgccaaattaaacctgtcatattttaggcgtatctttatatgcgtatattcataaatatacaattgtgactaaaatgctagtatttgctattctttttcgtggcatctagcaataccttctccatgctgcctaattaacaagacatttcaaaaatattctccttaaatttcaatgttcaaggtcaacaaatggcgtcgagtatttgcaaacggagagaaaagggaattaatactttcttcatcgcactaacaatcttccaaaaaggacaaatgcatatttcttttagacaaaaaagacgacatatgtgcacatttggtgttatcttgtgagtttcggtgaaatttcaggtgaaagcaatcgctggaatgatgttgaacaaccatgtactcaaaagtactttcaaagcgatgactgatacaagaagaacttaagcaaattggggttcttggaacaacttgttgctcacgtcgacgaattgtcttttttgatctgtgatttgacaataattgaccatgcccaattatccaaaacttgccttttatctacaagatttgttgacttgacatagatgagaattattttagctggaccaaacaatattccaatggtaaaatgttaggcaattttcaccttttattccatgcatcaagaacaaggaatgtgcttaaaatcccccaaaattgaattgtttcatgtgaacaccctactttacaaacattttcacatggctatatttcagcgtatctgaaatgttagtacagtggcaaagttgacaataacatgtgttagtgtgattgctccataacctgtataaaggccaaaataattgtacttaaagaaagcttgtcttatcttccaattggtgattagtgctaatatcaaatagtgtgctccattatgctaatttaacaaacttgatagaatcggagagatccttgttggtgcaccggaactttccaggaagcagcagcaatcagatgagattaatattgttttaattttgtagagcacccatgattgtgatttgggaatcggtaaagtaagattagtgctagtaggagtacctagttttaaatatttattaactaagcctacttgtactttcatccggttaactgcccactaggtttagtacatagttctaaattacgatggaaattggctgtaaattatgttttggagaccatgaaattgacatagcaaaaatgacatgttttagtggtatttgaataactcagatcacctaggacaatctggcacaattaactattattactcagtactaatctatttgtcccttggctgctagttgttcacgcagatacgttgttagattaccagtaattaattgcttccacgatgcttattatggaaggattagtggaaacaaagatgcaaacgtatatacggtcctatcaagaacgtcgtttggttgagtagaacaaaagcaaccagcaaaatgtccctatcgttggtgcctgcctgaatgcaactcccaaccaatattcaccaaactcaacgggtaatgatgttgagacaggaaatactcaccaaactgaaattttacgttgtgcatgtttgaagcgtttttttcatggataattgagacggatttttttacttgattagcatggtaaattgatatttttcagaaataaactttacaaatacttcagaataattggctaaacaatgcagtagaagaattttcttttctaagaaattgtatctttagaagcatgggcaaataatccatgaaaaaattagagagaaaaaaaaagctgagcagaacaagacctagtatatcggagtaatagaaactaagtacacaggaaaaaaaaacaatatttgattatcttaaaaattgagaaaaattaaaacatggtgttaatttcaatcttgcggcaagtggtgacttggggtatttttgatatgacagaaccagaagaagatacaagcaagcaaccttgcatgtccatctatcaaagtcttttgaataaatgggttacttatctatctctatctatctccgtactgttctttcttgcgtccagactcttgacgacgtgtgacaccatggtcttcttgttagacttgtgcaagaaacaaatttttagagatgcagacaaagatggaacccggcaatttttccaaagtctgcacctggggccttaatttctctgtctatatactacctagctacctggccttgctctgtctaaaaacctagccatcaaccaatcttttatgacatacctctctctcctctcgcgtcgtcctccccgggcgactcggaaggcgacgacgccgccgcctcttcgtcttcagcgcctcctcccccgcctcgccgccgcctgggcgggcactggcaaagccgtgcgcccgcaaggacggcagcggcggggcctctctccccttcgcacccggcggctggggacgccgctcgtcggcgtcggtggtgcccagatccgccatggctggccggatctgggggagcggcagtcggcggcggggaatgaaggtggcggcggtggacgacgtggagcgggaggtggcggctggggacgccgctcgacggtggcgatgcccagatccgtgcggtgctagctggatctgggggagcggcagccggcggcggggaaggaaggtggcggcggtggacgacgcggcggcgctggagttggcggtggcggctggtggcgactgtggctggctggcgttcgcgtcggtgactgcggttgtcgacggtggcggctgactgctggcgaggaggcggctggtggcgaggcggtggctgctatggtgactgctgaagcggtgacggtggcggcggctactgatgcaccggctggc

SEQ ID NO: 71156 - DNA, 4068 bp, Oryza sativa
gtaggcatggcggcggggaaagatgcggcgacgggggtacgaacgcggtgtcgacgaccggaaacgggcgttgatgaccgcgaaagggcggcgggggcggtggaaggaggcatggcggcctcagacggctagtcgagggtgtggcagacggctgcatttggccggcgcggcaatggttggaggagggtcggagaccggcttggcgcagagaggcgcagccgatggtagcggaggccggctcggcgcgagaggcgcgggcggcggagatggaggccagcttggcgcgagaggcgcggccggtggagggaggccggattgacgcgaggcgcgtccggtggaggaggccggcttagcgtgagaggcgcggccggcagtggaggaggcgaccttggtgcgaggaggagctgccggtggatgtggcgcggtcttcggcgcatgaaggctggccggcgggggcgccggtgcagtggtcccacatgtcggcagaggttgagtggtggtggagcatctgtgcatgagccgtggattcgcacgtattgagcagcaggtgaaaacctagcccggccttggccgggccggcaacgagggttaattccccctcctgagggcgttgtcgtgctgtctcatccctcacgggtggttgctgggcgaaagcccagtcttggctcctttaagccccgacggacggcggcggcggttttccgtcgtttctcttcttgaagacgtcgttttggcatcccttagccgaagcctctcgatcggtgcaagcatgctctaggagttggctttgtgttggttctgagggtgttcttttgggcgatctcgtctgtattcctttgtcatctagcggcggttagtccggtgttagccttctcccgattatatgtcttggcgctgttggtgtgtgggtggcagtatatttttttctttttcctggttacgaccctccagggttgtaatcttataatttttttcctgctctatcaatacaacttcgcaccgtcttgtgcgagtcgttcaaaaaatcaaccaatcttttcttgtgaagaaattctggagattatttggaggcacgataagtgccgcttgctgattcttcctggaaaaggatgtggcagaattttgttcttgttgcattgccggggacaaataaaaaatacagaagttttcaataattgtaggacccccttaaatatatatgcaaaatggcgcagcgataaaaaagtactccctctatatcagttatatcaggttataacatgttataagtcgttttgactttggttaaagtaaaactactttaaatttgactaagtttatagacgaatttaataatatttataataccaaattactttaatcaatgattgaatatattttcataataaatttgtttgggttaaaaatgttactattttttttataaatttaaaatagtttgattttgaccaaagtcaaaacgacttataaacgtaaaacggacggagtacatgctaatgttcttctatatacgagaggagctgcctcggagctagatgtattaattgtttgattagatcgcattaaggatacacatataaaattaagttttactcacaaattaatttttatagttaataagccgttacggtttataggacacgctcaaaggtagcttgggatggacatttattcaccctatgtcggaaaaaggacttctccatacaaaggactatcaattaaaacatgctaattaaaatattgtgtgatgtgtgtaaagatcggatataaaaatatactctctctgtctcaaaataaatcaacttttaaaatttaaactttatcctaaaataaatcaacttatacattcttatctactttcggttcgcaaaccgaaaaattctattcctttgatatccattatccacctattcactgatactaatttgctatcaataagacgtgttttggactttatctatattgtttgaaatgaatgaactgttagttttttttaattattgagggaagcattattatacatgctgaaatcatctatagttgaagcgatgcaacagtggtggtaaatctgtcacccacaaactctcaataactaccctgaagtcatttaattagtataataaaatattgcttctagagttaatgtcttcttccttctctgcaatataagtttatcatactaaaattcgatggtgaagtcacatactcacatacatatgtagttcaaatgctattttaataattagagtacgtgcatagaattaaaaaaaatctaacagttcattcatttcaaacaatatagctcatgtagcagtgctcgtttttcgtagcaaagctcaaacatttagctagtgatgacgaaaagtatcaatgggagcttgatttgcatatatcagcattttttcattagcacgcacaatatcattcacattacacacacatttatataagggagaatttactatttgccatatataagaggtagctggtctgtgattactttgtacaacaaaagtttcatccttcagagaccagataatacatagaggattaattaaacatacatacataattaagagcagtctacttataaacaccaaacgcctaatatgtaattagtactacttgactgtacaatagttaagtccatctcttgagtccacaactccacaacagccaaagaccacctgaccgaagcctaattaagggcatgtttagctggaaaaagaaaatccctgatgtgatatatgcagacacatatttgaagtattaaacgtagtctaataataaaataaattacagattccaccagaaaactgcgagacgaatttattaagcccaattaatccgccattagcaaatgtttactgtagcaacacattttcaaatcatggtgtaattagacttgaaagattcgtcttgcaatttcctggcgaattgtgcaattggtttttttgtctacattaatttaatgctctatacatgtgttcgaacattcgatgtgacagcacgaaaaattttgtttggaaactaaacaggccctaaacagcatgaacaacatggctacctacatggaaatgaaataataagtacggtcagaagaggtaaataaaactacaactcctagctagtttcataaatgaaaaattaccttagattgggtgtaatagatgaggcgatgaagatgctgcatatttttctactgccaatccaccgtcaggtcaaggcgcccatccagtaacatgaattctattagctcgtccatggcttccaccactactggtgcactaatccatgcgcagaagttgtcacccaacaagatgaccagacgatcatatgcgatggctaagtataatttggcgagaagagctagctaatcccagagctaccaaagtctctaccactacgtaccattatcaagaatctgagagtgaaacagagaacgatcgagagaaccgtgagcagccatagcttgatccagtatcgattcgatccggagtggagtccatggcgatttccagcctcagctccaggtgatcgatcgagtagcagatgcagcaatggatgatgtgccggcgccagatgaggcccaggatggtgccttccaccagcgagaggagagctcggagaggatggagatggagctccggcaatggctgcaggaggaggaggaggatgattgatcccccacgcagcggtggcattaattctgacgccattgatgcctagctcagctcccagcttgtcgacccagcttgtcgcagatcaaggtcttcttccttcacctcgatctccacctccaggcttggaatggtgaccaccaccgacagctcagcttcccggcgaggattcagcgccgccatcttagggcatgtttagttcgcgaacgaaaattgttgacgtgtcacattagatacatggacacacattcgaagtattgaacgtagactaataacaaaacaaaatatagattccgcttgaaaactacgagacgaatttattaagcctaactaatccgtcattagcaaatatttactgtagcaccacattatcaaatcatggagcaat

SEQ ID NO: 71157 - DNA, 9782 bp, Oryza sativa
gtgcttaggttacagagaaaggagaaagaaaagaaaaaaaaggagaagaagaaaaagaaaaagaaaaagaaaaaatgaatatatattttgagagtttaggaaccaagatgacatatctctataagtttaaagacaacctgtgcactttactaaaataaatacttcctccatttcaaaatattataatctagaacaagatttgatccattctaggatgaatctagtatatagttttgtccagattataacttaatataatacttacatgtatcccagtccggctacctactcattgtttgcaccgtacttgataaaaaccgtggaaaaataaatgaaattaactaaaaaaaattataagtagacttttatatgtatgtttctagcaatttaaaagatactgttaaaaaattaatctgttctgaaaattcttataactaacttttaatcaagttctaaaatttagattttaggtacgggcgtacggctcataagcaatcaagcaaagctttggacagggagcatcatgcactgtgcgcgggggtagcagccgcagcgaaccaagcaatgggagacaacacacgaggtcgagctctgcctggaaccctgcaaacatcatgaactgtctggatcgagtaaggcagtaagcaggtagagtatgaactaaagggattcaaatattcagagatgttccccaaaaaaaaaaaaagatattcagagatgtttcagggtttcagagataatagggttttagggattcagaaattcagagttttgtcgtctgaaaaaggagttccagggttccaattaagagacgttaatcagtcgttcgacacctcttttttttcccgcaactgggattggaaccataaaaacactgtagtaccaaaggaacaaaaacatttcaacatacacaaatatcctctcaaaagaaaatatacatactcatgttacgaatcgacgattagatattgcatgatatgacgctgcgaattattccctgacatacgcccatctttcatttgactttatgcatgctgctttacctctagaatctggaccggaaagacagccattccatcaccacttggtaaacagccagattctcaatctcctttctacagtaatacataactagaggtaaaaaaaataaattaagtggtcacagtgacttgagtagcattttaaggtcctgaatttaaatctccgtaggagtgaatttcagattgggttatttgaggagttaagtttccgatttaaaaggttgcatatattcggttggatgtagagaccgaataaaaaatatccttctctaaaaaggttaaaaaaaaggtacaaaaatctgtctcaaaagctatttttaaggttgcatatattcagttgaatgtagagaccggataaaaaaaatatcctcctctaaaaaaagttttaaaaaatctgtctcaaaagctatttttaggccattcatctgcgcaagaaatacttgtgcaaatcatagatgggcctcaaagaacacacttgctttgcatgtatggcattttctacttggaggtaggggtcagagtttaatactccgactgcggccccagttctctcaattctctcgcatcttctcatggcatccatctctgaagaaaattaagaacttgctatcaatcattctgcaaaccatacatcatagctgaatgttcaggagtatacaaactggtagtctttgcaagaagataaaatttaccacaggacatctaaaaatcatgtaattaattagaagacacccaaaaaacacgacactttcaatggatactacaaaatttgtgtaattagctgtaggacacccgaggtaatattttattattttcggtgaaaaagaggagagagaaatttcaaaaggacggaaatgcccttagcctcagtacctgaaatccccatccaacttcaactgcggcggcgaactccggcgaaggcaccacgccgccgccgtggtgcgtcgtgcatgccagctgcatggacaaaaacccgagctcttccaaatggagaatcctaagctctctcgccgcccataaatcctttacccagcacagcgtcctccgccttcctcgcgagctctcgccttgccatggcgtcgttaggcgacgccgcgccgttctgctgctggtggtggtggtgctcgtcgcgggcgcggtggcggcggcggccgacatggcgggcgaccgcgcggcgctgctggcgctgcgggacgcggtgggggggcggcacctgccgtgggacccgtccgcgcccacgccgtgcggcggcgcgtagcacggcgtcgggtgctccactgctccgccgccggcgaccgcgtcaccgagctccggctccccgggaagagcctgagaggagcggtgcccgtgggcacggtcggcaacctcaccgcgctgcggacgctgtcgctccggacgaacgcgatatccggcggggtccccgcggacatcggcggctgcgtccagctccggtcgctgaacctctccgggaaccggctcgccggcaggttgccggaggggctcttctcgctggcgctgctcgagaaggtggacctctccgggaaccgcctcaacggcggcgtctcgccggagttcagccggctcgcgagcctgaccacgctgaacctcgaccgcaacggcttcaatggcacgctccccggtaacctgatgctgccgaagctcgcgcagttcaacgtgtcgtacaatggccagctcggtggcgccgtgccggcgtcgctcaccgggatgccggcgagcgccttcctcggcacggcgctctgcggcggcccgctcgccccgtgcgccaacccctcgccgccgtcgcccgggggcagcaagggcgtacgtgaggaagaagaggataggagagagaggtgtggaccccacttatgattagcaaatagtaatctctctactaattacgaataaattagtccatgactcatgggcccaggaggttaaaaacctattaaaaattagattaaacataggctgtccgtgacatgtgggacccaccggtatttaaagaaggaaagagaaagggcaatccaagcatttagataaatatctcacctttttttacccagaaataataaaataatgcgaccggtgttctacagtcaattatatgttttttttttccatgagccgtgtcacattttcgcggtgtctctcagctaattacatgttttttttgcgtgttctggggcaaattttgtcttgcaagaatcatacttcataattacctagtagagatagctgctgattagttcatctatgcatccaaccagcacaggccggatgatgtgataacaaagagcagagtttttgtggtggtggtgatgactgacgaattgtgttctgatggtctcttccagatgccatgaaaaatgcaattgcaggatgaggcctgaagagacgcagagttgcagagccaagtttcagaatcgccttgcagctttcaacaggcaccacatgaactaactctggagttcaacgagcaaaaatgggtggagttcaacatgctggctaatatgtaaaatgaacgttggatggttcagttacgcgccgaacacttccagggatgatgcaacttggaacaaaaagtttcctgcagaagttcatttacagccagattcttcattccagggatgatggaacttgcgataacttctgcaaacaatatgcactttacagtcagattcttcatttatttttcattattgccttgtaggtatttttgatcattcatctgccagacaaaaatttgtgaaaaatgcaaatcatagatgggcctcaagaacacacttgctctggtatggccttttctacctggagcggggttcggagtttgattctccgaacccctgttttctcaatatcctagcttctttccttggcagcatgaaggttagctgcaacgaaaatcacctcaaatgttcacccaagatttatgcattagttttgggtaccatcaccctgatttgtgagaaaattcaattatgatacagagcttctcatcggaacatctgacatcatcagctatcaacttgcggcacaaccgagggataatatgtaataattctctaccattgtttatgtcttagatctaatcagtttctgctttctccagtagtcataagttcatgtgttcagagaaattttcttcagatcagatgatcgacttgatgctgatgacatgctttttagagcaggtacaatagcaagttattagccagctacaaacatattttaatgagataaagataagagagaagagtagcgggctacagatttgtagccagctgcagcacggactccaagatgcaatgtgtgtatgacatatgagaccatatattaatagtatagtaagcaactattatatgaattggctattagattagctatatataaattggagctagtagtgggctatactattaaacttgctcttaggagcgtaaaatttggaaatcttcagtgaactgcgatgatactgacatggatacagtcagggaagctttagctagctgctgcagagaactaggattaacctgaatatacaggcttgaccatgaacattcgataatcagcttattctcccagagcagtacgccatgtagcaatgaacagatgcttgtatcctaactcctaagtagattttgaaatgaagctgctgtgaattcctgcctgagctatgatgccaatcttttttttgagatgtaattcagatagttccaatcttcactgagatgtacagcattgtttgtctacatggaggtgtgggtcggagtttaaaattccgacccccagttttctcaaaatccttcgcttctcttcgtggcaacatcaaggtagccgtaacacaaaaacacctctaaacaagaacattcattggtgtcaggatccattgcttttggatgcagggtgcagcctgactgcctgggcgatgcatagtctcacagccataaccataagtagatcgttggagctacagccatagtcgcacaggcaaatctgcaatgctgcatgggcttgaattgcaaccgtgcgcgcaagcggaaattcagatcgcatgattcgcgtcaatctcgtcaaaaaaaaaaaaaaagagaacaatcaagaactgcagtatctccgatggtcatctgttctggtgctatgagaagatttctttatagcagatgctctgcattagcgcctgatactgaattcctgatgttgatactgcgttgctgaagtgcctgagtatacaaattggcagcctatgcaataacctgaatcacacctacgtacataatttctttcatttcatattataagtcgtttcgactttattctatatcgaacttctataataagttagatcaaatatattttaatagcacttttgtacaaattggcttaataataatatgaaagaggatgtagtagagatcagatagctgctgattagttcatgtatacatccaatccaactagcacaggccacacaacaagataggagtaggatcgataacaaaaaagagcatttgcagtggttttgtggcggtgacacagaaggtctcttccagacagcctggagagacgccgagttccagagccaagcttcagaatatatgagtgcaactttcaacaggtatcacacgaactaactccggagttccaaaaaacttctgcagtattaatgtgcatatctcaattgcactgcaaacaatatgcactttataaccaccactgaaacaattacccaacacacgttcacttgatgatttcaagaaatgtgcagggtggggctaccgatttgcaaaatcagagttgttgctcaccaatactgaccactgtgaactgagtggtgatcactgatacgaattggtgtttactaaaagcataggaattcaagaacacacaacattattcctaaaatagccaatgaaatttaagtacagatcaaacataacaatgcctgacagccatttactaacagaacacacagccaaataggaacgaacgcatctttctcacatcccaagttctttaaaaaagaaagaagcaggcaaagttcaaggcttcaacagttcagctcaatccagccacattaacaagatttttcgtatttaacaggtaacccttagcaaagacccacagatacgcaaattttctactccctccgtttcacaatgtaacaaaaattatcaaggtgatatggacattactacaaaacaacatgcatacattatgcagaggggaagagtactactgatagaggtgaggaaagttacttcttcaagtaacagccgtctactaagtaatttacattagaaaccgcagcctagtgacaaagcttggtacttgacaaacggcacgattcacaacgcaaggacgaacacaagcacagatttgaattagtcacaattgatagaagataaaagagggtaaacattaagcaaaattaagtcacgagctcatatcatatctcaaacttaacatgcggcataataagactaagcacttttgagttcgatccaaatcacacgagcatcgagctcacacgctacaaaagattggttcccccttcttgttttcttgcatatagcacttaaaaggaaactactaccaagaacaaacgggacatcaccggcggagcggcccggcgcgtctacttctcggaggagttgggcccgcgcttcttgccgaatccgacgacggcggtgacgaagcggcggttgtactgcatcctcttgtgggcgcggccgcggggcttcttcttcttgtcctgcttcgccaccttgggcgtctggccgcgcaccttcccggcgcgagcgagcgatccgtgcaccttacctgcggccgaatcccatcagcaaaaggcgcgagggggtagggagagaaagagaggcgatcgagaggacacttacccatgtcgacggcggcgaggctgcggcggcggcggcggcttcgagggcgcggaggaggagcggcggcggcggcgagcgcggagacgggagaggaaaccctaggcgagggtaagggcttttatagacgtggggttgggtgcggattgggttggattttcgtgggccttgaggcttcaaatttggcccagtagtttcggcccaaggttactcttgtggacccaatgtactgggccgtactctaatctgggccgcgcattttaatccagtaaaggaaaaaggaaaaagtccacttagactcccttaattgttaatcgaatctaattcgtgacccttaactagaaaaccgggtagactgactcccccaattactaaaaccagtacaaattgaatcccttggcggttttgaatagttgtttcgctgacgtggcatctacatggcaatgttgacttggtctgcagttgacgtgacgcttaggtggcattataactaaaaacatacacgtgggacccattcgtcattcacatagaagaagaattcgtggggccacatgtcagtctatcccttcctcatcctccccaatctccccccttatctctctctccctcccaattcagcaagcgggggccggcgccagcggtgacggcaagcgaggggcagcgccggcgacggcaggcagggggcggcggccgctgagctccgcatctgggcgacgccgagcttcgctctcgagcctcggtcaggtctgggcggtagcgggcgcgacctcaacgaggaagttgggctgcgcgccatgtcggactcccagacgcggtcgtcggggtagcggacggggtcggtgggagggggtgccgaagttgatgcgggtggcgagggagaggaagaaggcaccctcgaagataaaggggtgaccggtggtggcgttgatgaggcagtcggagaggaaggcccagggttgagccagcgccaccagcttcgagcacagcggcggctggatacacgcgctgctggaggaggccgagaacgagcggatgcacctcatgaccttcatggaggcggtcaagccgaggtggtacgagcgcacgctcgtgctcgccgtccagcgcgtcttcttcaacgcctacttcctcggctacctcctctcccccaagctcgcgcaccgcgtcgtcggctacctcgaggaggaggccatccacccctacaccgagtacctcaaggacatcgaggccggcaagatcgagaacgtccccgcaccgccgatcgccattgactactggcggctccccgccggcgccacgctcaaggacgttgtcatcgtccgcgccgacgaggcgcaccaccgcgacgtcaaccatttcgcatcggtacgtgcgtgcgtgtgaattcccaagcttgatgtgtgctttgtgtaggtttgtgatgactgaattatttttacttgtgatgtgcatgcaggatgtccatttccgggggatggatctcaaggatacgcctgccccgctcgattatcactgatgataaattttcaaaagaagattatcactgatgaaatcttgcggcggcttgtgtcctgctcagctctgcagttgttaccaggaaacacgagttgctgttgatctgttgtatcctctctcggcctccccgccaggcggacgcgcgacgggtgcagcgtctcggcgacaaggttgcgccggaggatttgccacatgggcccgcatctgcagcgcgtgatggtgtagccgttctctccgaggagcgagcgcgccacctccaggcggtcggcgagagtggtgccgcgctccacaagggtggcgtgcgcgacgcagcagtcggccacgaaggatgaggaggagggcgacgaggcaaagcggtgccacagacaaccatcactatcgccatccaccgctgccgcccgcaccaccgccatcgccatcgccggcggcggcgattgctctgctgttttttttttaagatagagggagaagagggccctgacaagctggccctacgtttttttatatttttccctaatcaattgcatgtgggcctcatgactgggttgacacgtcagcataatgggccaagtcagcatgccacatcagcaaaaccgccctctaaaaccgctgagagattcaatttgtactggttttagtaattgagggagtcatcctgcctggttttgtagttaagggtcacgaattagattcggtaaacaattaagggagtcaaagtggactttttccaaggaaaaagtacaccaaagttccctcaacttgtcgtcgggattaaaaaacgtcctcgaaccgtaaaaccagatatggggtcccttaactatacaaaaccggtcacccgaaatcctttggtggttttgaccccggttttatctacgtggcggttgagtcagcatgaaacctacgtgggccccacatatcatttgtccacgtcaccctctctttcccctcttctctccctcatctttctctctctttcccctctctctctctcgcgcgcacatggaacgccaggaagtagtggcggaagcccttctgccaccccgcccacaggaagaacgggagcgcgagcggcggcggcggtggcgggcgagcgctggggacctcggcgacgagctcgggagccacgcggcggagcttggagaggtccgtgacgacgggcgggccccagcgttggtggcggcggaacgtgttgaggaggaaccgcgcgagcggggagaggcggcgggcggccgcggtggcggaaggcgaaggcggggaggaggaggaggaggaggaggagggaggaggcccctaccgcctctgcttgggaggaggcaccggtggcgtggaggtc

SEQ ID NO: 71158 - DNA, 640 bp, Oryza sativa
attcctgcagcccaggaaaattttagaagtgcctagatagggaactttttaagtttaggtgctatagagggaagagcaacttttttttgatgctagatagggaattttctctacaatgatcatacttcccatacgggcattgcttatttgactctgttttgaagtctaataactaatttgaccctacttttttaggtttgctcatttaaccctgtttttcaaaattgaagataaaggttgaccctattctgtgaagtctagataacggtgttaactgagtgacgatttctcttttttgcccttgctcgtttgaccctaatgctacattttaacatattcgtaacaaatttgacatagatttgagaaaattttgacatatttgatttcaatttgataaatttagctttagtttgacaatttgactttaatttttttaaaaaaaattaagagcatttctcctatcttatccatcccaaaatgtataaaataaagcaaaaacatggcaaagagcgctgcagtcgccgtcgccgcaatggctgccgctctgagcacgatagcaaccgacgccactcccttccacctccccgagcacagcagctgctgtcgctgctcccttattccgcgtgcagctgccgccgtt

SEQ ID NO: 71159 - DNA, 7366 bp, Oryza sativa
taccaatagttttgtcatcacttctacaagttgtaattgttttgaagatactagtactagtagtagtacgttttgaatacacaaatacaaacatatccatgcattgcttgaacaggactactgaaataatatattgtcaagtttaactaaggtctattgcgtcaaggaaagcttttccaccaataattcgaggcaggtgacattctccttgatagtgtcactattagttaattaagcactgaaagctctgactttgctagatgagcctatttataatgtccaaaatatttcacaaatggggggtttcattttctcaaatccagctagccctctgtaagtctgtatacatccaccattcaccatcaagcaataaagaacataaaactgctggtccctcaaaagaaaatcaaaagaaaaaggaacaaaaaaataattatcattgtgcccatatttctttttcttttaaaaaaattcctgttccatatcccacgtgtcaagcacccattggccaagatgacgaagtggagaaaagtcagaagaagaaaaaaaagacattagaaatggtattcactgtagcgcctttctgtgcaccctccaacaagatggcgcactagccctatggtacacacctttggtgtgtccttgtctgtggggcccacatggaaatcctggaggtggggcccacatgtaaaggtgtgggagcaaggcaggtcaaggcaagaaggcaacaactctggggtcaattccggagtgtgctttacaatgatgtgtgattagtgattactactacaacggcagcaggattgttgaagacgtcagcttctgtaattaaacatgcagatgcaggaggaggaaggatccatgcagtttcttgcgttttattattgcaatttgcaaccagttcaaggaggcatatggacaaaaataatgagaaacctcggcgtttggatgcccatattcgtagccacacgctggtttatttttacataacaatttcgtatctatcccccgctctagtactacgctatagtcctgcatcgtttttaacacgtgcgtttttcaaactggtaaatggtgtgttttttttaaaaaaattctatacgaaagttgcttaaaaaatcatattaattcattttttaaaaaaatagtaaatacttaattaatcacgcgctaatcgctactctgtttcccgtgccaccctcactcccgaacgcaaccctaatggttgattctaaataatgatcattttctcgtgcttttcaatgctagttttggttatattcttttacaattttgtacgggctatgtgctaacaaatatagtattgtgaaaaaaataattcgatgacaaaattactgagatttatgttgcgaatatctaatctagatggtttcaattaaatcaacggtcaaataataaaagagaaatgatatacattttttttcttatgaactctcttaaaaagttgatgtagtaaaatgtgattgcatcttggctttttttttcgcggggaacaagaactttgattactcagctaaattgtcctcccacacaaggtgagaaatggaattacaacttccatgcggccagagtccgtaagggactcacacctggctttattagctagagtatgaccagctaagaaatgtgattgcatcttggcttttaataactaaacaaaatggttaagaaatgtagtgcatatatagcactactcactatttcacttagggcctctttaaatcgcaggattgagaaaacgtaaaaataggaaaaacgtaggattttaattggaatgtaagtgtaaaacagaggattgcaaaacgcaggaaaaacacaggaatgaccgtttaattgaaccgcaagaaaaacgtaggaattggacgagagagatagactcaaaggaaaaataccaagaggttaaagctccgctaaatttcctccaaaatctctataggattgtccattccatagaaatttcaaaggattggatatgatcaaatcctttgttttaaagagcttcataggaaattttcctataggattgaaatcctccaaaattcctatgtttttctccaaattaaagagaaacaacataagaagtaggagtacataatcagctttacacgtgtttactatttcctaccgtttgcctttcttgatacagacaaattgtatgggttaattagcagaatatccatgaacctctattgatatatgcaaaacagaagaggaaaataaatcgttcaatcttggtgtacaagcacaaactgcgcgtggaaaagacgccaaccaaaaaaaaaacaatccagggagctgcatgaatgaatgaatggatggtcatggaagtagtatgatatgattccattggagtggaaaagagtggacaaatcatagaaaaagcaaacccaaaccaaagcaaaatcactgcctttttcgttcctcaattccgtagtcctccaactctactcgccttcacctagcacatcagataggtataggtgcgtgcgtgccacttggctgctgtacagtgttaacaatttttaccggtccggcatttcgaaccatgtcacgatcataaattgctcggtttttcgaccaagtctaaaaaaatgaaactaaaattttagttttttataagatttatctagatttcacccatttggatccaacgaaatgagaatatcgtgaggcggtttttctgtgtttcttcgtacacactaaaaatttatctattctgaatgtaaaacatgatagttattatagtatattaattaagtataagcttaaaaaaattaatatgatgtttttaagtaaatttttataaatttattttggaaaagtaatgtttaacagtttaaattaaggtcaacaaagagataggagcgaggtttacgttaccgctggtaaccgcgcggttaccgggcttaccgcggagtacagtaatataaatacgtggtaaccttcttagattcaaataaatttaaaaaataatttaaatgtttgataaattttacacggttttgtatgatttcacggttaccgtggtaatcgtgtctaccgctggggcgcggtagcctcggccccaggcggttttgggaaaccctggtaggagctgagaaggatgcgaaaccaacggtgctggctgctctgaacgctgttggttgctgctgccccgtggcgacgacacctcaccggaggcaacacaacgcaacgcatcgaaatcgaaccgcagcgatccagcgagcggttgagtgttgccgcatcaccgagtcaccgagacatttttccttttttctttttttgtaattgcagccgcctcgcgaagcttcgtgccaccttcctcccgtcgccactgcgtcaccttccctcttttcaactctctccctctcacacaccgcattgcagatttcatttgctgcaccgccctcccctcccctgcaaatactactagtagcacaagagccccgcatgccgttcacacctgcccaccaccaccactcgtagcccccaccgcaaccacccacacccacaccactctcgatccttcttccccgactccggccggcattggcggtggtggaggaggaggaggaggggaggactctgggctgtgtctctgtcttgcgcggcggcggcgcgagagggagagattggttgtgattttgggagtcccgacgtcgcacgcgcgcgcgtgtggagtggaggaagaagagatcgcgtctcttcgcccgaggatttctcgggatatttttatttgttagttagtatttataaagacgccgccgcggcgagggcgaggtccccgattcagtttggtttttcttctcgccgacgcgcagatcgatcgcgtcgtggactgggaattcttccccccgcattgttgtttgaggtgaggtggtggtggtggtgatcacgatgggcgaggccgggcaggacgcgccgccgccgccggagaagggcgtcgaggtggaggtgttcccggcgtgggcgcggggcgtggaggagtgcagcgcggctgggggtctcggcgtcgcggggcttgtcgtcgcggaggcggcggcacggctgcgggcgcatggccccaacgagctcgccgagcacccgggacccacgctgctgcagctcgtcgcgcagcagttcgacgacacgctcgtccgcatcctcctcgccgccgccgccgtctccttcgcgctcgcgctctcctcctccgccggcgccgtcacgctctccgccttcgtcgagccgctcgtcatcttcctcatcctcgtcgtcaacgccgccgtgggtgtctggcaggagaccaacgccgagaaggcgctcgaggcgctccgcgagatccagtccgaccacgccgccgtcctccgcgacggcgactggctacccagcctccccgcgcgggacctcgtcccgggcgacatcgtccagctccgcgtcggtgacaaggtccccgccgacatgcgcgtcctccgcctcgtcacctccacgctccgcgtcgagcagggctccctcaccggcgagaccgcctccgtcaacaagaccgcgcaccaagtgccccacgacgacgccgacatccaggccaaggagtgtatggtcttcgccggcaccaccgtcgtcaatggcagcgcaatctgcctcgtcgtgcacactgggatggccactgagatcggcaaaatccacgcgcagatccacgaggccgcgcaggaggacgacgacaccccgctcaagaagaagctcaacgaattcggcgaggcgctcaccaagatcatcggcctcatttgcgctttggtgtggctcatcaatgtcaagtacttcttgacgtttgagctcgatgggtggatgccgaggaacatccgcttctctttcgagaagtgcacatactacttcgagatcgctgtggcgctcgctgtcgctgccataccggaaggacttcctgccgtgatcaccacgtgccttgcacttggtacaaggaagatggccgccaagaatgctcttgtcaggaagcttccaagtgtggagaccttgggatgcaccaccgtgatttgctctgacaagaccgggacgctgacaacgaaccagatgtccgtggcgaaacttgtggcgatcggagatgctgaagggaaggtcaggagcttcaaggtcgatgggacgacatatgatccccgggatggtagaattcacgattggcctgcagggaggatggatgcaaaccttcagacgatcgcaaagatttctgctgtgtgcaatgatgccagtgtggcacattcttcacatcagtatactgcaactggaatgccgacagaggcagctttaaaggtgagaatcgataaactgtatgatattctcattctgttaaaatgctccagtttttggtccaagaatatggtgcatagtttgttaatccactagttgcacatttttcaatcatgatttgagcagtctaggaacattgcctactgaaagtaacgttctggcatgtgttggttctaattcagataatgctgcttgatgtttggaaacattctgttgtaaagctctgatataacttttctttattggtttcttctaggtcttggttgagaaaatgggaatacctgaaggaatgaacggattgtccttggatccatctgaaacattaggtaagctagaaatgccttttcggcttagcttagtattacctatcagtttcaactacgtgcttcttaattaggatattcttctaatcacgcactgagctgattatgaaattgtttgctaacaggctgctgccaatggtggagcaatgttgccaagaggattgctactcttgagtttgaccgtacaaggaaatcaatgggagtaattgttaagtccaaatcaggaaggaatgctctacttgtgaaggtgttaattctttatttcttgctatatagtcatctcttactgatctgctggacatgtattgttcactgcatctttttagtatgttccagtggttggcgttgtcattagtgcctgattttgtgttcttaataacagggagctgttgaaaacttgctggagaggagtagccacattcaactgcaggatggttcagttgtgccgttagatgaaaaatcaaggaaagctattttggaaaacctccatgaaatgtcaattaaagctctgcgctgccttggttttgcatacaaagaggatctagcagaatttgcaagttacgatggtgaaaaccaccccgctcacaagcttttgctggatccagtcaattatgcagcaattgagaccaatttgatattcactggtcttgctggcctaagggtaagatgatgcttctcatgatatgttttcaaccagattgtttccttttttttttaactccaatcaaggaaaattcctgtttcttcttggttcaacaaaatatgcatagtaagcacggttatggacttcaaggcatataaggtctaaataagatatacttgactaggagataacagaaaaggctaagcatgaattctgtatagctaggataagctaatccaaacaagtacagtcatcaattatacagaaagtgatttgctggggaccagtatttaagatcaatgatcatcttgtgtaattttcttttcttggcaacctatcttcttacagtattaatgtatctttctcattgatgttttaaatatgacaggatcctccaagggaagaggtttttgatgctattgaagattgcagagctgcaggcatccgtgttatggtgataacaggagacaacaaagaaactgctgaagcaatatgccgtgaaattggtgtgttttcacatgacgaggacattaccttaaagagtcttacaggaaaggagttcatggcacttgaggacaagaagacactgctgcgaaggaaaggtggcctactgttctctagggcagagcctaggcacaaacaagagattgtgagactgctcaaagaagatggtgaagttgttgctatgactggagatggagttaatgacgcccctgcgctaaagctggctgacattggagtagcaatgggtattacaggcactgaggtatgtacttatttcagcaccataggttgttttcagccagtgctttctttctttaatttcctgtgcagaaatatacaggccttaaaattttcatgacatttccctttcagtccttttttggttgttagccctttgtacttgtctgccaatatttcagctaatcatctatactgttctgagttaatttgaacaacattggttagagataacatgaatttataggtcttttattgtcccaaaagtactgatatctgtgacataatttgaattggtatctcacttatttttcttttgttcaggttgcaaaagaggcctctgaca

SEQ ID NO: 71160 - DNA, 5462 bp, Oryza sativa
gcggcgcggtggccagcgtcctcctcctcctccgccgccgcatcgacggcgtgcgctgcttctccttcccggccgcctccgcggcgtcgtccatgccgggctcctgcatcccactagcgagctcctgcatcagccccgcctcctccagcctcttcgcatgctgcatcatcgttttcatcagctcgtgattaatctcagctaattaattacactcttagttcagttcgttgccaattcgccatcgccattgttgccaactcgccaatgccaataatgatgaattgatgatgcagatatatgtggagagcgagcttgccgccggtgagcttgccggtgaccggcgagttgactgactgacctcgtggccgtcgttggcggagtcgcggcggacgatgccggcggcgcgtggctgcttcatcccgaaccggatggctgcaggtgcgtcggcacgcagtcgatgacatcgccgtcggggctgccgcgtcgccatgtttcccgctgcggccgccgctgccgccgggtgccggccgccgtcctctctcccgcctcgcctgctggcctctggccctctgcacccgcgcgccgctttgcctcgcccagaaagagagaagagaagaaaaagggagggtgatgacgtggattaccctgatatgtggggcccacgtaggtcccatgctgactcagcagccacttaggacaaaatcgggatcaaaaccgttgagggaccttctgttttttagtttgaggatgattttatatctttgatgacaagttgagggacgttgggtgtactttttccatccagtaaatgggttttccattcaagggcttgaattggagtgtactgtgtacgtgatccgcttacaataacagcccattccaatcaaacaaagtttcggaagagaactcgggataacgaaggggcaatattttcgggacattaaactatttttttgaaacctaaaaaagaaaacaaaatttgaaacctagacattttactattcgtcactcttaaatttagccttaaccatttagcactaatacgtcaatgaaatgtgagtctcatatgttaattaccgcatgcgaggacagataacaatggctaattaccacatctaagtgataaatagttaaatattcttatattttcggaacatttctaaattttcgcgcgaatttctggcaaaatttaccgccgccaccgggcaaggccgccggcggcagaccagaggcggcggcgccgccgcgcgtcggcagggacgattcgtccatatccccatctgtttcctctctctcttttattaagatttttttttctcgcggtgcggcagccaagatgggatcgaaaagttcgaaccatattccacctgtccctcgccttcaagaatccgcatctcgtcttcatcattcgcgtcctccgccattgatgccgatggagagcacatgcttcgcttcgcgtgccctcacgatagcagcgaatcttgctgccgctgtcgctgccgttcttgctgattctttccattaattgctgacgccgatgaaattgtttcactgtgatttttaagcatccgtgttgttaatggttaattagccgtctgattagattagctcaacgcagtggctgaatggtttggtttacctatcttttaactactagccgttcgagcgtcacaagtggatcgaatcgattgaattaaaagtagtgcaaattaggtggagttcacgcgtaattgcagctgaaaaccagcctaaaccacactgttgtagcgcatcaccaatccattatgtcaaccttgtagagttgttatctaattatctgtaaccatcagaaggggcaatcaaatagaagaagagcattatgcatccacttgtactgtcactctgtcactagtgtagatttggcatcccccacatgggcagcaaagagtaatctaattgcttagctgcaggctcagctcagctcaggccttgacactttcttgcatgattcagtaattgacaattaaattatcatcatcatcttgtgcaggccccagatccaagcttggaatttcttaattaccgtgatagagatctgagagatattagtaaaacatctcacagtgcttgtggctgattgttgaaatgtcatttcattaacctggtcacagtttttaactggtctttgcagtctcagccaaagttcagaacgagacgaaactggtggtgaggcctttctgacacttggcaatttggttgccaggtttacgttgcaagggtagcgtaagcacaaggctatagagctcatagcctttaaatcgaagacaacgactttgcataaatttcacagaaacgacatgtatcggtgctactaggttgtatagacttcagtaatttgtttttgcaagacgagaagaacatgaaaaaacatgttttttttttcatggatcaaagctttgtacagagaaaagacaaaggagaagtcaaattctcctttttgcaagtaatactactcgttgggaaattagttcttgtctgagggtctttgaggtcctgaccacgtaaaggtaatacatgaatgaccatctcaaatatttgaccattgaatttttcaaggaaaaatcatcaaaatttgaacaccaagaaaaaaaaattaccttgaattttcgaagtaaaaaaacagaacaggagcacatgtgaacccatgccgcagaagaccacaagattcagtcttgtgatcacagaagaacagaataatcttacttagctaccttgttcataccgccaagaacttggtagctttctccatgaacaagccaactttacagatcaactattaaaaaaaattatgataatttgccttcagaaactatgccattggaatcatacaccagtaaggctcaagcataatacagaggccgaattaacagctaataatatcaattaaacctttccatttcagccactgtttcttttggacaaattaataacctgacagtaggtagcaggaactaatatttacatgcatatatttgaaacttgtcagtcaaaacaggcactgaattacgaggttaattagactgcaaaaaagagagaaaaaaaaccaaagaaagtgatcaagaacaggtgggaagaaacacaaagcgagcgagaagaagaagctggttagtcttcaactccactcacaaacaattgattttttgctttgatttctctctcccgccgatcgatctgcgagcctcgtcgtgtccaagaacaaattgaggttacttgcctttgcgaatccgctccgaattttggtttttgaatttgaatttgatagaagttggagattgcccgccttggtgctaggccttgacgacggtcatcatgcgcttgaactcctcgaagctgaccatgccgtcgccgtcgctgtcgacgaggcggatcatgtcgcggcactcggcgacggcggggcggccgccgtgctggcggaggccgagggactcgagcacggtgccgagctcctcggcggagatgaggccgtccttgttgccgtcgaacacgtcgaacgcctccctcaggtccctctcctcctcctctgcttcatactcctcgtcagcggcggcggcttcctcgtcggcggcggcggtggaggggagcgggtgctgctggtggctcttgcgccgcttggggatggagtcgtagagctcgcggaactcgtggatatcgatgagcccgtcgctgttggcgtcgacgcgggccaccagggcggcggcctcggcggcggacgacacggcgatgccgaggcgcttcagggactcctccagctccgccgccgtgatgaagccgtcgccgtcgtggtcgaacgtggagaacacgatcccgaggtcggcgtccgggtcaggccgccgcggctcctcctccggcctcttcttggccaccaccaccacctcctccccctcctcctctctccgcttcttggcatcgccgcacttcttggtcgctggcgaggaggaggcgagggagaagagggcgcagaggccgccgaggaggaagaggaggaggagaggcgccatgggtggtggttggggttggcagcgagtgaatgtgaatgggagaagtggaggagacagggaggttaatatatgcggaggttggaagcgatggtgctggcgaagaagaagaagaggaggcagtcgcagtcgtcagttgccgatcgtgcgacctggtggtggtagtagatcgatgggtaattttcacttgcgtccttgtgtgatgctaatattacagtttaagaacttgggagaatagtactcccttcgcttcgtattataagcagcgaattaaatttgaaaatataatgttcatttattttatttatagaaatatccgggattcaaaacttttacaaaaatataccgtcgatctcgcacaaccattgcacgaaagtgacatgggcgtgacgtcgcgggcggtctcgcgcagggaaagcgcgagaccgcgcggtctcatgaaatggaagagcggtctcgcttaaccaatcagcgataccggatttcaaaatagttaattagtgattaattaccataattagtgattaattaattattatttaatcactaattattattagttaaataattaattaggtcattagtcactaaccaaatgcagtttaggacggtgtcgctctctgcttgagcgagaccgctcgtccatcctgcgctctcgcaccgtcgctgcgcaagactgcgccgtctcgcgctttctccgcacgatatcgctcacccttgcgttattttcgctcaacggttgtgcaagatcgatggtatatttctgcaataaaatttatatcctgaatattcttgaaaataaattgaataaacaatatatttttaaatttaattctataaatagcttacactttttaaagtcaaattgcttgaaactttaacaaaatttatagaaaaatatagcaatatttataatattaaattagttttgttaaatgtaagtatgtaacattgaatatattttaatagtttatttgttttatgttgataatattgctatatttgtttataaacttatacaaagctagagaaggttgattaataaaaaagtcaaatcgatttataatatggaatgatgttgtatccaaaagtggctagtactattggttgaggttaccgaccaattttaaattttaatttttaattagatatgtaataataaaaaaaaggtggctagcttgtatccggtgttttatgaaacattccgaaactttgattttatgaaacatattgcaaatcataggatggtatgaaacatatttaatcttcatataactacgagtttatttattactagtttcttttgtcaggaaattatcacgtacatttaacattttcctttctgataataaaaggaataaacaggacatgtactgatgtactattatctaaaaaatgtactgatgtacttacatagtactgtactgt

SEQ ID NO: 71161 - DNA, 6761 bp, Oryza sativa
ttctagctgtctttcttcactgctgcagatacatgatttcctcaaacattggtgaagttgcgtcaattttcctaacttctgctctgggtattcctgaggggttgataccggttcaacttctatgggtaaaccttgtcaccgacggtcctcctgcaactgcattaggtttcaatccacctgataaagacatcatgaagaaaccgcctagaaagagtgatgactcactgattactccctggattttgttccgttacctggtaaatgatctttctgatcttctatcatttatgacaaaaatgattcatctccttggccttacattttgagatgatttctcatgagctataccttattcgcaggtcattggcctttatgtggggattgccacggtcggcatctttgtcatatggtacacacatggatctttcatgggcattgacctcaccggagatggtcacacccttgtcagctactctcagctctcaaactggggccagtgctctacctggaacaacttcacagttacgcctttcactgctggagctaggactttcaccttcgatgacaatccatgcgagtacttccatggtggcaaagtgaaggcgacaacgctctcgctgtctgtcctggtggcgattgagatgttcaactcactcaacgccctctccgaagacactagcctcctgaggatgcctccttgggtaaacccatggctgctcctcgccatgtcagtgtcgttcgggctccatttcttgatcctctacgtgccgttcctcgcgcaagtgtttggcatcgtgccgctcagcttgaacgagtggctgctggtgttgcttgttgcactcccggtggtgctcatcgacgaggttctcaagtttgtcggaaggtgtcaagctcatcaggccccaagaggcgaccaggaagcagaagggcgagtaaaatgctaacagtgattcttcagactcatcagtaacaaaagtcactgaatttgttgtgatcaagtaacaatgatcaccaaatgatgtttattcaatagaaatatgtccaatacaagaaagttcaggaaagagattttctcaaaacaggtcatcactctttgggaagttgataacctttgctgttcttttattccttgtcctaaatggtactatactgagctcacagcaaaccagcaggcagcagcattgttctgttggcaacattttgcttctgtgaattattatatatagatgaaatatttagatcaaattatacacatttctgcctaccttattatgcttctgctgtgtggtttctgagctggttgatctggcaggccaatactcaattaattctccctgtgaattgtctctactatctacgtgtgtattaacacctttatatattaatttttactagaaaagatgctctgttgcgcaacaggtgaatactatttaaatcttattattgttatacggtttagctaatgtgaaatttattgtgggaattcacttggatatttttttgttagaaaaccatgagctgcaattaggaatccggcatttatctcaagttagcatgcgtgtttttaaagatatttcttatacgactccttttgtatttttaaaagatccgacttaagcacgggtccttatttttaaaagcaaacgaacttaaaatccgtctcaaacacggatcagtatttccaaaagcgaacagaatacagacaaaaacatattcaatttttataatagtagagatatgcaccacttcctgaattcaatatgagctgaaactggtagccaggtctgcagaagtatgatatctacaccgagcatacaaacacaactcaaggcataatggatcgaggaaggataaatgagtagattgatccacctctccgttgaatctcgctgggccatcagccacgtgcacaaccgagcgatcaaggtgttacgagaggaaaagggaggacgggaaaaactcaaaaataaagtcgcttatcacctggtggggccgtgcggttgtgggctggggcctgtgggctcgccgctttattgtatcttcgtgagcagccgggttgtctccttagctccatgattcttgcatccgatgcgagcgatttcaacagatgaaaaaaacggaatgaaacgggaacgtcggaagtttacgataactgtgtccgacacgatctcgcagtgacgtactaaaatccttggcaaaaaacaccttgaatttttataataggtaaagaaagtgcgtagtatacagtgttacaattcgattcagttcgtgctcaaattactcaaagaagacaagggcacaaggcccatgggattaaacaagactatatttatatattctctacaccttacaacactgccgcagcgtgattgtgtgttacttatacacttccgcatgaaacatgcaaacaacactcttcactctcatcttttgctgcttgcttaatcttttcactgacgatatgcagagtttcagtaaaacacctgtcatcttacatgcaaccatatacgaaggctatcagcagcttcgaaaataacagtgtaacgtacttcgtataaactggctcaaagataccagcttaaaacgctagttggttttcaggatttcgttcagctgaatattaggctaaagcaagcacgcaagaaaagaagaagacagtgtaacgtactacatataaatcgcaaagggtggtcggagttttaaacgccgaccccctgttaataacagaaacatcgaattaccactcggcccaattgcgattcgttgagtacgctttgagcagctgatctactcaatctgagtcacataacttgatccaacggccagtagagaccctaatagggtcggaaattttgatctccgacccaccccgctgagcttcatgatgtgccttgccagaacgcagccgtaccaaggtcgacaacacacaagaacacaagcagtttattttccggtcgacaatgactttctcttccctcagctggtcacaccttttttttaaagggactgtcttaaaaaaaaaccatctaaatcttcggtttttatttttttaagggaatgtcttaaaaaaaccatctaaatcttataattgttagatcattaaattgctttaagatttatgcacgctcccctaatcctaaccccctctttctttcctttcttctccttcccgacgattcgatgccacgacgcgctccaccgcttcctgccccaccgcctcccatcaagctattgcctggcctcaccggttggccggaagaggtcatcggcgctccacctcctcctcctctcctcctccactttgatggcctaatgtttactagtgacccaaatgggaagtcggagttttaaactccgaaccctgctgcgtgcagaaatggacataaatttgaggcagaagcgctattgttttttaataatatataatagagaagatgaaatatttagatccaacattgctgcctcttgttactttgcttgtgctgatatgatttttgaggaggtttcactggcagctggttcatgcatgaattctccctggtgaatttttatctctacaatctatgtgtatttacactttcattagttgtgtattaattatatcattatcttttaaagtatggttagtacattgttacattatcaattcaggatgtcttcagctcaaagacagcccatgagatttggtcttcctccgccatggccgtgctcggcctcctcgtggcgagcttacatattgcttcgttgagcaagacgtacgaagcaccagtggcgacactacaagaatcaggaattttagctagaaaccgtcaataatagaattataatcgccaatattttatacagtatccatcttattgaccaacctgaaagtaccttaatgtcgcctagagaggggtgaataggcgttcctaaaaattatcacaacttcatagcatattagaatgatgagaactttcggttcaaatagtaacttccgatatgagattggaagttccggtctcaaccgaaaagttcggcggataatggaagaaaacactactagctatgaaattgtagctcaaataaacaaaatgtatatgaataaaaaaggtgacaaataaggtatctaaacaagatataaggtcaccaactaaatcaattaagcatgcaagtagattaggtaaaaacaagctcaagcacaatatgagagaatgcacaaatgggcaaaccaagagaggagacgcgtgatttgtttcccgaagttcggatccacggatcctacgtctccgttgaggagccacaagggccgggcctatttcaaccttttcctcacgaggttgcacaaatgcactcctcggtttcactcttgatttcttcccttgcggaggcgaaattgaagccttcacaaactttccgtggcacaccacaaccttgggtgctcaccggcgacgcctagccgtctagtagatcttagtccccaagagtaacaaacacaatcgaagatttgcttgctatgaactcgagtgctcaaagtatggagtgaagctcactagctctcaacttctcaatcactcaatccaactctttccccttctcaaatccctctcacaaagaggcaccacaaaggatggagtgaagctcactagctctcaattcttcactctctcaatccaactctccccccttctcaaatccccctcacaaagaggcaccacaaaggtagagaaatggggatggctatttggctttgaatgtgtctaatactccccaagagcagcagccactcaaaggaggggtggaggagtttatatacccgagccccttaaaaactagctgttggaggccaagactgtaattttcggagtttccgaaaagcatttttggacaagtccgaaaacttatagaagcaaatctcagattcgcagccattttcggaatgtccgaaaattttcggagtttccggtaatttttcggattttccaaaaagcacagagtaaaacgactataacttttcgctcggataacttttcgctcgggagtctgttttttatgaacttggactctatggaaagctcactcagaggactacccaactcaaccaaaaacaaggtctaaaaccactcaaatgataggttaaatcttgggtttctctcaaggtagcactatgataggtcactttgagcaccaagacatacacaaacacctcgacgttgcatccctcttaatagtacggcattcctagactcaaatgtaaataagaagataattataccattaggaatgcctttttttcatctttctttcattgtcttgagggacgccaatgccgataccatttcaccatatattcttcaaacgattgatgcggttacttgtagcttcaaatggtctcgcacggtccatcatgataaagccgtcactcgcccttcaccaccggatttggttcttcggcgccaagccccttacttgcccttcaccgtcgcatggtccatcgagaccgagcatcgcttgcccttcaccgtcttgccataatagccacttcgtatcacacatcttcaatatcttcactttgtcactcttggtattgttaagtgtaatgatatcacttgaacatcaacacctttgtaatcctttggacctatttctttcattcaactcaataaaattattagtcccaatgatccggttgtcaaccttcacatgttgaccaaccaatcgcatgtataaaagtatatgaataaatgatgagtattaatcaacaccacaagtgtcatatactcaaatataaagatcccaattaaatgaaggtgaataacttggatcgattacatgcataactaaagtataggatttgctccccctaaatgtatgcatacaaaatatttgtgtgaagcaagagtatgcataacaagatattaaacattgagagcttatcctatacaagaatagaaggcatttctcaaatatagatattaaaataaaaacataccttcatcatctccacgttctcaatgtaaatagattaaataagagataatactcaaacaaaacattagtctcacatgcatatgccaatcacgtggaaatattatatacgaacatatcaatatgtacatgaagagaaagattgatacatatagcttgatctccatgcatttcatccttgtgatttaggtccaccaacactccactttcatatccacatgagactaggcaaacaaatgtttataaaaatattagtctcacataattggatttgttattaatcatcaaaaccaaatcaatggcacttgaactttcacaaccatcaagaaataaccgccaagcctaaagaggaaattcaaataccttgtcggctaatcatcagtaaaagttttactggcggttagaccggcaataaaattgcattcatttctaactttcggtagcgccaagaattataaccctgtcagtctggagatgcaaacagattgcaccaccattcgccggcgttagagatgatggagggaggctagtgacccatacgaggggttggagatttaaattcggaaaaaaaatccactttgactctgtcggtgacatggggccgggggtatcgtgactagaggcttgggtagccgcggtcacccacgtggcctgaccccctcgggggggtcgggcccgaaggtgacgtggccacccctccctctgtctccccgaggggtcgggccgctcccgtttcggccccgagggctggggcgcccgaccccctgtggttttggcgccacgtgtgtgggtta

SEQ ID NO: 71162 - DNA, 10454 bp, Oryza sativa
ctcctaaccacatttatagcaggttggacgagcgcgccacgccgcatttaatgcggcgcagcgcacgcttatccggtccgtgaccggtcgcggtgagtgaccggtcacagaccggtcagatcgcgggttaggtggcaataggcgacctgtcacacgcctcgccccatcccgtcggaatgatgagagcttcctggctcttgtccctagccggagccggcgtgccaactccaggagttggtatgtcagtcccggtcagattcgttccaggcttcagcgcaagtatggcaaggaagtcgctggccattaaatgaaggttgaaatgggcgtccaccgggaaaagcgggcgagcggggcaggaggcgtgcgctctgctttttagaagtcatttccggctgtagattagccctgattgtaaaaagcatgtttcccttcttaggcagctagaggcccatgtggtgacccctgaccagataaaaaggaggcccaggcctaagaaaagaagaggggggaaaagaaaggagggggagttgggactctggcgaatggttcctagagcctgaactctctctcgctctccgccctctggattccttcacacacagatccaccagaacacaggagtagggtgttacgcttctcagcggcccgaacctgtctacgtcgcccgtgtcttgcgcatttcttttctcgctgacgttcctcagatcgagggcgaagaacctcacttagcgcccccggccgaaccggcaaaggagggcctgcgcggtctcccggtgaggagccccacgctccgtcatctggcgcgccaggtagggggcgcgcgtgtcttttgaagccctcgtcctctttcgtgtgcgccaagcttctcccgctcagcccaatggccgagcgggcagtggcgcacaggctctctccgaacgctagcggtgacgacggggagcagaacccgcgccgtcgggctcgcaccctaccgtccccctctcgccgaaatcttgggcggggggaggcgctcggggaggccggaggatccgcgacttcgccgcccgcgggcgacgggggaggacggcgagacggggcgcgtcgccgcctcgtctacggcgatggcggcacgccccagggcgcgctccaggctgcgggcgcgctcctgcgtcacccgcccgtcgtccccgatccagagactccagcccgacgttggctggatgatgtggccgacttggtcatgacggcgcagcagcgcctaggcgccggcgggcggtcctccgccaccgagacctctggcgctgccgccgccggctccatgtcgtcgaggcggagggcgcggcaagcggcggccgttacccgccgttcgtccgccattccctcgtcaacgcctccgacccaaggagatgtgcgtggggggccggatgcctgcctcgacatcgagcgccggcgcgacactcgtcgcgccgcccacgcaacggagggcgcttcctcgttcggagcaccacttcggtccgggcacgggggccggccccccgtgtccccggttggcggtgccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccggggatgacgacagggtcatggcgaatttcttccccatggccctgaagggtcaggcgtggggttggctaatgaacttgccacccgcgtcggtccactcttgggaggatttgtgctagcagttcaccacgaacttccagggcatatattcgcgcccaggcgaagaagcggacttgcatgcggtacagcgaagggacgatgagtctcttcgctcgtacattcagcggttctgtcaagtccgcaacaccataccgtgcatccccgcacacgcggtgatctacgcgttcagggggggcgtgcggcacaaccgcatgctcgagaagatcgcctccaaggagccccagaccaccgcgcagctttttgagctcgcggaccgtgtggctcgcaaggaggaggcctggacctggaactcctccggttctggtgtggcagctccggccgcccccgggtccgccgctcggtcagggcggcgggacaggaggaggaagaaggggccggcccgttccgacgacgagggtcacgtcctcgccgtcgagggcgcttcgcgggccccccgaaaggggaggcctgcgagcgacaaaaagaaggaggccggcgctcccagcagggagcgcccaaccggcaagtggtgtaccgtgcacaacacctccctccacgacctcgcggactgccgcgcggtcaaaagtttggctgattgagcaccgtctcgccgtgcggccgggcgcaaggccggtccggcagaaagtgcggcgacaggccccggaacgtcaagccttcatccgcgaggaggtggcgcgacttctggaggccggattcatccgtgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattactcccataggaacttattgttacaccacaatgcccttcgggttaaagaatgcaggtcctacttttcaacgtactactcgaatttctttaggtagccagataggacgcaatgttgaggcctatgttgatgacttggttgtgaagacgcgcaaccaagagaccttactctcggatctagcggaaactttcgaaagtctccgctccgcccgcataaagctgaaccccgataagtgtgtgttcggtgtgcctgcgggcaagcttctcgggttcttggtctctgcccgaggcatcgaggccaaccccgagaagatacgagctatagagcggatgcgccccccagcaagcttagggatgtgcagtgcatcaccggctgcatggccgccctaagtcggttcatatcgaggctgggagagaaggcactgcccctgtttaagctcctcaaacgctccgggccgtttacctggatggaggaggctgagcgggccttcactcagttgaaggcgtacctcagttctcccccagtcctggtcgccccggagccagatgagccgttgctactctacctggcggcaaccccgcaggtggtcagcacggcgttggtcgtggagcgcgacgaggacaaccctcactccgcgcatccccaccctgcgtcgacttgacccgggagagaggagggaggagaggcccccgagccgaacggtggcccaaggcccccgacggccggagctggccctccgcctgcttgtccgatggtgccaggcgcccccgacccctaggatggccccggggccactgcgggaaggccgcgcctgtcgccctctgaccccgaggtcgtcggcacagaagccgagtgcgccccgcgtggcctctcggacgaagagcgccctggagatgcggcccctggcgaagaggatcggtcccgccgaaaggtgcagcggcccgtctactttgttagtgaggccctccgggacgccaagacccgataccctcaggcccagaagatgctttacgctattctgatggcttcgaggaagttgcgccattatttccaggcgcatcgggtcacggtggttacgtcttaccccctcggccaaatcttgcataaccgagagggtactggacgggtggtgaaatgggcaatcgaactctctgaattcgatttgcgctttgaaccacgccacgcgatcaagagccaggccctcgccgactttgtggcggagtggaccccagctcccgagcccgtctccgccctcgaggctagctcgggcccctcgcagctgcgtcacaccgcctactgggtgatgcagttcgacggctccctgtctctttagggcgccggtgcgggggtcacgttgacctcgccgagcggagacgtcctcagatacctggtccgcctcgactttcgggcgaccaacaatatggcggagtacgagggactccttgcgggactcagagtggcagctggactagggatccgccgcctcctggtgttaggcgactcccagttggtcgttaaccaggtctgtaaggagtaccggtgctctgacccgcagatggacgcttacgtgcgccaggtgcggcgtatggagcgccacttcgacgggatagaacttcggcacgtgcccagacgggataacgcggtcgccgacgaactctcaaggctcgcttcctcgcgagcccagaccccaccggacgcctttgaagaaaggctcgcccagccgtcggcgcgacccgaccccctaggggagacgaacgcgcctgaacggcccccgaggcccgtcggagtccaggccttgggacccgaggggagcgctcccagctcccctagattgattgcttggatcactgagatccaggcgtacctcgcagataagactctacccgaggaccgcgaagggagtgaacgcgtccggcgcatctccaagcgctacgtgctggtggaagggaccctctatcggcgcgcggctaacggagtcctcctgaagtgcattcctcgggaacaaggcgtcgagcttctcgctgatgtccatgaaggcgagtgcggagcccactccgcctcacgcaccttggttggcaaggcctttcaccagggtttctattggccgacggctctcaacgatgcggtcgacctggtccggcggtgcagggcgtgccagttccacgccaggcaaacccatcagccggcccaggccctgcagaccatacctctttcgtggtcgtttgctgtctgggggctcgatatcctgggtccattcaggcgggccccgggcgggttcgagtatctgtatgtcgctgtcgacaagttcactaagtggcccgaggcttatccagtcatcaagatcgataagcactccgcgcttaaattcattaggggcatcactgctcggtttggggtgcctaaccgtatcattacggataacggcacccagttcactagtgagctcttcggtgactactgcgaagagataggcatcaagctctacttcgcctcccccgcccaccccagaagcaatggccaagtggagcgcaccaacgcggaaatcctcaagggcctcaaaaccaagaccttcaacatcctcaagaagcacggcgactcgtggatcgaggagctgccagcggtgctctgggcgaaccgaaccacgccaagccgagcaaccggggaaacgcctttcttcctcgtctacggcgcggaggcggtcctcccatctgagctcaccctgaggtcccctcgggtcaccatgtattgcgaggctgatcaagatcagctttgccgagatgacctcgactatttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctagtgggggtcgggtgtcatgcctcgggctcgggccaaccccgcacccccctgggcgtgcagggttggccgggggctaccacatgcatatacttaccttttttctcttccgtatctcaataaaagcattttcgatttcttgaggactgtgtctgtgccatcgtttccttttgaagaatcttggcttgaattagcatgctcgtgctcgaccctgccctcggtggcccgggccggctaaaatcgccaaacggggcccagaactgagccgtgccccggggcgtggcgaactccgggggggaatcggcaaaggcccacaatcgggtcatccataaccctcggtcaccgcactcccggcctggccagtctcgacacgtggatctccccaggcactagccctgacccgcgccgtttgaggctgggacctgggcacgagcccttgttcaagccaagacacagaagaaccgcggcacagaccatcctcgtctcatacacacaacaaacagagctgacgcagaaatttcctctttacttgattacagattaaatcagtctatacaagaagggggcccgaaggcctcggaagaagaagcaaaagttattaagattggcgggggcctgagggcttactccgacgcgcccgggtcgtcggcctcgtcgtcgctgtcgtccgcaccgtcgtcaccgccctcctcgtcggagtcgagcgcgaacgcgagccgaggggccgtaccctcgaagctgtggacgatgtggtcggcggcgtcccggacctgcgcgcgtgcgctgtcctcggttccgggagggaactcttccagcactgcccacggggagaagtcagggtccctggcctggtagcttgccagtacaagctccaccgtcccccgggcgaggtccctcgaggatgacttgatcgtcccctcgagctcctcggggagccgctcgagggccccggtcatctctgagaggcgctgggcgaggcccccctggttggcggcgtacttcgcgtgccgcccgccccagaggcccgcccgccgcccggcgcggtctagatgggagacggcgtcccaaagcatgccgggccctacttcgctcgccaagcggagggcctcgacctccccggcggacgagtccagcgcgccctgcagctcggcgatggtgtgttcggcggctgcgaggcgggcgactaggtcgccgtggcccgcggccgccccgccgctgcgcgctctcccgtccagctccttcgcccgcgcctcgagctcagcggcccgctgatccagtgcggccctctcggcgcgggcgccttccagattgcggcgcgcctgctcctcccgcgctgcctcgcggaggaacaggatgtccgccagccgctgcgccgcggcctcggcctcctcgagagctcgcccccgctcggtgagcgcgtcctcgcggaagcggagtgcggactcctcttcggcgcaggcggcctcgtgcgacggcggcctcgcggtccgccaggtctctctccttcgcgtccagggcgcgggcgcgctccttcagcgccgtggagcgagcctcaagggcctcttcgcgccaccgggacgccgcctcgttctccgccgcccgccgttcccgggcagcggcggcgtcaaggaccccccgggcagcgtcgagcttctcctccagctccgccgcccggctcccgtattggaggcggaggtcattccgcgcctcgtcgagcacggcggtggcgatgagggcagtctcccgctcctcctccacctccctggcgatctccgccaggtccctacgacgggcctcgagctctgaggcgtgccggcggtgtgccttgcgacccgcctccaccatggcctccaccgagcgccgcccctcctcgacgcgcgcccacgccgcgtcgagctccgcccgctccgcctgcagggcctccatctgggcacttaacccgtccagcaccgtgctgttcgcggcggccaaggcctgcaggaagggctccgtgctcagtggggcagcggaaggccgaggggagagccccctcggtgtgggtgccgcgcggctcggcccgccgatcgacgtgccggactcgggggcgccccccgaacctggctcgtcccaagcgtcgcccgaggggtcgggcccgagcggcgcgcccgcggcctcgtcatgggtggcctctgaagtcgtcgtcgcctcgggcggaatcgagtcgggggtttggcaggccacctggcgtgcgcgcgccgcctctgccacccggacggactccccggcccggcggagtctggcctcctcccgagcggcctcctcagcctggcgaacccggacggcctcctgggcagcctcctcggcttcccggaggcggtccgcggcttctcgccggtcagcttcccgcctccgggcctccgcagtcgccgtctcctcggcctcagaccggccggactaggaatggcgggggggggggggcgacgggatctcgctgaggcagaagaaaaaccagaagacaaaaagaaacgggtgagtgaaaactcgccttgggagatgggagaatgaatacggccgcggtgggcgcggggacgaacctgcggggaggtcggctaaacgaccaccttgggggcgagatgaggttcccccggcatggtacgatcccccccatcttgcggagccgtttcttctttcgctccccctcgggctgcggcgtcggcacggcaccctccgggcgcctgctgctggcacgcaccgccccgccccctcggggaggagatgggggaggagtaccctcctgcttcctcttcccccgggcttcggcagggcggctgccccccgggcccccgtcgcggggcccagaagcacgaccccctcccggggtagattgttcccccctgcggctcccgcccgcgccatcgtggcctcggggggcccgctccccagacgccccgaccacctgcatgatggtcaggatcttggcgcgctctggatcgcagcagagggggaggaccccttgggggatgagggatgcctccacggagctgagattcagcacccgttggaccaccatcctgaagacctcagggtcccagtcccatttgcacccctggtgggtcctcatgtagtcctcgggcccggtatactcccaggcgccccgggcgcgccgctggagcggcgcgatccggcgacgaaggtagtcgccgaacaccatggcctccgtgagcccctgggatcgcagacccgccaggcggtcaagaacggcgtcgtagccgtctcccagatctaccgtcgcccgccagctggaggcctgcgccgggggctggctcggaagtcggaggcgcgcttcgtcggcgaggggggtgtagaaccaatcgctcttccagtcgtcccactttttgcggaggacgcagggaatgtagcggttcagcacctgcccccgcggctggaagtagcagccaccgactaccgtcagcggcgacaccggctgtacggtgaagaaccaccggaacagctggagagatgggcgcaccccgataaacatctcgcacaggtgtgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgcccgggtagtgtggcgccgggcgtccctcgcccagcgcgaccacctcccagccggtggcagattccggcatgaatcggcgcggcagcccggcctgcctctcgctcacgatgcgggaaggcggcagcacgctaccgtcgagcggtgcggagccccgtgccatgacgccggcggaggaggagcttgagagcgagcgagtgcggcaagggtagggcaccggaaacgaagagttagagcacaagtggcgaaggcaaggggaagagtggcgagaggaaagaaacgaatccctccctcggcgtctttacacccttgccaacgctatgcccggctcctcgattcccgcgcccactacctcgccccctcgtttctcgcgcccacgcctccactaaccccgctcgcccgtttgcggcgcacgcggcagatgtgcggccgtggcagtcgagatggggcagatcgtgcgcgcattaactacgcccgccaaccgtgaaatgcgccgtcatcatgtctccaggcgaaacaaaccggctcgtcccgattcgcgcgctgctcgagtaatgtagcggtcttaaagaggccgctcattattgtcggtcggttttcccttgccgatgcgcgcgatttgcgaccgctgggtttctgcccgcctgtagggaccggccccacctgtcaccgggcctaaggagtggcgtcacgcccgagcgcttccctcgaggggggcgatcgccctggcgtaacgccgggggctactgtcggtgacatggggccgggggtatcgtgactagaggcttgggtagccgcggtcacccacgtggcctgaccccctcgggggggtcgggcccgaaggtgacgtggccacccctccctctgtctccccgaggggtcgggccgctcccgtttcggccccgagggctggggcgccccgaccccctgtggttttggcgccacgtgtgtgggttaggtgagcacagcggg

SEQ ID NO: 71163 - DNA, 2375 bp, Oryza sativa
cgtggtacggaggggtagctttgtaacggcaggtaggcgcatcagcggttatgttggtgtagtacttgggcttgcttttcactagcttttggacggtcagtggagtggacggagagactagtaaggccttgtttatagtttctaaacaaaaactttttatccatcacatcgtatatttgacacatacatagagtattaaatataaaaaaaatcaattacatagtttacgtgtaaattacgagacaaatattttaagcataattgcgtcatgatttgacaatgtggtgttacattaaatatttgctaataatggattaattaggcttaataaaatcatctcgcagattcctggcggaatctataatttgttttgttattagattgtatttaataatttaaatgtatgcacgtatatccgatgtgacaaccaaaccaaaaaaaatttccccaactaaacaagccctaagattttctaaggttgcacccaggataacgagtgggtcgacccacgaacccacttatagataaaattagtgagtaatccacgaatcaattattaatttaacatataaatagatttatgggttggtccacatccttagataaaaataaaccggaccacgacattgccagttactatttggcatataaacgggttggcgggtgagcttgtttgcatctctggactctagttgtgtcgtacggagtgtactagtatttggcttcggcaccccgtggagtgcgtgcgtacctcccacggtgtggtgtgatacgtgtgatttgtgccgttaaacgtgacacatggacctttttttttctgagaaacacacatggaccttgttgatagtagtatttttctagttttgccgttgtcactctaggcaacccacaaattcacaagatttggcatgaaaaattaaatcttcacaagtaaatttcattttgggtcactttcattactgttttggtttagaccacactttaagaaatatttttattttgaactaagtaaatttaactttgtggcattttagaccaccctaaactatttttatccatttgtatctacttgtcatatcaaagcaatagtctacgtataatttaactatttttagtctatgtaaggttcattgacaagcaaaagtcgtcgtactcgaaattgttcatatgcttgataagagagtcaggtagtctaaagtaaagtaaaggtaaaattatccaatccaaaataaatacgtttgttaaaagttaatccaaaacaaaatatcggtaataaaagacaacccaaagagaaattaactcaatattcacagctatacctttggctttcaccggttaggttacgactacaagaggaacacgactgcaacataaaatcacatcgatcccatgctcccttgtcgtcaagcagcagcagcaacaatccaagcacacattaccgtagaaaaaaagccactggaacacgtagacagatggacggctgattgagcgaacagcaaacaaaggagacgtttggggcacacataaactcaggaaaacaacacggcagcagctagcaacagggcgtaccacctattttttctacaagatacacgagcgaccacgtattgctcggacctggagttttatcaaatgcggtatatatgcgtcgtatataccccgggccctctttaactccgacaaatatgtgttcagaagaacaagtcgttgctctgtaataataagtgaagcaatcactggcttaaatagtttcctgacctgttcatcaccttccacctgagataatgaacagagaaatcagatgcagacaggtggcagattagtagatgttagagacttgttagttgcctgcgcatcagggcggaaggcttgtgattatcctttttttttctttccttttctttacaaatgttcactacacttttccaggatctttgaacaattttttagaccaaaggatatttcttctttttcctaagataatctctagtgctgcttgcgtcatttgtgccaacttttattgtttgttataagcccgaaatggacctaccaaagtaccacatataagctgaaccacttgcccttcaaaatggttgcaacacgcagaaactgagctagtggaatggaacagtttttcttataagttggaaccccaaattatctggacatatacatattgtttcaacagatcataaaagcttttgtgactaattaattgcacacattgcacgagttattctcaccaggttagtgttccctccacaaaacgtaaagtccacctttctcccaaatccaaccaagagtcacaggaaacaaggggggaaaatagaacaaaattcttggcatgcaatgatgcaactaaggggctgcaggaa

SEQ ID NO: 71164 - DNA, 6530 bp, Oryza sativa
tttcacaggattcagtcattttgtgtggttctgggattctagcttgccctaataacaaggtgatttacatgtttcagtttggatctttgggacaaaacaaggtgatgaagttggtgcctcctgtctacaggtataaatcctatttgtcagatctcttgtcctttactggttagaaacaaacattagcacattatattattattgttcttatcatcacatgagctaagttggatgaagcattgaagcctgtcctgccttgcagctgcattttactactccctccgtcccaaaataagtgcagttttagcactatttatgtccaatgtttgaccgttcgtcttatttgaaaaaagattatgattagtatttttattgttattagatgataaaacataaatagtactttatgtgtgactaattttttaaatatttttcataatttttttaaataagatggatggtcaaaacgctgagtacgcatatctatggctgcacttattttaggatggaggtagtaccatcaacataaagtatcatatcttggtcgatttgttcagtgaaacgtttatatattcttttcatggctttgacctgtcagtcaaacaatctgctgccccttctgggctactgctgccgagttaccagatgctaacaacctaacagtacagtaattccattgttcttctgcttcatctgtgccaccacttgatggttgtggtttgccaacatttaatctactagtactgttttcttggtttttcgtttgatgactcattttgcatccaagaacacgacaactgttagctaaggattgcacacgaaccaaagcactggtgagtgctgtcatcatatgaggctcttgacacttttccagttgttttttgcgattggaaatctctctccttgaaactttttctcttttttttcttcttctcctcttgagcaacagaaaggtgaaaactttttgccatggccactttatccaccccaattccccctttttccctctctcatctgggaagattctttggttgtatcctgagagctggtttgacaggcaaatggtttgctccatccaaggtgctgttaacattaagcctgcactgtagtaactttgacagtcattcacaggcacaggtatggtgaaagtatggaatctctcttgtgtttatgccattgcttgctttctctctggctcatcacagggcttgctcgtgctcatctgggcctgtttgtgtgttgttgcatgacccatcccaatcagaagctggctggacaagccatggtggtgggagaactgggaactggcaatcacaaccccaaagctgctccccttttggccacccctactgtgtttgtgtgagtgtgtcagtgaccaatgctaagagcaggtacaatagcaggctctaagccagctgcaaacatattttaaggagataaatgaggagagagagaggagagaagcgggctacagatttatagccagttgtagcacggactccaagacgcaatgtgtgtatgacagatgggaccatgtattaatagtgtagtatataactattgtataaatgagctattagattagctatagatgaattggagccggtagttggctatactattagacttgctctaacaggagggagtatactgcattgctagtgctactaccttgcaactgtttcagatgctatacttactactatctcccaattcaaaaggagtagcagcaaatccgaaccatcttggtaggacagtatacaaaatttttgaaatgatggtttgaagatactagtctggtctttttggacgatgccatccgtaatcgatggcaatggagtactgttagcttgttcttgattttgtttgctcatcactgcatttgctccatctcgatgtctgtctgcagatacatgggacccctaatctcctcttgctagattcctcaaaagcatcaccggccatgagagtgagctcaactgaaagcaagcatgcattgcattttcatttatacatttttcagtgaatacactactactcctactacaaaacctttgttttgaagccaaggaacagcgagatgcagcaggagcgtggcgtggaagctgacaaagtcacaaagagatgtctgcttattaatttgggagcctggactttggcgtgccttgtacaactacacaaaaagatgtgaggtaggtgaagggtaatacatgatgcaatttatacccaaaagattgattggtactccactctactcctgcatgaacatgaggcatatggtatggtcaagtaccgagaagagagtgtacttcgagagaggaatcaaatctgccaccaagtcagtgccaccctagcaccatttatcagtacagtaccccaagccccacaacagtacaacttctacccccccccccccctccctccactgctatggtaatgcaacgcaatgcagtattggaatgcaatgcttctcaacactctgtcaacaaggaagaaaattgtatgaaaatgaatgcatcagaagttcagaacagattcaggatggaagcaaatgaacagagattcatattaataaagctaaagattcatatgctacattaggaaagaagaacactacttcgaaacagggaaaattccactgctatggcaatgcaatgtgttctaaatattggtaatgcaatgcaacactctgcaaacacaaaccaggaatgaagaaattgggatggggatgaatgcatcagaagttcagaactgaaacaaatgaacagagagattcatatatcatacagctaaaatcctttggtccaacaaaacaagaaggggagaatcaaagaagaaaagagtccatgaatcatcacagcaattcattcacaacaaacattgctcatcttcacagggactctggaacaaccaaaacagaaaatgaaacccaagaaaaaaaaatatggtcttctttttcttcttctgttcttgtcaacctcatgagccatgacggtcaaatcaagaagagaatgaaatcatcatcccctgcacatctcctgcctctccccctgggcgacctcgccgccggcggcggcggcgacagatgacaccctgggcgtgttggttaccgagtagaacaccacgtcgctgacgcttctcctctgctgctgtaggtgctggtgctgcgacctcttgcagtgcgcaatggcgccctggatggcgccctcctccgacgacccggcgctgctactccgcttcagcgccggcgccgccgggaagaacctgctcgcgttgccgcaggacggcgtggacgacgacgacgacgaggtcgagcacagcggcgaggtccccggcgccgacgccgacgccgccttcgtcgccaccagccgcacccgccggatgatgccggagaaggacttgcggtggccgcagagctcttcctgatccatcacgccgccaccattgccgccgccgacgacggcgatgccggtcggcttggcggtggccaagaagagggacttgatgtactccctcgacgtccacctcttcatcagcttcaacctcttggaccacgagtacttcttggcagcacacaccttgctcatgtcaaccatgtcgtcgtcttcaacctccttcttggtcccctgcacctgcacctgctgctcctggagcagcttctgcacgagctgcagccgcggcggcaggtggagggggaggagattgcccttgtagaacagctcgtcggccggcgacgcgaacgccttgctgaccacggcgcccgagctgtggaactcgaactcccggaatccgccgccgccgcagaggcggggggaggaggggggcagcggcgtggtggtcggggtgaggtccatgtcgatgtagtcctcttggatcaccattgtgggggccctcgccattgttgccacctttgggtggaggaggattggatggacaaaatgagtctctctatacaagtgagggagaagagtgtggtgagaatggtttatagttgtagggttttgtgttggagtcactctactacttggaatggtaagacttttcttttcttttcttttccatgtgcaacaatttttattttttttatcaagaagaagaaaatgtttttttttgtttctggaagacagtgtgtgtgagctggtgtttggtatgggaatgcaaatgcaggcaggaatggaggatgtgcctcacttgcaacagaaattgttgttgctgaatcacgttactttgcatggctcgttttggtttccttttagttcttgattttttctttttatgtcgccagcttctctctctctctcttttttaaatcccctttcccttttcttgtttggttgtcaggacaggagacaagcttaatactgaagtactgacaattactccttgctctttcaggataacaaggaggttcatttcatattcagcgtttcagcttcaggataaactccatatatagaatgaaattctctgatttgaactaacataagtacagtagtaacttggttgttcagatttcagaatcttttgctcatgcatgcaggaagcagaagcaggggaagaagtaaaatgttccagctgaaaagtcatatccgctctgcagaatccagacacaaacgcaacaacgccttggaacgtcgccattcaattcaacgcaggtttggtttccgttctgttctgcaaaccccaaagaaaaaaaattaaaataaagaaaaaagaaaaggagtagagtgctcgtaggccggagcaacaagcaaagctaacgatgcaggataaaagcagtcaacaaaagacttcaatggctgtggaagtagtaactgaccagcagtaacactcacacccaaccccattgggtacagtaatatataatctccctcttttgcttctaaaaaaaatactagtaatactccaataagctttttttttccaaagcctaccaacacaccaaccaagccagcatcattgataggctcagcatttcccttctttttaatcaccacataaaatgctggacagatatgatcatctgctctcctttttttcccctttttctttttatctaactcaaaaaaatgattggctttaactactaccctagtacaactccagttagtagttgttgttagagcaaatttaatagtatagccaactactggctccaaattatctatagctaatctaatagcctattcatataatagttaactataaaaatatacatcattaatacccggtcatacctttcatacacacataacgtcttagagtttgtgttacagctggctataaatctgtatcccgttttcttctctctcttctcttttcttctcgatatatggttataactggcttatagcttgctattgtatctgctcttacagtggcttactactatactctatggtggtaattacagagagaaggcagtgcagaagagatgatggcattcattcagtcacaagggtggcaattgtagcttgtttgaccagcctttggctttggtccgaaagggagctctaaaaactttgaacagtgagagcgagctcagctcttaacccaatggggccataggtatgtgtgcactgtgcagttggttgtgcctcactcccacatgctgtgcaaaaacccatttctttacctgccccatttatctccttgagtttaatactacctctcaaaatatagcaacctataataggtcccaaaatatagcaacctaggatacccatcctacaatataccttatgtccaggttcatagtcctaggatgggtctcatcacatcttagatcgctatattttgggacggagagagtaagaatctaagagcttgaacgagagtttctggtacctacagcttctgccaggatcagaacttcacccaaacaatataacttttcgtccagattttaagaatttgtattgtagaattcaaaaaatggactagaagcctcaacttctttaaattctcagaagctaaataccaaccagttgcttcttagaatcttctcagcttcttcttcttcagattctcagaagctagctaccaaccagttgcttctcggaattttaagctcccaaataaaccctgagtttaataagagtagttaggatgggtgcccttctcaatttggttatggtttgattctcgtttaagcattgtttgtttcaaaaaagattctggtttaggttcctttgggattgttggattgaaaaagaaacaagaatatggaaatgcaggaaatagagtgtcatggttagctcaatcctacaggaaatagaaacatgtgaatttagggcccctttgaatcacatgaatgaaaaaatagaggaataggaaaaacataggattctgacagaaatgtaagtgtaaaacagaggattgcaaaacacaggaaaaacataggaatgatcgtttgattggaccacaggaaaaacacaggaatttgaagagagataaaagactcaaaggattttttccattaggttttacctcttgttaaaattcctccaaaacttgtatggaaagagaca

SEQ ID NO: 71165 - DNA, 7657 bp, Oryza sativa
atcaagtctaatttcaaatggatccagccacatgtccatatctgttctggagcggccgcaattgtcattttactcccgactattttctgtccatggtgctgcgtcatctcttttggcccaatgggctgtgtatccatgttgggcccattaggggcgcgtcctagggttggagcacgaccctatggtcgttcttcccctctttttatacctctagtcgccgccaagaacaggcgggttttgatgatagagatagcttcttgctaccggctcgcagcgcgcgtgttggctaaaccgcccgtctgcctgtaatcggaaccccaccatattgtgtttgatagtgaaactttcatctttatctagcaatttcagtgcttgtcctacttgttcttgcttgttcttcgattgcttgcaggacgagtgtcctcgtggccgggttgacgcgcaccacaagttcgcggcgaccattggagacggtgtatcggttgctaaggcgcagcgtctttggacagttgtagtcgggccgtgaacgtcgacttcatctaatcgagttatcccttacctctcatcgaaagatcgggccacaaaccctagcgggttcgcatcatgcacccaacacactccaatatgtccaaaaatcatgttttggtgttttttgaactttttcattccagtctaaaacatcgcacccacctatggcaatattggcattaattcacaaaagttcgccgcgcgaatcacgaagtgagtttttgccacgaacgcacccaacacacaccaatatgtccaaaaatcatgttttggtgctttttggactttttcattccgttgaaaaacaacgcacccacgtgtgccaatatatggcaatattgacattaattgacaaaagttcgccgcgcgaatcacgaagtgattttttgccacgaatgcacccaacacactccaatatttccaaaaatcatgttttggtgctttttgaactttttcattccggtgaaaaacatcgcacccacctatgccaatattggtagtaattgacaaaagttcgccgcgcgaatcacgaagtgatattttgccacgaatgcacccaacacactccaatatgtccaaaaatcatgttttggtgctttttgaactttttcattccggtgaaaaacatcgcaaccacctatgccaatattggtagtaattgacaaaagttcgccgcgcgaatcacgaagtgatattttgacacgaatgcactgatgaggacatcaacaccatcgatacatccacgtccccccatatacagcatgatggtcctattacccgcgctcgtgcacgtcaactaaattatcaggtgagttctttcttgagttcatattcctcgtctttatacctcggagacgcgtgcactcgtgttttactcaggaacgatggagaggatccaaagggaagaggattcgcgcggggtggattcggactgcagggcagcgccaacttctgacggccgccacgacttcatgcgaactccgatttgggcgtgcaagtacttcatggaaagcttatcaagtctaatttcaaatggatccagccacatgtccatatctgttctggagcggccgcaattgtcattttactcccgactattttctgtccatggtgctgcgtcatctcttttggcccaatgggctgtgtatccatgttgggcccattaggggcgcgtcctagggttggagcacgaccctatggtcgttcttcccctctttttatacctctagtcgccgccaagaacaggcgggttttgatgatagagatagcttcttgctaccggctcgcagcgcgcgtgttggctaaaccgcccgtctgcctgtaatcggaaccccaccatattgtgtttgatagtgaaactttcatctttatctagcaatttcagtgcttgtcctacttgttcttgcttgttcttcgattgcttgcaggacgagtgtcctcgtggccgggttgacgcgcaccacaagttcgcggcgaccattggagacggtgtatcggttgctaaggcgcagcgtctttggacagttgtagtcgggccgtgaacgtcgacttcatctaatcgagttatcccttacctctcatcgaaagatcgggccacaaaccctagcgggttcgcatcatgcacccaacacactccaatatgtccaaaaatcatgttttggtgttttttgaactttttcattccagtctaaaacatcgcacccacctatggcaatattggcattaattcacaaaagttcgccgcgcgaatcacgaagtgattttttgccacgaacgcacccaacacactccaatatgtccaaaaatcatgttttggtgctttttgaactttttcattccgttgaaaaacatcgcacccacgtgtgccaatatatggcaatattgacattaattgacaaaagttcgccgcgcgaatcacgaagtgattttttgccacgaatgcacccaacacactccaatatgtccaaaaatcatgttttggtgctttttgaactttttcattccggtgaaaaacatcacacccacctatgccaatattggtagtaattgacaaaagttcagcgcgcgaatcacgaagtgatattttgccacgaatgcacccaacacactccaatatgtccaaaaatcatgttttggtgctttttgaactttttcattctggtgaaaaacatcgcacccacctatgccaataatggcagtaattgacaaaagttcgccgcgcgaatcacgaagtgattttcattccggtgaaaaacatcgcacccacctatgccaatattggcagtaattgacaaaagttcgccgcgcgaatcacgaagtgattttttttccacgaatgcaccaaccacactccaatatgtccaaaaatcatgttttggtgctttttgaactttttcattccggtgaaaaacatcgcacccacctatggcaatattagcattaattgacaaaagttcgccgcgcgaatcacgaagtgattttttgccacgaatgcacccaacacactccaatatgtccaaaaatcatgttttggtgctttttgaactttttcattccggtgaaaaacatcgcacccacctatggcaatattggcattaattgacaaaagttcgccgcgcgaatcacgaagtgattttttgccacgaacgcacccaacacactccaatatgtcgagaaatcaagttttggtgctttttgaactttttcattccggtgaaaaacatcgcacccacctataccaatattggcagtaattgacaaaagttcgccgcgcgaatcatgaagtgattttttgccacgaacgcacccaacacagtccaatatgtccaaaaatcatgttttggtgctttttgaactttttcattccggtgaaaaacatcgcacccacgtgtgccaagatatggcaatattggcattaattgacaaaagttcgccgcgcgaatcacgaagtgattttttgccatgaatgcacccaacacactccaatatgtccaaaaatcatgttttggtgctttttgaactttttcattccggtgaaaaacatcgcacccacctatgccaatattggtagtaattgacaaaagttcgccgcgcgaatcacgaagtgatattttgccacgaatgcacccaacacactccaatatgtccaaaaatcatgttttggtgctttttgaactttttcattccagtctaaaacatcgcacccacctatgccaatattggcagtaattgacaaaagttcgctgcgagaatcacgaagcgattttcattccggtgaaaaacatcgcacccacctatgccaatattggcagtaattgacaaaagttcgccgcacgaatcacgaagtgatattttgccacgaatgcacccaacacactccaatatgtccaaaaatcatgttttggtgcttgttgaactttttcattccggtgaaaaacatcgcacccacctatgccaatattggcagtaattgacaaaagttcgccgcgtgaatcacgaagtgattttcattccggtgaaaaacatcgcacccacctatgccaatattggctgtaattgacaaaagttcgccgcgcgaatcacgaagtgatattttgccacgaatgcacccaacacactccaatatgtccaaaaatcatgttttggtgctttttgaacttttttattccggtcaaaaacatcgcaaccacgtgtgccaatattggtagtaattgacaaaagttcagcgcgcgaatcacgaagtgatattttgccacgaatgcacccaacacactccaatatgtccaaaaatcatgttttggtgctttttgaactttttcattccggtgaaaaacatcgcacccacctatgccaatattggctgtaattgacaaaagttcgccgcgcgaatcacgaagtgatattttgccacgaatgcacccaacacactccaatatgtccaaaaatcatgttttggtgctttttgaactttttcattccggtctaaaacatcgcacccacctatggcaatattggcattaattgacaaaagttcgccgcgcgaatcacgaagtgattttttgccacgaatgcacccaacacactccaatatgtccaaaaatcatgttttggtgctttttgaactttttcattctggtgaaaaacatcgcacccacctatgccaataatggcagtaattgacaaaagttcgccgcgcgaatcacgaagtgattttcattccggtgaaaaacatcgcacccacctatgccaatattggcagtaattgacaaaagttcgccgcgcgaatcacgaagtgattttttttccacgaatgcaccaaccacactccaatatgtccaaaaatcatgttttggtgctttttgaactttttcattccggtgaaaaacatcgcacccacctatgccaatattggtagtaattgacaaaagttcgccgcgtgaatcacgaagcgatattttgccacgaatgcacccaacacactccaatatgtccaaaaatcatgttttggtgctttttcaactttttcattccagtctaaaacatcgcacccacctatggcaatattggcattacttcacaaaagttcgccgcgcgaatcacgaagtgagtttttgccacgaacgcacccaacacacaccaatatgtccaaaaatcatgttttggtgctttttggactttttcattccgttgaaaaacaacgcacccacgtgtgccaatatatggcaatattgacattaattgacaaaagttcgccgcgcgaatcacgaagtaattttttgccacgaacgcacccaacacactccaatatgtccaaaaatcatgttttggtgctttttgaactttttcattccggtgaaaaacatcgcacccacctatggcaatattggcagtaattgacaaaagtttgccgcgcgaatcacgaagtgattttttgccacgaacgcacccaacacactccaatatgtccagaaatcatgttttggtgctttttgaactttttcattccggtgaaaagcatcgcacacacgtgtgccaatatatggcaatattggcattaattgacaaaagttcgccacgcgaatcacgaagtgattttttgccacgaacgcacccaacacactccaatatgtccagaaatcatgttttggtgctttttgaactttttcattccggtgaaaaacatcgcacccacctatgccaatattggcagtgattgacaaaagttcgccgcgcgaatcacgaagtgatttttttccacgaatgcaccaaccacactccaatatgtccaaaaatcatgttttggtgctttttgaactttttcattccggtgaaaagcatcgccaacacgtgtgccaatatatggcaatattggcattaattgacaaaagttccccgcgcgaatcacgaagtgactttttgccacgaatgcacccaacacactccaatatgtccaaaaatcatgttttggtgcttgttgaactttttcattccggtgaaaaacatcgcacccacctatgccaatattggcagtaattgacaaaagcttgccgcgcgaatcacgaagtgatattttgccacgaatgcacccaacacactccaatatgtccaaaaatcatgttttggtgctttttgaactttttcattccggtctaaaacatcgcacccacctatggcaatattggcattaattcaaaaaagttcgccgcgcgaatcacgaagtgattttttgccacgaacgcacccaacacactccaatacgtccaaaaatcatgttttggtgcttttagaactttttcattccggtgaaaaacatcgcacccacgtgtgccaatatatggcaatattggcaataattgacaaaagttcgccgcgcgaatcacgaagtgattttttaccacgaatgcacccaacacactccaatatgttcaaaaatcatgttttggtgctttttgaaatttttcattccggtgaaaaacatcgcacccacctatgccaatattggcagtaattgacaaaagttcgccgcgcgaatcacgaagtgatttttttccacgaatgcaccaaccacactccaatatgtccaaaaatcatgttttggtgcttttcaaactttttcattccggtgaaaaacatcgcacccacgtgtgccaatatatggcagtattggcattaattgacaaaagttcgccgcgcgaatcacggagtgattttttaccacgaatgcacccaacacactccaatatgttcaaaaatcatgttttggtgctttttgaactttttcattccggtgaaaaacatcgcacccacctatgccaatattggcagtaatagacaaaagttcgccgcgcgaatcacgaagtgatattttgccacgaacgcacccaacacactccaatatgtccagaaatcatgttttggtgctttttgaactttttcattccggtgaaaaacatggcacccacctatgccaatattggcagtaattgacaaaagttcgccgcgcgaatcacgcagtgattttttaccacgaatgcaccaaccacactccaatatgtccaaaaatcatgttttggtgcttttcgaactttttcattccggtgaaaaacatcgcacccacgtgtgccaatatatggcaatattggcattaattgacaaaagttcgccgcgcgaatcacgaagtaattttttgccacgaacgcacccaacacactccaatatgtccaaaaatcatgttttggtgctttttgaactttttcattccggtgaaaaacatcgcacccacctatggcaatattggcagtgattgacaaaagttcgccgcgcgaatcacgaagtgatttttttccacgaatgcaccaaccacactccaatatgtccaaaaatcatgttttggtgctttttgaactttttcattccggtgaaaagcatcgccaacacgtgtgccaatatatggcaatattggcattaattgacaaaagttccccgcgcgaatcacgaagtgactttttgccacgaatgcacccaacacactccaatatgtccaaaaatcatgttttggtgcttgttgaactttttcattccggtgaaaaacatcgcacccacctatgccaatattggcagtaattgacaa

SEQ ID NO: 71166 - DNA, 968 bp, Oryza sativa
aattactgccaatattggcataggtgggtgcgatgtttttcaccggaatgaaaaatttcaaaaagcaccaaaacatgatttttgaacatattggagtgtgttgggtgcattcgtggtaaaaaatcacttcgtgattcgcgcggcgaacttttgtcaattattgccaatattgccatatattggcacacgtgggtgcgatgtttttcaccggaatgaaaaagttctaaaagcaccaaaacatgatttttggacgtattggagtgtgttgggtgcgttcgtggcaaaaaatcacttcgtgattcgcgcggcgaacttttttgaattaatgccaatattgccataggtgggtgcgatgttttagaccggaatgaaaaagttcaaaaagcaccaaaacatgatttttggacatattggagtgtggttggtgcattcgtggaaaaaaatcacttcgtgattcgcgcggcgaacttttgtcaatcactgccaatattgccataggtgggtgcgatgtttttcaccggaatgaaaaagttcaaaaagcaccaaaacatgatttttggacatattggagtgtgttgggtgcgttcgtggcaaaaaattacttcgtgattcgcgcggcgaacttttgtcaattaatgccaatattgccatatattggcacacgtgggtgcgatgtttttcaccggaatgaaaaagttcgaaaagcaccaaaacatgatttttggacatattggagtgtggttggtgcattcgtggtaaaaaatcactgcgtgattcgcgcggcgaacttttgtcaattactgccaatattggcataggtgggtgccatgtttttcaccggtatgaaaaagttcaaaaagcaccaaaacatgatttctggacatattggagtgtgttgggtgcgtttcgtggcaaaatatcacttcgtgattcgcgcggcgaacttttggctttactgccaatattgg

SEQ ID NO: 71167 - DNA, 1527 bp, Oryza sativa
gccatatattggcacacgtgtgtgcgatgcttttcaccggaatgaaaaagttcaaaaagcaccaaaacatgatttctggacatattggagtgtgttgggtgcgttcgtggcaaaaaatcacttcgtgattcgcgcggcaaacttttgtcaattactgccaatattgccataggtgggtgcgatgtttttcaccggaatgaaaaagttcaaaaagcaccaaaacatgatttttggacatattggagtgtgttgggtgcgttcgtggcaaaaaattacttcgtgattcgcgcggcaaacttttgtcaattactgccaatattgccataggtgggtgcgatgtttttcaccggaatgaaaaagttcaaaaagcaccaaaacatgatttttggacatattggagtgtgttgggtgcgttcgtggcaaaaaattacttcgtgattcgcgcggcgaacttttgtcaattaatgccaatattgccatatattggcacacgtgggtgcgatgtttttcaccggaatgaaaaagttcaaaaagcaccaaaacatgatttttggacgtattggagtgtgttgggtgcgttcgtggcaaaaaatcacttcgtgattcgcgcggcgaacttttgtgaattaatgccaatattgccataggtgggtgcgatgttttagactggaatgaaaaagttcaaaaagcaccaaaacatgatttttggacatattggagtgtgttgggtgcattcgtggcaaaatatcacttcgtgattcgcgcggcaaacttttgtcaattactgccaatattggcataggtgggtgcgatgtttttcaccggaatgaaaaagttcaacaagcaccaaaacatgatttttggacatattggagtgtgttgggtgcattcgtggcaaaaagtcacttcgtgattcgcgcggggaacttttgtcaattaatgccaatattgccatatattggcacacgtgttggcgatgcttttcaccggaatgaaaaagttcaaaacgcaccaaaacatgatttttggacgtattggagtgtgttgggtgcgttcgtggcaaaaaatcacttcgtgattcgcgcggcgaacttttgtgaattaatgccaatattgccataggtgggtgcgatgttttagaccggaatgaaaaagttcaaaaagcaccaaaacatgatttttggacatattggagtgtgttgggtgcattcgtggcaaaatatcacttcgtgattcgcgcggcaagcttttgtcaattactgccaatattggcataggtgggtgcgatgtttttcaccggaatgaaaaagttcaacaagcaccaaaacatgatttttggacatattggagtgtgttgggtgcattcgtggcaaaaatcacttcgtgattcgcgcggggaacttttgtcaattaatgccaatattgccatatattggcacacgtgttggcgatgcttttcaccggtatgaaaaagttcaaaaagcaccataacatgatttttggacatattggagtgtggttgggtgc

SEQ ID NO: 71168 - DNA, 4572 bp, Oryza sativa
cattcaaaagaaggcacgaaaccaaatcttgtcacataatagagttggagagccatgaccatataaactttctatagtacttgccttctaaatatgtaggtaccttgcatctacatcctaaaattggtgaaagctccaactaaccttgctgtcaattgacctctctctgtaatttcccacagctttattgaactgcacactcgtgcaagcaaaatccacacatagggatgctaatctctctcaaagatgcagttcaagaaagctgtggaagaccacaaagaggaccatcttcttttgcaggtgcacagctaataacatgcaataattcatgtcaagaagctggcaagaaactgtggctagctaagctagttgttcacttctttgtatagttcaggtgctcatgtagctgaagaagagttgaaatgaaggaagaaggcacaagaagcagctagttcttgtaagcttcagcttagggaggtggagggagaaagaggggagagttagggctatttataccagcaaggtgaggaggaggccaagcatggggttggtgagaggttaaggaccccaatcccaagaagaatatggaggccttcctcattcactttctccctctctcaactctgatgaactctgaagaaaaaggagaatttttggctcatcaatccaagggaggctgtaaatcagacaggagacagagccaatttctttacttgacacacttgtagccaaatgtgccactggcttcttagaaaaaaagattggcatttcactttgttttctttctgttggtggttttgatatgtgggttgcacaaaacatgcaaagagatgttgctgaaagcagtgaaaagatggagctttttctgcctttctggttgagttgagtaagctattgcacaccctacaggcaggtcagcactgagcaggtgtgatcagtgagctaagtggggtacagatcaccagtgggtataatgtgccaatattttcaagaacaattctaaagtaagatttccatggggtctccagtgattctatacttgattgtatcccttaaaaaatggatgaaatggtcttgtctgtttatcacttgatttagaattgtgatcttgtttcaaaacaaatatttttttgaaaggaaatatcaaaacaaatataaaggtgactgttattgtcggtcccatagtttaaccgtctatagttaggttgagttcaggttcgaaactacagaatttctctgaaaaaaggggtctgtaactatagttcatctaaatgtaatttttgttttgcctatatttcaatattaatttcggttcacaattttgagccgaaattttgggtactggtaaggatgtgcttttggctgaatttttttttccttaaaaaaaggaaaatttgttcaaactcagtaataaagtttcccaacttttccctaaaatttccaaaatgttggatgtcaccccctctgaaatgtttttgttttttaaaatagttaaaatcctagttttaatcgtattatcgtttttcactagctacatgaaaagtcaaaggtatgttggtagcattagatgtggtgtttcaacattaccaaaattttggcacattttagtgttgctatgttggtagcattagatgtggtgtttcgttttaaagcctcatattttagtgttgtcaatttttttagcgttggatgtggtgtttggtgtatattgttgccaaatgattttagtagagtttttaagagcaaaaacttccgtaattacctcacttgataaggtaacaatgataagaatatgttcgatttgttgccttatcaaaatttggtgggattgaaagtggttgtccagagagtgattttggttgataacctgtgcttgacacctgaattaacaacccggtccatgttgaagcgtagaaaaagggggaaagcatgcgccaggttctcgcgcaaaggtcataccgatctgacatgcgtgaacagaggcctgcctgccaatgccaatgctttctcttctctattgcttggggccatcaagcaagcagtagttattaattagttaattataaatttataatcagttgagcaatctcagaaggagaagctaggtagaggagatctcggggcaaaacacacaccaatgctagtagcttctctgaacaaatttaattttactaaattcaacatcatcgctagctgtcccgacacgatcgaccggactgtccaatgctggctcaaatggagcaagaacctgaatttcctcttgtgccagatgataactacacccggatgcagacatgcagtcaaagcatggctgtgaaatttctgaatccagagatctgaagccttctcgggtgatcagtcgacgacggccacgtacgtttagtaactactagcatgctgtaaaagtgtaaattatgattttttttaaattacacagtacaacacagacactcacaacgcacgcacactcacccctaagaacgcatgcacgcgaaccctacccctatgagcatcttcgaagactaggccggtaaatccatcctggagattgatcaagtcagcacaggcacctcgctgtcgatgagtatatcgtctaccactgaaagcacaaaactgttaaatcctgaaaaattcgttcccatgagaagttgaacccaggatctgaggtgctactggggctctggtaaaagtgtgaattaagtagtggtaattacgcagatcgatgctgtaatattatgatgagatactagtaatagagaattcaggtaaatttgcaggttcgatgcttctctgacatgcgtccggtgtcaggccggcgtcagagcgctcccggatcagacggcgccctgcgcgctgcatcgcctgcacgcgcgcatggcttccgcgagcttcttccattatcccaaggctaattacgttcttgatgatcaggtacttaccggtgatcggtcggtgtggcgttgtttggaagcaaatggaggtagtagcttgcttgctgtcagactggctgtcagtcaagagtgtcagtgagtgagtgaagcacgcgtgtttcgatcactagctagctgaagctgattaattctgcttaattagcttgcatgctttgaccagattcatgcatatcagcagaaatgcagaggcaatggctgggtggtggggtgcttggaatttggacggatcaacctgaattatgcagaggcagcgcggcatgggggggaggccgtgcgcgcgtgcggcgtgtggggagcagggcgagcgaggcggagacatcctgctcgcgcgcggccgcgagggcgccatcgatcttcgaagctgagactgagagctgcccgagatgtgactcggcaaccggcggcatattattcacttgctttagtttgccttggactaaacctagggtccatttgaaacgcggaataggaaaaacgaatagaaaaaacgtaggaattaaagttgtatgtttttctaattctataggaattgaaaacacaagaaatgaagagaagagtcctttgattacaccataggatacactcaacaaaggaaagtttcacaagaggtctaacctcttgcttattttcctatggaattgatcataggaatgcaatcctatggaagttttcctatcctcttcctatgaatcaaagggctctataggaaaaaatccttatgaaaatgaatcctctaaaattcctttgctaattcaaaggggcccttagacgggtacgtgtgtctaaatttatagtatgagaacttttataatgagagaaaaattttataatgagaggagtgtatatctctactattataaaaactaggtgggtggcccgcgcaattgcgcggctagcacccaagcaaatcatatatttttagtatgattttactaaaaatttattaaatagctatctcattgtcttaagaatttgaaagaccaaaccttatcatcccgtgtttctaattatatagtttttaaaagtcacatcagttgctaccccttatgtcatcttcttctttatttgcttgctcgatctaccactatttcaattcattctccttgtaacctttaaaaattggaacttaagtttttagagtttattgtaacgttgggtttcgtttttataatttgtagacgtcccgtcaagcattgccattatgctcctctatagcatgttcattgtcttttctctttactgtcattgagattttaaaaatcgaacatgattatcgttgggttcatttttactttttagaagtcccgccaaaccttcagcggttttaccattgtacttctctacggctcgtccgctgcctcctttctttattgtcattgagattttaaaatcgagcatgattatcattgtttttttattttttagaagttacgaacctttaaaaattggacattgtagtttttatagtttattatcttgttgggttttatttttttataatttcagaagtttcgtcaaacgatgccactatgctcctctacggcccgtccgccgcctactctttattgtcattgtgattctaacaacaaacataactatcattgtaattcatattttattt

SEQ ID NO: 71169 - DNA, 709 bp, Oryza sativa
cttacaactacaagtaaagaatgacagtcccagtcttgctaatcctgtatatacaaaccattgtttctcaaaataaacagaaaaaaaaatgcatacaagaaaggaaggcaacctacggtaaacactgcagtatatgagtataaaattgaggcctctgtgacagccaactcaacggcagtgccccttatttctgaaaaagcatattatgccagaaaatggttgctgaattgaaatacagtttgatttccgttcttcgcaacaacgaattatccaccctccaacaaggagtggggatggtggttccatctgccttgaccacccttcaacaatcatccctccatgatcatggaatctgcaagagaggggcagcttttgacatgctttccatcagatgtaaatgttgttgatgtcactaagttgtcctagccatgctattgaatgaacaagctagaggcatcagaaattcgcatcctattgacagaaagcacccatataaaagacaaaggcttattggaggtgacctacaagctctattaattttttcgtacaaccgcgtacaaccatctttgttgctggtaggatgctttctaacatatcttgcccaattcgtgattaacaataatcaatttaacattggagctatctaacgaatcatgaaagataaatggcaaggtatgtatctctctcttttttagtcatttaccaaaga

SEQ ID NO: 71170 - DNA, 2760 bp, Oryza sativa
  unsure (1)..(2760): unsure at all n locations
caaaccaactaaaccaatgaagagctcatttaaaatgtacgaaatttacagcaaacatatcagtttcccccattactaaaccggagagctcccacatttcaaatggggcctagagttccaaccaattgcagcaagagcagtaacgacagcgaaggacgcataccatgggatcccggtgaggttatgaaatccgtcgaggatgtcaatcagcgagctgacagcgaaccccgacgcgcttccgccatctcctgcggcggctactccggctgcatccgccgacgccgcgctggtggcgaccacttccccgaaatcagcaccacccgcgtcgtgcaggtacgcgccttccccctcggcgcgcacgtcctcctcgggagccttctccgccgcggcggggccggccggcggcggcgagcgggggtaccaggagaagcttcgcgcggggacggcagcgaaagggactagcagcggcggcaagcgagggggtgacgggagcagcggcgcgcgggtggtggggcttggatccgaggcggagaggtggtggtggtggagcacggccagcggccgcgggaggcgccgaccgccgccgccgccgccgccggcgaggcggccgaggaggcgaagcggaagcgccatgtggtttgtcgtgacgtggcgtgacgtcacaggagggtgtaaagcacgtgacgagttctctccgagccgttcgattaggaatggacggctcagatccaatatggcacatacattttcacaaaacccccttgtttttgtagtaattacaattctgggcctaggcatctcccctcttctcgggcaagaaccctagccaccttcgccagtctccggctcgaacgcggccacggcgaggctgcgcggccagtgatcttgcggtctaggcggcggcggcggaggaggaggaggaggaggaggcgtcgagatggtggtggcatccggtggagggcggaacgcgtgggcgaaggagatgaccatccgccgcaggattaccagcatgtgagctacctaacctgaactcctcggattttctttttttaaagaaaagatttagctgtcaagttcatgagtttgatgctttgtgtggataacgatctcagattcaacaagacgcgggagcattttccgtccctgaaagattacaacgactatcttgaggaagtcgaggatatgagtaagttgttttataacttgtctctaggttggtcatcattcaacagtaaggaagcaaatgtgattgatcaagatttgcttgtttgaaattcgtttttcaagctttcaacctgatcgaggggatagatgtcgaggtgattgaagctaaaattgccagatatcaacaggaaaatgctgaacagatatatttgtcccgggctaaaagggtatgctgttcatcattgcgggctctcgtgctgtatttgaattttatgattgataaccatcttatttcaacatctttttgtctgtaggccgaagatcttgctgccgcacttaaagcaagcagaatgaaccctggcaaggctggtgccaatgacacggttagttgatagtattagcattagattatacagttaatatatttttgctccttcaacagtataggtgttgaggattttatggttggatgtgtattttttatatatacatgagaaattccatcatctttgaatgattgcaagtcttcctctttggagagcatcatgtatgaatcttaatagattctagctgtaaaaagctctgataaaatttcttcagaaaatggtattgaaggcatactgaattttactcccgactgtacaaagatctaataaaatttcttcaggaaatgatatttaaggaattactgaattttaaagtgcaaaactttagaatctttttaacttgacatcctatcaaaagacgtttgatacaagacttgaaagaagaaatactgtcatcaaattgtgatcaagctgaaacatgccaccacatgagtacatgactaaagtagaaattatagggtgccgatgtaaaggccaaccattggtttcagaaatgatgtctcagttgacaatgcatttcatatccttaaacaatttggtttgcatagtaatctttcagcttcacaaattggctgtttaaattatctggctatattatggcattactatgtaccatgtcagtttggaccttactttgtagtatttgctaattttgttgagctattctatttcatctgatttgactacttcatgtgatgtgaggtagaattgtagaaagaatttgatgtaaacttctcgttcttcttctctgtaacagcaacacttgaaattggtgcattcatctattgattcgatacactgtaatatgttctgttcttttgtttattagaaagatgtggtatttattccaatacttggtactcttgcaacttgtaacaggctgctggaagctctcagggcattagtagtggcgcgggagttcaggaaggccagtatgcgcctgctgctgttcccggtgggctagctcagcctcggccaacagggatggccctcaaccgatcggcggttcatcggttcctcttcaaggagatgatgaggagaccatgaggctacgtgcggagagcggggctcgagctggtggatggtccatcgaaantgtgcaagagaagagcattgcaggaagcgttcagtaccatattcgtctgacggtcagattagacgcaagagcacctaacatgtaggatgcctgataattttgtggacatccttt

SEQ ID NO: 71171 - DNA, 28163 bp, Oryza sativa
tataggccatttatgtgtgcacccatggtgcatagacaaaatgcacaggtcaggcatgcttccagtttaggttagcattctattcttctatattcagtactccagttgctactgttttgaaattttggattgagaatattataggactattcgcaaggcattgtagatcgaatatctgaaataagcatgctttaatgtgtctatagaatatgcacacctcaacagatatcctgtattttctgtcactaatgtgccaagcgaatggttctttttgttttttttatgttgtgcatgccgtatcatttattatatgcactttgcatttgtatatggttttgtaatgtttttgtgctgccaaatttagcttttctttgtcatcagatttcttattgtttgtacatattggttcactcaatttcaaggtttctgaaatatttcaatttgcgtgctgaaccaactcaatttattcgctagtggcagtgccccctataagttcttttttcttttttgctgtggcaccagactcccatttcatgcttattttcatcaagttgcacttgatgaatggagaaaacatcaatggataaactttctttttatatacatgtaatcatgtcttactacgagctggtgaagtaatattatttacttaatttgcgcattgcatgcaggatcgatatttattactgacaggtcctacgcgtgctgttgtggtatctgaccctgtgtattttgaggccccgctgaaagtgaagggctctgtcgaatctgaggataaagatttaagctttttagctgtcccgctcaccggtgcttctgatagaggtgaaacgcgcttggttaatagagagtacactagcaggcttagcacgctggagttgacatttggctttgttgttgagtccttggaggcctcaatcagtgtgcgtatcattgatgggtcatggaaagatggttttcgtggtgcattcactgcccatacccccagtctaaaagacaataaagtcctgctgcttgattctggatattgtgagatggtgcctgttactgctgatcgcatgatcaagctttcacgccatgttgtttccgtggaaggtgagggagacctgaccgtttcagtgctggcacttggaactgataatgtgatagaagatgagaaggatttcacgcctaaggaagccggtatgagccagagctctcttgacgtgggcttttgtaaattggaagtaactgtcaactggtcacttctttccttgcttcctgatggctatacttaattaagtacattgcacagtggtatgtgaattgtgatgttcctttggatctgttgcttctgaacttctgaaatggggtgttggtttttttttcttttgtttactagctagaatagcgaactcttgatggacgcggtatcctgtgtatagaatgttggcagtattgccaccgctacggataaagttcgatttcctatcttgatgagattttgtattttatgatgccccattttcttggacagaatttgtggtggatgaacggcgccccactttgtgcacgcggagcaatgtggacatataatggaataaaaggggtgatgctaatgagaaaatttctagtttagatgccacttaccgaatcagcttgtcgaccacatctttattattatctttacacaacacaaacatattatcactaggaatttggtgttgtccgtgttactaataatatagtgtactgtaatatactgcagtctaggacaagttggtttcttgataagcatctaggacaagttcaggtgagcttctcgaccagctctgtcactaggaatgcttggctgcttgcaatgaaacttctatgcatgtacccagatatgtgttgaggaagttgattgttgattactttggttacagaacttgatcaggcttgtcgttaagccaaactgtaattcacttgtgggttgtggctatgaagtctcattttgagctgaatgttggtacatcactgacatggcatgccttacctacctatggaaaaccaagataatcaggttggttttcctatttccagacatttaatactagattgcagcagtagcatataaattatgttaggatgcaatttatttgtgacccattgattgtacgcttctatgcagactcaggtactatattatactatctgcttgtttgagctgtggccgtatttatgggcattactaaggcatgacaagatcaattgttctatttaaattttgtgttcatgtttataatagtggtgcacattttcttctctgtatgctcaacattttataactagattgctaactgttcttctctgtgttgaagaaaaaagtaggcatactacgttggatgaatagtatgtaggatcgctcatgtatatgcatgtgtagatgtatttcctgtagttgtaggtcttctgactcagcttgaaaaaatcagttctgacagaattgagtttctgtagttcctttttttttttttggaatacgcaagatgcgcatatttgtattaagagaaataaagattatttacagagttttaaaaatgaaaataaagaaggggacagggtaccggatggacaacaaaatctaaggcctaatctcctatcaaattttgtgaccgccactccgtggtcggtagaggtaactccggcatggccgctttcgctaagcgccaaagctcggcctcggccgccatcacctttgccacttcgacccaggtcttttgctgttggttgaagaccctgttgttccgctccttccaaatagtccaagctatcaaagctgcaacggtgtcgaatcctcgtcgttgagctttggcaaccttcattctcttgtcacaaagccataagaggaaggagggttcgttgaatggcagtatgtccgacaagccaattgctcggagtgcgaaccaccacagttgacgtgactccaggcatgcgaccaggagatgatcaatcgtctcgtcaccttgatcacacaggacgcaccgatcaggatgtggtaaaccccgtctccgcaaacgatcggctgtccaacatctgtttagtgccactaaccacaggaaatagcggcatcggggtggtgctaacgaccctcagataggcttgtcctggaattggaccttccccacaaacatggactgataagctgagcgagctgggtattctcctgacgactcccatctccagatgattgaatccggctcttccgatagggcatccaaggattgcaaagatgtccacaagctgaggtactctaggatagcttggattcccaaagccccagatatatcccggatccatgttctaccttggagtgcttcgcgaaccgtcctacgattccgctttcttgctacgaccgctgcatgcacagccggcgcaagggtgcggattgacgacccttggatccagttgtcttcccagaagagcacgttcattccattgccgactcgacatgtcaaagagacttggagcaggttcctctccttttgcgagattggaacgttgagtccatgccatggcttttccggcgatgtcctcagttgccaagcccagcggcaccggagtgcaagtcccatgcattcaagatcagggacacccaatccaccatacgatttgggtgcacaaacccgtgcccaagcgacccggcagcttccaccactagcgcttgctttcccggacgggaggaagccgcgacggaccttatcgattccctttatcacccactttggcacattgatggccatcagcagatagatcggtattgagattaataccgcatttaccatagtgactcgaccaatgggcgccatctgctctgccttccataccggcaaccgacgggctatttctgtagttccattgtatgactgtaccatatctacttgtatctcattgaacattgagggaaaaattaaagtacaaacaaaacaaggaggaaatttttcatggttcctaaggcagcaatgtcaagctggtcctctctgcacattccttcttgagaattgagataattgtttttatggtacatgtatcacaatcttaatctccatgtctgcatgttgtccccttttggcttctgcatacttatctctgaagaaacaggcatgaaacttgtctgttgcggagtattcagaccttatggatgggaaggaatcccagaaaaggatggtgtcatcacttaaggttttcaactactcctatactgatgccatacgatcttttatttgtattctagctgcatttatatttttttggtgatattgataaggccattgtctgaaagacctttggtgatatcctggcatcatatctacagtacaatgctgggttttagcagcctcagccctcagtatgatgtgcagagtgcagtgcaggttaactgcaagcgatgtctttttagcactatgcaatggagaggatatgaagctcctccatcttatgtactagtactttgtttctgtaatgaataatccctttcgttctcaactgctaatgctacaaaatgattagactactgtccatttcacaccctgcttcaccaactaagggcacattgcacaaacacaaaattctgttcttgacatgtgattaaggtgttcttcagattgatatcatttcaaaccataattttttttttggtaaagtttcaaatatgtgtatatatttggtttcttaccaactttggtaaaaaaatacataaggaatttggcaactacgtagtagtggctatcctgccaaaacctggcaatattgccaacttacaaaaatttatttattttggctacaatctcaacagccctaatttatatgcaaataaattgttcctgccttataaatctctgcggttatcttttttcctcctgtcatgttttggagttcacactttacaggagcagttatcagttttcctctatctctttctgaaccttttattctctttccagatattggcaactgcaaattctacaattgtctattcatatatccaaagcatgttctctgaacagttacttgggagagcatgcagatgatatcaagtgtaagcttttcaacaagaatttgttctgatcctcacatgtctaacacaatgatgcctctcaccgaatgcattcagcataacatttccttttcccatttcattttcttcagacatctctgaagtctgcacctgtactgggataatggtggggagaggagtacgtggagaaactgatttcaggtacgcaaaaatataataagaaatttgggcccccgtcttgactgattgaaaggaaaagcccaacaacctatccccatccatgcctcacacgacaatgttcttttttttttctcggcagactattaggtagtgataattttttttttttgagaactaggtagtgataatctctccctggaaatcataaccgtactcaccgtgaatcatatggtggtgaaatattcaccactattttcgtttagaagtcatatctttaccacattaccattttgactgcacgttttacggtgatctccatggaaactatacagtttctcatgaaatgaaattcctacattttgaataagctctaaggcatcatttgaatggtggagttttaaaaagacttggagaaactgaacaaaattctacaaaaatcatgtaaaatttatgtattccaaagaatctctaagaaggcgtggacgctacatttttctccaaagaaaagtgcatcaacaatcctagatagctactcttcatgttccatattataggtcatattagatttgttttaagtcaaacttctctaattttgatcgaatttatagaaaaatgcaccaacatgtacaatgacaaataaatgtattattatcgatggatttaatgaaactaatttaatattatagatgttaatgactttttttaataaactcagttaaagctaaaaaaagtttaacttaggacaatactaaaatgacttgcaacatggaacataagggaatagtgtcacgcccagaagtttcccccttttttcttgctttaaatatttgttaaataaatcgtccgaagaaattatcttaattaacctagagctaaatccctagttaataaatgcaattaataatcagaaatagcgtggtggaattttttttcttgagtcccccatgctccaatgcattaacaagatttttagtggaattttcagagccttggaaataattttaaccaattaaaaatcaccaaagtgcaatatttaatcccaggaaaatccttcttctctttttcttttcttttccttcctttttctctagatgggccgtcggcccatctctctccccgcgctcggcacccctttcctgggccggcccgctcctcatttcccctccccgaagtcctccctccctccctttctctttcgggcgccgacaggtggggcccacctgtcggtcgtcccctacctccggtcattggagccggagctccaaccgcccgcgccgccgccttctccgctccacgtcgcgcctccactccgcgctcgcacctcgcgcccacgtcgccgccctctcccccgcatctcccgcgcgcgcgcccgcaagtggtgggggatttgaaatcccccaacaccctctctctctcctccacctctccacgtcgccggccaaataggggccatccccggccgtttccgcccctccctcgcccataaaaaccctcactcgagctctctctctctcatttcccccattcaccgtcctctcccacgccctctaccgccgtagcgccgcgctcgccgagctccgccgccgccgcccatctccggccgcatgccgtcgccactagggccgccgccgcgccaagctgccgccgccgctagctccgccgccgtgtgggccatctcggccaccgcctcgcgtcgccggaaccccaccggaaccccatctccctcgcgagccggggagctatccattcccctccgtctccggccagccctttggtcgtcgcggtcgccttctccatccctaactcctctcctcccctcctctgggtgtcgccgccgctcgtccgcccctcctctcgtcgggtcgtcgacgccgccttcgtcttccgctctggccgccgtgtcgccggtgagtcctccctccccctcctttcctcaccttaccgcgagcgccggccacgccgctgctccggccatgcgccgccgcctttcggccgtcgccgccgcttcccacaccgccggtcaccgccgtcggtggccgtgcctcgccgccgcctcgccttggtcggccggtcggccttgaggccgagccgagcccggccggcgcctccctcgcctcccctttgagccaccgcctggtggggcccacctgccaggcgccacctccctcccttggagccgctgacccgtggggcccacgtgccggtgcccccctttcgctgacgtcagccctgggtattattgcgcaataattaattaaggactttttctttattagtaaaaacacagtttatcttctaaaattcataagtaattcatccgagctccgtttaagtccatccaagtctcagtaaatcaagaaaaatgcaaagaatccattaaaaatggttttgtttcctgtttcagtagtcttatagcatgttttgcttgtgtgctttgtttgtcgcgtaggtttcggccgtttcgtcgatccgcggtttctcgaagacgttgctgaggtctcatcagttcgagagcagggcaagtcatgcaatacgtttgatcatattgtacccaatttacaaatatcccacatttctattaaatgttgcattcttttacaatatcatgtgggatgggtcctactactcagccatatattgatttccttatgccattgataacttgggtattaaaatgactagatgttggtttaggaaatgcttagccatgcttagttcaactagtacacaaatgggggtcacattattacatagactctgactattggcatagctttagattggtgccaccgcaagggtgtcagttaattaaaatattctgaatggcgggctgtgagtgcatggttttgcttgtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccgaggtgttcggttgtccagctgccggattcaccgcggtgcaagaggggaccgcccactgccttttgaggggtgggggtgaaaccttagcgtggtgtggatggttaggggaggtttatgtggagggtcttgtcacaatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgattggttaatattgattaattactacagctgttttactgctttcaactactgttttgaaatgcctgctttatgcaaaagaacccctagcttcctttggttatatcctgcatcatacctcctcttccggtatgacttgctgagtacagtgggtagtactcagtcttgctctcttttcccccacaccagagttgaagttcttcttagttggagccgtctcagagaggttggtttcgtcgctgccgtcaaggtttgcctgtggagtggagtcgcccgctgctgaagtcaagcttcccggtttagctcgctttaatctttcccgctgcatttgtaatcttttatatttttgtaagatgtgggtctgtatgtcaacaattgtcgtttgtgtaccctggctggtcctggacagggatttaatgcacattcagcttagaaattctggttcgagaatttctgggtgtgacaaatagataccttgatgacctgatcaaagctagccagtggcaagtagaatcccagttttgagtgattggattgccaatcatggacggccggtgagtgagaagaggatggtgccttgcccttgtcatgctctgatcatgcagttggcctctggaccaatggagaaaatgcattgccatggaaaggagatgagaagggtgtggtacactagtagtagttcagaggacggccggcattgatgccatggaggagccctcaatgatcaggcactcgtgtgcgaagaagaaaggggaggcttagatgcaatggctcacacacggttcgtcccatctaaacccttttcgctctttttttctctcaggggttgggacattgcatgatttgattcacatctatttctatcagttggtcccaattgatagtactgtcaagatcattgtttaagccttgctgattagttaggtaatgaatagtagtagttgcactggtactgtttttaattagcttccctccccccacactgatcaagaagcacattttcagagtccctttgaccatggtgagtggattcagaagcatcttgtgctctgaagcatgttcaggttgttattattcctctgagacatgcctggaataatgattagattagtgctaatccctctgctaaagaaagattccttctcaaatcaattacttacaattcgttgcatgatgagaggagaagatgcattgcttgcaaaagatccatgtgagcgtcatgtgggggctccatggatgtttctctgaactctcacggcgttctgctcatccatcccctcactgtgctgtggctgccaggtgggccccgctccgacacggcgatctgtggttgaccccggtgagaggattcgtcagtgatgctcgaatccatcacacgtcagatatgaaccgtacatccatccatcgatcgacccgagctgacgatgcagttgcagacgaatcgttcagaatacgcacatcacatgggaagcaacccatcttttttttttttgcttttttcttttcttttttctctcgttggtgagtgagaactgagaagaggaagttggctacgtacaggaggagccgttgtacctgaacaataaagatgaagatgagatgtggcctccaaataatttacgtgaatgtcggcagaacatcccctgactgtcaatactcaataggtcaaagaaattcaccctagtcgacactcaggagctaaaacgaaatagaaggatatgccactcgtttgttttattgatcaagtttaaacttgttttactgattgagtttagattaatatatgtatttaaatttgaattgaatgatatatagtatatatatggtaaatatagacgaatcattaaaaaaatttctgaatcgggttttttagcatgcacccgtaacacatatagttgtgtccctaccgatattgtcgatgacgtattgagagagaaaaaaaatggacacagccggcaagaggtaatgggtagcaccgcccgcggccgacacagcagggccgaggaggattccgccgccgccacctctgcggcggaggccggcaggtgccacgtgacgtgctcgccgtcggcagcatgccgcactgtgcgtgctacccagagatgcatatgcttccaacacatcggcgagatatatatagatcgatctgaacccgcaaaaaatatagatcgatctgaaactcctgcaagaagaagacgatagtaatgcacagagcgtatgtgtgtgcgtaggacagtatacgagtaggtagaagacgacgagggcggataacatgggcgacacatgcgtgtctagctagctccattccgtgccgtcgctaccgatgcctagctggacagatccatgcgtactcctatgtgatatcgatctgcgttgtcattttcagctccacgtggctttgtcaacgtgccaaatcgatccagatccaaaactcaaaagaacaacaaaaaaaacttctttttacctacaccctctattctataagtaaataagttcattcttcacttatcccacacatactgatacaaaatcaataaaaacataacacccttgttttcttaaatcccaataaaattttttctctctttatcttttgcttatttattcatttactattttcataaactcctatacaataattacttacaaataaacttattttgagataattgtaaaaaaataaaaccacggatctcttatcactacacgatgatcaaatgatcaattgcatatcagataaatggaagaagccaagattgaacataatctaggatggagtgattacctacccaacaagaagcttttctttttctcgtcgccggccgggcgtcacgagcggccagctcgtctcgtggcgtgcatggatgcatgcatgctgctcacgcgtgaccgatcggtccgatcgaatcgccattggcgtttgcacgagaaagcaactcgctatcacttgcatgtgtatgtgctggccttgtgccacgagaagtagctaggctgcctgcgcccttgcttgtcacatgaagctacaccacaccatatgataccaccatacagattaaattgccctaaagaatatattaagcttgaagctgaagaagctagctaaccgaatgcaaaccatgtactccctccatcccataatataagggattttaagtttttacttgtattgtttgaacactcgtcttattcaacaaattttagaattatttatttttttttgacttactttattatccaaagtattttaaacgcaatttttcgttttttatatttacacaattttttttaaataagacgagtggttaaatagtgcaagtaaaaactcaaaatcccttatattatgagatgaatggagtattaattaattaattagacccttaattaatctgacatttctagcgaaagatagattacccacaagaaactaaaggatactgtctcatcatggaccccatcgatccatcccaggctagtgaatttagagggggtgattatatacagctctgcctaattgcgtgattaaccctaggattaggaggaagaagatggtgaaggttccatgtcggccttaattaattaaagagaaggaaaatgacaagacaggtgctgggctggacaagtgaagtgtattgcccccaaagagtacaggacggagaatagacaagatagaagcagcaggggtgagagaaaatcctgatggattaaggcagctaactaacgatggagcctctctaaaattttgtgtttggcatcatctccattccagatattcaataactgaaagctatttgtagttttgcatatattgccccccttcagtcttatcatctagacctctgacccaacagtttgttagaaaaattaaggcaaagaaactagtaacatggtcgtgtgcattacaatttgcaaaaaacctaatacaattcaggatatgagttgcattagcatatatgattagcgaaggcttggagtgtgaatcaaacacgaagcactggctccaacatatcatttttaactgatcgcttaattttcttggctagactagagctgcgcacttaccaatgtgggtatgaccgtatgagcctacggacaactccgctttaaaagtaggttacaacaattattaagtaaaattcatgtcaaatttgatatccatgttcaatagcaatagaaatactaactctgtctcaaaataaattcatatttcactaagctcatgcataccaatacaaaaccgcgtccgtgaaaagaaaatataatacccctatattatcaaatctcaatacaatcattatttactttattttctcccaatacaatttatttcatattttcacaaactctaatacagtagttacctaaaaatgaatttattttgggataaataaaagttgtaggacgcatccaacacattttttatattttcaaaaagtaactgtcagtaggtggggcccacaagcagagacacgcacgccaagcattagtattagcagtatgcttcactctccctataatcactaatcacccacccccaccaccaccaccggccgcgtagttacgcaacgaatcaatcacccccgcggtgattaccactgcaaacaccaccaccgccgccgtgggaaccggcattagaagcgaggagacgactaatcaagccaccaaaaaaaaatttaagacccctccctcctccttgccgcactcaccaccaacctgtaatgtgaacctgctgctctgcgagttatcggtgttcatccagcagcgagagcggtggcagtggtactaggagtctaggacgagtggtgggtactggttgtactggtggtacggcggtttcagcggcggagttctcgcgggattgtctcgttcgtctgatccggcgctggaggacggcggttggtttctttttcttctgctgcttcgcgagcgggtgtgagagatcggttccatgcgggggtcgctgctgctggcctcgggccgtcaggtgatggagaattccggctcccctgttcttcgctttgttcgtgtgtggtttttggttcttgggggagtttgcatggagaggagagggtgaggttcttgggggattcttggtatttgctgtgatggaaggcgtgttcttggatgcttggggtgtcggtttgtttgtgagttggtgccggattctgcaatgccgcggggttttgttagatttgatgattcggtgctcgatgagcgtttcttggttcgtctggtgatttcttttcttttttctttttcagtttttgtttgtttgtttgagttttgagcggttttgtgggacggatgattcgaagggatgttgaaaagttcatcggaaagtgattgcgccgtaaatgttcgattgggcttttctttgacagaaaaattcggttctcttttcggctcagcgcatcattgccgctcttgagaaagtgcctccttttcccctcggtttcctgaactttctgcgatgtaactgctcgtctgcctctcgctctctcccgctttttcatgcttttctttggtaaattcagttagattttcgtgagaaattttatttgggatcgtcggtttttctgacgcttatctgacagttactaccttttctcctctttccatttctgatgtttttttttcttaattttctctctctgtcttcatttatcttgcttagtgtcattggtactgtgatgcttgcctgaacacgtcctgaattcagccagtgcacaattcgctgaaggccatgccaagcaaaacttgttcttgagaaagatccttgtttttacttgtccgatgaaactccctctctttttctatctaccaaatggtagtacttctgaagatgcaattatgggcttagaacagtggattcaggactgctaattttgtggggacttttgttacactttcatgctttcactggttcttgtattatttcagacttccatgttctctttttggttttgatttgcacttgcgtttagttttcttgttttctctgtcatgttatcatttggaccgcaactggtccgggtggttggcatgtgaacgaataataacgccacaatctaggtggttggcatgtgtttctggctgcatgtggtttcgggttgagtgattcaattgcagatcgggaggttggaatttcgtgtgtgttggaaccttgacccaaaaggaaagaatggagtgttgaaaatgctgtcatagtgtcatggccttggtgattcaagtaaaattgactatacaaatttttacagagaggatgtggatgctggagtttttattaggaaacttaaaactactccactgttgtagaatttttggccctttaggtagtactgaatcacttctagtcggttgtaatttagttttgtgggctgttaagttccaatgcaaatgtaggttcgaggtctttagtgtggtatagtagaaatgtttgctccgagttataacatgcttttcatctcaagtttccagtttttttttctgtgtggtaaacgtccacctaactgtgtgtctgtatcatttcaaacttccctttcagttgttagtatgtcagatcaaatttcaagtgttgattataatgtatttgactttgcagggtttgcaagcggaatctactcaactatgacggattagcctcaaaataaatgatggcagctgaggttaatcaaacttttttcgcgtggtcacaaggagaaccaactgaacgggacggttctcaagtaagttttctaaggtattctggctagtagtagtagacgacttcattttaaataaattgtacaatgtgagatcaatttcaaatggtaatgttacactctgaagttaaagcaattgtagttcttcgcaaaaaaaaaacacaaaaattgtagttctgttcctgtgaagccagcagctaatagtctcatttcctttctatttcattgtttactatcctcagggtgtatctgtgtcccagaaaattgatcatggttccatctcctttggaagattcgaattggagtctctatcatgggaaaagtggtcagtattttctgatgacaagcgtcatgaagaatttggcaaattcaatggtttagttgcacagaagaaggcatattttgaagagtattacaggaaaattagagaactgaaggcacagcagcaaaaccagcaaactgaacttattttggaatacagtggtgatggcagtgattcgagtcagacaggagaatatacacaaggtgcagagcttgaaactcctactggatctggaactatcgttgatgattatgtggagcaaggtgcacatgaaactacctctgagcaaggattgacatgttatgatgaccatgaaaacgagaacttcaatgcagaattctcctcatccaatatttcttcttcagctgtaggtttacagcaaactggccgggatgctagagaaaatgtacacggtgatgattcggctggtaaaatggatttagagcagcagaatgccatttctggtcatagtcttggaacagcatatgaagttgtaagggctcctaaaagaattatcgagaaagactccaggcttagatatgctccaaagatagtaccaaagtctgtcaaaacctcctccgatagtcctctggatcgcacatctgttagtaaggtaatgaataatagtgtagtactcactgaagctgcggcctttgtcttgtcaaaaatctgcttctatcagctattacgctaccactatctgtctgatattatagactagcaagactagtgcattagtcctaccttatcgtaaatactttctagctaacatatgttttgtgtttatacactcgagggcatgaatctttcagtaaagtcttaagagctttttcattaatcgttgcagaggcctgattctctgaagcttggcatgagtattaaccagaaggctaagactgacaatgatcgtttattgagaggaccaaatgtagcgcctcataagatgtctggatcaaccgaaaggaacaagcttacaacaaaacaaacaggtgtcagaagaccttcctctgcatcctcacaacggccctctgtgggagagcggcaccggatagccagggagagcataaaaaagcctgctgatgtttccaccccacggcgtccttccactgcagaaaggcaccctgtcaccacagagcgtgcaaggaagcaagccgatgtagatacaccacgccgaccatctacttctgaaagacgtgctgtcaacaaagggagtgctgacatgaccactacacatcgcccctctactggagaaagacgatctgttaccagggagagtgttctgaagatggacgtaagaacacctagcaagacaaggcctactatgacgcaactgaagggtgcaacaaccacagtggtatgttctagcacttaactgtaaccgaagttccatctattcatttatgtcgattgacacttttaagtccatgttttcagttaaatctgaaaaacatgatggcatcagatttcttagagttttcatcttcatgcagggtattgttaaaaaggcaggcactccaaatgcttctaaaagcatcaacatgggaacaaaaaggttactcttatgaacatattgaatagacacttggaagagttagatttgtgttcaagattttaattgcattgttttatacctgatttaatgaacagcaatatcagagaactggaaggaccttcgaaagtgggcagacactctgttgggtcaaaaattacggacctgcaaattgctggcaaacagaaatcaaggtgctactataaattagtgttggaatgtggcatgaatcttttacaatatgatttgtaaaacatattttcttgacaaaacttatatcattttgtagctctgtccaccttcctccacggaaactattgagttccagtattggagaaccagcactgcaaacctttacaaggccaaaaaagaaagatgtaagttgctcaaaacttgtatgtgattcttgttattttatgcatgtggccatgagttgtgtgataaagtgccagtgcaatcgtttttgtaacctttgtcatataaacggtgttttaaaattttgctgtcttctttacttttgtggttctagaaccccatgttacctgctgatagattccagtaattcaattgtaaaatcactttcaatcgccacagccacttaactctgattattacgctgcactgacaagtttgtcagttgtgcctggctgtcagctgaacagagattttgctttctctagtgctttaggttctaagaatttggtttcaatgttatgttttgtactgcaatgttgcaccaaaccattatactggacagaaatatagctgaaacaagataaacaaggtactgtcagtaacagttaaattgagtgctaacaatgacaacaaacctttgtttgggtattcaggttgcagcgcaatctcgagcatctacatcgaagagagcaatgactttgcacactggaaacgtaaaggggaggagttcaaatgtaagactttcacagcactacatcatattgggattcctcacctgaatcctaagatgtctttctcttttctttcttttcctgttgcgcttgatgtagctttattcataccatcagattagattttgaccttttgtccactcatttatgcagccacccccaccaccacctccaccgcgtcggccttcacggacgacgaacagaccaaatggcagtaactcatcaactgttggacaaaagccaaagtatgatactcatgatgaacattcaaaagtaatcttatgatgcttcactgcaaactactgaattacacccatccaatgcagggtttcatcagcaccaaaatggcattgatgcaaagggagactttcattcaacctactctcccgcacaaatgatggatctgcgacaagtcgcaccgctacacgaatcttaaagcatcggcattgctgtccacttcccctgaatgatgtttgatgtttctgtatatcagttcctctactctctagtgcctccccccttcccttcagagcaagtccaatatagtgtatgtagttacctgtatcatatcatcaactgcctagctttgtcgcccaaggaacttagaacagtgctgtacatacctcaaataaaatgtttcgtcagctaaagtaaggctaccctgaacatgtgaaaaatctgtggtctctgaacattgtctgcacatcatcagtagtaatggaaatcgttcattcttttcacttgttcttgtcaataatggtttgactgattcattatttggcatgggcagttccatcgtattgcctttaactgatcatgagccttaacgcatactccctccattaaaaaaaaataatctaggaggagatgtgatctctctataacaaatattgtactaggagaggtcatatctccttctaggttttttttaaaggacagaggaagtactagcggctaaaaaaactgtggataaaattttaatatgcatgttttttatcatcttaaaaagccaaaacattgaaaagcaaactacgatttcaaatttagttataaaaacaaaaacaaaaacccactctaaattaagttctaaaatttaacatttcaaattaagatttaaaacctttttgcgggcgggggtgatgctagcagctagctcctcgccgccgcgacaccgggatcttcctcgtcccaatcgacgaagtaaagcgaaagaaagagacacaaagagtggcaggcggcctcgctcgcgcatgattaaccttagctacgtccgtccttaccttccttcatccacaaggcagtgctgcgaaatcaaaaggagagattcagaatctcatattacttactgcattgcatgcatgtcccgcgctctttgggtgcaaatgcaattcaatccaatgcgtgttgggtaattaattagggtctcggatcgtagagaagatttctaccgtccagtgatttttccagctagcttcacaaggtggtgggctagatgatttaggttcgaaggctcccccttctaattatttaatattaggtttttccctagagggctgctatataacggaatcccatttttgaacgggatgataccggttaggtgtcaagtccggtatcagatgatacatatcaggtatcagacgattctaccacgtttttatgatacttgcgaggtatcagatgatacctatcaggtatcatgcgattcttaccacatagaaaggcgatacttgcgaggtatcaggtcctgatacctaaccggtatcagatgatacttatcaggtatcatgtgattctaccacgtatcaggtgatacttgtaaggtatcaggtcctaatacctaaccggtatcagatgatacttatcaggtatcatgtgattctaccacgtatcaggtgataattgtaaggtatcagatgatacctatcaagtatcatgcgatttttgtcacgcagaaggtgatatttgtgaggtatcaggtgatacctaccagatatcatgtgatttctactgggtaccaaagcctcgaggtggtctacggctgttgccaagaacggattcgtctttcctgttattaccgaatggtacttggacctgacctgacctatgtgcatttgctccaatggtgatttgcagcacaaacaacgagctgttggagctgctatggcacaacggcggcattgtggtgcagccgcaggcggcacccgagggtcgtctcctcctccggccgtggccagagcatcagcgtgctcaccaccggcgacgagacagagaccgccgcgtggttctcgaacacccttgacgatgcgctagagaaggacctctacacgcagctttggcacagcgtcaccagcgatgcgttcccggcggcggcggggccaagctctcaccaccctccgacgccggacttgccaccctctgacgaggccaccgatgaggagcggcatcgggtcgagctagaccggcaacatctattcgaccttctgcggcagtaaccacctctcggagatgcctttactttttggataagcatggggacgaagggcgacgggatcccattatttagcatttctgttttccctaatattcccgttttttttaaagaagatttctgctgaaaatgcaagtagatcattgcctgtacaaactttcattgattattctttctttcgcctagtaaaccacgtgatatatacttcgtcgtttacatccgttttagccagatgcacgatacgtgaccaactctgcctttgtccctgcgactcgtcaatacaagcaatcaagcaactacactttcacataccaattcctttgcttctgaatctgtcctgtttctgaatctcgccgatttctcatggaccaaggagaccgagtttagttccaaacttcttcaaaacttctaactttttcgtcacattaaaacttttctacacacataaacttctgacttttccgtcacatcgtttcaatttcaaccaaactttcaattttagcgtagactaaacacacccggagacgatgaatattccgacaaaacctacccctttacccccctctctctctctctctgacgtcacatggacggagccgtgacgggatcacgtcacgccgtcatggtatcccgccccgctacccgtgggaacggggcagcgcgtgcttttttctcaccaaacccaccccgcgtcatcacgctcgctgtaaagtgggccaggggttggcgtgctgggagatgggccccactagtcagtgggagaggtttcggtttggaccggctcgggggaggaggcgaccggggaccaccgccccctcctccgcacccgcacatgccacgtacgcagcgggtgtgggcccgaggtgtcagggagagcggggggacgttttcggtgggcagaaaggcgtgggatggggggcagtaaggtttgttgggccccacgtttcagcctccagctgggatggtgggccagcgggagagctgtcggtatgtttacaatagttttttcttgtggaagagatttttgctaggcgcacactatattgttttcaatgttttatgtatgcatttagagatgtaaacctccaccaacaggaaatccatatctgaggtaatattgttaggccttgacacaataaacgagactgattaggtgtttttaacctcagatgataactatgcccatacatttagaagaaaaatcttagacaattttaataacacaaacattttctttcaaaaccatgtgccatgtcaacttactagtgctagatgggtttttagcttttcgcgcattacaacgaaagaataatgtgataagttggtagatatatggtgtgaaattttctttcttactacttaaatttctctcatgtgcttatatgtttcatacttagatcaattatcaaaagattataaataattggattatatagtatggtttttgggcagaagagatcaagagataatttatatccttgatgaatcatccaaaagctaaaaaaaaaggacgatatatcttcacgagagaagaaagaattaatataaagtagggatgaacgtttagatatacaagattagctaactttttaaatatatatattttattagcatctacatgaatagaataatatctaagtcatttttattaatattatttaatgaataaagagtgatactttggtattggatacgtgaaacacacatgataaatacatatgacatagatataactattgagccgttgaaatcagtatccaaagacgctagcacatccctgttatttaaataggatcaaacgagtctgaatcaataaccaaggagctcaggagaacatgcccttcttctccatcgcctctttggtctcttattgtacattttcaatctcaccataagtatcaaacacaagattgccataaagattatccatcccttcctttcctttccctctaattttctttcacacagtccacaacccacaattaaatcatggcatgattgctccgtgatatataatgctacacacgtcaccatgtcaatgatcccctttcttttcctatcaacagctacaactataaaagcacgaccggtacacttcagcatctccaacatcgatcgccggcgaagaaaataaaaaaaacacaactacgccgcgccggaggagaagagcccttttgtttcatatcaaccgctacaaccaaaaaagcatgatcggtgcacttcatcatctccgatataagtcgccggcgaagaaaagaaaaaagaaacacaactatgttgcgccataggagaagaacccatttgcctcctatcaacagctacaatagaaatcacgaccgtcgcacttcatcatctccgatatcggtctgccggtcgccggcgaagagaagaagagccaccatcagcagctgtggtggaatggaatcgatatgggggcgtgtacacccagcgattacacaccccgggcttgttccacgtcggctcggggtggggccggccaaggctggaggctcggcgcccaccgagccgcaagacaactggagacagcctgtctcccacccctctccccctcttcttcgctctgtctctactctctctctctctctcctccccttctccccatctctctctctctcctctctccccccattccccacctcgcttcgcctcctcctccgcctccgccgccgccagggcctcgccctcccaccccagcagcgccgccgccgccgccgccgccgccgcggccggatcccacgcgcggctcgccgcgccgccccgttcgaccccccgaatcgccggatcccgtcgccggcgccgccgccgcgcctgggggggagctcccaccagggcgctccccgctatcctcctccgtccttccgccgaggtgatttgctcggagctttcgctttcttactagtttttttttggatggggagtgatcttctcttacctcggtgggtgcttaatgtgctggtttgaacagttggttgtgggggaaatgagtagatgttgtgcttgtgggttatctgagttggttggttatggcttgaattgcttcttatttggtgctggaatggttagctgaagcaagtaatgcgctaccagcttagtcatacttaggtggtgtgcttgctaatttagcagattaaaccggttttatgcgaactgcgaatatatagaagtgatggactgtgagcatcttttttgcggggataaggtttagtgtgtagtcgaatcattctagctttgcagggttcgggcgtgagcttatggggtactagtaaggagtaaatatttagtttagtaatttgttgcctccttaagcaaatttgaattggatttgctttgcaaccacccttatgcgattgcttgatgattgcagtgctgtagaagctggtcacagttgaaacctggaaggcagctgagtctatggtttttgtgggccattgtgctatcgatgcgagtagagagcatgcgtggcagctgttcttcgggtgatgcccctgaccagagaagctgccgatgcattcggtgtggcaacaattacactgtttgcaatcttcgctgttctgggcctcttctgcattttccagtcaatctatttccggtttcggattcggagaggggccttcattccgctcggatactttaacggcccttgggtgactcgcattgttttgattctgatcaccatttggtggggagtaggggagattgtcagattgagcttcttgaagagaaagttgttctccagcatattattgcagaagggtgtatgcgacgcgtacatcctttccaatctagggtttgcggagccaagcatcttctttgcgtttgctttccttcttcacggctcgttacagaagagggagttgggcactttgaaccaaagatggaattggaagaccataggctacatgttggttttctgcgttccggtgttcttcgtgcaggctcttctcgtgtttgttgggccaacatttgttaaggatgagaacaatacacatggaaggaaaaagattgctaaatacttcatccggacatccatgccagttggggacacaaatatttgcacctatccattgtttggcaccattttcctgggacttatagacgccatcctgatgagctatgtctcctatgttggatctcgggttttgtccttggtcatcaacaaggcactgcgaaggagggtttccttgctgatgttatcggtgcttttcttccttcctatcagggtgcttctacttgggttttctgtcctgccccaaccaggagatgtagcatttgaagtgatcatcttcttgtcattcttgatgatgatatcctgcacaaccgttggtgttctcttgctggtgtactatcctgtagcagattcattggctctccgagagataggtcagagggaaataacagagatggttccttatgatgattactactatgaaggtgcatcgcttgtagccaaccagagctttcgagaaattgaacggaactcagatacttcaacgaagcgtggttccatatctttccgcactatgatcagggaagaccaacttcagcaggatggtgttgatgaaattggattctcctctcgtagtggtgctcatattggatcaccctcaccttcaggttcatccccaagtgctgcaatgcccatgctccctctcaaggaagtacctagatactaagaagtattcacctgttccttttgcccttctactatgttctcccttttcttcttcctctttcttcctcttactaccttaatgataacagttttgtggcaatcaaaggtttttgtaaagtttccaagtagcttgactcatcattagtttagtactcaaatctcatttatcaaagtggcatgtagctggatgttgcaaaggctgaggagctgtgcatctggcattggctggaaaggctgagttggaattcacttttggttggttttgctgctccacaataatatcttagctaataaattccaccatggcataggctggaatgggcctcagccttgtcctctattccttagctgcttctctccatgacagctatgcaagtatatattatatttgcttctttgtgttgaattaaaggtctgccaagagaagctgtcagttataaatagctttgggggaaatacagtggtagcatatgctaagcaaggaccaccatcttgccagtctgccctccatccctatccaactaacaggtgagcaatgaagattaggcaaatgtttgaccaaactaagtcaatataggaactcaattcaaatcaatttttgcccacttagaatatatgtcccatgaaatatactgaagtagagagctggaggaggggcctgaggcttcatatatggctaaaagatgaatctttactatgtttatctcattggctgctctcgtactctgcaaagttccatggctcacctgccctacatgctttgacattggcatagatctgtccatctggggatgtctccttcaaaatggatcgatcagtgggcaggtgagcttgtttacaatttcctccccctgcatagagtgcttagcatgatccagatgcacactgcctggtatccaaagcccctgttgctgggcatagtcaactgggacaaaattgtctcctgtttttgtgattgtcatttgtcctgtttctacaagctctcctctaccctcccttctccggcaatttttcccctctgcagttgtttttcctgtcatgttttttgtgcttgtagtagtagtagaacataggattccttaggttggggtaatatgggtactcgaccacttgtgttacttgcctggtgctgccagtactgcaatgcatgtgatctgtgtggcttgaagggatctgtcataattttagtgggcctgccgtcttgtgtcactttttattctcttacaggatgggtctcttggaatcacactcttcacaaacaggagcaaagcgaagtgaacgtcataagcagcagctagcactcaaaacaaattagggccttctaatgtcctttctctgatcccaaattcctaacgaaattcttcagacatctgctgcgaccgtgccatttatttcaaatttattttttctttctttttgaaaaaaaattactatgcgtttgagcaagtgtggacctaacgacgcaatggaagaaatactagaacaaggcatgcaatcttctggaggtgttcgtatgagtagagtgtacattcataggggtaagtgtgcgtgttctggatgcctgtatggctgcgtttatgctgtgtttcttagaaaaaaaaacttactagttggtctcgcacaaattgttttagctttggaagaatcttcctagttggacgcacacatgtaatcttgcatcggaaacatggacaagtggagaccattttgcttgttaatctcggcccaaatggtcgacattctcgagtgatttgcctgccggggtcgtgacagcggcatcgccactgttcttttcgtacccgagcaacgtcccccgcacgctatgcgggacgcgctgtacaacttctcattcccaatgctgtagcgcacgtgacgtccaagaggaaggttgatttcgtctgtggtggctcctaaactccacttccacgattccgcacacatgttttccaaactgctactcagattttgatattttgcttatactgtttgatcatttatcttatttaaaaaatatatttatctgtcgctctgtttatgcatgggattagttcccaacccacgtcaaagaacacagccaaagaatagctcgcagctgcccaagtggatgagctgcacatcgtctcttccacgaggccactgcttattattacaaatttacaacacagttttgttgcaaagttcaccttacaagttacaaagagtcagtatgaggctacgagcaataagcttctcttcatcttaggaagatggcagcagggactctcatgctgtggcgttcttcaggtatgcgatgagatcagcacggtcctgtggctgcttcagtccattgaaccccatcttggcaggagtgtactgcatatgcaaacaaagagtaatgtcctgagatcatattgaataaatgaattgccctgtaatagctgacaaatatgtctgaaatattcagcatctgatgtgcaagcgtttaagatataccgcgtgtgtatgtggtggtagtggtagtgggcaaaatcatttcattggatgcactagaggtacttagcaatagcacataacagtcaccgctagcaagacaactagacaaggtgctctgaagtagtagacagcgctttttctgaatatgagataaccatgaataaaagtttaactctagtttttctttgagatcgactcgcatcagctcttgtgatgcaatgacccttcatgcgaatcctgctactttatgagttatgcctgggatcacagaaccaagagtatctgcaaagacacgtaatagaaacaaaatagcacaatgagctaattgtagttaatctatactagcatgatgatccgcgcattgcaaaggatcccaaatttaaaatataagatgcaataaataattaat

SEQ ID NO: 71172 - DNA, 689 bp, Oryza sativa
  unsure (1)..(689): unsure at all n locations
acctatgaatcaggaagattcagtggtatgtagatctgtatcacatagctatcgctgttaatatgattaaacatagataagaattaaagcagagaaagccatacttacactcattctccagcagataactccactggtatgctattccttcgctagcctcctttgaagaatcagaagtaaacactagcaacctgtggttctttgcaaccatatctgtgacacttggccagtcctttccattagttggcatttctgagatagggtaccaatatttcgtcaagtcagcagcagtaaacaatttgctcaatcccatcgttgaatggacgtaatcctcaatgaatattgttattatctctgtcggattctcagatagaaatgcttccacctctttcaatgtgtcaaattgggctggttggctaaacaatannatattttcaattttaaaancactnnttagtttttttagggaaggttgggttaaaaaaaccaaggnaaactgttgaaagataacgtgaatagattcaaaagcaaacaataccactatgttactaaactatccaaacaattgatacctaaaggaaatttattgaaatgttgtcccaaaacaggagacgattggaaaacaaagcaaccagtgcaggacttcttatctaaatggcacgcgcctttctttaaatcttagcacaaat

SEQ ID NO: 71173 - DNA, 11714 bp, Oryza sativa
aaaaaacacggccaatcaatataaacatcagaagctaccacttatgagttccagggaggcgactatctttaatttaggtccacagcgtggcagcgcgagggcatgctgtagaataatcagcaacactaacaaagttcacaaaacactatcagttcaagtgacaacaaagcttgcaaagtcctccagtccccggacttaacaatgatcacttcgactggcaacattggcacgggacaacattgcaaatgaaatatctggtcacaaaatgcacatcgccgacgcacacatttgaagttacactactgattagaaaacagaagtgatggaaagttaacattggtcgcaccttcttaggagtaagcaggtagtcatacaaagtgttctcttcccaaatcacaggcactatcttgtcgccagatgggtaagagaaaccaggagctgtaccagattgcctcccaaacaaaccgttcaagtttggccctgcaaaggacagcattgacattagtaattacatatcagcatctggttggtaaagaagaaaaagagggagaatactacacagatgaaatgaacagatcaaatgaattgaactctgaaaagtgtcattggatgaaatacacagctactgcacagaacagtaccagatggaaatggttaaggccctgtttgttttagcttaagattattgtaatccagattattcaatcagattactctaagctggattataataagctgatatagaataagttgcgagttgtttgtttctctggattattggaggcatctaaggatagtgggtctttagccactcaataatctagaaaaagctcctccataggagattattagattatactaatctggcttatagattataataatctatcataataatctactccctccgtttcacaatgtaagttattctagcatttcccacattcatattgatgttaatgaatctagatagatacatattgatgttaatgaatctagacatatatatctatctagattcattaacatcaatatgaatatgagaaatgctagaatgacttacattgtgaaacggaggaagtacttgtttgttttggcttactcataataatccagattataataatcctaagctgaatcaaacagggcctaataattgacatttcacagactagccgataaacgaagactatataaccgccaaagatgtataggatcattagaattaccattaaaactagcatatgtacacctggccctgagtatactacatcgagagagaagagctcagagagcttaaatgcatattaccagctaaccagcaaatccagcaagatggtcaacgcatgtccctcgtatgattcatggtgattgcaaaaatcaaacatcagcgacagacacgtgctagctgtaagatctaagtagcatatattacacaaaccaactatctgatggcaacctggaaaccctgccatcacgcatcagagcagtaaaacgatgcagaaacctccacaatctaacaatcctccaaccggacgaacactgagctatatgcattaggtggttcggtggctcaccatgcttgtggccggcggccttgtcgacggcatggcagtacgcgcacttggtcctgaagatcttctcgccggccgccgcgtccccgggcggcgcatcggagaatgtcgccatcgccaccgcactcgcggaccaggtagggtttgggttgaccttggaatgactgatggagaggggatggacgacgggcctggttgggccgcaggcccacgtagaggcctcgaactcgaagcttttgaatttttaattcgactagaaaaacattatactctttattttcggtcaaaaacacattttgctccttccttttcagtctcggtctagcccaccgcctccctgtgcttagcctgcttctcttgaacctactctacaagtagaatgtaggcctagctcgcatagttgaatgccatcttcaacctccggaatacagtccgtgtagtatgatgctaggaccgatcctcctatcaaatccggtcaaatctttcttgatctcctaaaattggttgagggcttttggatcactcgatctcctcttttcatttttatcaaaattggagcgaatccacaaaactgtgggatataaacggtgacttctaaatagagattgaatatgaatatggtgaattaaagcggagctgaaaagaaaaaatatgtggaaaatgatgatgggtagtggagaattgatttttataataaattggaggacggaaagcatgaggaggttgatcgatgtggcggtggtgctagggttcggcccaacgatggaaaaccgagtagatgaaaaaaaagaattctaagcaagtgcgcacacccttccgcgtgccaaaaaaaatatgaataaaaaatagggacgggaaaaaagaataaaaataaaaaggcgatggcaaaataaccggaaagaacggcgaaaaaaagatggatggaaaaaagaacgaaaaaaagcagatggaaaaaaagaaaaatgggaaaaaaaagaaggataaaagagacggacatataccaaatctgtttttccggatggctttttttttttttgcagtcggcgatttatttattttatttacggtcggcttttttttttacccagcattttttgctatttttttcgttggtacgaatcggacctcttttcgctgtttttctttcgcgagattttttttacataatggaatataatatccggcctttgctcaaaaagaactatagccaattattagaaagatccacttcagaagagagtgtagttcaagacaagttaaacacaccaaacaagagaagagaggaaccaaactgagaaaagcaaaacaaaattacggattttgaggaatagagattaaaatcgaaacaagaaattaaaaccgactcaaacacggatgatttaccaaagtaccggaaaaaacatcttcaatttttataatagtagtaatttttgaatcttcacatgtaaattttgaaaatttatattggatttggtctttttcttgaagatatggtaatttagtgtccattattgcgtttcttagttaccttttgccttttactgtgtctattggattttaatctaaagattaaaaatctgcgtgatatgattataaaaacctttcgaaagatgcataggtacccctttttaatttacgtccccattgtttggctcggcatatttacaaacgagaagtaatttataaataaaatttttatatatgtgttcttagcgacctaaatgtaaaggctgagaaataaacttcgatgaaaaacctcaatatttgcttcaaatttaaggttaaaaattcaaattttggctgataagcataagcataagcgaaaagatgaggccgttactctttttttaagaggaaatttgaatgaattttgaaaccatgccaagatataattaggcatatagggcagagattttagtagctacagtttcactgaatcttcgacttaaaccaaataattcatattgtcatctatattttaagagtctaaagttgtaaaatctaaaaactgaattaaagctgtaagcttaaaaaacccaagttcttcatactcttataaaaataacatctaatatgctagctatgaatgcatccaataatcctttttctcaccgctgaatgctgatctcgatcaagagcagtcatggcatgtaccctttcccctgtgggggattacttggctcccttaagttcacagtgccccgcgccggcggtcatcgagctgtcgccgtcctcgatgtgatgtggagtcgaaagtccattggagatttttggagcagcgaacggcggaggaagaaacgcggcggcggcgccgcgcgctctttagcagcgctgcgcaggtagcaaagtaccgtattagggcaatagcaatagcactctttagcagcgctgcgcaggtagcaaagtaccgtattagggcaatagcaatacgtcttgcattttgttagtcctgaactgccaagtaggatgaggaccttccaaggacacaagactcacggtgcgaaatcaaggcgggtggaaaggcgaggcgaagccctgcgcactgcaatggccttgatatcgtcgaaaaccgggtggcaggttttggtcacaggttcttcattttggtggacccatcaagaaacgtggcatggaatcttgagttttggcggacgtggagagctcaggctgaatgccagctccttgcattgtgaacggccttagcgacaagttttatcccacctcgacaaatttgatgttttgtgacctatacaaaagagtttccacctcatgatgcgttgcctcttcggagacaccttatatttataggtcacagcatattagctaccaagtaccaaccagtaaattctcacaatcttaagctccctaaacatgatcataatgtcattttaaaagacacagtactaaaatatgttgctatattttttttatcctctttgtctatttctacaagccaaacgatcatataatacaagatcaaacgtctataatttatctacgagtggaatgtgaatttgaaggtttgtacgcaacgtcttataaatgtctagaattaacaattctatggctattcacttgttgcgagaatctcatatatcagtttgtgtatgtcagtttatgttgttggaggcatactaggatatcaccactagcatcatttaaaattgtacaaaactacgtggaggaaatttgatgatgaattttgaaaccacacagtaggaatcgcgccaggtgctttgctgctaccctagaagataccaggcgatggggcccacctgccagcctccgtgcgcaccactgccccacacgccgccacgtgcctcgtctcctccccctcccctctcctctcctccgctttcctccctccctcctctgctgctccttcccctccacgccttatcgcttccgagctcccatggccgcacgccccgcgcgctagctgaagcagccagcctcgggccccacccacgcagccgccggcgccggcgccgccgctccccatgaggcagccgcacctcctctcgccgcagcagctctccccgtccccggtcctctcctcccacttctcgccgccggcgcccgggggctcgccggcgtggcggcggggccgacaccaccaccaccggcgggcgttccacccgccgctctcgtcgctgcgtgaccccgacaaggccacgctccgcaaggcctcgcccaacgtccccttccgcctcggcggcggcggtcagggcggcggcagcagcaaggaccggcgacccgccgctgaccaggaggaggaggaggaggaggaggcggcggaggataagggagacggcggcgcgggggccatcaccgggacgctcctcgccggggcgctgctggttggagtcgtaggggggttcggggcggcgggatacgtgtacaaggaccagatcaacaccttcctcacccagttctccgggttcattgatggtaatggctaatccagctgtgttctatttggattgtgctgtgaaatgctactggtctattgctgaagactgaagtgtctccttgctaattttgtgctaaagcaaaccggaagctggatgcgaatgctctagggcaaaaaccaatgaactagggcacgtcagtgtggttttcacactttattaagtgttatgtttctcaaaaagtgtataaaattgattgggtcagcatgctatataaggcttagttcaacttgcgatgtgtgctatgtggcaaaataaagagcacatagctgatttacgtatgtgcgcaatgtcttgtttgatcaacatagatttttattttccacaactaattgtcctttgttgaatttctgcctgaaatgtgaccgtactttgcatggacaggttatggccctgctggatatgctttatttgtactagtgtatgcaggattggaggtatgtccttttgctagctaattttactttcattgatgctgtacagtgtcttcgtttctataattttcacctaaactagctagtcaattacagtgatagtgtaaggctgatatttttgcctttcagttacacacacacacacacacacacacacacacacacacacactttgtaaatttgttgtgccaaaatgtttgaatatgagtgagtaggcaataggcacttttgttttggataaagccacttcttgatggagggcatccatttctttctttgtttgatattggtgaactctgaaataaactaacgatctacatttagccctgtcaaccatttgtacaggcttttgtcatatattcttgacatctggattggaacttcaccttcataataatactatgattttctttgaattcaggtccttgcgattccagcgataccattaacaatgtcagcaggtctattgtttggtagtattactggtacagttattgtctcaatcagcgggacagtaagtaaatccacatcaacagcattctgttgttaactctgccttcagctgcattttcttattgtgctttgccaactgtgcagctagctgcagcagtggcctttcttattgctagatactttgccagagagcgaattctcaaattggttgaaggaaacaagaagtttctggcaattgacaaagcaataggtgaaaatggatttaaggttgttactctgctgcggcttagtcccctattacctttctctcttgggaactacttgtatggcttgacttcagtgaagttcttgccttatgtcttgggaaggttagtttctaccaactcctgttcttccatgattccagtatggcattttctgtcaaacaaacaggaacggcaatatggtctcagtataacgactctacttggtagtaatgcaatttataagaccaaaagggtagtaaaaatcatatacccgttaaagataccaataatccattgcaaatcttatatccctttaaagggcaaaaattgaaggatcgtcaatagtacctttttgtcaaaaccttgttggctcagatatctttctaccattgtcatgcagttggttgggaatgcttccaggatcatgggcctatgtcagtgctggtgcatttggacgagctataattgtaagttcttaaacacattgaattattttagttcattgccagcacaaacgtacttccattgccatttcatccattctgttcaatgaaaaccacatctattgaaccacagaactctttcagctcctaatggctgatcagtggtatttttgtactttgtttctattttctacgaatgcctgtatcttaccatatgtgctttctcatatagtattgtatccaataagagctggttcatgccatgaatctgggagtgttttgcagtttgctgatcgccgttgctttgtagtgaagtgttcaaaggacacttatttttagatgtttacatatccagaattgcatatgtgtacgtcttaattcaaagccatgaattctttacccttgcgattttctgcctgtagaattgatccaccgctagtttagcagttcacatcttcgacatttgtatgtctggggtgaggagagatttttcatgtcattaccgaatgatcttgcttgtcttccttctctatttgcataattgcatagcagcagaacacatgctatccttgaaatgcttatctggtggcttgactattgaaatcataacatatggttcttactgctgctttttttacgtcaaacatgacatggctctcattttgacagcaagatgagtcagagatcggtttgggaggaaacagccagctactgacactgggcatcgggctattattcacagccattgctgctacatatgtaacacgacttgcaaaggtattgacttgctatgatctatcacacatactgaacaaatgggattcggcagtatttgaacatatgcttatttcgttagtggtcactttgggtttcaatttctctttttcgaaagccaattctaactgttcttaactatgttatttgcaggatgctgtaaaggagatcgatgaatagaatggtaggattctctagtaaaatgcggccttctgatactagcatactagcccattgtacatcatcactgtcatctttgatgcaatctgatctactagaaattcaagcaatttttcaaaggactcccagatgctcgttggaatgcaatgctggttctctctcttatgcacatgcctaattgcctatagagtgaatcaaccaaaaatggtcaaagacaacacaatcgtactaagctccagttaccagtaatctccacaagaacatgaaccatccttcatgtgatggaagcagttggagtctctcagtatgatctccctgccgtacacctcggcgaccatcttgatcgcggcgtggcagtcgccgcacacccggaggttcttgtacacgcggatgggcgcggcggctggcacggcgaggaggccgaacgcgacggcgagcctctcgccgtggtgagccagccccatctccctcccctccggcgcctcgtcctgcagcgcccactcggtgtccggcacgtgcccccgagcccggatcctcgccgccatctcctccgccttccggtagatctccgccgcccgctggtgatccctgtccccggcgtggaacacgtgcgtcacgccggcgaccaccacccagctgcacccgggctccttgctgatgccccgcgacctcatcagcgcgcgcaccctcgccacgtcgccccaccgccgcgcccgcgagtagaggttggacagcatgacgtacggcatggcgtccgtcggatccagcctccacaccatcccggccgcgcgctcggcgagcgccgcgttccggtgagtccggcacgcggcgaggagggccttccagaccgtggcgtccagctcggccgccgggctccggtcgagcaggtcgacggcctcgccgaggcggccggcgcggccgagcaggtcgaccatgcaggcgtagtggtccggccccggggagatgccgtgctcggattgcatggactggaagtgggcgcggccggcgtcgagcagcccggcgtggctgcaggcgaagagcaggccgacgaaggtgacgtagtccggcctgcagccggagcgggccatgtcggcgtagacggcgagggactccctgccccggccgttctgcgcgtacccgacgatcagcgccgtccacgtgatggcgcaccgggagcgcatcgcgtcgaacaccgtgcgcgcgtcgcggagcgagccggtcttggcgtacatggacacgagcgagttgccgaccgagaggaacggctcgtgcccggaccggaccgccgcggcgtgcaccgaccggcccagctcgagcgcggtcgagccggcgcacgagctgagcacggccgcgacggcgaactcgtcggtggcgaccccagcggcgaccatgtcgcggtaggcgcgaacggccaggccgtgggatccggcgcgggcgagcccggtgacgagggaggtccaggtgaccacgtcccggcgcggcatttcgtcgaacaccgcccgcgcggctccgaggcgggacagcttggcgtaggcgtcgacgagggcgttggcgacatggaggtgcgacgcgagccccgcgcggaggaggagcgcgtggagcgccgccgcgggcggggcgcggagcagcgcggcggagttgaggatcggcgggagggtgtactcgtcggcgcggagtccccgcgcgcgcatctcggtgaacagcgccagcgcccgccggtgcagccccgcgcgcgagcagcgggagatggccgcgttgcacgcgaccagccccttcccgcccggcgacgccatcgccggcgccggcgccgtctacgcgattagagattatttatcaaactttgtcgcttaacgtaacaactactactacgcccttctcgtaataaaaaccaaaagaaaccaaggcgttttcaacttctcattcgtgcgttcctccacgacgccggcgacccgtcgccggcaggtcgccggcgccgccgtacaccagagctcaatgccggcgaggcgttcgagaggtttgctcattttcttcgaatcatccagaagccaagaattggtcggggtcccaaggcggcgatgcccaccggaacctttcactgcctccagattcttgcccggaaatctccaaaatcccaaccactattccaaatcaaaatcagcaacaggctccatttgccaattgccatgatacgcgctaatggatttgctaaactagggattagcttccgttaaatctgcaggctaacaaacctcatcattcctctgaagacgtcgtttcttcaggacaaaacaagagctcgtgtgcattcgggtggttgtgaatgacacgggtcattcctacaaaaacagcaacacctgcagctggtaatttgttaatctgcatgcgcctatctgttgctggtggcctaacttcgacgtttgctgactttatagaaaaaatcgactttgcaaaagagggtaaaagaagattctctttttatcagctgttttttttttctcagctaagttgagtaatcactaatcaaccataaactaagcaccttttctgcagaaagcagcagaactgatatagtttcgtattcgtggtgaggttacagaaagagctaaaagaccgacgtggacagactcttgcctttcgaagtgccaaactcatctgtttcaggatcactcgaaaatgggttgacaacagccagtaattttggccagaatattaaaaccgcaggaggatttgttcgttttcttttgccaatgattgagtagttccagtatctcgctctcactgaacattctgtcacggagtgaccagagaaatcagatccatgtaaaaaacgaaaatatcttaaatgtggtttttgacctgcaagagaaatcgacagtgaatgcggttctctatcaacgaacgctctgctcgtagccgccaccaacgcaggttcgacatgcaggcctctaaaaatctagctgcatttcacatttcatcatcctcctcctgctcgcacatttctttcaatactcgtgttgaaattgagtactccaatgttcaccatctacgacaacccgaacccgaaagccacggtaaatggtgagtctaaattatagcagcgaacacacatcatgagaaatacatctatacttatcaaggaaaagaaataaaaaataaaactgttttttttacatgaatataatatataactgtgagtgtaaaggtagtaaaactgtactccctctaattttaaatatatgaagttatcgaatgtttaaccatctatcctattaaaactatatatgcatcacttattttgttgtgacctattttatcattaaaatattttaaacatgcatatattcttgtatttgtacgttaagattttaaatataacggataatcaaaacgttgtatatttttacaagaagaaggtagtgcaattctttttaagtaatacaattgggcatttttatttttcgagataaatacaattgtgtgtagaacataaacattaagtaggaacatgtaaaccggaaaaaaaatcattagtacgtgattaattgattttagtcatttttaaatcagataaatactaaagtaaaatatgtctttataagaaaacaacgggacctaaatggatggtgcttaaaaaaaaaag

SEQ ID NO: 71174 - DNA, 734 bp, Oryza sativa
  unsure (1)..(734): unsure at all n locations
gtgactagcttacatgacacacttcatgaaaaactatatcgataactgaggtatataatgacctgtagggactatcagcataggatcaaggcgactcatagaatattagacatcaacatctaccatacccaagcaggtgttgcataggaagaccgcttaaactccgagggctcccaaaaagctgaacgagggactagaggatgggaaataaccatgacaccaccacacatgtgtctctctacgcattgcgaccactttcatcattaacataatactctaaagatgacagatcgccctgagctcacagaaaccatactggagatgtattgccaacacacaactgcctgaatgtgtctgcttaatgccgctcatgcgaagtccttttacatacttaaagaagaagaacgatggccacaagcaaagaatcttgagaatactttcctttgtcatgcatatgactgacaatacatggcataagaggcttgaacaagaaagggtagtcacataccatggtcctgaagatcgttacgactgagaatagcaaagacggctgtgcgtggttcatcncattaccattgccgaagtgcattcaagaagaacattccgcaggccatggcaggacaaaatgactaattgaaatggctataaacgcagcgctgccatcagtgaggtactcgccattgtgacacaagaataggacaagtacggttgcagatagtccaccatatggaaaa

SEQ ID NO: 71175 - DNA, 959 bp, Oryza sativa
tatccatgctccagagttcttcagtaaaagctcaacaaacacaatatctcggaggaccacaagtatcatgtagaaaaaccagaatactccaaaatcagccatcatggagcaccagattcagtatctatcgtggcgcctgaaaataacaactgtctaatgttagctcctagtgatataaaggtttccatatcaaaagcagataatttcattgtgtttctttgtcattatactgtcaaaagtttatggtcggaataaatcgctatacaagaaaggcagagagaagtgagcaaagaaaccattgaaccatacctgcgctccctggatcgagaacgttcccttctccttgaatcatggccacgcgaacggtcataatctctatcccgatcgcgatcatggcggcggtccctatcgtggcgcctatcccgatcacgatcatggtctcttctgctttctcgaggttcaactctgtcctttctttctgaatctctatccctggatgcctgaccattgcggtccttgctgtattctcttgatctgatgagcacagcatgtactttcagattatgctgacactacatgaaaatgaaactaggatggaaaagcacataccgcctgtcatcttcaggtgccttccttcttttacttctctcctcctggaaggcggcatagaatattttataatgataaaatcatgatatcaaggctccaatttgcataggagggaaacagataaaggaaaaaaagtaacatatatataaaaaaaaggtgcaagagatacattacggttaaattgctccagcaattaatttacaaacttagtacttacagtaaaagatggcaaaaggagtgcactttcagagtaacttaaccggtactatttatcaccatctctacaaaatatggatcacccagcagaaaacaatctccagcttctgatcaacataatactaagcagatta

SEQ ID NO: 71176 - DNA, 2569 bp, Oryza sativa
tgctctatgcgatatattcataactctcttttgtagatcaagatcacttactggctcaaaccaacctgagccatctaatatgattgcagccatgccatgtcttggagagcaaacacctccagttgcaccgaaaaaagccaagagcaagacaaagggaaagccaccatgttctgctgttccaaacagcccagctatgggcacaaggagcaaaaataagagccctgcaatgggcactaggagcaaaagaaagcttatggactaaattatatatatatatatatatatatatggctagttgattaggttttatttggtactgacaatttattatgtggagcctgatggattttgttgttgtttgctgtgttatgcctcatgatgcaatgatgtagtggtatggaccttatgctattatgctcatgatgtactgcccacttactgtcatttgcaacatttgtgtatggagtggaaagttggtttggttcctgcactactaggtatggaaatgaaattgtggtctttgcatgatatgaattgttctgtatggatgatggaaatgagattgatatgaaatgctctttgtggatgatgaaaataaaattgatatgaagtgctttgaatggttgctacatgatttgattgatgatgtatgatgctcttattgatccggactattttgtttcacaaaattctatatggatactctctttatttacatcctgcctaattttttttgtatggatatgaaaaatttttttgcaatggatttcctcctttgtccacaacaagttcagcttcctattgaatgtaccaatttttgttgtacagaggaaattaatgtcactttgattttctaaccctattattttttttgatcctattatttttttaaaacgaaagtgatgtattgcatttttttccaataccacaataaaagttttaaacttattattagcctcataaatacacatattgtgtggtcaacgtttttcaattctttttcaatctacctagcacctgctgttcctcctccatctacaagggtattatggacattttcaatcacatgtaactggaaaatgaagaaaacctaacgggagaggcatggaagggatgaaagcgaaaattcgggggtataaaggggatcgagtaaaattgggggtatagaagagattagggaagttttcatgggtatacaagggatttactcctaaatttatcaagggtcatgcacttgataaatcaaaattggagtgtgacctttttggggtctactgataataatcttttggtacatgctaaatttcaagttatatgccttgaacagaatatatatatatatatatatatatatatatatatatatatatatatatacacaaaactgaaaatcatcttaaaggattacaactgaatttacatggaatccaatccattagacataaatgaatctgagtaattctctggatagtacactatgtgttcacggtaatctttaaaagcttatagaatcctcagtacatcgagttgcaattttgcacagataaatacaattctctaagaaacaggaatgaataataagaaatgtcagtggtagcatatggggcaactgtggaggcacaaatggacgcgccaagaaaatgtaaaaatgtgctatcaattgcaacttagggtgtgtttgaggagaaggggattgaggagattaggaagatacgcaaaacgaggtgagccattagctcatgattaattgagtattaactattttaaatttcaaaaatggattaatatgattttttaaagcaactttgctatagaaatttttttgcaaaaaacacaccgtttagtagtttaaaaagcgtgcgcgcggaaaacgagactcaaatctcccctatgtccccagaacgaacggagccttagtgaacaaatcttggagaagaacaatagtttattagttcagacaaaaatgagagttttaacttctatactgagaaatggaattttatacaaaaccatatacctttgaagcatgaaaaaaggggtcactcctatgatcaccaggaaaaaggcaacatcaaatgagattgtaattttatagtgatcaataggattttagtactgacctgattatttgacagagtctctgttcacttggtaaaagagttcacaattcaaattaatctgctttagtcactactcatattggaacactattccatgtatataccttgagacaaattccaggcctgctgatcaattatgaattgaccagcacatttggactgcagtgaaaacagaagaaaaatgatatctcagtcaataaaaaagccaacgtgtgagaatagccggtaaattagaactaaactgcacatagatattatactgctcttccttcctaatatctgaccatgcactgatttggctactcccaagaatcagatgggaatgattagaacaaaccactgtgtacaactatgatatgaagtatatgaaccgttcatatctaaaactctgcattgcaacaagactacctgaccaaactgatccatggaagcagatctgaaaaatgcat

SEQ ID NO: 71177 - DNA, 2120 bp, Oryza sativa
aggagggggtggcgtccggcaacgcgagctgggtggagcccgaccccgacgacctcgtcttccccggccctgaccgcgcggcgctgtggtcggactcgtcggacgacggggagaggcgggaggaggccgaggccaccgagccgctgccggtggaggcggcagcggcggaggtggaggcgggcgagggcgcggtgacgaagggcggaggggctggggcgggggtggtgcggtggtggcacctgccgatgggcgtgctccgggcgtgggcgctgcgggcggcgaggagcgtgtggtcgttgcccgtcgccgtcgcgctgctcggcatcgccgtgctggggcggcgcctgtaccgcatgcggcggcagagcaaggccgtggcgcgcgtccgcctcgtcctcgacgaaaaggtgaggcctctcgccgctttcccggccatgcccttgccgtgggttaaacactccaaccttgcgccactgtgcttgtgtaagcgtctcattttgtttgtgtcatcctgtatcatccacatgctgctcgaaaatgctacaaatatttttaatatttttctataaacttgatcaaacttataaagatttgactaagaaaaaaaagtcaaaatgacttataatttgaaatagagggagtaccttgtttgattttagggtgaaaacagcataaaatttcaacttccctatccattgaaaacaaaaggtgcagttctcaagtctcaaaccaaacacaaaccattttacttcaggaacctgatattactggctaagcatgtaagcaatagccaataggtagctcctttagagcctataggtgattgcatttttctttaagcaaattacatgagttaagtatggttgcaagctgatgagaaaatatgtagctccttgtactaatcttgtcgccatcgtcctcataatattgcacaaagaattctttctgtttgtgactttgtagtttgtactgccatactagtggcaggatgtgcatcgcctacctgtgtttgcgtgtgcacgcgtgtatcaacggggcaaagcgctgaactttgacttacttcgaaagatgattaggaggacttagagtagagcctgatcacataagagcatcctgtaatatgcttatatgagacaaataccatataagacggttttcaaaaaacaaatactatataagagcagagcctgcataggttgcatcctgtcgcacagggcatgaacccacttataggtcaaaataaacgggtttgcggcttattttggcctataagtgggtttcacgggttaaccacttatatccttacgcacaggttacagtggtatgtaaatgcaagtaattccataattgttgaatgtaatgccatgtgatttgtcgacgacaattgtgctgacccttaacgttgttcatggtatcagtgcgttccccattattgcttagcttagctctgtgtggattcttactgtcatctgttccttaataattttaattgacttatgcagaaggcatcccagttcaaggcccaagcatcacgcctgaatgaatctttcccaatggcacgccgagctccgatcatgaagcctctgcttcctgcgaatggagtgaccccatggcctgtgctgggacacatctgagcttgagatcgacggcataggactagtaatacaattgtccaaagttacttggcttgtgagcataccatattggtccctaaagatctagccgctataccgctacttggagtatacacctctggttgtggaaggtagttacattcccactttatgtgggatgccatttaggccttctcagctttcatgtttcttttgtaccttataattttcttctgtagtgttgtgttaccatatgcgcttgaacattgtatctgtaattctgtatatatgacaaagtaaccatacagattgggagtttgaaactgtgctcagcttcctttcgctactgttaatttagctgtttccgtgctgatatactctctgcgtcactgcgtgtatgcttgattaatgaaaaggtcgcagattactttgaatacctagagggttgagcccaactgcccatagcaagtatccctaagagcaagtttaatagtatagcccactact

SEQ ID NO: 71178 - DNA, 18741 bp, Oryza sativa
attacgtcttagaatttgtgctgtagctggctacaaatctgtagttcactgctcttctctctcttcttttatctctttaaaatatgtttatagctggcttatagcatgctattgtacctgctctaatctgtctcctttttattttcttataccatactccatccgttttttaatagatgacgccgttgattttttctcacatgtttgaccattcgtcttatttaaaaattttatgcaaatgtataagatataaaattactatgagtgataaaacaactcataacaaaataaattataattacgtaaattttttgaataagatgaatagtcaaacatgtgacaaaagtcaacggtgacatctattaaaaaagggaggtagtacacagtatagttttgagatgcaatgatcattgagaaagattagcttcctgaaccgttgagttgaatgcattatgcatgtcccctttcttgcatgggatgaaaggctttctcgtttaagctattgatacattacatgccaaaggtcactatgaagtctgttcaatgttgatggagataacatgataaaaagaaaaatgtgtgaaccatctctatcttagtggtcgtgccggagtggttatcgggcatgactagaaatcatgtgggctttgcccgcgcaggttcgaatcctgccgaccacgttttttattttttttactctggctgttttgctattttactcctgttgtctcactcggttgttttgctggaataatagtcccttctgttttttttattttttttactctggctattttgctattttactcctgttgtctcactcggttgttttgctggaataatagtcccttctagggcaaacacagaggggtgtggggggctctgggcaaggctaatgagcgatcacccacccgcccctcctctatacgctccgtcgccccccccctttctcctccccttcttatcttcctactacaccataaatattttaatttaaattcaaaattaaaacgggcatataaacttttgatttataaactttgggtctataaactaatatttgaattcaaatttaaatttgaatcgggtatgtaaacttttgacttataaactttgtgtctataaactttaggtgtataaactttagatgtatagaaatactatatataaaaaaaattgaattcaaattcaaatttgaatcgggtatgtaaacttttgacttataaactttgggtttataaactttaggtgtatagaaatactatatataaaaaatatttgaattcaaattcaaatttgaatcgggtataaaaacttttgacttataaactttgggtctataaactttaggtatataaactttagatgtatagaaatactttatataaaaatatttgaatttaaattcaaatttgaatcggatatataaacttttgatttataaactttgggtctctaaactttagatgtgtaaacttgaggtgtacaaactttaggtatataaatttactaaaatagaaaagtaatgtggtgccaaaaaaggaaaccaggtggagggaggggatccgaatttgatcgagcaatctcggagtgctccatataattaaattttactcctcatgtcttactttacagttctcgattagattggccttatatgtctatggctatataaaaaaagagaaggggttgctcacattgtcacttggtgctagagaaatactaaatgataagagagtctcacctatatattttgtgtctccactttttagaagttgcatactaattcgcttgcatgttctgcttcttacatccactccctgatcaattctcaataaacatatgtagtatttgaaaattatccacgaagtatattcatttatgaagtactgtttctcaaccacctggtacattcttttcatgtcctattcaatagaattttgtcattgattatttacttcatgtttctaatttgttcaaaaaaaactttattataatgtattgattaaaccacctattctaagctatttgtgaactttgttttttataaaataataatttgtcacgctaatcgatcgatgtttctaaggcctaagttcggacctgtttggtacagctccaactcctagatttagctctaggagttgggtctggagtggagttgtggagctgcctaaacccagctccacaactctagttcattttgtgagagaatttcactcaactctgctcctattttaggtggagccgaaacagtttggctgagctccatctccaagagaggtggagctagagctggagctatggcgctatgccaaacaggcccgtctattcttcaactctaaactttaacttactcgttttctgttagcacgcattttaaactgttaaatggtgtaattttttaaaaagtttctatgtagaagttgttttaaaaggcaaataaatccaaattttaaatttataatagttaatacttaattaatcatatgctaataaggtttctcgttttacgtgcaacaaaaaaatccaactcccaaacgggagatcgaatgggctggctggttcctagtcaagtggcaacattagtttatagtaagataaatctaggaaaatcattcattggaaaaaaaagccaaaacaaaagaaaatgcacaacatccaacttctacagtctttctaactattttgacataaatataggagattatctgtaaggaaaaaacaaattcaaaggaaatgcgcaacatgcagattctagaggttctccaactataaatcgcttttgcgagaagtttagttcacaattatctttgaaaactttgctacatgtgaaggaaatataaaacaataaattaagtaattgaatttataaaaatatgaaggacaaaagcaggataaaagtttgcatatacacattttttaatttatggtagtcatatgtaaatttatcaaacacatttttaaaataagcatgttataaatttagcaagttttttataggaactttatggtactaaactaatttatattgaaaaacataaaacttaaaatatgtttttcacacacactctaaataatatgcaccaggtacactaacgagagcgccaaccggcgtgcccatattttagtcatgcaaataattcgtgtcaatgatataatgagcgtagttgtatgaagcatgaccttaatttccccagctaccccttgttcaattttcctacctactattatcccaaccaccactcatttatcatttctctaaaaactaatattatattcataaaaggtcaaagccacgtaaccacgtcacatgtcagagttatgcatgagtcagatcccaaacgtagcaagagaatacaataaaatagtagttttcaccttaaatatctctaatatttttgcatgccttaatgggttttttatgtataatggtttatttttatctaaaggcatagccagggtttcacttatagcacgataatcgcgcgattatcatggttatcgcgcttatcacgagggtacgtaggggaaatcggcgatatagtttggatgaattttgaccaaattcaaaattctagaaaaaatcgaaaaaaactgaaaaaattcatagatgtagttgttgatttgtaattgccaatggtgaagaaattatttgaaatagagtaagctaaattcaaatttgagggcaaaaccaaaaatggtttacaaattgaaaaaggaagaggatattgggccttaagtatcctacatattcttcaaattattctcaatttctagttttctacacatattcaaccgtatttttaattttttttaccctatttattttacatttacatgatttcagctatacaacccgcgataaccgtgcgaatatcgcgattatcgcgctaccgcggggtggcgataaccccggcccaaacgataaggtaaaccctgggcatagcttggttttgttccatagatttttttttcttacaaataagcacgatgtgaacactctacctcctatggacaccctcgcggaaataattttttaccaggaaacagtgggggagtcccccacggtaatttcattaataaaaagaaaaattgtacaaattaattacaagttatcaatccatgattgaagaaaaggtttgaaagctactctaagcctagttaaatgtagacttagttcctccttgagacttgatttccaccttgggagggagggagaaatactattaaagatcatatcattcctctgcttccacagaagccaagcagccaccagaaaaatttccataaaacagtttggagagatatttctcgcggaaacaattagtcgttagtacgagcaccatgccaagtctaagatcttaacataggtggacaggttccatgacaaggatcataatcaattgagctactatcactccacttgctctactaaattttggtagcaaatcaaacacttgacattttgataattcttaatattatctactcatattgctgatatgatttagcatgaaattgaacttgtcttttttaagttataacttatcaaaacttggaacgatttataagtgttgggtttggggatgaggtaggatgagttagacccatttcttttttttaggatggatgatcctatctatccgtttgacataaggggtggggtgatcataattttttatttaagggatagcttatatgttagtgagagaaaaaaatgggttggattggtccgtcggcttttaagggatatgactaatcggactctgatgggaatattccctttcaagacttcttcgcttaatcccctccaaaagggatcggaggagatttgaagaggaataattccacgtctattgagttgttgaataaatcctctcagtcccctccaatccttccttatgagattaactgaacaaagagtctcgggaattatccattccacctatcccaaacaaaacacccttatagcaaccacaatgtggtagtaaaccaggtaacaagcaattaatgtgcccttactaataagcatcgttttttgtgctatgttcggtagaaaccaagtaaaatatgaacattcttataggaacatgggtagatgaggattggcatggataattttttcaggtgaacactgaaccccgcctcatttaccactatattcatacaagtattgtggggagggtggcactaccttttgatcatgggatctaccttactatcgaagtcaggcaacatacattgcacatatccttaaaaatcggttccacccgacccaacccatttactttttgaaaccaaacgtatgctaaaagtactacaaccaactgtaattcatttatgtatggaattgaaatggtttagttggattttaacttgtgtttagttcacgctaaaattggaagtttggtttaaattggaacgatgtaatggaaaagttagaagtttacatgtgtatgaaagttttgatgtgatgaaaaagttcgaagtttgaagaaaaagtttggaactaaacaaggccaaaggaaaaaagtaatgttggtgcggtgacaaacaggctataaatttcaaatcgtaaaatctaaatcgagagcgctctcaatttagtcataatgagcgaccctatcatctaatcagccgttgtccagatatatcttgaagaatcttactttactatagtactaattgatcaagcaattagaacaaatattcctatcatctatgtttcaaataaaattttctcttaaattactcatccgatttacaatccgattacaccgttgtgttcataacaattaaatctttacaacaagatctcacatgattatattttgataaaaaatcacaaattacttttataatatatctaaattacttttagatttcactaagttacttcttaaataaatatataaaagtaaattcaataaagttttaaagtaattaacatatattatagaagttactttccttttgttataagttacttctataatatatgtaaattacttttaggttatattgaattacttttatatgtccaagaagcaacttagtggaatctaaaagtaatttagatatattacaaaagtaatttatattttttcatcaaaatataatcatgtgagatcttgttctaaagatttaattgtgacgaacacaacggtgtaatcagattgtagatcagatgggtagtttaagagaaaattgtatttcaagtgtaggtagatagtgtttatcatagatagagtggtagctagtttagacaccagctgtgtagcatgtccatttcaaatatactcgcctgtgttcccgtgcgttgatctcgctccccccatacagccatactacttggcactttggcagcacagccaggagagcgccacgggggaggaggaggacgcagaaatagaaagcgaccaagagcggtcgccacgccagattctctctctctctctctcccccttttctcatcttcctcgagacgccccgccccgcgccccgcgcctcgatcctcgcctcctccccgcattcactcccccgaaaccctcgctctctcccccatccgccgccgcggccgcaaacgacggcggcggcgaggttcgtcggcggggattgtgggggggggggagaagacgacgagggttttttttttattttttttttctgattatccccctcgcgcggggggttttgggcgatggggaggaggagcaagcagaaggtggaggatatggccgaggagctctgcttcgtctgcaaggacggcggcgacatccgcgtttgcgacttcaagtgagcttcgcctcctcccccctcctcactatttttttttggttcggttcgtggttttgtgctgtcgctatctcctctgttggaaaaaaaatggttggaattgaggtttgttctgttggggggaatgtgtgcaatgcgggtttttggtagatggtgggtgcagtggctgctgcatgcagaattcagttctgtggtgcccttggaagttggaacagtatcgtcgggatcatttccaatcgattggtgacagtgtagctagctaattgtgccttgttatgcttttcaggaactgcctcaagggttatcatccacactgtgtggggaaggaggaaagcttccttgattctgccgaacagttcatttgtggtgagcgccttttgtttttttcccccagtatttcaaccatacttagctgctatctgaattagcacgacattgcaatacccattatgctgcctgcccatgtttggttacctcattcatttggtttgaccaagtatcctaaatcatgtcctgcctttgtggaattgccaatgcccctttctttttcctagaaaaaaaaatcggctgctggatgcttaacctttcatttattagtagtgaatgggcttcagtatcttggacaaaaaacttgggaggattaattgctcagtagtttttatgtagcatagacataactaaaaggaaggtgtttagcatataatctgtcagaaataagctgcaaagtacttttgtgagctagcagtactatgcattttttggatttcatttttctgttcttggagtgcctctttcaacttctaccatgtggtacaataatgctattcattcttgagcctaacttttactatttgcagaattgcacaaatgtgttagctgcaaaaggaattcagaatatcattgtttgtgttgtccaagttcctctgtatgcggtgaatgccttggaaaagttgaatttgcacaatttaggaagcagagccagaccaaaggattatgcaataactgtttaaagttggcattgtttgttgagaagaactctgaagctaattctgatggggtaagtgcatgtggatccttttacagtttttgaattatagcatttattttccatttttctggaggtagtactccctccatccaaaagtcttgagcctttttcatttcctggtttttccaaatgagatagacatatttgtagtctccatgcatctgaggcttaagtgaaggggttgttttattgttttacagtgctaaattaaattgttgagtggaacccaagcaaccaccttaatacttattggttgcatgcacatatagtttcttcgtctttgttacatgaggatgagttaatttctccttggtcttgatgacaaaagaaatatgccttagacctttggatggagggttaagcttccaccaatcccctgccactccatgcctgccattagtcaatccttgaaaaaaaattcaatggcctagtacagtagtgcctaccataggtccattaaccttgtatttatctgtttattgttcctctggcataatttgtctgggtagtttccacaaaaatgtcagttgacctctccatatatctggtctttttctgattactgttcatgtgcatccctaggaaacagttgaattcagatatacggagaactatcttgttctgtttaaagactactgggaaactattaaagacaatgaaggcttggcattgattgatttgcagcaagccaatatttgtcttagaacaagcttaagctgtaaacaaggaagggattcagagaaacccccagatgaagattacagggcagataagaattcattgagtgttaatgatggcgctgaacaaccattcccggttgatgtaaaggtccaaccaagtgaagcaaaaatgtcactgaagagaaagaagtcaaacaagaaaacatatgtcggttggggttcaaaagagctaattgaattcctgtcatgtattggcaaggatacaactaaacctcttgatgaatttatacttactggagttgttaaggagtacatccagcagaagaatctattcaaggacaggaaaagaaaatctgtcatttgtgatgataagcttcattctttgttcaggaaaagaaaagtgaagtcaaatatgattcttaacttgctggaaatacatcttgcggcaaatgctgcttcagaggatgattttctcgatgattctgaggatgatgaaggccgaattatgagaaaaaggccttgtaatactttaaaggcggcagagacttctgagagggatccaaagagaaacaagaaatgctttgcagctcttaatcacaataacttaaagttaatttatttgagaagaactctaattatgaatcttatgggccaagacacatttgaacagaaagttgttggaagtttggttagagtcaagaatgatgacaatcattatagttatcagatgcctaaaaaacactaccagcttggcctagtaacaggtaatcaactacaggcagtcttctcaagttttgaactttgatggtttctgtaatttttgtcaggcatgtatagcatatctgtagtattgcagtggaagaccaaatcatcttttttcttcattaaccagcaagccaaaaattattttgttttcttttagatgaaaaccattttagtgctacattcatatttcatgcattggcctatatgctgtactatctatcctccaggaaggatatgactttctcaccatgttgaaaacatccataacaggcattaggaaatctccacaagaatacaagataaaggacaaacgtacagatattcttttatgtgtttccaatctgtgggatgacatcaagatctccatgttgtctgaagaggacatagaggaggtatgattcttttcctagtgtactgatataaaatggaatgagtactaccattatgatcaagtaggccgttattactcccatttgatactataatgtaacacacataccaagaaatcttaactttgaagtaatatggagtattttataatcaaaccatgatttcctattttgtgagtattcttatggtccttgggaggtactagtacctcttggtgcctcccaagaaccaccgaaaaaagaaactgcccgattcgatgtcgtagtagcatgcgcatctagcaaggataagcaaagtctactcttttgaatattattagtgtgccagactaatatcgggacagaggaagtgtcttactttctttattctacattgttctgtccactcaaaatatttccctgaatagttgatgtggtcaaacacttccttttgcgctcttgataacaggacgagtgtaatgatctccttctgttggctaaaaaaggactcttcaaaagacctactgttgtaagttcatgttatgaaaagcttccttttcctagttgcagtccccgacagcagcaatgatatattctgtgatgtatatttacatatataactttagtgatgaaataatatattgttttctgggattgtttttaacagtggagacatccttgttgatgttcatgctgatgtgcatgccatgttgggtggatctctttttatatagtaatatagccctctcaacctgctgctacttaacttatgcatgttggtctgtctgagtcgctgaatgtgcatgtgtaatacgaactgcatgtctacttttatacatgtaaccactaaccacttaatttgggtcttattgtgttgcctggacttgtgcattcacacttacatggctaaaacatttatcttctatgtgagtcagcttatttacttcagttttcacttattagtttctgtgagctaaaaaaaacaacaacagtttattcagtttctcgttttttcttgagcaccgtgcagttgtgcatttctaaactcctcttttactgctctgggtctggatttttgataggctgatttagaagagaaagctgcaagtatacatgtggacatcgtgaatcatgtaagtgaactctgaattgatttccgtggaattttattatgctttatttttgagtttagaaatggaaagctcaataacaaattggttgtctgaggcaattttaaaagagcggaagtggctttacatcttattgactgccctagtgaatgactcagcaagagatccttaacttcctatctttagttcttaactacaaaataaataccctatataattgacattagcttgttttcaaacttgtgacctattttaaattattgcccttttgataaaaatatgttttgcacttatattttggtttgatacttaagtattgtctatatcctaatcttgttctgcagtaggtcgaggtactgtctgttcccttctctggaaataatcttgatgtttgactccttatgctatcttcattccaaattaaatttcttaattttagacacagtttgaaacctgaaagcaaattgttatagcaaactaaatacttttgtggttcctacaatacaatgattgacaaggtttcccttttttcagtggattgatagagaacttatgagactggaaaaggagatcgaaagagcacatgagaagggttggcgccaagaatatccttccaaattgtcttttatttgtggcaataaacttgtactccctccgtcccaatatatagcaacctatgatgggtctcatcctaggttgctatatattgggacggagggagtagttgttaagggtttgtctgattttcttattggactgctgccagcattttttccttgtaacatggaagaattttattatagttattccttgaccaactctattttaacattgcatgaactatttaataaaaaaagacttctaagcacacaagacgaaagacaacgtcgtcttgcagaggtcccagaagctattccagatacagaagagagtaaaagggatgaatttggagttgctgcaagcaaccatcttgaagaaaacaaaggttcaaaaccttgaaattttggctcttctatttttttttcgtgaacgcaaattttggctcttctatgaaacatattttccttcccatctgttttacgctaataattgtgcaaagtgatacatcatgtaggtgctattttgctcttctgatctatgtccatctagaggttgaaaacagtaattcaatttagagcaaatttcattttcttatggaaaactatcaatgaaataccacgaggaagtagtttcacaaaagtacaactatagttgcatacagtgttgcaaaactacattttaaggataatgcaaacgttcttttgtaaaacagtatgcaacccaatgtaagtgttttgaaactattgttaaaagtgtggttctttgaatatttttgcattaaaagcataggattgtgaaatttactcgtttgaatatctcattgacttaattttgctcctttctttaccattgtgtttgtttgtattctatactctctattttatgcgttgagttggcagatagattggtcatggttattaaactcttttcttatttagcttcacaatcatccctgcagaggcatttaagcagaaaaatcctgagaccttacatgcatgaagtcatttgttccgtgtgatcattttgaaataccaacttggaattgaattctttcactagttattttccagttgcagatacagaatgtatacatcttgtcaaattaattcaataaaaatattatgttttaaaagttatcctcacttaattctttacaaatatttgggattttacagttttaaaagtaaattatggatctgttacatttttaaaattaatgctggatttgttacttttttgaacaaatactggatttgtttgcaatacatcatgggggttgcttgacattggctgctgctctgcttacctaggtagagtagtatatagagtagtactgtagctaacttgcacacacaagatggttttgtattacaattcacatctgctctgtttaccttttgaagctactaatttaacattattctatggatgtaacatatagtttatagttctaattgcctccaatactcagcactcagcagtgcaagaacaaactcgagttcattagtttcgcatgcactaagagctgttccctgcaaatctgctgtaaccatccatacttgagactggtggaggagcatataagacacatcagtagtatgttttcgttatgtcacaaaagggtggccagcttaaaactcaagtgccatcaggttctttagattctcaattatcacagaacaatacagaaatctctactattataaaaattgaagatgtttttgctggtactttggtacgtcatccgtgtatgagtcggtttttaagttcgttcgcttttggaaatacagatctgtagttgagtcgggttttaagtgcgttcgcttttggaaatatagaaggaatcgtataagaaatctttttaaatgaactcgcatgctaacttgagatgattggactcctaattgcagctcatgattttctagaaaaatatatatccaagtgaattttcacagtgaatttcaccttaactaaaccgtataacaataataagattaaaatagttttcacccgttgcaaggcacggacattttttctagtataactataaaatagcagatcatactgtaatcttagcacagtaattttgctgcaagtttactgcagcaaccgaagggtcattgatgatgccctgccaacttgtattttaatgtaatcttgacttgataagcttgataagtgggtttaggccagtttgtcataatatgctgctgatttttttgtggcatgcaatctacctgtatggacatggatcatacgaaacactgattttgtgtgtcaaaacaagtattaaatcctagttgtaagtagatatatggcatgtacaaaattgatgctataatcttttttttttctagaaaataatgctttcgctttgtttacatatatattgtagatcctaataagttcttgaattatctgaaccacaataataacaagatcgatggtttacagcatttttctagttcatattattgtagtagtttctaactagtcaagagtgaatgtgagtggtaactctttcttgtcagctttgcccatcgagtgttcctttccatttcgtgtatttgctattaggcacttgtaccttcccccctaatttggttgctattatgtaatgtagtttttagtattatgtggaaagtggaactaatggcgggcttgcttttgccattaagagttccattccatttgtggtatttctattatgtacatgtacctttttccctaaaatagttgctattatgtactgtagttttttttttgttattatgtggaatttgtaactgatagcaggtttgcttgctctcttttaacactgagaccttattaagagttatcttttatcatctccaggtgcaacagggcatgtacctaattctgtgaaagttctaatggaggattcacgaggtttgttttcataacaatcagatatggtctgtgcagttaatgcttagaagaataactgtactttgtgcttgacatttaataaattgctattcacatctcttatctttcccttgtaggctagttgttattttgaacttggtcgttagtattagatagaactaaagcacttgctctattttaacactgagaccttaataagagttttacttctctcatctccaggtgcaacagggcatatagctgattctgtgaaagtacttatggagggtttaccaggaggtttgttttctagcaatcagatatgtactgtgcagctaatgcttagaagataactgtacttctgtactttgtgtttgttctgcatttctgcaaatgtttggttcaaggtgcacctaatgatttgtcagtatggttatagtcctttcccccctcttcgtgcttcgggggaaggttttggggggggggggatttgctatttgttactcttgtctttccctcatacattggttgttattttgaacttagttgctagtattagagtgaaccaatggaggtcacattattttttatgtgctgagatctgcgcccttgtctccaggtgcaacagcacgagtagctgatgttttcaatgttgatatggctaaatcacaaggtttgtattactaaatcagtcatgatttttttgcggtagttgacacttttctgaatatttctacctatattcactatgtttacttcattatttgttttttacaagttttatctaagcttttgtttgagcttttttctctcctcatgtttcattgtatctgatattattttgaacttcagttgttagcagtagatggaacagcctcagcccagcctgctctctttttaaattctaagtcgctgcctatccttcttatttctaagtgcaaaaatgcaagtagctgaacctttgaaagttgctatagagaaatcaccggaaggttttgtttcatgtcagtgtgattggtgctttgttttgatcatgtctctaccttatctaatatttccaaatgatcatgttttgccccttttctcctcaaatatcttttctttggaacagattaatcttgattcttgagatagatgtaactaatgatgttttaccttctttaatttctttgttcaagatgcatcagggcaagtaactgattacttggaggttgttgaagaggaaactccagaaggttattctgcgcctctgccttttctcaaatattttttcttcgaacagattaatcttgatatggatgtaaccaatggaaggttttatctcctttcctttttcggcttcagatgcatcaggacaagtagctgatatcttggacgttgttgaagaggaacctccagaaggttattctgtgcctctgccttctcctcaaatattttttcttcaaacagaataatcttgatatagatgcaaccaatggaaggttttatctccttttctttttgggcttcagatgcatcaggacaagtagctgatatcttggagcttgttgaagaggaaacttcagaaggttattctgtgcctctgccttttctctaatattttttcttcgaatagattaatcttgatatagatgtaaccaatggaaggttatatctcctttcctttttttggcttcagatgcatcaggacaagtagctagtatcttggaggttgttgaagaggaaactccagaaggtttgttttttcattaaacaatcatataatattttgggtatcatagctggctaactgctacttgggttgcctctaggagcagagcatctgagcaagtagatactacttgtgaagttgctttggaatgtactctataattgattctttgaaccccactttcatctattgatgtagtagcacactgcttttgtgttgaaacagatatgaaaatatcatataacttccaatcttaacaaatacaatcaacccaatctaaaaactgaacatatacataaagggaataaaaggggaaactattactgttgagttttggagttcaaatatccatggtggtttatcatactaaggactatttccactgtttgttttaggattttttttcaagctaattaaacacccaaattagaattcagcatgatagcacttaatcagggttaagcaccagatgaatcccctaaagatctctattgagcgtaaatcaatgaacaagcagaaaacctctatgcagcagtatatctcaacagcagtaataccctgttataacatgaagatatgcatgttttcatgggagtaatatgcatatatccacatacagatagtttttctatttacgatgatcaacaatgatctctgttgtccagtgtgtgctcttgacattcaatcctttccctgaaatatggaaatgcatgaaattggccagctgctattgttggatttgcatccttatggtttccttttttatgttatttcatgtagcacctggtaaagacctttgtaatggtggcattcctgggtctggactacaaaacaaaatgcacaatgctcaaggttttctactcactccttttgctagttatgatgggcctaatgaatttctggaagtttctagttgctgcatattgagctaacattgttcatttatcttttaatttttcccatcgattataccttgattccttgcattttgagagagctcagaggtgctactctcaatcctgtgattgctttactgttgatttcctcttctctaaccaagactaatcttgtttagatggtggcacggctcaaggcagcgatatgtgcaatggcggaaatacctcaaggcgtctcaatgatcgcaagagtgttatcgttatcgactcagacagcgatgaagacgaggatcctcacccagagcaacatgaaccagaacgtgctgctcctcgggcagccatggacgtggtcatggctcccactcatggtgctccggtagccatgaatgggactagtgctcccactcttccttgtgctaagagaggcaagaacgggactaccgcgcctaaaggccgtgttccggctatcgctgcacttcacgcactgcaatccatgaatgcgccaggtgagcatgaatacatatggaattacgcggatcctcaggggaaagtgcaagggccattcacaatggagcatatgcggaactggcaccggaatcgtttcttccctccggacttcagggtgtggagattaggccagacacagaatgattccgtcctgctaacagaggccatgggcctgaaattttcttcttgacctaaataggctttttttttttcgttccttgcgttattcaacagtgtagctgaaccttaagcaggcatcgctgaagcttgagttgatgtaaatgtttagttttggtcataggcggttcagtggagatcttttttttttctttagtgatgttttagcagattgcaatgtctagcaaaatttgctaaacaaggcaaacagaaatggacagtcggtttagtgatgtttagcatattccaatgtcagacgctcagagccccatcaaacaaacagcaatggatatactccagtacataagttttcacagttatttatacagcattggagtaaaggtttattttatcgactttgcttttgacaatttgttttttcgattatgtggtccgttttaactctaatagcaagctaagcctagaaatttcagtacagaagtgaactaaatatcgtgaaaaccatgtatacacaatagatgggtcttctttacaggaagcaacttgtgacatcaatcatttggaatcactaccagaaaaaatatgctacgactaggatggaatatacatctcttaattgcccggccaacaaggatcatggaacaataatcagaccgccgcattgctgcttaattgcgtagacttaccctctcccaaccctgacgtggcgctggttgcgaaaatagcttagaagaacctgagcctgcgcataaatacgtataggtttgaaggaagttttaggatagaaatgagcttgtcagttttaggaaacaagattataatactaaccttctctcttgcacgggctgtgcctgattgcgacaatgcaaccaaaggtggcacgacgccttcttgaagaaccagggtgcaaaacctgttactgtttgtgcagagttgtagcagggcagcagcggcattctcctttgaacgtgcagaacccagctcaacaacctcaaccagtactcggatgcctcctgcctgagcaatggcattccttccatcatgcacagtcgcaaggtttgccagaacagcaacagctttatcaaccatcccagcagctggatccatcagctccaccaggtggttgacagccccagcctgaacaatgcgggtcttgtgttcatgaaatatcgacagattgaagaggcagtagctgcatccttcttcccttg

SEQ ID NO: 71179 - DNA, 7945 bp, Oryza sativa
tcccaatcccattatacaaataatgcctcaagagactatgcagtattaacaatggtttgaccctcctgagaggtttgaccccgccgcctcagctttacgttgctcacgtaccggccagaaatatcacagcacacacacacggttaacttttttcccgcgcgaaatctctcgaagtgaaacatcccaagcaaaaatccgatcgattcggcgagctagcaggtcaactcgccatggctgacctcccatgcatatatatacgcgtagtacgtacacttgctttcccaacgctcgcgaatcaaatcgagggtgaaattaagtcaagaacggagagagatcacggtgaggttgatctcagctcgccggaggaggcaatgagccgggcggagtgcggcggcggcgaggaggaggagcggtgcaggtacaggggcgtgcggcggcggcggtgggggaagtgggtgtcggagatccgggtgcccggcacgcgggagcggctgtggctggggtcctacgccacgccggaggccgccgccgtcgcgcacgacacggcccaaatgatgacactctatcatctgaatcagagttttcatgtatcaaattataatgatgactatcatccgatgcgcactgtgcttttggatgcaatgcagctaccaattggcagtgttctggtgatccagacttgtatgcacttgcacttccatctgtgatgttgagggaaacagggaagcacaaactcaagagtttaacaggatctggtagcattataccatgtacctcacaccaattttcaatcaactgtttgacagtgaagttaggaatcaatttggtgtgtcccaatatttggcgtgtctttggacaaatgttgtatcccagatcaaaccattttctgataaaaacatgctcatacgtttgaccagatgccacaatcactggatccgacattagttcaagggaaagaggacaacaaaaatcagcaggaatggtcactccattaatgctacgtgtttgcttttcttccacatgtttgtcaagcatatggttgactaattcaacaatatcgttaatatcatccatttctttgttatcttcatgattaccttttgttttaaccttaacaagtgcaacatattccatcagcaactcctgatttgtggataagctcaaagtagtttgaatctttccaaattcctctgaatttggcataacttcccctgctaaagccctggaagcctccctaatgacatctgaaatttttccacagctatcgtgttcaagatcctgcaagttgcaagaagcacactgataagaaaatcagatgtcaaaacaatgtcactgagaagatgtgaaaggattttttttatcacctccaaatgcattgactcaatctgcatgagagaattgacaatttggcataattcgaatacatatatctgcatcttggcaataattgaatcagcctgaataacctgcacccaatatattactcatagtgagttatttactaagtagcatattaagaagaataataggggaaatcctacttggatggaaattaaagcattgtatatgtagtgactaatgagggagatttatcatggaaaggacaaagtagttacaaaataaatcttgctcatcatttgattccagcctccaactagctcagtcgcttcattgatggtagcgccaagttcttcaagcactttacttagttcaccatctggagtaatctgaggaaaagctctgtttagggccacctccaagtgatcaaggatgccatccatcgtttggcaatatttcttaactagctctgttttcgaggcattgcttgaagacagcacccggaaatttgaaatactatcgagtagtgacaatgacactgaatccatcacctacataaacaaatcaaaaattaagttcacttcgggtgcggagacaaaggaacggggaagctcaaacaggctcagagtgactaaacaaacaagcaggtgcattccactgtcattcgaagttatgcgtaagaaaaatagctgagtaataacaagcaggttagcatgcacgtttcagtgaaaatgagctgctagctaacttccaagcatgactaaccatgccttgttatttatctactatatatgtgaactaagatagacataaattccgtgcttatacctggaacggaaagcaacaaatttaggcgtgatagcatcgaaacatctcgtcagtgtcgtaaaacaattggtgatcatcagaaattcagaactacttagtccaaactgtatacaaacaagctcaccgaacacgcatttttgccccaatacaagcaccgaagcactatccccacactatcacaaaccctaaccgcacagaaatctcgaaaaccccatgccgtacttgcccaccaccacaaacaaacgccatcaccacgtccagtacacacatacatccaccaccaccagcgcaccgaactaagctcaaatcttcccaaacccaaccatggcgagttccaccatccaagcacaaaatgcagcacgaagcacccccaccccccccccccccaaccctctccctcgatcccccaccgcaaggtaaccaagcgcgatcacaccacgcgcgcagaacagagcagaacagcagccagagcaggagaggaagccccgttacctcggaggcctccaatggaggggggaggaggaggattcggactcccgtgtcgaggtgctcggggtggctcgcgcgaggcggaggcgtctcgcttcgcttagtcgcaagaggcggagaccaagcacgagcaaggcgaaggcgacgagtcggggtagcgtgtgaacacgaggcagcaacgacccaccccgagtgggggtcgtgcggagacagaggccaaactagacccggctcaccgtgaaccgggaacagtactttcactgacaggtagggcccatctgcaggtagggggaggcgtacggtagaccgggtgcacggggtgggcggatgcggctgcaggacggcagcaactgctccccacctgagacccgagggccccaccggcagtctcgcagtgctgtagtaccggacctgcgccgactgacgggtgggcccaccgtgttcctccctcaggaggtgggatccccacctcgacatcgcttttttgtgctcatgcgtcgagtcagcgcgtgagccgccgtgtacggaccgaggtttgtgtgctcggctgtggctggctggtgggcccggagaatcactagttctggccctactctgctagcgtcaggattcaaaaattgagcgcatacgagggctcgtttagtcggtgaaatgatgggttgtcacattggacgtttgatcggatgtgggaagagatttttggacatgaatgaaaaaactaatttcatagctcgtctgaaaatcgcgagacgaatcttttgagcctaattaaaccgtcattagtacatgtgagttactataacacttatggctaatcatggactaattaaactcaaaagattcgtctcgcgatttacatgcaaactgtgcaattagtttttctttttatctatatttaatgctccatacatatgtccaaagattcgatgtgatgtttttgcgaaaagtttttgggaactaaacagagcctgatattacaggagcaaagagcaagtttaacagtatagccaattactagctccaaatcatctatagtcaatttaatagccaattcatacaatagttactataatattaatacctaatcccacttgtcatacacacattgcatcttgaagtctgtgctgcagctggttgtaaatctgtagcccgctgttcttctctatcctattttatcttcttaaaatatgtttatagctgacttataatctgctattttatctgctctaatgtagctatttctagcacagtaacttagttccaaaataaagctatttcttcacctacctcctcttctcaaccaattacaatcattattcttcatctcctttctcttttcaaccaatcacatacttccttcaatcattctctcctactttctcaatacacgtgccaaccttaaaaatgactatatattaggacggataaagtagtatagtagtcctagttgaattattaatatatttttctgcaacaaaagaatttcgataggttcatttaggtagaaaatcaaccgtagaaacattctcatgcttgtgaaaattatgagcatcttttccatagaatgtatacatatacccacagataactctgaaacgatgagctgctgttaagaaacgacacacggggctaattaatcaagtaactaaagtagccagcttaattagcatttatttgatccaaaggacaatgcacgcagaatgttgaaacctgtccgtgtactaggaatcacgacataacttgctaattaactacggtatcctgccctgtcccccattagttcatgtatgcatgcatccagacttacttaacatgcaatgccactaattaaagcagagttagactaatctgatgtgctgtacctcatcaccaaggcaattgaggcaagtaggcataaaactaatcatatggaatcatccagatcgccaatacaaaattacccccaaactgagatcatggagtgttcggttaaccgatgctttcatctctggagccaaacgctaatcaggctgcatataatatgcacttccttgtgccgagtgatcaagagacagcctgagtgaatgattaaactagctaatgcaaaagagctttgattgctttcatctttggaagcatcagttggtcatgaatttaaaattaagcctgtagcttgcagagagcagcttaatttagctgacacatattatatattgatccattgatcaggataacaaagtcatggtggttaaattaatttaagctgtttggatattatatatacgtggtagtggatatgatgatgcccccagtacttcatgcatacgtaaacacgttgcttctagatataatgcatgttaaatatgattctctctcttggtagctgatacaaacttttaccgtagttggttaacgtgtctttcttgacaagttaactacataaccatattgatcatgatgcatgactgacttaagcccctacacgctaattaaaggtttgctaactgaattgagtagtatatctttcttacagaataatatatatgaattaattgaacctgatagttatatatcgttcctccgtttcgaataacttttgttttagctttattttaagccaagcatttctatctttgacttccaacttctagattttttttaacatcgtatttatatattttaattcatcataataaatactttcaaaatatgtaactttcatgttgttaaactgtacaaactcttagaaattaatagttaaagataaatatgaaatgtttaatttaggacgaagctagaatgacaagtattaattttatttttcctagcttgtaaattaaatagtctctttagtttcatagtttgaagtgagttcattggattaaattaattactgtgatgggtacttggaatatatggtagatagaaaatgtgtggacattaccaaatgcgttatatatatgaccgaccggatttatatatcgcaatacagttctgggcgtttggagttcaattaaaccatgcatccattgtaaattttttagatactagtagtagctaaatgccagtgcgttacagcggagcatgaaaatagcaaaattaaggccttgttaaaaaaatattttaattgattgaaacacaacctttcatcttaacaaaacaaataaaaaaccatacttagaaaattgaagatagttcagacgactcccccatattctaatatcttggctcccatgtcagtaatggtgatggtgatgactattatctttaaatagtagtacatataatggaaactaccagttacatgtttttttagtggaaggtgcatatatgttaaaaggtacttagtaacacataataaacaaaaaaaagttaattcttatgcacgcaattttcattaatttgatttttttaatgtttatggggtgggggagtttagccacctgaattttcattgagatggataaagtggaagttacagggtgataatagtcatagagcatcatactcttagggagatacggagtagcagagaaaaaccagtgtttccactgcgtaattacagggcgttctttctcattcattcgctccgcccattctttaatttgtcattcattcgctccgcccattgttcttagccatatgccagctagctcccacgtgttaaagatttgtcactaaaatttccttagctagttcctttagtctaaccggcctaaaggttgattagtggttagaattgttccgggtagttatggtacgtagaattaatttggaataattttggatggcactagagatatgatgttcctttcatggcttttcttctttaataattatataagtatataccggatattgattaatatatgaattaagatgctgtgtgtgggtgtgcgtgagtgcgagatgagtacgaagacatcaatcgatcgaacaacccaagctagctggcgacccaatctttggctgcatatatgcaactagctcggtgtataatacagtgtgtcagcatcacgcatagctagcactggcacgcggcaaaagaattcctcggaaggttcggtgtgttaaaaacgtccagattaaccgaacagcggaggcaccaagtacagggtaaagaagagataagcacgctgtctacattaccccgtggaatatatttcatcaaaagaaaaaaaacttttgacttgatcatatccagtctacacgacgatacgtacagatggcaacctgcctgtgcttgcatgcatttttgggctccgatcgcatcgcgtacctggcgtttcgagcacgtacgaaacgcaactcttcttctcagatgtagatgctctgcgatattcccccgccttataaaaaacaatctattacacattctactactataaatctaaacaatactataatatattaaatttaagacctagattcgtttttatgggacggtaggagtactacccatacaatagcagtgattgacacatggacatgagcggatccagcatggaggcagcgaggtcttgtgacccatcagtgtgaagtcgtgaagaccatgagagtcccacgaagccaccattataattttttaccatatatgtagatgggagggaggattaattgtagtttttatctagtttgttcagatttctctactatttctttctagatctgccacgtggatctaaatccatacgtcggtgtctattactgtatcattagtactgtagataattctcacttcttcttctcagcttatcattctctaatccaacaaaacattgtgacattaattagatttaatgacacgtgttattattttggcacgagttgataggagtacatgataacatgatcaaaacattcaccgtctcgatcaaacttattaaaaccgcgcgaacggtgcaacaaacacgagagagaaaaaacaacaaagaagcaagagaactcgtaaaacctgccacgaaagtcaccattaattcctcgaggcgacacgtccatcatcgaccacgtcgtgcaatatgctctgcacaaatagctcgatcgatccctggttagtccagcaaattaaaaaaaaataaaaataagcatattccaagcaaggatagacacggacatagcaggaaaaaggcaaagccacgcgcgggaaaaaaataaataattaactagcttgatctaatccaatggtgactgatcggtcagaaagcaacgtgggcgaggcgacgcagccatggtcatggaggagataggaggaagaagaaaggtggtgttgactaaccgcgcggcgatcacctaatcggcatctaatgccaag

SEQ ID NO: 71180 - DNA, 1017 bp, Oryza sativa
catgatttttgcacatccagtttaaatgtttagaaatgatatgttttcgtacccacaggaagtacagtagtagtttttttttattgtttttagaaaataaaaacatgataataaagtggcatattagttacttcggaaagtgaaaaaaaaacatatttttttcctggaaggagcttaattactagtactcattattacactaattatatatcattaatctttttttctaactgctgacagcttacctttgtattgcatctgtataagattagaatggggttgcaagattgattgacccttacgcatgtcagtgtgatattatctagccaaaaattcctcaactaaatcagtgaaacatctcattccaacccaaatgaaataaaggccaaagtgacaatcattatccacacttcgcaatcagggtagcttagttagcgtgctgtccactccacgcttgcaggatcccaaatttcgccaactccaaaatgttcagagtttagtttcagacaaggaggagcagcaggagaaaccgaccttgcgtggagacggagtgcgacggcggcggcagccagacgtgcgtgacgccggcggcgacgatgtcgtcgaccttccccatcagcaggttgtaccaccctccgctctgcctccacgactcccagttgaacccctgaagagaacgcaacagcttgttcagaaactgaactgaaatcggtcacaacttcagttcagtccgtggctggctgcgtacctggaagagaatcttgtcgccggaagccaagccgagaaggaggaggaggaggatcatggagaggcgtcgtccggtcgccatggcagcagccaggctagctctatagctcgatctctctccttgcacagaagcagggacactctgctctgaactctgaattgatgaattcagaagatgattacaggtgttttgatgattgcagaagatggctacgcgtgtagggtatttataggacgcagctgcggcagggcagaattgatgaattcttt

SEQ ID NO: 71181 - DNA, 12200 bp, Oryza sativa
ttatactgtagttctcaaaaacaatattaatcgattgctttatctcgcaagctgatcgatcaatttacattcatccggtatgtgtgtcgccttttataactaaaaatggtataatgttgttgtcatttttagttataccgaatctttacgccattaaattttgatatgataacaataagtttaccatttgtccaaataaattttagctgttttgagaattttcgcagttaaaaactctatcaaaatttatctagcttgccatcacgtctaccaataatttaataacacgaatgtatatatgctaaaatttgaaaataccaagttctttaagatcaagagtgatatgttacagactgcacgcatttctacatcacgtgtcctatttcctatatgcgagttccaagtgcttctttactcggaaaaggaaaaagataaggaaaagaaaaacacccaagtggttcttaacctggctaccttttttacctttgcctttgtgtgcggcatctgaattgaatttgttgatcttgtgcgggtgcaggtttcggggtctaaaatgtgttcggtatcttttccgtttttcttccctggtatatgaactattaagcacgttcggtttttctttcatttaacaccttgaattttcgttggtcaaatgtgcaaactttcaatgttgacgggtcaatgagaatttattgtagttagatcacgaaatcgcatcattggattgtcatcaaaatagtttgatagtttcataattttttttcacgtgtaagttgtagctgtgaacttcacgtcataattttgtatgaaccaaaaaatatataaatgtaaaaaaatgaggaataacaacttaaggcggccgcattaattttttatttaaattaggaattgaaagttcaattttgtagcggatactccctccgtcccataatataagggattttgaatttttacttgtactgtttgaccactcgtcttattaaaaaaatttgcgcaaatataaaaaacgaaaagttgtgcttaaagcactttggataataaagtaagtcaaaaaaaataattccaaaattttttgaataagatgagtggtcaaacagtataagtaacaactcaaaatcccttatattatagaactgagggagtacttaacatggttaaatctatctaataatttcttaactcccctacgaagcttaggtgtagtgataagaaaaatcgagaaggattggtacaagttaacaacttaatcaatagattgtgcatatagcaaacaagtctatataataacacaaagagaaagaaagaagacccattttagttgatagtggtattattacccaaaaattaaaaatacgttcaatttagacctacttttataagcatcatgccagctacagctacagtcacagcctctttcatccctttttctttcttccaaaaaacgctcacctgtagtgatggatctatgtgaaagttgtgaggtcgaatgtcgaatgaccctacagcttcttcacattcattcttgagtactaaatttttcatggaaatccattcaaatctacacaaataatcccactgaaatatttaataataataatcgatctcacaaagtaactttatctaataatttattgactccgccactgaatttaagtgtagtgataaaaaatcgagaagaaggtttggtgcaaattaacaacttaaacatgaaattaaattgtacatgtagcaaacaacctttataataacacaaaaaaaaccattttagttgaaagtggtattgctaaaagagttaaaagtatttcaatttagagcaacatgccagctacggctacagtcacaacccctttatcctttttctttcttccaaaatacaaacgcttaccttacagtgatggttctatgtcaaagctgtggggtccgttgaccccatagtttcttaccatcatcgtttagagtttcttaaattttctatatttatccgttgaaatttacacaaataatcccactaaaatatatagtaatgataatcgatgtcacagagtaaatttgctggctctgccactactcacctgtaaccccccaactatgccaccaaacacacataactcatcgcctcatcatcgtcatctatctccgcatgagaccgcatccttatcccaccacgtccccctcgcgctcacgcgcacagcaacaaagaaaaaaaaaaaaacccgtcccttttccctcgccgccccaccgctcccccaccccacgtgtcgccggcccatcggcggcggcgcctgcgtgggccgtgtggcccaccctgcggccccttcccgaaaacggaacgccccccccctcctcccctctccacgtcactgcgcggtgggcccgcgcgtgcgtccaagaagcgtgacgtaagcagtgacagaatccgcgccgcctctcggggcgcccacgtgtcgcggtcaaacggtcagcgcggggcgggggctcgcatcgcatctgctccacgtgtgcgctatcgcggctgcggccgcacgggccacacgtgtcgcttgcccccggctctataaatgcccggctcctcacccggaacaagtttcaagccctcctctcctcttcccaacactagtaggataaagccacagagagagcagtagtagtagcgagctcgccggagaacggacgatcaccggagaagggggagagagatgagcggcggtcaggacctgcagctgccgccggggttccggttccacccgacggacgaggagctggtgatgcactacctctgccgccgctgcgccggcctccccatcgccgtccccatcatcgccgagatcgacctctacaagttcgatccatggcagcttccccgtacgataatcctcctcctccatcctcccaatcatcaccaccatcaacgccgtcgtgaattgattgattgatttggtttgatttgttggtgttgtgtagggatggcgctgtacggagagaaggagtggtacttcttctccccgcgagaccgcaagtacccgaacgggtcgcggccgaaccgcgccgccgggtcggggtactggaaggcgaccggcgccgacaagccggtgggctcgccgaagccggtggcgatcaagaaggccctcgtcttctacgccggcaaggcgcccaagggcgagaagaccaactggatcatgcacgagtaccgcctcgccgacgtcgaccgctccgcccgcaagaagaacagcctcagggtaagcaaaaaccacacccaagattccatcactaaattcattactaaatctgtgttcatcgtgattattgattaatttagtcacctaattattcgcccaaaaccgcagctcgattcgaacagctggtggtacttctagatggatactactatttagatatttgatatatttattttgcaacttgtttaatcagctcatttcgctttcgaaatgaattgggaggataagcttagcgtggcccacggctttgggccgcagaaattaattggagacgttggctcatctcatctctagggccgcacctacgtggtgcaacttgcgcagccacgatcgaatcgttcgagcgtgaaacccattgccgtcaccacctcgcctcatccctttcagggaccaatcggtttttagccctacgcgcccctgcgatcgcgacgcccacgatagctaaatcccgaaagcaaataagcagtaatcggacagcgactcgaccgggattagttaaacaatggcttgattaattagatgctggaatttggagccttctgataagtttagggcctgtttggcacagctccagctccagcttcaccccttctggagctggagctcagccaaacagtttcggctccaccaaaacggggagtggagctgggtggagctctctcacaaaatgaactagagttgtggagttgggtttaggcagctccacaactccactccagactcaactcctggagttaaatttaggagttggagctgtaccaaacaggcccttagttttgcacttggtactttaatttttttttgagtgagtgtaaatttgtttctaaactttgtttatgaatttgttttgtattggtgcagttggatgattgggtgctgtgccggatttacaacaagaagggcgggctggagaagccgccggccgcggcggtggcggcggcggggatggtgagcagcggcggcggcgtccagaggaagccgatggtgggggtgaacgcggcggtgagctccccgccggagcagaagccggtggtggcggggccggcgttcccggacctggcggcgtactacgaccggccgtcggactcgatgccgcggctgcacgccgactcgagctgctcggagcaggtgctgtcgccggagttcgcgtgcgaggtgcagagccagcccaagatcagcgagtgggagcgcaccttcgccaccgtcgggcccatcaaccccgccgcctccatcctcgaccccgccggctccggcggcctcggcggcctcggcggcggcggcagcgaccccctcctccaggacatcctcatgtactggggcaagccattctagacgaccaaaaaaaaaaaaaaacaaccgcattggcagcaatggtgtcactgaacaccgtgcaggctagctagcttcatggccggtgaactttgactcaggcgagccgccggagttgactcaaagataattaaaagaagtgttttaagtggattggattggattagacagaggagatgaggactcgagaaaggcggcgatgagaccgtggttggggggaccctggcctggactgaacgacgacgaggcagcagcagaaagatggtgcaattgcatcgggtggcatgtcagtgtgtgtgtatagtggcatgtacatagtacatggtgattgattcggtatacagggggctagctttcctgtttctgtttcttcattggttaattattactcccattataaggtcttcttcagggttgctagcttaattaattaattaattagcccagtggttgaagtgtaagtcaaaattcatcaagtcagagactggaataatacaatacagtactgtagatatctttttttttttggtagatgctgatgtctgtttgttagcaatggaaaataaaatgatggaaccatgcgaggaaaaagcgtggaattaatacaacagacgcatttattttccaaccgagctgcacatcactacagctggagatgatcgatcagatgagcgaccaagcaaaataagcttgggcgcgaaggaaatcaaacgtgccgctctgggcggagtgaggaaaaaacgtgaggaattggagtgcgcgcgtagacgacatatgggagagacgggtggatatgcacgcattgaacgatgagtggtcggtcggttcaatgcgcacgtgtggggggcggacgtagttttgtctttgagggttcatggggcggtgcggttgacgacgttctacatgcggcctcgtgcttatcgcctccggttagccggcgtgttcccattcctgttctccaggatatgctcctgctatactctctccgtcccataatataacaatctagcctgattagacattttataatctcgtctcataatataacaacctaagactagattagatattttataatacgatgaatgaacgaaatgtctcgtccggtcctagatggctatattataggacggaggggtaagtatattgcacattagcacatataaatcaagtcatattaggcagattttattccgaagatttactccctctattttatattataagtcgtttgacttttttttcttagttaaatttatttaaatccgatgaaatttgttggagtaattttcatctgactggacctaactcctgtagaactgagcagcaaagcaaatagcgcaatggatttatccaggagtagtgaagctagccatggttttcaaaaaaagaagctagccatactagctcatctcgtctaatctaatccatcctgccatcgacgcttttcctcctgtactcctgtgcacagccacggtcccggacaaaactgctgactgctgcttccagagataagatccatccacccgttcaaattcactgcatccgtcgttctcagccggctgtaaacgcgcccacaaaaacaaaaaaagcggcgtcactttcctcgaactttccggcgacgttttcgtccgtttgcacggagaaattcaatggttctcacccatgtatgagtccatgacgaccccatctcgtctctcttcttccttcccgagatcgcgtcgccgtcctcggccgcatttctgacgctacgtttttgaacggaagcggcccgccgatcgtgtgctgctactgttcaccggtttccaacccgaaaacggcgtgaacgcctagtacaggtcgtatgtgaaattcttaccgggactcgggagtaaccgagcatgagcttgtttagttcccaactttttcttcaaactttcaatttttccatcacatcaaaacttttttacacacgtaaacttctaacttttttctttaaacttttaattttaatcaaacttctaaatttggcatggaactaaacacacccatgggctgtgtttggaaccctaggagtttgtttagttcacgaaaagaaaatttttgagtgttatatcggacatttgaccggatgtcggaaggggttttcggacatgaatgaaaaaaactaatttcataactcgcttggaaaccgcgagacgaatcttttgagcccaattaatccgtcattagcgcatgtgggttaccgtaacatttatggctaatcatggactaattgggctcaaaagattcgcctcgcgatttttcccataactgtgcaattagttttttaatttatttatatttaatactctatacatgtgtctaaagattcgatgtgatgtttttaagaaaaagtttttgggaactaaacagggcctaggtttccaaccccttttcctcgtattccgtacacacgttttttaaactgttaaacggtgtgtttttatgcaaaaagtttctatatgaatgtttcttaaaaaaaattatattgatccattttttttaaaaaaatagctaatatttaattaatcacgcgctaatacctagggcatgggttaacaacctctatacacgaacaaagcctaaatggttagtcttgtgattgtccagactaatggaattttcctatagctataggcctcaagtgttagagaaggctgagattttgagatactagtacatggctagctggtgatcaacaaaatagttgggctcccaacttcaacttttctgaattttgtatactactagaaaaatatttttttcaggcaaccaaaacacgtttatgcaaatgacaagaccctccacccgcaatttaagacctatgaaaataattttcaccggcggacctaatgttaccccgtctaaaaaaagtattttgggcaaaaaagaaaaaacaattttcactgcatgcaagcatcggatttaaatcagaatcagatccactggaacaaacaagaacaacatatccacatgaacaaacaataacatgttacaaacgattttttcaagtgaacaaaaacgtttatgcatgcaggcaaactctctgcctgcaatttaaggcccgtgaaaatctatagttacgtaactacatatttaagttctagaaaagttacggctgttagaagggataataatctcctgctgccgaacgaaagaacctaggccgattgtacatcgaactagtagagcaggcaaaacaaggagagatgctgagacctgtaatgggcttcggtgaatatgctctatagccatgtgtttgttagacccaatatcagcccatcatgttcatagagcgaaatagaactaaatttccggcccatagacatggatggcataactgggccctatcacagatcagctggatgggaaaaagttcactttcagtctctgaaacgcaaaactttgcataacaactcctctgactattaaaaacgatgaaaatgactttcatagcaatattgatagtggtattcactgatatgacgtccatgtggtagcccaatcactaaatattaaacttaaaaaagaattagatgtggggcccatgtgtcagtgccctttcttgttcttctctctttcttctctccttttccccaaccatggtggcaatgcaacgcacgctcacgagccctcctgctatgccgcagccttctcctccttctccggcatcggcttaggcggtggtggcgccagccgtaggcatgggcgtggcctaccgccctccgtgacggtgaagtgtcagtgtcgctaacctcagcttccgcagtttgcagatcatgtggcattgcctagtgaaagcgttctagtaaattagtaaatgtgttcgcctattttaacagagatcagctgctgaaaccaactttccccattgcattttcaaatattcaatttgcacaatcatcacaggcgatcatcacaggtgcgacttaagggctgccaccgccgcttgctcccttcccgcggacggggagggtgagcttgagttcgatgggtttcaatgaccactgtcgctgccatcggaagctccttgttcgattctgaggggattgaagaggattggagatgattgaggggaataattttacatcacaataggtgtgaaataaatccccaccaattccttccttaaagggattaactgagtaaggcctaaagggggaagacgaagggagggagaggaggaaggaagggaggttgaggatgacatatgggctccacggaatatttccaacttccatgctaactcagcgtttctgaccatggtcaacgtaccatactaccatgtcactcaataccaccctcaatactgccatatgaattatttcgtaccagctttaggacttggtggggattattatacctgatttgcggttgaggaatatgagtaaaatccaaccaataattgagagagtaaaagtggactttttcctcaactggacgcatcgtttctctgttgggcccaagtccactgtgggtctcagttcttcctgtagaaggctaactgcaattttcagataaaacaagtgttaataaatcgtgtgcttttttttaatccaagctttacctactactagtactactcatacctgcactgtaccaatcgtaattcgtaggagtttgtctaaagagaagagaacaaacgtcttgtcagagttggtgattatctaagagcaaggctaatagtgaaagtagcagtcggcggtagtatttatccaggtcatctaaagttaatactatatattgtttatataaaagattggctctagattggctttacggaaacaagaataggtttaattgttgcatgtacaggtgatcaaaactaaactccatctctgtagcccatcctgcttcagcatgaaactaaactatacttggaaccacacactatgcatatgcacataagatcaagtagctgaactatagacccacaaagtgaataaaatatttcatcttgcctaatttaccgtgctatcgtccggcgcttgcagaagcgctcgcttcgctctctctcatgctttctctctcctctacgtatgataatgctgatgtggtgcttcttatagccggctgagcacaatactattataccttctctcaagttagattcagagagtttcagacggatcatgccggaaatcaaagagccggacgtgatcgatctggtcgcagaataaccggcggatttcctcttgcggttggatggtcgcgcaccatggcacggcgctagctagcggaagaaacgcccaacgacaagtcaaaaagcgcgtgtgcgtatgtgattttggcagaattggcgtggtgacatgtgaagaaaaaacaattcagcaagccgctcggttgtggagtgccaacttcgcaattgagtaagtcctccctccgtcaaaaaaaaaaaagaaaaaaaaagataaaccctgttttccatgctcaacgtttgaccatccgtcttatttaaaaaaaatataaaaaaaattaaaaagataagtcacgcataaaatattaatcatgttttatcttctaacaacaatgaaaatacgaattataaaaaaatttcatataagacaaacagtcaaaattgaacacggaaactcaaggtttgtctttttttttttgacggagggactataatcgtagttgatcgagtatgttccaagcaatggaaatctcaccccattttttcttttactagccgttccttcattttgcagtagggttacagtagttacctagtaattaaggagtactagttctaccttgataaactagattcttttactgacatggagtgttttaccgactcaaagcgatgattccttttactgtgctttgccgtttaccttgctaattaacttgctaaatttgtggctaactcgtggtaattaagttacgttgtatgattcttgcagatggtgttagacaacaccacatgtaagtagtacaatatgctgtgttcacgtgatcgtttggttaagcaagctacagcgagagcaattaaaggtcacattagatatttaggttgtttttagttcagtgtaaagtttgtattttggttgaaattagagatgatgtgactgaaaagttgtatgtatatgacaggttgatgtgatgaaaaaggactgaagtttggatccaaacttttaatctaaactttggaataggccgagagcctggaacaatgacaccgaccatagcgaatggagggaacatggtgatgtggatttatgttgacacctcgcctgatgctcattcgacgaatcagttgggccctcgtgcgcttgcgatctaatcctgctcgtaaaagtgtcttttggtttagctttggctctgcatgagaatgagagatccatcaaaagacagtgagtagagtgtgacactagatatccctacttaagctagctctgttgattaaccccaatctctatacagtacagctaccaccactgctagaggtcaacggaggcctcagcctaacaagcgatgatgactaattatgtactcccccctactctaatataagagaacatttgacacttacactgtttaaccactcgtattattaaaaaaatactttgtacaaatataaaaagcgaaaagttgtgcctaaagtactttggataataaaataagttagaaataaaataaataataattctatttttttaataagacgaatgatcaaacagtgcaagtaaaataccaaaatcccttatattagaggatagaggaagtagtactaataagtaatgcattagtcagcgaatggagttaaattataacaatctccatgttcgttagtagtggtcggagttaggagcagtttggcaagtctcaactctcaacacaacaatttggtcatttgcgcggcagtagaacacacatgaacaaggaaacaatgagattatcacgagctaatgggcaatgtgatgatgagtagtgggttagttggtaggtaggccgcgccgcattagtgacccgtgagcccgcacgatccagtgggcttgcccccaacctcgccggactctcccccccgcggcggccgacgccgacgtcgcgccaccgtggcgcggcaccgacaccgcggcgggaaggacgtgggcgggcctggtttccggtgggcctacctgtcggtgcagtgggcgggccgcgtgggggtgggattgaatgcgcgatgggccgtgggccagggacgctgcaggtgggcccgcgtcgtactactatttgtttatccgcgctgggtggagatctttccgttttggcccttcggcaaatccatattccacaccacattgctgccatatacgaggtggtgtttgacatatacggagtacgaagttgaggatgaagttataaaacgagaaagctgattaattatctcttaatactataaatttaaaaataaatttatttgataagtattatattcgtctaaaaaatatatgaatctaaaactagatatgatattttctagtataatatatctagacagcaatgtttagccgtttgaaaaacgtgccaaaaaatcaatgtaaaatcatcttaatcatttacagcaataatgcgatatttggaggacggattcgcagagaccctggatccaaccatttttggtct

SEQ ID NO: 71182 - DNA, 4802 bp, Oryza sativa
cgagttgcattacccgtcgacgccgacgaagaaggctgcgccgccatccgcggctagggttgccggttgcgccagaagatgtggggggacacacaggaccacgggcgcgccggcggaacggagcggcggcagggggcgccggagcggagcggatcggggagggagcgagctctagagaggagatggcggagaagacggcggaggcggaggaacgccgacgaggaggagagcccgctcgagagatagaatcaggattcagggcagaggggaattttctttttttttctttctttcttttttttttttttggctggcatatgtggggacacgccgagacagtcaattcgtcagagagctgcggactgcgggcaaaacgtgcgaacttttttggtttttttggaattattattacgtgcaagtttgattgtagcggtaaaaataactgaagcgtatgtgccgttctgatgatggtagaggtgaaaagtgcctgaggtgcaaatttcagaagctaagtggaagggggtgaatatgtaaaaatatgttttgacgagtttttaaatatttgaagatattttgttatgcaacgtttggattgtatttgatatctattatctattatctatctattatatatatatatagggaaattatttgatgctccatggagtatgggctccaaaatcatccaccattcagctgcttaggatttgtgcaaaccaaaaactcagtgttacaaaaattagcgggttttacccgataagaaagatctatacgtacattccattttttttatttgcatgcatgtatttccactggtggagaaaccatatttggtcggtcgaccaaaatccacaatagtcccggttccactaaaaaccgggactaaaaatcatctttagttccagttagtggctacagtgggcatatttaatctttagtcccggttggtaaagatcatctttagtcctggtttgtatgttgtcaggggctgtcaggccctcccgtgatctctagtcccggttggtaacaccatccgggactaaaaatcctaactgtctttactcccggttggtaacaccaaccgggactaaagttaggatttttagtcccggttgttaaacaaccggtaaaacaaagcctctatccacgcgcgcgcatgcaagtctcttattaattccatcattatctcctcctctcccatccagccattctctccatcttatcttcttctctcctcctctcctcccatccttctcttccttcttctctcaccccatctcctcctcccctcccttcccctccggcggggcggcgtgatggaggccggccatggcggccccggacggggcgacgggatggaggccgccgccggcggcctggcgcgaggcgacgagatggaggcggcggcgaccggctgtgtcgggcgggaggcggcggccgacgcaggtcgggagggcggcggccagctgcgtcgggcgcggggtggcgagataggggcggctggcgccggtcgagggggcagtggcgggcggcgggccgtgggcggcggcgggcgcctggccgcgggcggcagggagcgtggccgcagccggcccggcagggaacgtgtcggcgccgggagctcgtgaccggcggcaccctctcctctaccggaggggggaggcggcagcgaagcacaattttcttttttttcccaaatttgtgatacatttggatataagaacttgtgattcattggatctgtgatgtttggatctgtgatgtatatgatgtgtgatgtatttgatgtgtggatctgtaatgtatttctttaagaatttgagttgtatttttttgagaatttgtgatgtgaatgattcattgatttgggatgatactttgattttggaatatttggggagatttgggaaggagcaactctttggaaagaaacaataaaaataaaaaaaaagaaaaaaatggtgaccaaccaggactgcgctgctatctttagtcccggttggtgggactaaagatggatttttagtcccggttatttaaaccggaactaaagatagtgatttttagtcccggattcgtagtcccggttggaaaaccgggactacaaaggggttaccaaccgggactacaaaccatctctccgccagagttccaaataaagtatatatggattctgaacgtgattatgacaaaattatgcccgtcaattacgttatccgttgaattgatttctttccatgtatacagatttggacgttcattttttctgtgtatatatataccatccgattccgacggtattgcaaattgtagaatttagattagacacatatacatgcgttcgaaaagattagatacatacactcgatcaaggtacatacgtccttgtccgcttgtcgtcgctgcgagcttcgtcgccatgccgttacgtcgctgaacgtccgcgaggttagtcgtggccgccgtcgccggtcaactgtaatctttcgtggccactatcgatcatccatgaggatcgtgcggtcgtctgtgaggttcatcgtcgccgctgcggtcgtctgtgaggttcgtcatcgccgctgccggtcgtctgcgaagttcaccgccgccattgaaggttgctgcacatgctgagaacatatctactgcatagcaaccatatgaagcgcgtatacaggccggagcaactcagtaaagccggaagccacatcttggaaggtatatatggaagaaatgtaagccatcggagtactaagcatcacttgtttgatatttacgtgttacacttacagtgtaatctatcttgaaacagtgtgtattatactttagttagcacctcatttttgttatttcagtatccaatccgaataatatgtttgtatggctgcattatcaacaggatacccagaaattaaatcagttaaaatgttgatttgtcaatgtgtgtcattcgatcgttttctctaaatctctactgtgattactgattaagttattagtgacagcatatactcaaccatcactgattaagtccaaaggggacacacacccaacgacgcacaggatgaacataatccggattgaattctttacataagtatatccaatcggttttgctaatttgcacgtgtgaacgtatcggaatcgggagtatttatatgtcaaaaaatatttttaggcgtgataatttagtgtatatgggtatttacataagtattatatgattaatgtacacctcaaaatttcctgcggcggagacgtgagcttctccaaggtgtggcccaggtgccacgctgccacgtgctgtgcgcgccgccgtggtcttgccccgtgcgagcagcagccgcagcggccagtggcggcgtctctccgtctcaagcgaagccgggatatatccaggtacacgatggtcggcggtggcgtcttgtttgctctctcttggggtatcacgcctggtactcaggtaccaagttctgatatctagctaccaactcgatactagggtataaggtaccagctggtactgggtaccggatagcagttaggagtcacttaaagtaccctgtagtaacggttcccgttgtctagtctctctctatttctttacataccttgaatttttggcacagacactagttataatacgatttttgggtatatgacatgactgttgggcacatacactaaataaaataagacacatgatttttatgtatatgccttgaatatttggcacatgccctgaataaataatacacgtgatttttgtgtacatacgctacactaaatacataatacacatgaatttctagatacatacactaaatatatacataatgcaccgattttttgcatgtgccctaattttttttatcacatacactgaataaataatacacgtgatttgttgggtatatacctaattatttaaaaatgtgtatataccaaatatacctaatttttttaatgtgtatatccaaatatacatattttgttgggtatatgccttgaatgggtatataccaaatcgatgtttaaatgcgtatatatttaaatgtatatatacctaatcgatgtttaaatgtgtatatacctaatcggtgtttaaatgcgtatatacttaatacgtgtataaatccaaatctgggtatataattattttttccttaaatttgttcctcaaaattaaaaagtgatgggtaatacatacattttaccacatacccaaaaataaatctccaagaatttcttgccatatactctccaagaatttccagctatataccatgtgtcaatcacattccatataaaaaatactgcacaacactctttattttatatggttaattcctatcatatttgttgcctaaaaattggacatgacacgtacatccgtaaggaaattactaatcatagatggcaagtatagctatttatctaaacatgcatgcatatcgttactacccacaataatagggcaattgcatgcggtagtttttaatccatatataactcattccatatttaatgtacaaacgggtgtacccgttaaacccaacacctagagcgatcaaatagatatggatcagatccaacggcagctaggtttggagcctatacaccatgaagtcccatatggctgtcccatatatatatattccaagattgtatatagatactgcattcctatcctcatatctggtgtctagacccctagtcactgccctgggttagagctggtattagagccaattgcttcgtaacctccccaagccatcttctcccaaaggagggggggaaga

SEQ ID NO: 71183 - DNA, 5200 bp, Oryza sativa
tttgagcttgtcagtgtacacctccattgaaaaagattagagctagaaagttgccaccatagctaacctcgtactctttatgtaatattacatattaactttccaatacattagcctcatacttgtccttttcttttattatacattctctctccgttttatattctaagtcatttgactttttttaagtcaaaattctttaggtataatcaaatttatagaaaaattaacaacatttacaatactaaattagtttcattaaattttacattaaatattttaaatatatgtttgttttatattgaaaatattactatatttttcaataaacttggttcaagttaaaaaaaattaaaaaaaatcaaacaacttataatatgaaacagaatgagtaaaataggcgacgcacagatatcccactttatactatcgttcaaatctaatttaacgaccagtcaaccttatctctttttaagtacctatagacttgcgttttaatactacgtactggctgattgacttttgacataacgcaattcagtttcactatcgcacgctaatagtactcgtacatcattcaccacaataaattgtacagtacgtactaataattagatccctgattaacgtttggtatgaacccaatttagcgtttactataattcacaacgactgtacctaataattataaggtttaatttaaccactactactaattatatagtactacttgaatatcgacaaacccaattttccaaagcatagctgcggtaatttcccaaaacatagaccatgtcattgttacaaatatatataatacctttttcctcaagtattcgttgataatgtattatttcagaaagcatcatcagttaacctaactgccttattcatctcttctgtagtagtattttactaacactcagccaatcaacaaagccttgccggtttatatacgaacatgagtcgatagttttcagtactaaatgtcactgtcagactacttttttctagctaagactaggcctttgagctttgttacctaacccaacagatggccgtctctttatgaatgggccgaaattaaagcccaacatgtatgctgtatgtttcctaattctgctgcccataaaatgacaaatttgatactgccactccaaaattcaaaattgatagcgttttaagatgccactccacaagagaaaaatggcaacaatatgcataaataaaaatatatatttagacaaatgcatgtcagagctagcaaacggaatacgcatatgcagcacactctgatcatatagtacccacacaccatgcatgcacaccacaaatgtatattaggggtgtttgggaactaggactaaatttagtctctctcacaaaaatataagtctctataataggaacttatatttttgtgagaggaactaaagtttagccccactttagcccctccaaccaaacaccaccttattcttcatcatacatacgtatacgtatacgtaggtctaccagcgtactatacgtacaataccacaataattattgtcatcttcatcgtcgtcgctcttacggaatacagtataattcgatcgaatgcatgcaatatttgcatccatggcgatcgatctagaggaggccgcctttgccggagtcgaccttgaagtagccgaggtggagagcagtctggtggtggtccgacgagtactgcgccgccgccgccgccgccgcggcggccagcatgctcaccggcggcgccggctggtagtattcccttgtgtcgaacgtcgccggcagcgcctccagctctgtccccgacgatgacccgccgccgaccgccggcgccggcgccatctcgtcgtcctccgccgcctgctgatcatcatgttcagctcgctcggcctctgccacctgtacgaatgtaaaatcgataaattaattactgtcagtagtaatatcactaatgacttaactaagttgtttaatttttacagtatgcaggtcatgattattgacagtgtaaggataactcaccttggctctcaggaacatgttctcgttctgaagatctgcttcctgcacgcgatgaggaaacatgaaagacattgtgtgatcatgtacattattgcaagggagaaataaattaaacaataagtaattaagcgtgtgcatatgcaaattttgatagtgtatctgagtattcgatttagcgaggcatacccttttctgcatgtattcgatctccgagaacagcagctcatgctgaaaagtggggggaaaaaatcaggaatcaaattagacatatatagattaattaatcagggtgaaattgatagtgtacgtgtattattgtcagttcagtataattaagcaaatccaactattaataacccctggtgaaatcatattactacacaagaaatttcttcgcataatttataaatctgcaattaatatttcaaagatcttcttgcattgttgacatatatataatccattgattataattagcatgtgctcatggtgtctcgattatatatattttcaccttctttgatcgaattcggctgatgcccttttcaagccgattttcaaggctcttgagctcctttgcggtcatattgccaatggactcaccgatgaggtgcctgacaagattatatattgcaattaatatatatgaaatatatgaacactttcagatatactatatacgcgttcatcatgcatgcatgacagcatgagatggatctttttttaactcagacatgagacgcataatatatattgtgctatagccataagctatcacaatacgagatgttggatttaagggcttaattacctgtttgcattctgcaaggtctgtatctggtggcgcatttttgctgcttcttgctgaaagtattgctgtgtgaagatacccagtactggattttagagggctcaagataacacacaaatctcacaatgtatgtagtatatttagttatttacgggtaaaatttcaggccaaattaaatatataaacgatgcgtgctatatatattatacatatggatatacagtatataaccaattaatgaatacaaaacaacttacatgagaattgacgtctatcactggagcggatcctgaagtgctggcagaggctttcttgtacctctcgattgttgaccttgtgctgaaccaaatgtgttgtcaaaacgaagcagtatagtttcacaaattattaaaccattgtttgatgaaaattagcaaatcttcatttttttagcagaaaaatgacatgatatataccgaaatggaactgaaagatagcttcagaaaccaacttcagcagaacataaaaaaaaaaaactactagtaaaatgcatgctgcatgcatgcatgtatgcgtatgctgtccccctagctttgctagagcctacagcacaaggtagcagaccatgcaatacttgatacacattcaaagattcactccagataggtttgcactacgacgtgtcacagatgtatatatatttgtggcctttacgttgcaccaaaagatgcagaggggccaaagatacatcatttgaattaatactccatactcgctgcaaaaacacaggcacagtcaatggcgttctttaacgctctttagcactgccaaggaagatgaacagggacaacctgcaatttccttccccatgcaacatacattctctctccgagagatagagaaatatcagatagcgagtacttgtcagtgcacataaaatgaaacgagagctttttcaggggccggcttgcctggcaacatttcaagactggctgcctgagacatctcaagactgaaagcttggaatggattactccttcaagtcccttgtgttctaattttgaccatggactgattgtggaggtataatttcatgaatgaacaagatctagcccaaggctgttacaggttgtccatttccaagatccacacaaattgcacagagatatactaatgtacactagtaataagctcataattaagcatctgctaactgacaaactacactactagtccgcccatcttgaatctatctcagcaaaacatctaagcttaaatgctttatgatcagtcacaacttaattatacacacacacacacacatgagtcaagtgtggtgccctttaattgtttccaattaagttgcagatagcaaattaattaaatgaagtgcaatggtggatggggatgcatgcatgatgcatacttatacctgtttacattggagaactcatagaggcgtcctcggctggagaagacgatgagtgcgatctcagcgtcgcagagtatggcgagctcgtaggccttcttcagcagcccattcctgcgcttgcagaaggtcacctgacggctcgtcttgttctcgattctctttatctcaatcttccccctccccatgttgatcaatcgatccaccttcacaaattaaacatgtacatgtacaaccatgcaacacctccctcttagcaattcatggcagaagcaattaagcaagataaagggagtaaaagcgcataaacttatcagcatataataaagcaagaaattcctagctatctagctaggaaagcacaacatatattgtttttggtttgttcagaggaaatattggtccaaccaaaatcttgaataatcacggatttttacaaattcatgtcttatcgttattacttagttcaatcgctaaacttcagtctcaagttcaccatttgaatcttcatcagcatcgatctgaagttctgaacgatctaacacgaaaagaaccttaactcaaagattcaagaaggggaaataattaacataacttcatcaaagatggacaagactttagagcaaaagaagaaatttcaggagcaaattatccatttgaacacctcatccatatatagcacttgaagaacccccccccccaacccccccaaaagaaccacaagttccaagaacaagaagcatagctagaagagggcaaaggagagaaccgcagaaatggcaacacaacaagatctagcaagcagcttgctgcagctgcttatgtttcaatttcccctttccatcagctcgttgcaggccctagggcttgctgtttctcaacaaatctgccccaaaagaacagcacaaaatggcgcaaagaaaagcaaatactactccatccaa

SEQ ID NO: 71184 - DNA, 728 bp, Oryza sativa
aaagtcctccatctgcctcacgaattctgtgggcggctttacagaaatatttatgagggataataccttctcgaatgcaattgacatcagcaccagaatcaattaaagtgatatgctgaaagtaggatccgtctataaaacgatacataacttctgtgtaccatttttgcttcatatatttttgaatggttccaacaacctgatcatcttcttgaattggttcgtccttttcttccatatggaatccttcttttaattctaacatgtatagacgctttcttatttcttctaaatcttgtttcataattttttggtcttcgaataggctcatcaaatctggtttctcattcttctttttctgttcatctaatcttttgaacacttcatcaatagagaggaatttgctcttttgaatatccttttttagtttatccttatcagtcttgactcttgaaaggaatttttcgagaactcttcttttttcttctggatcttgaatggtttcaaaagtatcgagaacaaattcttctaaactggttaaaacgagtatattttcatcagactcttcttctgaattatctggctcataacaagagcaaccactgtcttggcaacaattaatctctgcatttttttcttcatctgaacatgagtcattgtctatattatttagtattgtttcaagtttttctttaacatcttctgattctgaatctaacaaggcttgg

SEQ ID NO: 71185 - DNA, 2980 bp, Oryza sativa
gtgcagtagcgagaagtctgttggcactatgtcggtaaagaatgcttcatttatatcttttgaggatattgagaaaagtatttctgactggaagattcctaaggttaatattaaggaaatatatcatgtaggtactttttcgttacttagtgactactatattaaaacaattgaaatattccaattagttctttgcatgaaaccctgcatcttctttctgaaagagaaatcaattctataagagctaaacatcaatatcactaccttcactttggtcttatacaagttgctatcagatccttgactagaaagggtttgaacgtctctgttctggcttgtctaagagattgcagaaataaaaggttcaaagattccttatatctctaattttaatgaagataagattcccactaaagcaaggcccattcagatgaatagtcgactttaagaaatttgcaagcaagaaataaaaaacctgctagataaaagcttaataaggaaacgttcctctcctttgagttgtgcagccttctatgtagaaaatgctgctgaaaaagaacgaggagttcctcggctagttattaattacaaacccctcaataaagttctacaatggataaggtatccaataccttataagcatgacttaatacaaaggattcagggttcaaagatatattctaaatttgatatgaagtctgggttttggcaagtccaaataaaagaagaggatagatataaaactgcttttactactccttttggtcattatgagtggaacgtaatgccgtttggtttaaaaaatgctccttctgagttccaaaaaatcatgaatgagattttccttccctttacatcctttattatagtttatatagatgatgttttaatattttcccaagatgttgaccaacattggaaacaccctaatatattttataaaatcatagttcaaaacggtttagtagtctctgctaagaaaatgaaacttttccaaactaatgttcagtttctcggttataaaattcaatatgatcgagtccaaccagtagcaagagtaatagaatttgcagaaaaatttccagatgagataaaagataaaacacagttgcaaagatttctagggtgtttaaactatgtctccgatttttataaagatcttgcaaaagacagaaagattttaaccgagaggttgaagaaaaagcctccagcttggacagctaaacatactcaagctgttaagaagatcaaaggtaaggtcaaaaccttgcactgtctttatatcctagatcaagatgccttcaaaattatcgaatcagatgcctcagatcatggttatggaggaattcttaaacaaaaaaaggattccagagagcagctggtcaggttcacctcatatagatactgcattcctatcctcatatctggtgactagacccctagtcactgccctgggttagagctggtatcagagccaagtgctcgtaacctccccaagccatcttctccgaaaggggggggggaagaggggtcggatagcgtgctgaagtcgcggtgatcccgaacggtgtggtggtgttctgaagtcgcgaagttcccgaacctttgatcggttgcctgaagtcgcgttgccttgttgagccgcagaaggcgtttgtcggcgtaattcgttgactgggcacttatcaaaggcaaaggttgaacttaattgtgggaaatattccctgccgttgactggaacacatcatatccaaatagcttgatcataattgtgggagatttccccgccgttgtctggtaactacctacctatcttcctatctttcgtataagatgtcttggttggttagatcacgaagagccactgatcgatctgtagcctcgtgcagtagcgagaagtctattggcactatgtcgataaagaatgcttcatctatatcttttgaggatattgagaaaagtatttccaactggaagattcctaaggttaatattaaggaaatatatcatgtaggtactttttcgttacttagtgactactatattaaaacaattgaaaaaactattccaattagttctttgcatgaaaccctgcatcttctttcagaaagagaaatcaattgtataagagctaaacatcaatatcactaccttcattttggtcttatacaagttgctatcagatccttaactagaaagggtttgaacgtctctgttctgccttgtctaagagattgcagaaataaaaggttcaaagattccttacttggcatggtggaagctagcctcagtaatggtcctgtttattttaacatctttcctgatttttctgtatccctctcagacacaaatatccataaagttctcactctcaacttacaaacatctggttatgaactagaaccagggagtgaaaacatctccgttacctacagagtttactacaaagccatgacaactttagcaccttgtgccaaacattatacaccaaaaggcctaaccactctccttcaaaccaatcctaataacagatgtactacccccaaaaccctgaaatgggatgagatcaccctgcctgagaaatgggttttatctcaagctgttgaacctaagtctatggatcaatcagaagtcgaatccttgattgaaacaccagacggagatgttgagataacatttacttcaaaacaaaaagcctttctccagtctagaccttctgtcagtctagattctaggcctaggacaaaacctcaaaatgttgtctatgctacctatgaagacaactccgacgaaccttcaatctcagacttcgatatcaatgttatcgagcttgatgttggctttgttattgccatagaagaagatgagtttgaaattgataaagatttgcttaaaaaagaactcaggcttcaaaagaaccgacccaagatgaaaagatactttgaaagggtcgatgaaccatttagactaaaaataagag

SEQ ID NO: 71186 - DNA, 3444 bp, Oryza sativa
  unsure (1)..(3444): unsure at all n locations
gattcttattcctgattctggtgttcccgataacagcagaacttatgcctttctcatttcgatttatctttatgatgggggttctctatcttctctgcagaatatatacagaagagggaaaatcgctatacctgaaaggactgtaaatttggaaaaagaggatggtgttgaaaaaattgtagtccttcactcctttgtaatatgaaataatccctaaattgttgcaaggattgtagtccagtcgtccagattgtaacctgaacagccttttttttttgttcaaattgcaagaatactgagttatccctttgtaatctgtagactgtatttttctatctggaatacatatgagcgtttttggttgttctgaaatattcaatctgatggatgtgttacaaaaactgtgattgtttatctaattacgtgagtgaataaaatacggaatattgtataatctgaatttttgaagaaatttaataagaacaagtagcaactcacaaggtgagttcaggcaaggaaaagatgaggataattaagagcaactcaagaactggtcgccacaaagtcaagtttttacatgttaataagtcacaatctccgtattaacgtaactaataaatccatggtcgcaactaatatcatcaatgaaaattcagtaaatccattgctccttgtcgtcatgcgcagcgcaggtgaaaccagccggcacctgatgagacgaaggcagaagcccggcaggtcgatctgttcttctccaggcctcctcgtcctaccatcactatcgtcgacggcgtcggcgagaggtgattccggtccgattgaggtgagagggcgagggagcgatcgccgcagcgcgtccgcaaatcgtgctcgccgttcgatctcttttttatccacgcgtccaccatcggcgcccggggctgcagaggcttcgctttgcaccggtgtatgcaccaattttttttcaaatcaactcggactcggttagtcgctttgtactgccgcgcgcgcgcgtttcccatctccgactcggattacacgtaggcgcgccgcgcgcgcctatttatagccgctgtccgtctccttactccatgcattagcctgattgctagttgctgctagcgcgtggcacaagagcagcgagaccagcagtaagctaggcatggcggcgcgcgccggcgacaccggcctgagcaaggtcaggcgctactggcccgggagggcgccggactgggcgtgggcgggcgccgctgtcgctcacgacgaggacgacgcacgtctcgtctcgacgcttgacgagatcaagcacgtggaggaggaggtgctgaggtcgccgcgccgccgccgtgtgcggcgggctcccgagatcgcgtcggcggcaccggcggtagatgactggcacgagcccgatccgatcgaggaggaacaagacgaagatgatgatgatgatgcccgggaggagcgcagagcgaggataagggagagggcgctgctcctgaggcggcatgaggaggagcagcttcttcttcttcacccgcagcatcaggaggaggaagatgaggaggcgtctgagtctgaagagacngcggaatcggactccgacgtcggcgagcagatggccgtcgtctacatggccgtgccactgtttataccaaagccgcggcgtgacaccatccggctcaaggagaaagaacggcagcgatttgaggacgagctgcacggaagaggctcgaggacaggaaggctcagacgaggcagatcttgctccaagagatcatcaacgaagagctcctcgccgccaacacagcttcagatgaagccgccatcaacggcgtggacaccgacgacgaggtggaccaagccgaggagtacgagtcgtggcggcgccgggagatggcgaggatcaagaggatcagggaggagagcggcatcgacgacgacaagtcgatcatggaagacgagaacccggttgctgatcgtcccaagaagaagatgaagatcaagaagcagatgaggttcatgcaaagatactaccacaagggctgcttcttccaacaagacgccgacgatgcggcgcagacggcaggatcatgcgaaatctaccggcgagatttctccgggccgaccgggttggacaagatggacgtaagcgtcttgcccaaggtgttgcaggtgaagcactttgggcggcgtgggggaaggaagtggacgcatctagttaacgaggacaccacgtacaggacaccacgtacggtgagtgattttgtatctatccccacaattttgtaaaatttcaaaaaatgtgagcagcggcaagttatttttcacccccttgtgacgtactcatctgtattttaatgtatgacgccgtttactttttgaccaacgtttgatcatttgtcttattcaaaattattatgcaaatatataatcatgtgacaaaaaatttaattgtaataaataaagcggtataatcttatcttagatgaatagttttggagaaaaagtattcttacatggttgcataatgcatgctagtagatatcttcaaaactatagcccaatgcacaatatttggcaccatagatctttacttgaaatgatatctggaatggagacattagacattttcatagattgttcgggtgggactcagtcaaatccatatgtgacaaaacatttggagatagtgttaacttacctctacctgctcaagccttagatgaatttcagcagctacaagttgaattgaatgagttacaacttcaaatacaaagggagatccttagtctgtcatatggaacagccgtgtttgttcctcagaattttcacgggctgaattttgtgaatcattctccccctagtcaccatttggctctggaaaactaaatgtgtcgtcaagaacaaagtatttatgtggctgatgttgtatgatcgattgaataccggagacacgttggacaaaatcacaaaaaactattgtgctctagaatgcagatctaccttgtgttctttgcttactggttctagggagacaacaatgcatcccttcttcgatcatgtgtcgagaccgtattagagtaagatggaatgctaatcttgagtttttccaaatggtggtcttggcacgaccgaggtttaggcaaaagagtttcttggatataatgttcatagcttgctggcatatattgaagcaatgaaatgaaataatctttcaaaaattgttaccagaagaagacaatttgttccattcttttaacaatgaaattctcttgcatatgtgcaagatgaataagccccttaatttagtcatttttgactgattacaacatttacaataattattttgatgtgatactcttgcgtttaaatattttactgttttaaatatataactattaggcaaagcttgttagaatttttcataaaaaaggatcagggtac

SEQ ID NO: 71187 - DNA, 1136 bp, Oryza sativa
  unsure (1)..(1136): unsure at all n locations
tggatgatgccctggacgcggcggaagtggtcgacgccggaggggatggtgatggcgcccttctgctcgaacccgaactcctcctcggcctccttgaggagccccacgaacagcgggtgcttcagataacccaccggcaccacgaacctctctccctccgctcctcctccgccgccgcccacgccgccgggccccaccaccctcaccgccatgcaccccttcggcggcatccctccccccgccgacgagccccccgccgacgccgatgactgctgcctcttcagcaagtgcacacccatccttctacctatatagatatgactatatctaatcgaagaaacgctagcttggtcgatcgatctctagctccgacgacgagcaagaacgcgccgccgttagagcggcgggatctccatggcggccggtgaggtggcctcgctagcttgatggtttcttggctcgaggaggagttggtggaggaggagagcgtagggtgcgcgtgtatatgaggaggccggtgactgcgcccttttgtttctatctgtgaattttttttttactcttttttactatttatgatttattgatttcctttttcttctactgtttcttttcctgcagctgctgattttcctggtgagaaataaatgtcatatctctccccataaatattactccaccatttcaggagtgatattaattaatccagaaataattatttatcttagctttctctttgggatgtttaaaagaaatgtgttttttttttgtgtgtagctagctgttggagatagagcaaggcactaactctacagctttgtattagctacagcggagagggcatctgatccctccgtagagtgtagctggccagtatgccctggtgttgcntaggctttgtgtgcttacaagtgtcagtgagaacaccatgtgtttgagatttgagaatgtggtaccatacatattagaattagttagaatccgtttaccatgttgtatattaactctattattcaaagcaaaatatttatatctttttttactgtaggtaatatctatatcttatagcttcgttaattcgaagtaattcatacatttattatacccacctacacctacctcggcctggtagtaac

SEQ ID NO: 71188 - DNA, 25602 bp, Oryza sativa
  unsure (1)..(25602): unsure at all n locations
ataattcgtattttcattgttgttagatgataaaacatgattaatattttatgcgtgacttgtctttttatttttttttcataatttttttaaataagacggacggtcaaacgttggacacggaaaccagggtttgtcttttttttttttgacggagggagtatcttaaaagcacaggcgtccttcttttcttcccatctcaatgccaagtataaaaaaaccgcttcaaagaaattggtgtaccaaaaaaaggaacaaaaaaattgagccgtgttcatccaattcagtctcattgcaacacacggagccatgactagtgtaggctgtgaacaccttaattttaatttgactagaaggttattttaatcttattattgttatgctgtttagttaaagtgaaattcattgtgggaatttgattgtatatatatttttctagaaaatcatgagctgtagttaggagtccgatcatctcaagttagtatatgagttttttaaaaaatatatcttatacggttccttccgtattttcaaaagcaaacaaacttaaaacccgattcaaatacgtatttgtatttctaaaatcaaacaaacttaaaaaccgactcatacatagatgacgtatgaaagtaccgacaaaaacatcttcaatttttataatagtagagattaaaattgtactgactattgagaaaatacgttgtttgctaaactttccactgaaaaaaaaatgggtggactccttaatttgattaaaattgaactgactactgataaattactttatttgctaaactttccactggaaaaaaaaaaggcaatccaggatatgcttttcagccagcccctgaacaaaaatgtgaaagtagtagtagtacatagaactgcagaagcatttttagtccttaattagaggaatcagggtgcagatatctgcatgtccacaagggtgctagttgtttgtctggccaattttttataggttccgattcaatcaattaaatttgaaggtgtctgtctatatatacaacggtgtgcgggggcaagttcttcataaccatctcaaactgaacttaatcaacgaagtaactttcttcacttattatatatggacatcccaaactgaactgtaaagtcgtaaaagctgtcgatcatataaatagcacagattaagatgcgtacacgatgtttctactatgcactaatcaaggctaagctttttctgaataacacacacacaacagagtgatgcacgaattcagacgctacagaaaaagtcgcagctcaagctagccttgtttagttcctcaatgatactgatgattgccatccaacgacctgcatatatacatgatgtatatttgatgacctattgattactatcattctatggttgatatgatagctatggtctgctgctgaatttttgaactgacattgatgcaaatatggatggagattaagattcaggcagctggtaattaacgaactctaatatttgtacgtttgcacattggtcatgtatatatatatgtagacagacacaaacagaggggtgctgtatgcagacatgcatattcagctagcaccacaaatccaaaataaaaaaaaactaacaccacaaatgttctgatctctctccattcctagctagaatagattcacacttgccatttcgctgcaaagatacagagcatgccatcttggcccatttcaggcagcttgctcacactgcaaggctctctgaaactttacagccgctatctattttggacacctaccaggaaataactacaggattaaataggatatatagatgcaggggtaacaattaatcacaacgagtaaaaaaccatgaacttgtaatgattttttcatgtgcttttttgagggtgaaaccgtagaattgagaatacccatatgaaattttcaatcatgaatttacctcaaaaaatattttttaaaaaaataggaaaaaattacctaaagataaatcaatcgtgaaagcatgcatttcccatagtgttgcactgttcgtcttgagcttgcagaaaaagttgtaaccagattttcaggacccttcatcagtgccattcttctttgctgcaacaaaacagcaggtgacactttatatcttctcaggcacatatggcaaaatctgctcccaaccgtaggatcagagaatgaacgatcccgatttaccctctgtcgccgctgcctttcattcagatagctaaggacacctcaacatcacaccatgatttcacctcctgacagttgcaacgcacttagcgcccttttagccaaggaaatggaccacaccaacgttaaatggtggtcaaatgcatccacccatttttttgcctctttcttgtgcaaaacttccctttttcttaagacagtggaagcattttgtgcaagtttcctaagttgctgagaaaggagtccattgctaggaatgtgtgatgcgtgaagaagaaatggatcttcagttggattcctggagatggagaaggagaaggaccctcctccaatccacctcaatgccctacctgatttatgggtgcatgtggaccatctgatgcaatatgctctgcctcaatcagaaagtccatcaagccatccaagtgcagaagctagtcaagtttgcttatctacctaactctgtattaaggtgtatttgcaatattccatatgaataagcagaacattgcaaaaaaaagatttaagggttttttttaaaaaaaataaggcaagattttgccttgtgaaatttcagattttagtgcaacttcgacagataacctgccacaaatcaagtacaagcacatagaaattttgtttcaagaacaacagaacaaaggcactgtttagttcccacacaaaaaaaattacaccctacacatcgaacgtttaaacacatgtacgaagtattaaatataggctaaaaaaataactaattgcacagattgcgattaatttgcgagatgaatcttttaagtctaattgatacatgatttgacaatgtggtgttacagtaaacatttgctaatgacgaattaattaggtttaataaattcgtctcgcggtttactgacggattctataattagttttttattagtgtccgaacaccctatacgacaccctatataatacccgatgtgacacgtaaaaaatttactcccctgatctaagcaccccctttgtggactcatgcaagatggactgcagtcagtgcaaaacctgcaaaatctacactgaaaataaaatgtgctatgtgctcaagtgcactcaaatgggtactactactacttgtttgtcaggtactgtcattttgaggccctctttgtttaggcttataagccgacttataagtcgaaaagtttaagccaaaacaaataagcggcttttttgtttggcttttctgaagtcataagccactctaacactattaagccaaaagctaagttagaaaagcttttttggcttatattaggtagatgcatgactccaccattaaacttaggacattaaatccaccggcttataaatcatataagccaataagttgacttaaaagtctaagccaataagtctaagcctaaacaaagaaggcctcaagcgaaggggtacacctcgatgaatgccaattttcagagaatagatgcatgacttctttcagctaaatgaatggcacaatggaattcctttgattataggagcggcactgctttgctaattttctgaaagaactgaaaacaatgagtgagagatacatgaatagtccgctgcatgatatcaatatgcaccgccaacatgttcataataggcataaagcaatgcaatggcaagaagattgagacagtgatatgaatgttatgagtcttatgactagggatgatgggaagatgtgaaagtgtttgcgttgaggaccaaggaaatgatgctaattaacaatgtaaaataccagcaagattcagatgtgaacgtgtttgctttgagtagtgagtatgttggtgagttcgtcttatttaaaaatatacgtaattattattcatttatagtgatttgatttatcattagatgttcttaaagtataacttaaatttttatatttacataaaaaatttgaataataagatgaatagtaaacgtttaaaaaaattgacagcatcgtcagggccggccctggccctatgtagccgaggcgaccgctggggcccatgatggtggggggcccataatgggtgtgggggggtgcaacacctaatttattagtagtatagtacctcatccaatgttgagatcaatgatttttattcggaattaaaagtgttgcaagtgagtttgccagattcttcgagatgcagatttctatccaaatgtttcagttgcctatcaaactctcttaaccgtacttgtgacagtaactttagctgaaagaaatttctcaaaattgaagttgttgaagaactatttgagatcaactatgtcgcaagaaaggttaaatggcttggctatgtgctcaaccgagaaggatatcttggacaatattgatcttaataccgttatgtcaagaaatgcccgaagaagtctctttttcataggaagcaatgaatatgatggggttctattcttcataaagttaataaataatgatattagttccaagttacaaatatattattattttggtcgactttatttcttgataattatcagacatgttaaatttaatatatggatgtatttgttttcgttttacaagtaaaattagcgtctatatatatcataaaattttatatataacttagagggctcatcgcgatgaattcatctagagccctcaaaatcattggaccggtcctgagcatcatatattaagaaatgaaggaagtactacgataaatcaaagtcttgtaagcacaataatacaatatggggaaaatgtacaccgaggtaatgctgttacaacttacaacggcatgtgatgcctccctttggccggtcaacttgctatacaatggagatcttatgtgtatataaataaaatgtaaattcctaatagctgttgcggtcccgtagctcagtcggttagagcgttggtcttatgagccgaaggtcgcgggttcgagccccgccgggaccattttttattccacaattaattcagtgaagtttattttgcatttttcatcaatgttacccccaagtttattttgttttttcatctatgtttaccccaagtttatttggcattttgcatcaatgttttattccacaattaattctgtgaagtttattttgcattttgcatcaatgtttaccccaaaattttgttaagtttattttatttttttaatcgatgtttatccccaaaagctaaataacattattttgcattttgcatcaatgtttacccccaataattctgttaagtttattttaattttttaatcaatgtttacccccaaaaggtaaataacttgtagttttttcccctgtttataaatttaggtccaaatgttcatttaaccaacaaacccaatatttatcccttaatgtatatcacatatagtttttgtttccttgttataaatttacccccaaatttccatttaatccataaataaatatatacataaagcaataggaaatgctttttttaagaaaaaactcgcatttactacctctctttttaaatataccataatgttaattttttcacatgttgtttgattattcgccttattaaagaaaactactccatatgtctgaaaaatatttttgacatgagggaggatgacctatgaggtgctttatgcttaatttgtatggttgattagcatatattattggttgcatgttaggcttccagctaaaatctagtatgcttaaaaacaattgaaggataggtaatactacctccgttttaaaatgtttgacgcccnnnangtgtgancacatgttggactgttcgtcttattaaaaaaatttgtgaaatatgtaaaattatatgcctacataaaaatatatttaacaatgaatcaaatgataggaaaaaaaattaaatagtatgtaaaattatatgcctacgtaaaaatatatttaacaatgaatcaaatgataggaaaaaaaaaattaataactatttaaattttttgaataagacgaacggtcaaacatgtgctaaaaagtcaacggcgtcaaacattttgaaacggagggagtattagatccatttcagaataaattaatctatcacgagatgtgatatattctttcctagtactacaaattcatattccactaattgaatcacgattttaaaatttccacgaaccaccgttggtgagcacatgcagccagatagctctcgttaattaatttaagtagagcgtgatttttgaatccgatcgaacagagaacgaattcgccccaaatttagttggagacacgtaacccgctcaaagcgccaccgaaccataaccaaccgctctccctgccctccgggccccactctgggccccacagcgaccacccccacccacactctctctctcccctcttccgatcttattttttccattccgacccgaaggccgagccaccaacccccctcgcggccaccgacatgtgggccctcaccccaaacagcggtgggtcctcctgcctcccggcgaggcgcaccccgccgccgctcgccgccgccggcgaggccggctcgctggccgcggggcccgggaggtggtgctcgtggaggcgtcgtcagccggcggagcggtggcccaagctggcggtcagcgcgtcagggaggaagagcaagggcggccgcgacgagggcggcggcgacgagcccaagaagaacaaggcggcgtcctcctcctcctccggtaggttctctcggtcgattgaaaccgatggtgcttccggtttgtgcgtacttgcgcgattgggatggtgaaggttggggggtctttgtgtgggaagcggtcaaacctttgtagattcgatgcgggttggagtgatcggcgcagggggggtgaggtttcttcgttggaagttgttcaaattgagtcatgaaaatggttgcgttagaacttagaacacttactagacatgggatcgagattggggtttattatgtatttcagtggatttcttagccgtaatgtttcatgacgtttgggggtaaattttgtgctggtaatgaacgaattcgacgtatttacgattgggatatctttggagattgaaatgtttctggtgcaagtatggtgcaattggtgtaaaatggtttgctatgcttatttggtcgtagaaatgatcgaaatctgattatttatatgatttttttctctgaaggtttctgattgcttgttttgtattctagcttacactgctaaattagcatattacatgtgtttggcatttcttattttcttagtattagtataaaaagacaatgtaaagtggatcattggatgcgagctttatggaatgcaaatggataacttttgagttatgtggtggtggcaccgtggcagtttctttcattgtgttattaaaaataatatatatttctttcaatcctcataagatacatgtgttttttgtggaaaacataattcatgaacttgattgattaactagtcgtaggtctcaccaaatgaccaaatcgataatttctacgtacaggaaaaggtgatgcgtctgctcccagtggagatgtttcaaataatgaactgcaatccaatgacacaatgtatgtacctggtaacttgtcatattggagagacgttagagcaagctttgtggttccaaaggtatggccaatcagtttaaactaatttaatctaactgtggctatccactttttttaatgtaaatgaggttaataataggtcatctgttctttacaatattttcttgctagataatttgccgagattttggcttcgcaccttgcgttagctctattctaacgactacataacacctctgaaataatttgttgtcggtaccatatgggaaaggaagcaactagtcgatctctgtagttttagttgccctgtatgttcacctcagctttatacctatttttacactttctgaaaacatctatctgacaacatgtgctctcttaagaattactgaattaagacaaggaaactgtatcggatggtcatggtgacaccatcatgttataattattctagattcaactttccattctactttagattatcgtgaattggctggaacattttgaaattatcacatgtaccttgttttgacattctcactgcaagtaatgctgcaggatgtttcagcgtgtaattgatagttcacaagtattcactatgcttgtcctgaacaacatccattttgccctgtctagaaaaaatattttttttctccataagcaaagtaatatcctgtctctacataactataattggtgtttttgattatgtaatactatctcattgctgcctattctctgttatgttttcaaatcaggtgcaaacagtagatgcacatactctaccacaagcagctacggatgcaccagtgcactgtcttcctcggaagtgggcacattctattccaatgccagaatctggttgtgtgctggttgctgctgaagagcttgatggcaatggtacgtttgagagaactgtaattctcctcctaagattaggttcaagagatgcctatgacggcccatttggcgtcatcctaaaccgtccactgtatacaaaaatgaaacacgtgaacccatcgttccgcaaccaggcaaccccttttagtgattgctccctcttctttgggggacctgtcgacatgagcatattcttgatgaggactaccgatgacagaccaattaaggggttcgaagaggtgtcgccaggcgtctgcttcggtttcaggactgacctagagaaggccagtgctcttttgaagagtggcgcggttaagcctgaggacttaaacttctatgttgggtactctgcctgggattacgaccagttgttgagcgagattgatcaaggatactggcatgtcacttcctgtagctcaggcctgataagcgactcccttgcaacagatccttcttgcctatggactgagatattgaagctgatgggaggccagtacgcagaactgagtcaaaagccaaaggaagatggctcgtgaaaattcttgcttgctagcatagtttggcacaattgacgtgcttggtttgtacataattgggaataatctcgcccggtcactggccagggtaattgaacagtcctagtagtagtttcatgtggtcgtctttgtcctctgtattacttgaacaaatattatggagtactggtgatagaacggtgtgggctgtgaataattactggaattacatgcttccatcaattttctatgtgccacataaaaatccgaaattgagataattgccttggctcatttgaccgagttttcataatgctcagtcctgtgttcatggtgtgtgattactgatatttactgtacttcactctctaagtgactgttcaagcaaggcttaagtggcaagtagtacaactattgcccgagagattaaatcattaaaatgttttgcttttctagtcaaacgtgtattgcacaagattaagctaaacgcgtcaggcacaaaggtagggagattcagattgcgacagtgagaagcagatacttcagatgcgccacaatcctgcactcactcacgaacgcctttttatttcgtgccaatacccgcgttcgtttcagtacttgtcctcactactcgtctaatccccctattgattagtaattcattaattcacagtcacagcaacggctatggaattaaactactgtgtgaaaggaagacacaggaactcaaaagggttgaaaaaaaatgatagtggactttctgacagaactgcaggtaaatttcagactttcagtgcaagtgtgcaactattcaacgtttctgaatgccctggaggcctggactttgttctgttcttggcgagagtaactacaattactgcgttgttgccgttgtcatactctctgaagagttggtctacactcgagagtctaccggttttgacgtgagcagatgttacctgcagtacattcacaaccaggccatgtaataccagaattactgccaagtctgcgatgaatgcagcgaataaatttgaaaattgaaatttcagcaacgtcaaattcgtgttatggagagtatgtaagttgcagatagtggaagtgttttacgagtgctgtaactaattacagaaattaattattataaaaacaaatgaccaaatagaaagtcaaaaatcatcgaagggaagttccagtttggttctggaactttcagtcagttttgaggtcacagctatcgtcttcgtcggcgttcctggccgcaagcatggtcaacacagcatcttctcaattgcttatcagtgttttttgaactttattattgcatcagccaattaataccaatcttaatttttgttttttgctattttgtcactgcgtgattacatcaggatctccatgtcatccacgctaatctcctcggcacagacgagctgccgctcgccgctcgtcctggcgttcgcgccggcggcatgcgcgtgagcgccgtacatcccgcggcgcgccagctcgtcgtgccgcgccgtcgtcgcgccggcgcagtgatccgggcgcgcgtacgccgtcgccggcgcgggcgcgggcgcggcgtcccgcgccgccacgagctgcgcgtcggcggccatgccggcgtcggacgccacgcgctgcacggaccgcggcgacaggcgcgccacggcggcgccgccgccgtacgtggccgccgcgcgctccgggaagttgagcgtcgcgccgccgccaccgccgtcgcccgcgcctccgcggaggaagtagacggccgtgtcgtgcgcgacggcggcggcctccggcgtggcgtaggaccccagccacagccgtcccggtgccgggcacccggatctccgacacccacttcccccaccgccgccgccgcacgcccctgtacctgcaccgctcctcctcctcgccgccgccgcactccgcccggctcattgcctcctccggcgagctgagatcaacctcaccgtgatctctctccgttcttgacttaatttcaccctcgatttgattcgcgagcgttgggaaagcaagtgtacgtactacgcgtatatatatgcatgggaggtcagccatggcgagttgacctgctagctcgccgaatcgatcggatttttgcttgggatgtttcacttcgagagatttcgcgcgggaaaaaagttaaccgtgtgtgtgtgctgtgatatttctggccggtacgtgagcaacgtaaagctgaggcggcggggtcaaacctctcaggagggtcaaaccattgttaatactgcatagtctcttgaggcattatttgtataatgggattgggaaatgatttcccacccatcaaaaggtatctttaaattctaaccattcattctccatcttccatttagtcctaaccctttattcatttcccaattctaattccactctccatttcccattatccaaacacactctgagtgtctagaaattaattagttcaacccgattcaagtaacttcaattattcggattaataatttaaataaatactaagcatattctgtgagtttttaaatttgttttttcagtaggaaaatcattttaataaaattttcttcaaagtggttcatgttgatttcggagcaccttgttgttttttttttgccaataacaaaaaattgaatgtacatatttaacatattttttgcctgctaaacacactcacagagtacgttttttttaggtatgatcacctagctagtgcagcatcatccaagaccgtagagagttttgccttgtccagtgatgtgacaaaagactacagtagtagccactaacatgggcggcaatacctaaccacacaccaaaaggcatattcgtttcatttaggcggagaatgtctgaataattccattcatacaaaaaaaatgattaaaaaaacaagcgtccaacgaattaaaaagcatgaaaacgtgcggcaaaactgaataaaagcatccgatctgaagtagtcaatccctcccatgttgcaccgcttgttggtattgaccggaccgacagaccggctccagtgatttcaggttgtaatataaatgtcacctccggtttcattttaattaacgttttaaacaatgatacgatttacaaaatatatctttaaccttatttttctattataatatacacaataaataagtgcatgtttacttttattatagtgctttgaaagacaaatctatgttgttctagtttctttaaactaaatatttttaaagttattaatgctcaaagttataaaagtttgaccttaaccttgtctaaagcgtcaattattatagaaccggagggagtacattgtattatccttgacttaatgaatttcactgcatcagtatttatcacaagtaaaccatttactccttttcatcaaaaggaagtggcattttctaatatgtgcagtcaacaaattttaattttacttactaatatgtacttcctccgtttcgaaatatgtttatttttcaatcatcacacacatactaatataaaataaaaaaactataatcctcattctttatcaaatcccaatgcaactattattcgttttatttactctcaatacaagtatgtcctactttcacaaactccgatgtaatgattactttaaaaataaatttattttggaacagataaaataagctaaaaataaacttattatgggacatacggagtatttgaacatttcgaatcaacttttaaaaattggtctatttagatttatcgttaaatataattattataacttcacaacattccccatatactcatggtcagtagtaattcataatcaatctaatgcactacttcctccaactcagtctcaaaataagagtgcaaattaacaaaaataaaaaaatgcttaaaataatatcgatattgtttttatgtttcaaacatcgattatttatgacagaaggtgaaaccacgtacactactatcatggtcaagggagcggggtgcatgcagtcataaaaatctttactcgttcgcgggtggtgacgtaaggatattttctgtgacggtgacacggccggggtagcgtgtggtttggatggacagggaggacggaggaatcgagcaaagccgatacgaatcgaagctgtcacgtgtggaattgaccatccgatctcatctcagaccaccatgcacgtaacacgccatgcaagaaactttctttcttattgaccccccataggctggcctctacctgagactgacagtgggacccgcatgggaatatatatatatatatatatatatatatatatatatatatatatatatatatatatatatatcactggtagtttttttttttgctgggaatatatcactggtagtttgacggttaaaaacgggcattggactatttggggagttgtggtcggcagctctcgactggtcgaccggttattggtcggctgttaatttggaccctctcgtttggctagacatcgtcttcgaggcctggaaattttgtttgagctctgcttctcctgtagattaattcatggaaggtatatatgtgtcaatattgtgaattttgcaacagaccaatcatgtatagcaagagttcaagaccaatcatatataaggctatgttctttggtaactcattatggaatgattaatcaagtattacctaattttctctgaaaatatattaatatgttttttttaaaaaacaacttttgtatatatttttttttgcaaaaaaagatatcatttagtagtttgaaaacatgcgaaaaaaacaagatagttagattggtgagttgggaaagtgacccaaagaactcaggctaagtgtcgtccacttcctttctgtggtgttgttttgagcagggtagcaatgaaatgagctcaaataacgtgtcacgtaacagtataccagccaaatgttaaagcaggactgtcaaaataaagcagttaccattttttattactaaaatttccttttggactatccttatcttataatttcactttggcaatgataattttaccattgttatattttggatcattctaaactttcttacatgcataggtaggggagttctttggcgtgtagaagtcgatgtgctcaaggctattgatgtgttaaagaagagttgggtggcttaaagttaaacaatgataaaagaagaaaacatatcggcgccggtcatgaatttaggcatcttaccagttctatcgtacttattccactaagtgctcattttgttttaatattagtagtcctatatattattggtatcatattgataaaattgttacgtatatgtagaaagtgatggcaaaaatagattggtgacaatgtgattttttaaaattagaattccattgcaatgcacgggcaatatactagtatactcatatatatgcatgctaatttaaccattataatattaatgtaaatattgccaagagcaccatccatcgaaaaagatcacgatttatctgcttcagaatatgtagaaacgcattgacatgtacggaatattagcaagttttattttagtgtaaaaggaaaagaaaacaaggacgctgcagggaccaggagaaaaaaacgaaacaaataactcagatgatagacggcccatctgacgggtctatggacctatggttgggctggcgacccaactcacaaggacgtcacttgcaacacatcaaaccgacatattttaaagggaaaaactgtcgccactttattagcgttttcgaaagaaacacgcacaatttgatctccgagtccgtcacgactcacgacgcagattcacaatcggattcgggacagaggcgccgcctatttacgtgcagacgcggccgcgggcacacgggaacatcaccatatcgcaactctcgaggcaacaaacgcaccagacacgatcgactccatcatcatggagcacacgagcagcacgtccgcgcacgccggcgagcggccaccggcgccggcgccgttcggccctctgccggtgctcgtctacgaccacggcctcgacccggtcagccgccgccacaccgtggtccgcatcgccgccgccggcggcggcgccggcaacaccatcgccctggagacgacgcacgtcgtcgtgccggagctgacgagcaacgactaccacgtgacgccgcacggttgggtgttcctcagcgagccggcggccgccgggaccacgcggcggactcgcctgtggaacccaaccaccggcgagagcgtcgagctgcctcgcatggagcagctgctcccggcgaactggaagtgctacctctccgacgaccccaccgccgcgtcgtgcgtcgtgctcgtgctggccatgtcggagcccagcctcctctactgccacgtcggcgccaccgccggcggtgggtgggtcgcccacgactacgacatcggcgacgtcggcctgccgccttcctacgcgccgccgcggcgacagttcatctcccagatcgccgccgtgaacggcaggttctacttcgcggacaccggcaagcttggcgtcctcgagttcaccccatcgccggagttcagctacctcgactacccgcacatcgagttccccgaggggtccaacttcgccaagtcattcctggtggcgtcccacggcgagctgttcgacgtgtacgtcttcttcaaggggttcacgccggagatcctcgccgtgcgcgtgtgcgccatcgacctcggcggcgccggcgacgagcggccggcgttccgcgaggtgggcgacctcggcgaccgcgcgctcctcctcggcgacgccaacgcggcgctcttgtgctcggcgagcgcgcacggggtgaagggcaaccgcgtctacttcatgcacaacatattggaggagccggacggtgggccgctgcgcgtctacgacctcggcgacggaagcatggagaccgtgcggccgtgccctggtgtctcggagctcatgtgcaaaccgttctgggtgatgccctccgcaccatgatgtgtcatagatttcagcgaaaccatcttccaaaaccgtcgagagaataaaattgcaccagttttaatagtttgcgggtcgatatattctccagtttagggatcgaatcagattcggctagtagtcaagggagtcacagtggacttattcctaaatacgtggaggccgcgttctcccgaatactaatcgaattaacgcatgggcctagcccaatctttaggtcaacgtgccagttgggccggcccaaccgatggtcggagccaatagaagctagcagcctagcacattgaccattgagcatcgatcgactcataagccacctatactttttttttaatctttacacatgagctatgatcgttatgtttgtctaaattcaaacagctatagtgtcaaagttagtggtcaacttctaagtttttatggaactagcataacaacgatgcaagatggtacgaaagtcggtttactgatataacgatggtatggaagttggtttactaacataatgatggcataaaaagttgatttactagcacaaagagtatcaaaaaagaactccttttcactatagttgaagtttgtacaggaggtttacaactacaacattgccatcagattgcttgctagcttgacatttccccaatgaattcaacctttttgtctgatgtgtaaaacttcttaactacatcattcatacttggtctttggttcctttctttctccaaacacgacgtagccacctccagcatcaacgccacctgtgagtaaacgaagctaccattcaacctacgatccaccaagctgattacccatgtccgatcaccaatcttcaacccttccctgatcttccacaccaactgtctcatcgcaatctccgcatcaccaacgctatccgtggccaaatccgccattctggcccctctaaccagctccagaagcacgacaccgtagctgtacacgtcaaccttttcggttatcggaagactcgaaacccattccggagccatgtaccctctggtccctctgatgctaaacgaggcgggatcatcgagatccctcctctgttgcatcttcgcgagcccgaaatcgctgatcttgggctcgaaatcctcgtcgagaagtatgttctctggcttaacgtcgcagtggatgatccagtcgaggcactcatggtggagataggccaaacctttggccacaccaacggcaatgttgtacctttggttccaattgagagtctccttggcgccaaacagccacgtggcgagcgacccgttgtccacgtactcgtacacaagcagccgccgccggcggtggcgctccgagcagacgccgcggattctcaccaggttcatgtggttgatccggccgatgacgctcacctcggtctcgaactcgtcgtccccacgctgcggcgtcgcggccttgagcttcttgacggccacggcgcggtcgtcgccggcgccggcgaggacgcccctgtacacggagccgtaccggccatgaccgatcacgtccttgaagttcttggttgccttcctgagctcgccgtaggtgaaccgccggaaatggtcggtgaccaccctgtacccttcctccgccgcccattgctccgacgtcgccggccggctcctcgccgtgaaccaccacccgaaggcgatgaagcagagctccacggcgaagaacgccgagaggaacccgtagtagtagcgccacgacgacgtgtccggggaggcggccgagaaggagaggagaacctcctctgttcgcgcggcgtcgcaggcgagattaacggcggcggcggcggccggggcggcggtgtaggtgtctgactccgccaccaagttcgccggaagcttgaggtacaccgtgccggggtagccggggtaggtcttgccgttgaagagcgccgacttgaggtagcagtcgctgacgtcatccttgtactcgaacgccacgcagttgcagagctcgaggcacgccgccttgcatccgtcgacggagatggaggagaagaggttgaggtcggagccccagaagtctgtttgcggcagccgcgcgaagcccatctccggccggccaccgccgccgccgcaggtgaggttgaacgtcggccggcagcccttgccgcggtcgccggcgtcggcgggaacgtagcctggagggcacgagcatgccggccgcggcgtgtacacgcagaggccgttccagccgcagaggccatggatgccgcacggctgggagaaggccatccaagaaaccgaccaccccccgtcggcgtcgcgcaggctgtacagccggaggttgccgtcgtggtccagcgtcagccgccgccacgtgacgccgccggcggcggcgcccgtgtcggacgcgacgaacgtggtgttgtcgctggcgaggaacctgccggcgtcgtcgagcacgccccggcggctggcgttgtaggagatcctgccgttggcccagctgctggcgtcggggtccggccagtagatgttggagatgtccgggccgtcgtacgccagcgagaggaggtagcggtcgtcgaaccggagcgcgtagtggctcgtcgggtggagcacgtccgtcgtggacagcctcgccgtcgccgtcaccggctgccccggcagcagcgtgtcggtcgggtagtcgaagctctgccacaacacgtccccgccatggcttgtcacgacgaggttgccggagtccgtcagctccgcggcggcggcggcgccggagctcgagttggtctgccacaccggcgtgccgtcgtagtcggcgagcacgaggcggccgtctcgccgcagcgtgagcttcgaccccgcgccgtgcaccggccggtcgcggttggccgtccaggcgacggtccggccggcggaggcggcgaaccagatggagacggtgaagacggtggaggagaggttgtagaagccgaacgcgaagacgccattggaggacacgaggatgtcggaggcgcgttccacggagagcgattcacctctttgaaggcggctgccgccatgagccggagaaagaagaagaagagcagagaacaagaacgcgaggagcatgatcaatggaggattgtccgccatggctggcatcaatcctgcaccaccgaagctaatagctgcagctgctgtaaactaaggtgaaatctcgcatctcagttagttatgaattctaacaacccaaggacccaaaattgcagtactaattaggagtatgtcattgtgtcagcgctaatgaccattgcttggtgttaattgtgtcaactcggcggcaattgaacaatggataggtagctttagagaactgacttgttaagaaactactaaagaacacgtttttcaaaaatgaaaaaattatccatatgcgtcgttttttcccagctgtcagttgagaacctgagatcacccgtgttatccagggagaattttcacttacctactcaataagaactctttgtttgactttttattttgcagagctcattgtttgacttgacagccatgctacgctgatgactagtattaaactagtaggaattgctgtgcaaacaattttcggtatagaagattctttgctaaaccgtagttttagcgtccggtattatgaatgtgtaaaacaagaactcatggagctttcttgacctcttgacgagaacagtactgtagaattccgttcatcaaacaaatatgaaggatggagcacagctgaagagatcttggacgaaggactaatttggacgagtcagaggaaaatagcatatttgatatctcaagtgaagactgaaaccaaaatctgtaacacctacacatctgttcattgcatgagaacataattacaggtttttcctccaagaactgcagccgactgtcatgttacatacaagatcgaagaatcaaatgaatgaacaaatgacccacacacaacaatgttggcagttagcttgatccctcgctgaagttttttcagctcttcatattctacaaaactgaatacaagtttgtgttgatgcctttcatgtgtcttctctcttcatgtaatgtattgtctaccctacgcacgtacagtagtactgcatagtgcagaagctgttttggggcttctgcacctcaattctgcatccctcttatggtagcctcgatgcggaaggttgatgagagaattctaaatagcccatcagggttatctgcatgaacctgaaaggagataagaccacaattaaatcttatttattgtcagtaaatctgtattatatgcaacatcataattagcacaggtatgtcagatggttatgaccctgacccatgagcacatggttaatataagggtatctaatctaagctgtagtaaagaatactactttttcatcacagtactatcttatggagaatgctgccagaagatctaggagtaattacaaggatatagtaagcatacccaatgtccagcatcttcaagcacgtgcatttcaactcctccaccctcatctgcagccagttcctcagcagtatgaattctctggagatcatcaagagcccatctatgcaaacttctttcagctttaaggaaattaatatgaacaccccttggtacattctctacaatccccctgaacggcacatccaaatagtttatagcttaatagacaatacatgttgcaggtctagatgattacaaaaaggaatcatgaaggatttaccataagttagtctcttcataggacttgtacatgtcagatatgccatttaggtcaaaaatccatgagaagcttgaagacgatagtgaccctaatggactgcttcgtcggagatttgtagccacccactgaaacaaagaatcagttatgcattgaaatgccttttgtttcatggcagatgaaaaatcaagtgacgtttttatgccagtcaaatcaagtaagcttggcagggtgccttgacatcaggggagtattcaagcatacccgtgcaacatccacagaaaattgttctttgactagagcatccaccacttcttgctttgaagaaacctgggtttaaagttcagaaaacagaaagcatatggtgaaacatatagcatccacttctgcagactcaattttgcagtcatataggtgtacatataacgctaaaaggccaacctgcataggcattcttctgagggactcaataagttcagcagggtgatcttcgccatctcccccagcacgaaccttgccaggagtagcatcaagaacccatacctttaggggacacaatatacagaataaacttagacaaaagattagaaatatcacccataattgtcacactaaaaccattcagaaaagtactcatgattaccctgacaggacgtgcaagcggttttgcagcttgttctaccatgctcagagccactgcaaagaaaatccgtgaggactgggatgctcgtggattatttacaatctaaatcataccataaatgtatggtaaggggagacaaaggaaacaggaaaaccttttccaccaaagctgtgaccaaccagcacccgtggggttagcctgagctgcactatctgttgcattttggattaattagcataaggtgacagataaatgggaaaaaggctgaggtgaactgaaagctactaagatataaaataacaagaaatgaaagcccagtcccaggaaaaccttttggacaatgacatggcctccaaaatatatctttgactatgtttttctgttataatatgtacaataaataaaaacatttttacttttattatagtatcttgtaagacaaatatatatatattgtttagtgcctttaaactaaatattttaaaagttattgataatcaaagttacaaacgtttgacctaaaccttgtcctactaaggctgtgttctaaactcccatttcccaacttctatctcctcattttttgcgtgcacgctatccaaactgttaaacattatgttttttgtaaaaagtttctataggaaagttactttaaaaaaaatcatattaattcatttttaaagtttgttttagctaatatttaattaatcatgcgctaatctgccgtttcgttggaaaccttcactcacaaactcagcctaagctaactgacatgtgcatggcggcaaaaaaggtatgcaaagttctcaagcattttgagttctaaccattctctcaatgcaacaaaggcatataacacaactacccaagcacatgcatatatattttgtgattccatatattgatatttgatatcagtgccacagacatatttaactcagtgtgtagataatagaagctaagacagaaatagcagtaagacgaaaacacaaaccagctttagaacatcaagagcagttgaggcaacagtatgcggtcctcttttcttaattgacgctgaatctccatggcaacgcaaatcaaccaagaggaactgcatgaggaaaaggcaggtacagtttctttctttatgctgtgaaataagtcagattgcgagcagaattttagataaagtaacctgccacatcggaaattcctgagccagcctctttgcaaaagatccttcaaatcaacacagttaattaattttgtgattaaatgcatttatacagccaaaacagctttaaaatgtgtcagtatttcactctgcaaactgaacacaacaacaaacccaatacaccaggaaacaaagtatgcaataggaaagcaagcacttctcaattaccccagtttttcctgctcccaaggatgccatgaaggagaacagctgttggtggatcaggtactgatttgtccataaatgagttccattgcacctgaggtgaagtgatggctatgaatagcttgtcttacaccataacatttgaccatttaacttctagctaacattatttaacaactagtgacatgtcactgagttcgtatgaatgcaatacgtacaaggctcccttgaaccagctcataggcctgcagggaatgaacagaaacgatttgtcagcaaggaatgaagtttgtatacttctgaagcttcaatcttccttaccaaaactccactatgcttctgaacatcaggctgataagcaatccttgtgttggccaatgccatctgaacacaacggcatggagggcacagcaatggccttgatttgatattagtcgatatcaactggccacgacgaacattttcctaaagccaaaaaagcaaaatacacaatcatgatcagaagctcacaaatgcatcagcagctgtagcaaaaattcataactcaagaaggcaggccagtatccttgcagcaaggttctcaacactgtaaataattcggtaggaatttagagcactaagttagccaccagacacacttcctattgcactacacattatatataagaggacttttacggtacattctactgctagtatatactaccagtatatttgatctaatggtgtaaattcatctgatcttcctcccaaatatcctgcagtataaattgtttagggtatatttgtctttttatctatttatgtgtgtgtgtgtgtgggggggggggggtttaattttttaaattcacgtttcctcacttggtcagatccgatcgatagccgcctacccagtcgaagccctttttttttctcgatgctgcgcgcatgggcgatcgtcgccgctaatttcttctgcaagctgccgacgaccacaatcggcgccgtcgttctttcttaattaagttcaatgaattaaggacttggtatgtgttagggattcagacacttagaaactgatcgaaccaagaaatgtatgagataatccacttcattgctgtgaacagatcaaatctatttacactatcatgtggttttatccctgaccagttttttccctagtgttcttacgcaaatcatgcccattgcaaactcaatctactagattaaatccgaccgtcgaaggaatcgctacgcctccactcgcgccgtcgccacgcgcgatgggagcgctacaacgcccggacgacgagatcgaagaactcccgattgaattaaatcgcaagaaataaatctcaatttcaaattactaaacagcccttttcatagttttaacaaataccaaatctaccttttcacatactgctagtatatacttgtggtagaatgtactgtaaaagtcctctatatataattaccaaagcattattgctcacacctacactaataacagatcacgacctaaaaagagtcttaaaaacacataaccggtgacaattagaccctttagttacctaacaatgtttccctgtgcatcctactccaaatgataggtttatatatcagggaaatttgtatgagcacgacaacataacgacaaacacaatccacggtgtgaactaaacaaagactaagggttttcaaacacgcaagaaatgtgtactacaaaaggtgcacttaatagtaataatgcatttctgcttctgccctgcttgcatctgcattacgctgatcacccggtcgccacccgcctaccactttaccaaaaattgcacccaaaagcctagcgattaagctccaatcaatcaacaacagacgaaaacacccacaaccccacaacgcattatctcctaacaacagtccattactacgaatctgacgagcaagccaattcgatcaccgaaagcaaaggggaaataatgggtgaggggtacctggcgagcgcgcgaggcggcgcgaaccctactccccggtgacagccgccacggggggactcccacggcgaccggatccctcctcctcggctccgcggagaggacgcgcggcgccgccgacgccgccgccgccatcagatcaccgacgcagcgagagcggagacgagcgaactcggcgtggcgttgtccgtatgcgcgtgccgtgtcagcgaaatggagaaaaacggaaaggaaaaaaaatcgaatttattttcgtggtggggaagtcggagacggaacagcggaggcggagaacccgaagagcgtgacgctgacgcgtgggggccacccgtgacatgtggcgtgccgcagccgggttctgacctgtgggacccgtttccgtaccaggcggtccagcgtggcggcggtgtgtggccaggccggtgggcgggtaggcggggggacccgacttgtctgtaggtttggtgggccttgggctgggctgggctggccccacaacaaacgagcgcagttacatgggcctccagcataggcccggcataaaaaatatatttcacccctcccctacgcgaggtttaattatccccccacaacctaggttttctttgtgttgggtttacagcatctgcggcgagatggagaaggaggtagaggaggaggaggaggaggaggaggcggaggcgagtagaaagaagggagaa

SEQ ID NO: 71189 - DNA, 678 bp, Oryza sativa
atttaagaggtaaacactgtactaccagttgaactgattagaaaatatttaataaatgtgtagtcgagtggtaatgtaaagggtaggtgaagtaaagcatacccttggattccacttccccacgtacccaagttactggactatcaataatgagggcattatggctaccgacatctaaaaatgacatgcattaatttggcaaacagaaaatttaaacctgttttttttttctcaaaagtgttttggtttggtaatgtacgtctcctgaacaattgagatttgagagtcggtggttaaaactaaaccgtgagataaaccaaccggtgctttaattaattttgcacccccaatataagcaacaacgaactcctacgtggcggatggtcgagacggtcatggcgagcctctaactccccaccaactgccgcctctcgtcgcctcgcctcgccggcgccacctccgcattccgttccgaccagccgatcggtttcttcctcgccgttgcaaccttcgagcgcgatcgatcgaggcggttgaccgccgattcgccgcgcggcgttgcattgcacgcggctttccagttgataaatcaatcatcatccccttgatcgatgcgagtggcgttcttgttcgatcgagaggaggagatcgtgatcgcgagcgatccgggcggggcgg

SEQ ID NO: 71190 - DNA, 627 bp, Oryza sativa
attgtaatttcggtgcccaaagatttagttatttcaagcactggtggtgtaccagcgaatactcgatccaaagctatcactttatcacaagacgatagttcactctagaatgagcaggaaactgactatatatagattccattacaaagctcagtgcctcagttctgtaatatacaattgattcgtccatccaattacttgggtgaaccatcggaacaactacccgacgttcacctctagtcgtaatctgattcctcggacaattcaccgctttcctgcattgaaaataaggtaagtatgattttttgcatggaaaaattgaatagacacgaaaaaaacacgtgcaatatatatgcagaaaatacacctttttcttgtcaaattcagccaccgccttctcatactctgcacgcttctcgggtgctatatcataatacttcactctttcctggggtaatgaacaaaagtgaaattgttgacataagtatgatatgagtttatgtctaaaatgcaatgcgcaaaaatgtgaaatgaagctggacatatctgatatgagatattgtattggctaaaccatttattttgacaatgaagtaaaatttctacatagtccactgtgtactaaac

SEQ ID NO: 71191 - DNA, 1739 bp, Oryza sativa
acacttatcttctcctcttcgccgctacttgcacctccccaccacatatctgctgctcttcgccttcccgtcagcaagaacagctttcacaagctcttcagcctccctccccaggtaacaactgcagcttattatcttcagtaatctccatatgttcattcctatccctcctctccctatacagaagtgggtcagatccaaacatctgtaatagaacaatataggaaagtattagagcaaacaaactaaacatttttttgatctctgcaatgggcacgcgttaaccaacaggtcttctatttctttcctagaacactatggaggcccatcaagataaccaccctagccagagacaaccacgaccattgtcctatggcagtagccgtccactgttagcgacaaaattttcaagccgcggagaaatttcacagctatttgccgatgtcatttaccaggacgctgtggttgtcaccgttcttggagctggcaatccaaacacaacgaaaatatcagctatgataggcttcgtgtgtgactgccagattgatgattttgccttactgccgttcaggcacaaaatgtacattgtgctattcatggactcagacaagcaatatgagagatctcaaaaggcgtttgcccagaaatcctacacattccaaacaactcagctgcattttgagcctttcaagatgaacctttcaagatgaaccttcatagtgtcccaaacccactgcgccaaagagtcatacttgcactcgaaggaataccaccagaattatggaacaagcaggccatgaaagaattactagacggtagttgtatggttgaagagctttatgaagagcatcatatacaaaacctgtcgattttcagattgtctgcatggacaactgaccgcaatctcatccccaaactaatggattggaatattgaggaggttcaaggagaggaacaatcatctgaccaaggctggaaacgcaatgcagatttatttgtcatattaattcacattgaaaagctttttgactacactgatgaagacagcgacaatgagatcgatggagaagttttaaagcaatatgagaaagacaaccgtcgactgccagttataaagacattccagtgggtatctcggcaaacagacacagatagcggacctgttgaaggcgggtcgccggcaaggccaccacggcgtcttcctcttgaatttcgtaggcgccacccatatcatccagctccatagcagaatagttccttctatatatgttctcaccaaccacatagccaaaccacttatgctatagatctcctatgtgatctttttttggctactccattagagtcatacgtaattctcctggttcgaatatacaattccatcgcatgcactatgtaacatatcattttacgtctgttctcgcgacactctattttgctttcaactgatcttcaatgtttgcttacactcttccaaacttaacattactcttcactgccattacggcgcggcaaggcacgccaaacgtcctagtataatgcataagcagtggcgaatctaggataaaagttgagagggtgctccatgtaagccagtttaagctaagttaaatactatcttgtcccaacttttactctctcgttccgcgcacaaccgtgcatgttccccaaattgtaaatgatgcgtttttttaaaaaaaatctatagaaaatttggggtaccgagctcgaattcgccc

SEQ ID NO: 71192 - DNA, 684 bp, Oryza sativa
tatgtcatactaacatgctccaacatgtgaactgacaataatgtgtgcataggttcagagcaataacatggttaagtgggaaatacctcgattccaacacaaataggcagttgcgggtgcttgtcacctttcccttcagaactcttcttgtcatccagatacatggaatagccgatacatccatatctgaagtcggaaaggttgcgaccttcctggatagcttccatctcaatttctccaaccatgtgatcagggactgatgcagaaacatagaacagtcagccaatgccaaccattgcgaccgaagaaaacaattcagattgagcatttaaacaatccataaaaattaggccaacagttaagtactccattaaatgacagcaaattcagagtaaatgacaacaaaacatttcaaaccaagcaaggagttacggcgcagtgcgatggcatgtaacactgtccagatctgcagttctgctgctattaggcattagcagtggcagtggcatgctaactagcaacaagtcaggatgaatacaaatatcgatcgtgcgttgtggtgtgtggtaaggatcatggttacttccaaaagttacagttgctactatgaccgcgccaatccagcagttgcgattgaacatctacgttccccattgttcctgcgtgcgtgcgtgcgtgtttgca

SEQ ID NO: 71193 - DNA, 2558 bp, Oryza sativa
agtaccatcagggtcacagcttgacaccctcaatgaccagcatccatatgatggcaatgatggtctctgtgggcctcctctcgaaaatagctgttcaagcagcagtgcctcaaagcaacgccatctgataagaagcaagcaaagtttgggcatggggccattctcccttggagttgtactgggattcatagcaggtctctgggtggttttctgtacccttctgttcaagaagtcgtggagggttgcctacttctgcctcttagacaacatgtataacaatgtttgtgtgattgtggttgttcaatggggaagattgccaggaagaacatgagcaagattgtggatgtcgcaggttggtacattgatttgaccagccctattgataaatgaagaaagaagcaggcctgcagcacaattagttgggttgtgtattttatatgttttctacgcaaaaggtggagagactaccttataacaataatattgactagaaagaatacatatgcaatgcatggatattttatttattatttatgagaggtaattgtgttcttacctctattttatactccggttgtgattttgcctttttttttttttagcgttcgtgtttttacctttactttttttctaatgaagcttcacttttcccctattttgttaagatcagttaatggtgtcaattcagccataaaaagacatgtatcccttttacatttgcccaactttttttaggctgtgtttagttccatcggcaaaaaaatttgctgggtcacattagatatacggacacatatttgaagtattaaatgtagactaatacaaaacaaattatataatccgcatgtaaactgcgagacgaatttattaagcctaattaatccgtcattagtaaatgtttactgtagcactacattgttagatcatggtgcaattaggtttaaaagatttgtctcgtaatttacacacaaactgtgtaattagttttttcaatatttaatacttcgtacatgtatttaaacgtttgatgtgacgggacaaaaaaaaatttgccggtgggtctaaatccaccaccccccctcctcttagagttgatatacattttcacacaacttgcacggctgcaaaacttgactaaaaagattcatgacaaatttctcgcaaatattgagataggaaaagagagagagaaaatcaggtagcaacggcatctcgctggtctttgtgaacgggaaactatttagctcgagtggatgtccacccgtttattgcatgtcatctaaatggttatgaaaaaaattgaaaaaatatgaataagatagatcaatataaatatatcaatccacaaacatgtaagttaaaatttaacttctcaagttgtaacaaaaataacaaacaaaactcaaattactatatatatatttacaattaaatttgttatttttgttacaatctgtagaagttgaatttgaacttgcatgtttgtggagtgatatattacatattgatctatcttgttaatttttttgaaaatttttcataaccatctagttgacatgaaataaacggatggacgtccactcgagttattagaatcctctcccgtttgtgaacgagtcgctcgccatgtgccattgttgttggccggctagctagcttgccgcgccatgctgctgcgatcgctgcttgccgccgctgaggggcatcgatcctatcgtcgttgacgcacaagaggggagagagcaaaccctgttgcagcgtagccgaggtgccctgcccaccttccccttccgcaccgtaccatcgtcggagcccgtacgctgccccgccggagctgccaccttccgtacgtgcgctgcgccagagttgctgccccttgatcgagccgccgccttcccgttcccgtggtgctgcgacagactcgccgctggctcgccgctgcctgctcgagtgctgcacgggcggatctatagtacgtactaggaccggtgtcaggcgacaccgacgactctcggtaaaaaggtatagcaaaactgcttattcatatgttataacatcatgatctaagcataattagtatactatgacaccgttagacacgttatgacaccaacgaatcgattttctggatccgccacagtgcacgggattgggatgggaacggccgacggacgctgtgtgttgggctagctaggtggggttgggagttgggactaggtaggttatttttgccaggggtacaatagttcttttgcattttgtaactcttcttctttttctttcgagataatccattatatgccattaactttatcgcacgtctacgatttgccactgactttgtcacgttctacaatatgccatcgacttttgcttaacttctacgatttaccatcgccgtccggttaaccacctttagtactgtacaaatttgttgaaatgaccaaaatacccctatgacaaaaatatccaaaatttggataaaattatcaaaatattatattataaacataggattgtaaacatccaagatttgaccaaaaacttgaaatatgata

SEQ ID NO: 71194 - DNA, 815 bp, Oryza sativa
cctctcccattccaaacaggtggatgcaggcgacggagacagaggtggcagcaccggagcaactcacgagcaggatgtgacggtggcagcgctcgccggcgtgagcagcggctgctcggtagagagcaggtggtggctcagcgacgctgtagcaggggaaggggtggcttagcttggctcagcaacgctgtagcttgctgcgaacatcgttcagagtaggagcagcaacaaggacacacgacaagcaagctcatccacgaggccaatgcaagggatgctgcctcctgattttctttttttttccccatctcatagttgagagtatatatttgggagaattttgtttggtaaatattttttttcctgtgaatgcgatgaatccttggtgaattttttgcgccctgtgcaacttctgtaaaagtgatatccaaactctatcaaaatttgtcaagtttggtcaaatttgagagaaaatgtgaagggtatatatgtcttcttgcagctcatttgacactgttagttggtcttaacagagtaagggcaaattgaaacttcgtttgaaaaaagtaagggcaaaatcacaaaccctaaaaagaaggggtaaaatcacaattacaatccaaaataggggtaagaatgtaattgtccctttctttttccccttcctttttacagtttgaaatttcatattgttttgtatttgaagtaaggatgtgtaatctaaaaacggcaaatatacaaagacagtgtatgaaaaagagcactagattagaaatgtgcatcaaatcgtacagtagctctctccttttcagctt

SEQ ID NO: 71195 - DNA, 8348 bp, Oryza sativa
agggatatacaagaggaaaatgcttcggtgcccctatccttacgatgtgcctatgcgactggccggtgggccagccttggtcctaatggtaacttgatggaggacaggagagctgcccccggcatgggggcatcgctgttcccgagggaccttgctactacccgggtaaaggcatccccgggtaatagcatgctccgtctagctgccatcaatagtgtcaatgttagttggggcgcgtagtgcgcatttattcgcgcccgctagcgccttgttcttgacttggcttgcgcgagcacatcgaggcataattcactccggctagcacatcgggctttaggggcccctcggagctccgaagcccttaggtagcctccggagctccccttccggactccgggtaccctttcgggcttcggagctcggtcactaggtgtgtcaccggagcccatggcgctgcgacctcccggagctcttccggagccggtcggccgccatccgaagcctgcttaggtcttgttcctctcgccctcaatgagatccgattctctcggatctccggaggcctccggagcaggggggccagccgcggaccgacatggccttgattcacggtcatctcctggggaggatggttctcggagcgctgcagcccttcggaggctagcgtcccttgatccggagatactcccctaacaccttcttattcaaccaagctaggaccaatgaccatgacccttttggatatcaagatgaccacaggtttagatatcctcttaatcagccaaccgttttccagtctgaaaatcaagtgtgccaacaagttgcggaccaagaatgttggtggttggtcaggctacatcactttttcttatatctgtctaagtccatgagctaaaccaaaaacatctctcgctcttgctgtcttagcttgcaccgatattctctgcatctcggcacgatgatatcactcccattactgctcttcgtcctcttcttctctgcgctgctgctcttcccttcgagcagtgacgacgacggtggtggtgatgctgccggcgacgaactcgcgctgctctctttcaagtcatccctgctataccaggggggccagtcgctggcatcttggaacacgtccggccatggccagcactgcacatgggtgggtgtcgtgtgcggccgccggcacccacacagggtggtgaagctgcggctgcgctcctccaacctggccgggatcatctcgccgtcgctgggcaacctatccttcctcaggacgctgcaactcagcgacaaccacctgtccggcaagataccccaggagctcagccgtctcatcaggctccagcaactggtactgaatttcaacagcctatcgggtgagattccagctgctttgggcaatctaaccagtctctcggttcttgagctgactaacaatacactgtccggagcaatccttcatctctgggcaaactcacaggtctcactgatcttgcactggctgaaaatacgctgtctggttccatcccatcatctttcggccaattgcgcagattatctttccttagcttagcctttaacaatttaagtggagcgatcccagatcctatttggaacatctcctctctcaccatattcgaagtcatatccaacaagctaagtggtacactgcctacaaatgcattcagtaatcttcctagtctgcaggaggtatacatgtattacaaccagtttcatggtcgtatcccggcatcgataggtaatgcttccaacatctcaatatttaccattggtttaaactcttttagcggtgttgttccaccggagattggaaggatgagaaatcttcagagactagagcttccagaaactcttttggaagctaaagaaacaaatgattggaaattcatgacggcattgacaaattgctccaatcttcaagaagtggaactgggaggttgtaaatttggtggagtcctccctgattctgtttccaatctttcctcttcgcttgtatctctctccattagagataacaaaatttcagggagcttacctagagatatcggtaatctcgttaatttacaatatctttctctcgctaacaactccttgacaggatcccttccctcttccttcagcaagcttaaaaatttacgtcgtctcactgtagataacaacaagttaattggttctctcccattcaccatcggtaatcttacacaactaactaatatggaggtccaatttaatgccttcggtggtacaataccaagcacacttggaaacctgaccaagctgtttcaaataaatcttggccacaataactttatagggcaaattcccattgaaatatttagcattcccgcactctctgaaattttggatgtgtcccatcataacttggagggatcaataccaaaagaaatagggaaacttaaaaatattgtcgaattccatgctgattcgaacaaattatcgggtgagatccctagcaccattggtgaatgccaacttctgcagcatcttttcctgcaaaacaatttcttaaatggtagcatcccaatagctctgactcagttgaaaggtctggacacacttgatctctcaggtaacaatttgtcaggtcagatacctatgtccttaggggacatgcctctgctccactcgctgaacctttcgttcaacagcttccacggtgaagtgccaaccaatggtgtttttgcaaatgcttctgaaatttacatccaaggcaatgcccatatttgcggtggcatacctgaactacatcttccgacgtgttccttaaaatcaagaaagaaaaagaaacatcaaattctgctgttagtggttgttatctgtctcgtttcgacacttgccgtcttttcgttactctacatgcttctaacctgtcataagagaagaaagaaagaagtccctgcaacgacatccatgcaaggccacccaatgatcacttacaagcagctggtaaaagcaacggatggtttttcgtccagccatttgttgggttctggatcttttggctctgtttacaaaggagaatttgatagtcaagatggtgaaatcacaagtcttgttgccgtgaaggtactaaagctggaaactccaaaggcactcaagagtttcacgtccgaatgcgaaacactgcgaaatactcgacaccggaatcttgtcaagatagttacgatttgctcgagcatcgataacagagggaatgatttcaaagcaattgtgtatgacttcatgcccaatggcagtctggaagattggctacaccctgaaacaaatgatcaagcagagcaaaggcacttgactctgcatcagagagtgaccatactacttgatgttgcatgtgcattggaccatcttcacttccatggccctgaacctattgtacactgtgatattaaatcaagcaatgtgttgttagatgctgatatggtagcccatgttggagactttggacttgcaagaatacttattgagggaagctcattgatgcaacagtcaacaagttcgatgggaatcagggggacaattggttacgcagcaccaggttaatcctaaactgtttatgtctacctcctttcattgttttttttagatttgctctggtccaacaaaaaatacctaaagatacagatacttgtacctcacaatattaaatagttttcgatcattgcattgttagatctaacgatcaggaaacgatttggtaccgtgcccgtgaggtatcggaatctcaagatattttttgttcgaccgtagcaaatctatttttttgtttgttttcttctctttaatgttttatgactatgaaataatttttatttctggaaaacagagtatggtgtcgggaacactgcctcgacacatggagatatttacagttatggaattctagtgttggaaacagtaaccgggatgcggccggcagatagtacattcagaactggattgagcctccgtcagtacgttgaaccgggtctacatggtagactgatggatgttgttgacaggaagcttggtttggattccgagaaatggcttcaggctcgagatgtttcgccatgcagcagtattactgaatgccttgtttcactgcttagacttgggctgtcttgctctcaggaattgccatcgagtagaacgcaagccggagatgtcatcaatgaactgcgtgccatcaaagagtctctctcgatgtcatccgacatgtgaagatgtgagacatgctgatgttatgtccgagtatttcgttgtaatctaatgtgaaaggtgagtgtgtgactgcttggttgtaagctatttcctgatctgcccatcagatcatgtatctggtctattgttgtatttctcaaaacaaccacacacctaagtaggagtacacaatagtgtatttgcgtaatttcaatattgatgcatacccatgctatgtgctaaaattatatactgaaattttgagatgtctgaagttaacagtcaatcggggagcgattcacaccataccgggaaatcgacctaatcagctaatctaattctacaggctgcctttgcatgacagtgtgatattaaattagcccagccctttttagcaaacgatgggagggtcaatgctctagagaaatggatgctgttaggttctctcctctctcgattctcagaagaacacaagaacacaaggatagattatggaaccaattgatttccaccgtcgccaccaggttccaactcacgcctagactttcttctcggtacagaacgggccaagcccaagacattacacggtgaattttttttatttatacattttcttattaaagtatttacaaaaataattttttgtttcgaaaatttacaaatataatcgcttgccgccctttgggagggcgatttttaaaaatcgcccttctacagggcggcaggcgattagatttgtaaattttcgaaaaaaaaaattatttttgtaaatattttaataaaaatatgtataaataataaaaattcagtatttaatgttgcttttactaatgcgcttctcccttgccttggcgtaatctggaactccgccttcgatctgtagcccgtcttcttccttgccgagttgtcgtccttgaggttctcagtctcagcacccagcaccctaaacagatgcctttggttaggaaacgtgggtggcagcaacctttccaagttggaatatctcgaaatctcctacacagatttattttgctaggtgaaagcaccgggtggatggcttcaccggggccttctttaaagcttgctgggatatcatcaaaggggacatcctcctggtcttcaactccatctatgacctcagatgtacgcacctgaacctaatcaactcagcaaacatcgtcctaatccccaaaaaggatggggccgacggcgtctcagactacaggccaattagcttaattcacagtattgccaagatcttctccaagctgcttgctttacgactgaggtcccatatgcacgccttgatcccggtcaaccaaagtgctttcattaaaggaagaagcattcatgacaacttccttttcgtcagaaacatgaccagacgttttcaccgactgagacgagcaatgttgcttttcaaattggacataacaaaggctttcgattcggtgcgatgggattatcttatggccttactgcagcacaggggcttcccaaccaggtggataggctggctggcggccctactctccacttccacctctcaagtcctcctcaatggctcaccagggcggcggatcaaacatggaagaggacttcggcaaggggaccccctctcgccgctcctcttcatcttggcaatcgactctctgcagcgcatcctctccaaggcaacagagctgggcgcaatttcaaagttgcgaggaagaacgactcggttgcggacctcgatgtatgcggacgatgctgtcatcttcattaatcccacccgagacgatgtcacggcctttgcggacatcctacaccgtttcggtactgctactgggctcgttaccaacctccagaaatcccaagttgcggcaatcagatgtgataactgtcacgcccagaaattcccgaatagaattctaagcagaatgtgcattaaaaccgccgtccaggaccggccggggtacacaaacgacaatgttgacatacagatccacgtcttacaaacattataaaagtcttacataaatgcagcggaaaacgaaaaataacaggagctaagccttgacttgaactgcagcgggaacaccactccacatgcatcctcgacggcacggacgaagcctactcctcggagaacccgccatcggacacatactcatactctggggttgggggaaaaatagagcaagactgagtactatccactgtactcagcaggtcataccggaatagtggtatgatgcagggatttaacaagggagagctaaacaggttcatttgcacaatactggcatttataaacagaagtcgtatgcgaaaatagttgtaataattaagcagtattaatcatccactgtccaacgttccaccacgttgcaacaggcccaaccatccacctataccatccaatttcattagactaaactaagatgagtctaatcacggtgagtctggttgaccgcccataaccgcgggcacggttattcgaatagttttactatgataagaggtgtacaactgtacccacaagacatagccccacgacacgtttccgtgtgctgacatgccaccatgacataccggaaagaggccgtgacaggacccttcgcataaccccctctagccaagcacaccacacctcaggtttcacccccgtccccagcgggcgacgggcagtcccctctcgtgcctaggtggatccgaaagcgacagaggccgtcgcagggcccgtcccgctccatcatgcccacccttgcctggatgcgtcagctagaggaaagctacactacaagcccagccgttgcccacgctggcttgtggtaagtacgaggaattcttccagggtttcctgcgaaccggtccttaattgccatgggtgcgactagcaaaaccatgcacccacagcccgccatgtgattcattttaattaaccaacaccagagcggtggtactaatccaacattatcatacaaacctacagtctatgttttaaatgagatttccccattgtgtgctagttgaactaagcatggctaagcaattcctagtccaaaaactattcatgttataaccccagctaacaaaggagcatggtatcaaaatagcatggttgtaacaataggtaatcatcccatagtattattgcaaaacaaatgcagtatttgaaagaaaaacattaggacatttgcaatataggattaacatggtcaagtgacaagcatgacttgccttgctttgctgctggaggaacctcggcgactatctcgaagtacaccggagcgtcggaaaagccggaatctaacgacatacaaggcaaacaatgcaaacaggctataagactactgaaacagggaacaaaaccatttttaatggattctacgcatttttcttgatttactgagacttgaatgggcttaaacggagctcggatgaattagttataaattttagaagattcactgtgtttttactataaacagaaaaatccttaattgaattattgcgcaataattaaatcccgacgagagagagggcggcgccgacatgcgggccccacctgacagtgactcgggagggcggtccacggcggaccgagtccacggaccggggaaaaccggcgcaccacgtggcgcacacgtggcaccgacgtggtgcacacgcggcgcacacgcggcggccacgcggcagccgaaccgacggccccgatctacccttgggtaggctcgcgccggcgcgcgcgggcatggcttaagccggcccggcggccatggcgcgcagcggcgcggcgcgcatgcggcggcagcgcgagacgacgaccggcgacgaccggccggcggcggagagcagcggctaagcggcagctagcggcgcgggagagagagagagggaggggaagggggcctcaccgacgacgaccgacgacggcgagcgacggagggcggcggcgttagcgggacgatctccgggaccacctaataaaccgaaaggaaggttagagggggagaggcgaaagggggagggcgaggacgccggccgaaggcggcggccacggccgaactcaccggcgcacggtgtggagtgggtttcggcggcggaaatcgacggagaaggggtggacggggtagcccttggcc

SEQ ID NO: 71196 - DNA, 1503 bp, Oryza sativa
atgagaggatttgtttgagtttttcttgaatttttgatgatttgtggatgttgttgatttgtgaatatgtatgagaatgtttatgtgaataaatttgtgatgatgtgttgtgaatgaatttgtgatgatctgtatgaatgaatttgtgatgttgtggatgaatttgtgatatgtgttgtgaatcaatatgaatggagaaaaaaagggaaaaatcaaaggaggaaaaaaaagaaaaaaaaacatagatggttgtatctttagttccggttggtgactaaagatgcatctttactcccgggtatttcaaccgggactaaagatagcaatctttagtcccggattcatagtcccggtttgctacctaggattatagggggttataaaccgggactaaaaagggttagtgcaccagtgccattttatttctcccgctcaccacgaatctcaaaggacattggatggtcctaaataaacgggttattttaatgaaaccgatcatttaaaagataccaatcaacacgcatctcaaagccacatcagatatcttaaacatttttttagcaatatcgaatatttttaaaacacccaaatatattaactatcagattttattttggatggggataaaattattgtgtttgttttagcaaaaccaatcaatgaaaaaagtacgaaaatgctcattatcaagcgaccaacacaaggcgaaccgaccactcatttcctcatcctctctctctcttcttcttctctcttcgctctctctctctctcgcgcgcgcgcatccgtatttggcactcgcatctggtggcgccaccgcccttcttcctatccttcctctgcgtcattgccaaatcaccgcatctggcgccgccacccgtcgtagccacttctggcactgccacccgtcgtcctctcctctctccgtgctgctgccccatcgcctggaacttgggagctcgggagctgtggaacacgacgaccgagcttcattgtgatatcccagcccagggcttaataggattaatagaatactcatatcaacaagttgcaacttcttttctggaagccgatctctaaagaactctgaggttaagcatgcttggcctagagcaatttagggatgggtgaccgatcaggaaattctttccaggtgcgcactttcctaggaaagctaccagatgtagagagggcccggcctcggaaagtgtggggcgtcacattcatgcagcatcgatgatggtggatacgtggatgcggtggagctcgtcacgacatcgacgcggaagtggttgctaaccactggagtggaggaagaggtagatctaggttttcatcttgaattttttgatgtttcagtgcatgtactatgatgtttgattagttatatttgaaatgttgcagtgggtattcgatggtttttcattctatttctcgatctagaaatgaaacagttgggggccgaacaacgccagaaaatagcccaaacttccatcctttctt

SEQ ID NO: 71197 - DNA, 4928 bp, Oryza sativa
tgcacgattatactcatagtagattagtagattaggggattggattacacgattcaatcagaagggttattgatgccattggcaaaagagtattgtagttgtcgcaaacacgtgatattaggtggttttttttttgccccttatttgggttaagatattggtaccttgaagctgcctcttgatgaggcatcatgggcaatgtgtctgatgtgtggcgagggatttttttcccctttggatatggctcacatgagtgctgactatttacaaaaagcaaaaggaaaagaggcaaagaactacctttcccttcagagagtaaacaaaattaatttggaataaagatatgacattctctttctctttctctttttcaatccctaccgtgtctaagggtcagatacccatgttgtaccaaaaaaggattaagtacacaaacagctgctgcaaaacttcttcacaacttcttctatttccaattgtgaatatctcttgataacaatggaagaaataatggttaattttttcaagcaattcttttcttttgtctccaaagattcaaatcacattgctaactttgtgatgccatgccaaattccattgtaatatttaaacaccaaattcacactcatgtttactgcatttggtctagaagaaatacacaacagctagtataagagaatacctaaatgtggtcccattcttttttggaaaatgacgaataaagcaacatatttaaacaagactcgtataatatgtttgctaactctctttatggtttcttgtctactgccaaatactatatttatttccaattttccactgtagtgttctgaccactgtctccttttttttttcttgcagggagtaagagtttcttctttgcatgagagggtacttctagaaggatgcataggttaattttctaagattttttttttcagcctatgtttcatgatggcatgaaacagtggagttgctgtaagcaaaaaagccatgattttagcctatttttggctattcctgggtaaggatccctctctagtatttccttttcacagcatgcacccacaacataagtcaactatgtgctatcaacctgaacattaccatctgggctggcctgttgtgtattttagcaaaaccaagcatgaatgcatgaatcgtatgctgtactgctgtgtaggtgcaaaactggaaagcacacaactgagaaaccaatcacaaaagcagttcctactaaaccatcaaaggcagttccagtccagacttcgaagcagagtgtgggagctgacacttgctcaaggtgccgtcaaggtttcttttgctctgaccatggtgagtttctgtctataagcataatgcttggatacaactgattgatcccctatttgggtgtaacagctgattgtttcgttattattttaacgactgacatccctatgcatttttatgtgttgatagaataaatcgtaacttttaatttaacagattatgcactgctattttttcaggatcacaacccaaggcacaaataccaaccgctaccagtgatactaacatggtacctgttgagaagcctgcagttccaccaccaaagaaaaaaattgatctgaatgagcctagggtttgtaagaacaaaggatgtggtaaaacctacaaggagaaggataatcatgatgaagcatgcgattaccatccaggacctgcagtttttcgcgacaggattagaggggtatgtttttggttcaaacttattgttgttttgctctattccttgatttttgccatcactgactctgacatctttttaaaaatttttgcagtggaaatgttgtgatattcatgtcaaggaatttgatgaatttatggagatccctccgtgcacaaagggttggcacaatgctgatgccgcatgaattttcaccatgccccatcttggaataagaaccctattagcataaggttctcttgtatctcgtagtgcataaggtgcaatttttatggagaattttacttggagttggggagtgtggcaaagataccgagaataggctgttttaccgtgctctgtgtgactgctgcaaaagtgtgcgtggtgtttcattttttgtctgaaacggggacttgaaattgtgtgtggagacttcggtctcgttcgttggctcgttgccaattcttcatagttagaaaatcaaatgctccatctaaatgctatcctgcagacttttggtaacacccatctttctgtttatatgagaaataacatgatttcgttatcatatcaaacacttccttttccatccctacgcaacaaaattgggtattaggtagtgtcttcgtttctcaacattttgtgctactaaagttgataacaatacttaactttgacatcaaccatacacttcttttccatcattcccaactgatttggcgctgccaaagctttgcccaaccttcaacggtacttttacatggcatcaaattaaatcaaccctatcaaattttctgtggcatcaaattgatccaattctgtccgatttaatgcatacaagtttttaaaactaaactatggattgtgacaccgcaagaatcaatgtgttgctgtccaattccagtactctgggcgctcgagtcgaaggacaccactgtttgatgtgatgaagtgcactaaggctctgttctttttggttgagttgggacccatccctccggtacgtaaaacgaatcagtccattagcacgtgattaattaattatttgctaatttttttttcaaaaatggatcaatataatttttttaagcaactttcgtatataaactttttgcaaaaaacacaccgtttagcagtttgaaaagcgtgcgcgcggaaaatgagatgggggagttgggaactccaggaaacgaacagagcctaagtgtaacaacatctcgaccaacttacctactccatccgtcttaatagaagtgtaatataatatactccctccgtttcacaatgtaagtcattctagcatttcccacatttatattggtgctggtagtatatgtgatatatcctaggactataaatctggattattgtctatccacgttcgtagttttaggatatgtcacatcctactactactattttttttccaaacaacagtattctctctctatattggttgtcggttgttctctcctcaccctatcacagctgctgcagcttcctcatgcaccaaatgttggattcatcgttgttgagatatggagggttgtggcactcaacctgcggcggcgggagctgcctccactgatcatcgtggccacaaactcctcgcagcgggtgaggcgtgggagttgcggcgacgctggagaagaggtggcgtgacgcgtgactgagtgtggggtggtgtgggaaagagttagctgaatcgctcaatcacatgagcggatagaagatagagatcatacgcccaaattcagggaatacgagggaatgaactgaggacgcctcataataggggatggtatagttgctagagcacactttttcgccaaattctgtaaatttagagataggggattgtataagattctgggtagaggtgctggtcgtgtttagctccatttcaatttttttaaaagtatacggacacatttgaagtattaaacgtatactaataacaaaacaaattacaaatttcgcctgtaaactgcgagacgaatctttttaagcctaattaatctgtcattagcaaatatttactgtagcgccacattgtcaaaaatcatggcgtaattaggcacaaaagattcgtctcacaatttacatgcaaactgtgcaattgttttttcgtttacatttaatgctccatgcatgcgtccaaatatttgatgtgatgaaaaaattcgaagtttgaaggaaactaaacacaaccgttgtaatagcaaacagtgaactccgcagactaccactataatttccaactgtgccatcaatatttctagttatacattgagcaaacaagacctcatacaacctcgtttgcatttatttggcatttttgacttgtgcttacctcctcgtttgcatttatttggcactgacttttaccgttttaactttgactattttttaaatggttagaccaaaatgaatacatgatgcaactggtatataatgtgacatatttttaagaacttgtatttttttctaaaaaaagaaagataaacattgtcaaatggtatgaatgttgtcattttttaaaaataaaattaacaactatttgaatagtgtttgaacaaataaagggacatttcctcgaaagcttacaacgatttccccacattttgttgcactttaaaatttgccggaagaaagaaaagttcactcttgagcttctggaagcctggaactggtgccatatcttctgctccctccgttttaaaatgtttgacaccgttgactttttagcacgtgtttgaccattcgtcttattcaaaaaaattaagtaattatttattcctttcatatcatctgatttattgttaaatatactttcatgtacacatatagttttacatatttcacaaatttttttaataagacgaacggtcaaacatgtgctaaaaagttaacggtgtcaaacattttgaaacggagggagtattattgtcttattggtagatgtttacataatcatacagtaacagtaacatagataataactataagtaggtaagtaagattattattgcaaacccgaacataagagtagcacaagcagaagcagtaggcgacgccgaccagtacattcaggggatgccgatgattggcaggaaagggaagaagtagatgagcggaaggcccgggccggtatcctttctagtggtatccaatatgcatgtagtgaagggcatgtgagaataaactatttacgcat

SEQ ID NO: 71198 - DNA, 11952 bp, Oryza sativa
gacgagggagcttaaataggggaggggagtcccggacgtggccggtaggagcgggattccgccggccaacgtggggagtgggggaggagagagaggcgggattccaatcccgcccatctcgggcgcgggcgcgagcgcgagagagggggaagtgggtgcgggggacgcggtgcatgcgcgggcgtggccgacgtgacccgggagaggcggaggcgtgggcgcggcggcggttgcgggcgcggctgcgccggctggaggaaggggacgggcctgacaggtggggcgtcccggggagagagggaagggcggcttgggccggcccacaaggaggagggcgcgcgcggcggccgggtggactgggccgacggcccaagaagaggaaaaggagggaaaagaaaaagaaaaggaggaaaagattttccctgggatttaaaatattgcatgctcaattttaattggttaaaattatttctagggctctgaaaattgcactaaaaatcttgttagtgaatttcgacatgtagaactcaagaaaaattccacatgccagattcgattattatttgcattgattccttagggttttctcttgatttgcaccggtattttcttagggtcatttattaattcgattttaggcttaggaggagaacttcagggtgtgacaataacatagatctgacagacgtgctagagggtctcccagcaatgatggcaagtttccccttaaaatacttgggcctcccgctagttcttggaagattgcggaagacgaacttgcaacctgtttttgacaaaatcttaggaaaggtcgcaagttggagggggaaaaacatgggagcagctggaagagctacgctagtcaagtctgtgctctcagcgcagccaatctacctcctgactgccttgaaggtgacgaaagaatccctggagcaacttgataagcagagacgtcgttttctctgggctggcacaggcgatatcaccggaggaaaatgcaaggtcaattggacaaagacgtgcttgccgactagccagggaggcttgggagtcctgaacctagaaaagttcacaagggccttgagactgtgatggctttggcacgaatggaaagatccgaacaagccgtgggtgggtttggacacgccttgtgatgaaatcgacaaagacctcttcgctgcctcaacaaagataaccgtcggtgatgggaatatgacacgcttctgggattccgcttggattgatgggcgcaggccaaaagatcttatgccgttggtctacgcgatctccaaaaataggaaaaagtccctacaccaagggaaagaggacgacgcatgggtgcatgacctgatctttgacgcaggctcaaccatcacagtcaatctagtggaacagctggtccgcttgtgggaagcggttcagaatgtgcagttagtcagtgaagagccggatcagattgtttggaaattcacaggcaatggccattatacagcctcttcggcatatcatgcacagtgcttgggggcgccaagtacaaacctcaactctttgatttggaaagcatgggccccggggaaatgcaaattccatgcctggctcatcatctagaatagagtctggacgtccgaccgacttgcaataagaggttggcagaacaacggccattgccccctctgtcgttgcgaagctgagacgggattgcatcttgtcgccacatgcagatacacaaagagaatctggcaccacgttgccggatgggtgggatatcatcaattggagccgtcccagtgggaggaagcccggtcagtccgccaatggtgggaaagcctagcaaatacccccaacatcctaaaaaagggccttcggtccctcatcctactagtagtctgggaaatctggaaggagagaaatcggcggattttcgatcacaaagagatggcggtaggccttctcctagcaaaaataaaagaggaggctagcctgtgggccttagcagggacaaaaagattgcgcgaattcgttccacgcattgtatagtttatagcttaaagtcttttttctttacccttaggggttgtattttctcctttatattcaatgaaaaggcgtactcttgtgtcgttttccgttcaaaaaaaaagattgtaacgctaattagttacatatgtttataaagagttatatgatggtatattttttgtttttaaaattttaaaaaatatatatcaattatataaatgaaaaaaagaagaaaaaatgaataaaaatggagggagccgtacgtactacatacccatgtacgtacttgatcacctgtgcacgggagaacgcacaggagagaggagagtgggacccatagcattttgtttgttttacgatcaatttcatctaacggtgtataatattggacccactaatttaagtgaaaattaaggggtagatgttttgcttttttcttaaaatttctaggattttctctaatttattagagcgcgatgtgacaacttgagagcgcttgtaggaattttaatggacttttagtatataatagatatatttaaattatttggtcagtttaaataatatttgtctgcaaacgagttatgcacctcctaaattgcttccatatacctgcattttttccctgttcagaaaatggaatagctcacctctgtgtcaattggtagcatgatgtttgtagtgctaacagtgtgcttgttacgatattgaaattagcgttccttctggttcacatgatatccaacatacatctggtatattttctgaagctttttctcttcctaggctgtgttcattagcacataattaattaagtattagtcatttttaatagattaatatgattttttttaaaacaacttttatataaaatttatttattttgaaaaaaccgcactgtttaatagtttaagaagagtgcgcgcaagtgagttgggaaagaagggcgaggaacatagcctatcgtttaattaacagtttgattggatagctacaccgaccgacgattgtgttcgatctgcaacaccaccatcgtgatgatgcgtcttgtatgtcatcctttgatgatgcgtttgagagccagcacaaagagaagaaaaagagcatcgtttttcacgtggtcttttgaaaaactttctataaaaaaagttactttaaaaacatattaatctattttttcaagtttacataattaatacttaattaattacacactaatagcttatctcgttttacgtatcttcccaattttctaatttcctagttttactcactatgcgctcatagcacatctatctatgtatctattatttcctagttttactcactatgcgctcatagcacatctatctatgtatctattatatctttaaagtaatagaaaaaggagcctacacgttcgctctcacggtatagaaattctcacattaatctaaaaaaataaaaaaaatagaactagattaggattaggattagttaaaaactaaagaaaggagaaaagaagatgaatcggacaatcagtcaaaacgaaaataagattaatcaaaaaaataaggaaaaagaaaaatagaactagattaggattagaattagttaaaaactgaagaaaaaaaaagattaatcggacaatcagtcaaaatgaaaataaggaaaaccgagtcatacaatacattggaaactgacaatgttttgggaatccgcatgttcacaccacttttagaaacattgaaagacaaaccaatcctaattaaactctaataaaactcttgccgtttccgaatcgtataagtacttgtcatgtcaataaatacttcaacaagctaaccaaagcaaaccagaaatcttcaacaagccaaaaaaaaacttcttgcagtgaccgtcgccgtgatcatcaacaagcacgccacaaattagcaatttcaccgggttcttgccgttcaaacttctcgccagcacgccacaaatctgcaagccagaagttctcgccggaatccacttcgtcaatcaaaaaggcacccaggaattgttcttgctgaatcactatggcatacaagaagattagtgagttgacaacaaaaggtcaaacatggagaatcaaagcgatattgagaatgtaggaatcggtaaattttgcaacagatgagattatgagttttgatatgctattaatggatgaagtccgtacatgcagaacaaggtccgcgaaataaaacggactggcacatcctatctaagtccaacaggattagattaagccgacattccagaaatgcaaaaatcattaaaaaaataaaaaaagaatcactgaagcgctcaccatccggagaggagttgagaggctgttgggggaggatgcgtcgatgctagcgcgtgcataagctccatagaagatcaggacccgacgcggccatggacgcccgccgtcggcggctggggaaggagcagcctcgatctacgcctgcgatggcgtccagggagggagccgcctcaatccgcgcctacggtggcggccgaggacggagccgcctcgatccactctggcggcggtgccggggacgcgccggagaaggggacacggtggggaggggaaaagggcggcgccgctcggacggggaagagagggcggcgccgcatcgatgcgttcgatggggaaggagagaagcgaatcagtgagagaagggttgggctgacatgtgggtcatagaagttcaagggtacatctgtattttttttttatgttctcatagggtctaaaaacatacaagtttcagtaataaatatttcaatgactaaggtgatctgcactaaattttaatccatgttataccggatatttgacactatttagtagtattaaatgtagcaccattactactgctccttattatgggtaatcactggatatactaataccttcatattttaatatatgacgccgttgactttttatccaacgtttgaccattcgtcttattcaaaaaaatttatgcaattgtcatttattttattctgactagattcatcatcaaatgttatttaagcatgatataaatattttcatatttgcacgaaaattttgaataaaacgaatggtcaaacgttagtcgaaaagtcaacggcatcatacattaaaatacggagggagtattaagcaagcaatctaaggattatttaaaggtcagctttgttcataacttttgtgcgctaggtacagcgatcgatccaatatctcacttgcttttttttttcaaaacagtaaaaaacattacagaatatttttccaatattttacagaatacttgctaggtacagcgatcgatccatttattattttcaatagaaaaaacatatttttccagggggtgtttagatacaggggtgtaaagtttttgcgtgtcacatcgggtattatatacggtatcgcatggggtgttcaggtactaataaaataaactaattacagaatatgttagtaaactgcgagacaaatttattaagcctaattaatacattattagcaaatatttactgtagcaccaaattgtaaaatcatgaagcatttaatcgtaaaagattcgtctcacaaattagtcacaatctgtgtaattagttattattcaccctatatttaatacttcatacaggtgttcaaacgttcgatgtgactgtgtgtaaaatttttatgtgggaactaaacagggcctaaaacacattagccaaccatttctaacatcaaaacaatctcttttttagtttaacaatacctcctaacaattatctttcgagtccatgtagaagtaaaaaaaatataaaatgtaaattcagaatttaaaaaaataataaatattataagaggagtagatttatgctcccattttactatcttttaaaaataaaatatgaaattatatgacaataccctctatataatacaattcaaagcagtgcaccgttcccggatcataatcacccccttataaacaaggtaaggactccccagcgacccccgtgggcttatctccgccacttcacagtctggtgctctactatgaaccatacaatacagaaagtaaagccgttgcccacgctggcttgtggttggcacggtaaatgttttacaaccgaaaatcgtgaaccggtccttaattgtcatgagcacgaccatcaaaaccatgtgctcacaacccaccattatcaagttttagttgacaaattaattaattaaccattcatgattaaccttcatgagctatcattaagccatcattatataatagtgaggcataagttatcccaatagtgtgctaatgtttctaagcatggctaagcaattatgcctaatatctagttgaaccattatataaagctcaactagtcaagttataataacccaaggtatcaaggaataaagtaatcaagaacaaaagggccataacaaataataggttaattccacccaattacattcgaaaataaatgcagactttgaatagaaacaatagctttaaacgggatcaacatgctcaaagggttgtttgggatctgtgtgacttgccttgctggcctcggaaatcctcaaagtcttctcctgcaaattcggactctccgggaacgtcggaatctaaagagaaaagaacaaaatcaccaaacagtacataaacaagcatgaacagtacttgaaccaactaaatccgagctaagatgaattagttatgaattttcaaagattaaatcggattaaatcatttatatggattttaattgaattacgacgcaataatgaattatttttgaaaagaaaaagggatttattgcgtcagtaggtcgggtttacggtggaccgggtgcacggcgacggttcacggaaacggacggccgagatctatccatccaaaacggacggctgagatcggccggtccacgaccggaccacggcggatggcaacgatgacgacggcgatgacgtcatcaccggcgacggctcggcttcgcgtgctcgccggcgatcgacggcgcggcggcgcaaacggaggacacctacgcgttgcggacgacacgacgaactcaccggtgaccaaaatagcgacggaggagcaatggacaatgccggcaacgaggttgaaacgacggcgaccttcggcttaacgacggcggcggtattccggcggttgacagcgacggcgaaggggcggacgaggacggcggcagcttggcgaccacgacggtgacctccccgagcagtgacgacgaccggagcgacggcggcgcacggctggagcggtggcgacggcggcggcgcgaagcggcacggcgctagagctctaccggcgacgagagactaaggcgagggtggcagcgggtagaggggagctcgggggtcaatttataggggctagggagcggcggcgaaggcccacggcgaccggcgacgggaaggaaagtttagggttcggaggagagagatcgatccgaattgaactcaaatccggcgatttccaaagcgatttagacgatgtttccaaaagggaaaaggtagagtggatcacggggatcctttcccctcaatcaattcgaccggagacagaaaggggcggccggatttggaatggcggcggcggcgcagctcggctagggtttcgactagaggaagacgacgactgacgggtgggacccacatgtcagcggcggtcgcacgcgcgcgagcgggcgggcgctcggcttgggccgacttgggccgagcgagagagagagatctttgggcccaaagccaaaagagaattttaaaaacctttttccatttaaattattcattaaatgcaattccatttattaaaaatacttccttagctcaaataaatcccagaaaaatctaggaattatagaattaagcaaagtatttaatgaaattttatctggccccattttatattggaatttattaattaaaattagatcttatcttctaggcttttacaataaattctaataattccaattaaacaacaatttatatttttgggatttttagggtatgacaatgacattgaaaaaaactcgatgttccatgaaataggattttctactatttaaaataaaatatgttactaatatacgtagttaaactagatcttctataatataaaataaaatatcctatcaatgtttttaaaaatatatatgtaatttgtgttccggtcagatttctcaaattaaataaactattaatgtctatgttcctaaatacatcataatacatgaggccgatatataataaataatattatgataatattttaaaggaaaaataacgaattacctctaaactattatgatagaccgaattatccccataaacctaaaaaccagacatctcacaccctaaactattaataccgaacgaattacccctgactcaacccgaagtggtttcggttctaccttgtagtcccgtcagcattttcttaaaaaaaaaatctctctttcttctccctccgatccacgtctgtcaatcggcaaggctaggggcggcgagcgggtggatcggaggagctcgagtgaagagcggtggaggcggctcgtcctcagcctccatcggcacgcacctccttgatggacacgtgacctcttcttggcctccactggcgcgtgaagaggacgatagtggcggggcggaggagctcgagctccgtaggcggcttgggggcggtgagcagcggaggcggctcctcctcgactttctcggccgccacatgcacactccagtggaggctgttgtctccatccttttcgtcgcatctcgtcgtcgcatgatgagcgttgtggctgccggaggcaagcacctgcgctggtcttctatggctaggtttggctacgccccccccatcgagaactccccaacaaataaggccgcaactctatctagctaccatagcatgtcgtcgcatcacggttcttaatcgatccccacctagaggcatgcctctctcccgacgagacagaaagcaccaatcaatcaaagaacatcgaggtggatcaatcaagtgatcaagagcaggggaatagacaaagatgaaggagaagagcggcgaagcgacagtgcgcctgcccggcttgtccctgtagcagggggagggagaagagagtggctggggaatgggattgaggaagagagggagagagataggtgagaggggagatgaataaagaaggtagaaagtgtgacagatgggccacacctattttatttttttaaaaaagttaactgtactgccacgtaggtccaaaaccactccgggttgagtgagggggaaggggtaatttgtccggtattaatagttgagggtgaaacatatctggttttcgggtttatggggtaattcggtctactgtaatagttagggtaattcgtccttttcctattttatataattccccatcatatttcaagtgtcaaatatcacttgacgactatacaatgctaatttaaatcaacataataaatgaaaacaccacaatttagttgtgtatctttaagtatatatgatttaattttaatttgtttaagattaagattctcaaacattttttgaatttttataactatttcattagtatatgataagtgggccacataaatgttacatagaataaaaaaatatgaaaaatatttcaagccaatgatattgctataatacaaccccttagtccatcgtgagacttatgatcataaatgtatgtttttctctttgtcaaatagttttcaaaacaaatgaactaccgagtaagttgtgcaatacactattcatgatatattttcttatagttgaggaattccaacatatcaggcataatttgatgaatgtatgttatacactctattgacgtgactataaagtatacttcaataaagcgttgaaaatcaccggacacaaaactatagatatttatcaaaatatatccaataatatggtgctttggagattatcgtggtagtacttaaaaaaacctttatctttgttaaaaaaatcacatacagttgtttaggatagaaaattacgaaaatgtatccctctatgtttagagagaaaataaatgcgggcgtgccagtgtacctagatacacaatgtaaaacaaacataaaagagacacagaaacacatgatctttattaaccgaattaacaagatacagtttccatgtatgatataaaatacgcgtgccattgcctgtcgttggacagatcttgacatcagcgatgtggtcttctggttcctatggtctcgaaagactcccagttaattacctccgcaggtctaggcctgcagagcacctccgattaagctgcttgtggtcgtctcatcgtcttcgcttcacgttttccatgcatggttgtgatgatggtgtagatgtgtgtgtatatatgtgagggcgccggtagcgatccacggcctcgtcggtccgtgcgctggtgttggtggcgtagccttcatatagactccgcccgccctcgtcgctccgcctcatcactcttgagcgacgtgtcggtgtagattgcttgaagaagacatgcatggaatcgcatagcttggacggctcgacgtcatagcaacagcatcggaatggtgtttaaaggtaagatgaattggtgaagtcagttggtgtacacaacagccgaataaacatagctgggcacctcttgactagatgagatcaaagtaatgaagagttgacgaagacagtcggtgtagacgacagccggattaaacatggctgggcacctcctgacccgtcatcaagatcaaatgaatgaagagttgacgaagacagttggtgtagatggcagccggatgaacgtggctgggcacctcccgactcgtcatgccccttatacaacagggacttgtaacaaagatgttgatgaagaagtcgatgcagacagcagccggacaaacgtggcttggcacctcctttagatgatggacctattattgattcggttaatatgataacgaacccatgaaaggggctctatgagggcgccggtagcaacggtgaccttggaagaagtaaacgtctcatcggcgggatgaccgagggcatttgttggtgtagatctggcacgaaggcatcacagatggcaccattcttgctttacgttgatgtagacaagcgacgctccaatacacgaacgagcggcgacatcgatcttgacaaagagggagagaatcctggacgaacggcgctaatgtcaatgtgacagaagagagaacatcacggacaaacaacgtctcatcatcttggcccggtggagggaagtcttcatggccggacggcacgacgactccggcatgacgatggtttacgggcaccaagcagtggtgctccggcgggatggtcacatgacgtcatgaacgaccccagcatgatgaagtgaaagcgtcgcggacgagcggcgagcggcgagcggcacgacaacctcggcttgatgaagagaaagaatcacagatggacgtcatgacgacttcgacttgacgagatgatgacgatatgctccggcgggcggcgtgatagtgttctatcggcatgaacgagcactgcatggcagtgctcggctgcttgataattataacgagctctcaagtgctatagtcgagagcagctcggcgacgtcgatccgcgggtgctccgactatccgtggcacgctccagcaagacggcgtgcgggcaccaaaccatggcgctccggcgtgatgaagtgaaggcatcatgggccggtggacttgacgacagcgtgcgggcacctagcagtggcactccggtattgcataggttgagtagatgttgatggtgtcgcaatgcataggttgcgaccagcaaagtaaggacacccgacgtcttggcgacgtcgtacactagtacagatgatgaactactg

SEQ ID NO: 71199 - DNA, 4369 bp, Oryza sativa
  unsure (1)..(4369): unsure at all n locations
cattgatgattgaatatctctcaagaacctaaatgcaattttagtaatggagtgaaatgcaaaatcctttaaatgtagtatgttgcatttgtcttggtggaaaccggtccaaatttcaatattttccggcttgttgaaaacacaaaccgcttggttttcggtctagttcaaaaattttcaaactgaattttaagttttgacatgatttatcttgatttcattttctttttgttatcaactgtttttacaaaatccaaagataccactcgtgagaggttttgatccaatatcaaaattgcgaatcccaactcccggagtggaatgaaatcatgcatcaataattccatcaaggtgctaaaggtgtgcattgtgctttcctataaatcattttttttgaacgaattataaatcattttttcaatcgatcactaatgtaccggaagtgttctcacctagacgctcaaaggcaactcgtcaccaagaaagccatcagagttaaacatgtagtcattccaagagagacggagtataacaaatatagtacctcatctgtctcaaaaaagaaattttacatggatgtgatagtatttgctagtactaggaagtgttatatcccttcaaaatctctcatactccctccgtttctaaatatttgataccgttgactttttagcacgtgtttgaccattcgtctcattcaaaacaattcagtaattatttattcctttcatatcatctgatttattgttaaatatactttcatgtacacatatagttttacatatttcacaaatttttttaataagacgaacggtcaaacatgtgctaaaaagttaacggtgtcaaacattttgaaacggagggagtattattgtcttattggtagatgtttacataatcatacagtaacagtaacatagataataactataagtaggtaagtaagattattattgcaaacccgaacataagagtagcacaagcagaagcagtaggcgacgccgaccagtacattcaggggatgccgatgattggcaggaaagggaagaagtagatgagcggaaggcccgggccggcgtagggcggaggggtggcgcgcccggcgcgcggcgtcgccctgcgcgcccgcggcggcgcggggctctggacgttaccggtggctgccgccgtcgacgacgctagggcgccgccgccgcacctcgtgaagacggcgaggctgcacgccagcgcgtacgagccgtgcttctcccggccgcccgcggcgaccacgggcgcgacggcgagcccccccggcgcgcagagctgctcggcgccgccgaggaccctcgccgcgcaccgcgggtggctccgccaactgtcgacgtcgtctccgccggccgccggcacggccacgtcgaagcccccgcgctcgtccgtctgcgccgcccgcagctgtccaacgccgccatcgccgccgccgcatctcaccgccaccaccacacctgcagccaccgcgcgcgacgtcacgatcgaccatgtctgcccggtgcgcgcgtgaccgcgtgttactacattacataccggagaggtcgtggcccggggcgcagtcgaggcaggcgacgtagccgcggagcgtgccggcgccgcgcaccccggcctcgccgtgcgcgacggcggcggcggcggcgagggcgagggcgacgacgaccgcgaggcgaggagccatgacgagtgtagtactggttgttgcacttgcaccgttgcacgcgcgcggctatacgtgtctacgtgctacggtttgtgtgtgtgtgtgtgtgcgcctttttgtagtacgaggatacgcgcgatcgagcattgagtacgcgcacgcaggggcagatgggcagatcgccgggccttaacgccggccgccaccatggctcgcgcaccggctctggacgcaaacgtacccgaaaaggaggtccttttgccgttgcagggatgtacttcccgaaaaggagggcaccgattgctgtaaacgggccggcccagagttggcaagaccgagctcggtgggatcaaagggaggacgggatatgtatggttttagtatggaataagtccactttgactcccttaaaaatgacccgaatctaatccgtgactctcaaccgtaaaaccggataggatgactctccgaactattcaaaccagtacaatttgactccctcagtggttttggagggtggttttgctgatgtggcgttgacgtggcgatgttgacttgatctgtgttgttgatgtggcgcttatatggcattaaaataaaaaattatatggactccattcgtcattcacatgaaaaaaaattgcgacgccaacatgtcatcctctatctatcctccttcccccccccctctctctctccctcctctgtatgtttctcttccaccagattcggtgcggaatctggagcgccaacgncggcggcagggtgagggccggcgcggagaaaggaacttgagcgggttgagcggcggcgacggcagagagccaaaggagagccggtggagtggcgacggccacagcttgccggagaaggcgggggcgtccggccggtggcctcccccacgatggtgccgcgccaggctaggacgaacgagagggctaatgcagacggcgaggcctgagacgctgccggccccagccgtgcctcccggtctgcaccggcagggggtgccgcctctgtttctttctgctcggagaacatgcatgtgcacagcgttgcctagcagatgcaagtgcagcgccggtgtggggtagcaatgcgcggccgccatggaatccagtcgaattttggcaggaccagcagctgtaggacgaatccgtcctaccagcgtggtccacccgagtcctgcagatcttgaggtcatggactggtctgatttttttctttctggtcactgtttgcaaggtcttgaggtcgtggacaatagctacttcatcaccgaggacaacgtcggcatgctgaagctcgccaaggaggccaacagcatcttggttcgtcgatcagcgcattgactcatgttaccaattcgcctatgaaaattgctaacatctaaccgtgacatccttttgattaattggtacaagaagtttgactgccgtatgccgcgccggagacagtgggttgcacagtggtgcactcaaacggccataccgcggcggccatgtccacgagcggattgatgaacaagatgaccgggcgcatcggcgactcgccgttgatcgggttgggagaaggcaaggccatcatatgctccacgctggcgcgcgacgccgccgccgttatggagtacaggggcgtcgggctgcatgaggccatcgactactgcgtcaaggaacggctagacgaggttcatcgggctcatcgcggtgtccagcaccggcgaggtggcgcacgggttcaactgcaccggcatgttcagcgggtgcggctgcaggagaaaagagagagaagggagagagagggggaggaggaagggttggagagagaaaggatgacatgtgggtcccacaatatattttgtgtgtaaatgacagacgggtcccacaaaatatttttaattgtaatgccacataagctccacgtgggatgaagaccaggtcaacaccgccacgtcagcaaaaccgacatccaaaaccgctaagggagtcaaattgcactagtttgaataattcagggagtcatgctatccggttttacggttgagagtcacggattagattcagatcacttttaaggaagtcaaagtgaacttttttccttttagtatcacatcgggtgttgaactgttgacagccgaggaggggcaaatggcggatataaaagggggttggagagcattgttgcaactcatatctttcttggtcctttggataagatcaagtgtagtactccctccatattcataaaggaagtcgtttaggacagcgatacggtgtccaaaacacatttttgacttcttatttctataataatatttattgaaaagtgatatatgtatacttttatgaaagtatttttcaagaaaaatctatacatatagtttttacattttcaaactcaacaacttgagagttattcatgatttatattcccaaggtttgacttaaacattgtcctaaatgacttcctttataagtatggagggagtatatgttatcagtttataatactattatctggcatgtggactatgtgcgcccactttgatattaaatttattttttttgggaggattcactgtagtggcttgcaactaggaggaccctcgtgtgttgtttgggcattgcattgctgccaatcttagagcaacccaaccaaaatgaagtaaattttgttaaactg

SEQ ID NO: 71200 - DNA, 4001 bp, Oryza sativa
  unsure (1)..(4001): unsure at all n locations
tctctccagatgatcatttttctttttataaaagaaaccagatagccatcttcataactgtcaaatattaaaaagaaataggggatcaaactttcaattgagttggtccacaagacatatatttactagtgaaaaataaatctagtgatgatcttaggatgaaccacgtcatctatctatcttctattatatactaaaagtctattaaacttcctataaacattctcaagccaccacgtggcgctctacaaacgctcctaagtcgccacgtggagctctaataaattagaaaaaaatcctagaaattttaagaaaaaaagaaaaacatctcaccattggttttcacttaaatgagtggatccattatttttaatcattagatcaattttaaaggaatatatactcaatccaacctatgggcctattagatcgatctcacggaatatgtagccttcccttcccctgctgtacatgccaccgtacgtaagtacgtatatatgtgatacgtattccatatgccctccccttttctcctattttctaaaaactcattacaaaatagtttaaattttaaatagctaaataatcatgattctcaatttatatacaacattaaattcatttgtactatttttatttgtaattaaataaatacattaagatcgatattgcatatattttgcgaggtaaagaaaaaactgaaatacgtttggacatagaccctagcgtggcagtcattaaacaaataaaaaaattgacaacaactataccatcttaaatcattctatatataaatatgtacattaaattaaatatcatgtaggacgcaaaccatcaaccgtcacatcctaaaaattaagaaatatcgttgaaattctatgagaaaaacaaaagcaaaacatcctactatcattttacacttaaatcggcaaatttattattttcagccattagatatatcattctactctcataagccactacgtatcacatcttaaaaattaataaaaatcacataaaatctaaaacaatgaagcatctgacctcgataaaatcattatttcagccattagatctatatttaaagaaaaactataaaaaaataaagtaccatcccattccccctccccctcacctggattaacaaagctccatctttatattatgaaattataaatatatagtaaatgaataaagatatcgttggagtatataagtataaaaaaaaacagggagtagctaaagaaaagccctaagtgcggaaatgctaatgggcgggtgatcgctccctcacccgcccagcgatcagacgcccgccccctcccctatactactagatacactcctccctcctctcctgctacagtacaccacacaaaaatttaaaaaaaaacaaaaagttagaaaaatttatgtatagaaatactatatataaaaaatttaaattcaaattcaaatttgaatcgggtatgtaaactttttgacttataaactttgggtctataaactttaggtgtataaactttagatgtatagaaatactatatatagaaaatatttgaattcaaatttaaatttgaatcggatataattcaaattcaaatttgaatcgggtatgtaaacttttgacttataaattttgggtctataaactttgggtctataaactttagttgtataaactttagatgcatagaaatactatatatagaaaatatttgaattcaaattcaaatttgaatcagatataattcaaattcaaatttgaatcgaatatataaacttttgacttataaacttttggtctataaactaactttaggtgtataaactttagatgtatagaaatactatatataaaaaaaatatttgaattcaaattcaaatttgaatcggatatataaacttttgacttataaactttgggtctctatactttagatgtgtaaacttgaggtgtataaatttactaaaataagaaagtaatgcggtggtaaaaaagnaaaccaggtgaagggggggcgtggggcgatcgctacccccatctccaggcgatcgatcgcccattaggatcgcccccctaagtgcttcaatcctactgcatcattagtcaactgctcagtagttttgctccctccgtttaaattatactattgactttccacattcgttttaaaatgttatatataaatgttatttattttgttgtgacatattttattattattaaagaaactataagtatgacttataatttagaatatttacactaatattttaaatagaacgaataatcaaacattattttaaaaattatggtattatctattaaagaaaatagcagaggtagtattactaggggtggaaacgagccgagccaagcctagctcggttcggcttgcaatggctcgtaacaagctaggcttggcttggctcggttcggttagggatacgagctaaacnatgagctcggctcggctcgtttcctggctcgagccagctcgcgctagcttgcgaaccttccgttgaagctatataatttataatcattaagaaaagcaataacaaattatcaacatgtaaattaaaataactttatatattcaattcattaaaatctagacgataaattatatattgacaaataataactcaactgcaaaataaaatcatccatacaaatatatgatggcctaggctcacgagccaaatcaagtggctcgtgagccagctcgggcttagctcgtttcagaaacgagctaaaaaggaggcttgggcttggcttgtttggcattcaagccgaccgagctaagtgagctcgagccaagcccgagctaagctcacgagcccaagctttttttccacccctaagtattactaattagattgatttagggtagaccgcgagaggtggcggcggtcattggggtcacgtacaatactcctatctgatttgatctccaagacttcaaaacttggaaaagaaatttggtgcagaactgcagaactgcagacctgctccagatgattgccatgtggacgacgtggtgatcagacggctatctcccctcggctcctatgcagcgcgatatatatggtaggatcgatcgatcacccttctccatatggtttcctattttaacaccgcattacttttctattttagtacatttatatacctaaggtttgtgcatcataagtttacacatgtaaagtttatgcacggtggcagacttcaagttacagattataaagtttatatattgttgacgagtgatactcgcaggcaggataagttgagtattggggtatgtttgaatgagggtttatgtagtacaacatctagctaacagaagacgaggattatactggttcaggcccgttatcaggtaatagccctagtttagtttatatgagattgatgatgatgagaacagattacaaagagagtagatgaagcaaacgacaccgacgagatcatagtcaatagattcgacggggccgacgagatcatagtcgatagattcgacgagatctcccggtgacttggctccgaatacttcggcttcgtaagctgtggtgggtgtgttggcgatgatatttgatgcccttcacctccctctaggggtccgttttataccgtggattatcttacccgaagtaagagttggagatatgtaaactagtacgatatagcagatattctatcccctccaagtaggactctgatagtttcttaactcgtagagatatttttcataattcgggacagattcctaacggtgtatacggaaacgacccgtgcacgtgaaggtataccttatcggtatatttcataagtcgtaggttagagggtatgccttatccataatcctaacatacacctcaagtttagagacccaaagtttacaagtcaaaagtttatatatccgattcaaatttgaatttgaattcaaatattttttatatatagtatttctatatatctaaagtttatacac

SEQ ID NO: 71201 - DNA, 1873 bp, Oryza sativa
  unsure (1)..(1873): unsure at all n locations
actactacacagtagtaacaacctcggatctgctgggatcgacaactttagtaatcatatcgtagtcgatggattcaaatctacgtgttctcttaaggggtttggaacccttttcctcagtatgcaaaccaagtgttaaattaatgcatgatacaaaacaaagtgttaaattaacacatgattaattaagttttagtaaagaaaaacttgaaaataaattaatatgatttttttaaaaataacatttgtatatattttttaaaaaacataccgttcaacgttttagaaaacgtgcaagtaaaaaaatgatgcaataaaagtttgtataaggctatgttcgtttgtatcggttgggaacgctctcttccggcgtggaaaatagagcggttcattgacacgtaattaattaagtactagctggaaaaaacttgaataatggattgatatgattttttaaagcaactttcatattgttgatgcgaaaaacacacactggcctaggagatttgcttagctccagtacaggtccaaaatcttgccttgagattcgcgagcgtaccagttgatttgatcctgcaatcaacaagaaataaagacgaaagaaaccacggttaaatccgtaaacgatagccgattggccagtcgccgatgacatatcatttattttcaagccgatgtcatatgtgaatcgatcggtagtggtaaataagcaggataagactaaatctactcgatcggctgtagatattaacgctatataatctttctgttgatgtatatttaaaccaagtgattgggatagatcggtcgccatactgagacagtataaatcacttagatcgaagtatgcattaacataaaggttataaacgcttatagcatagctgatcaggtagatctagcatgtatcggctagtactccgatactactctatgttaagatgttaaaacagatagaatatatcacacagaagcctaatatactttattgcaataagatcttaatataaagggcatacttagcatatcaattaagcatgtaaaacataagactaagtcaggtaagatcggttgaaaccccgatactatctctctcaatgatcataaaacaagccagatattcataattaataaatacaancttaacagatcgaactcaaccgnnatgcagcatcaagcataaagacaagtatgagatctaaacagaatgatgaaaatctacaagagatggtagatacaagatacaatctagattaataacaaaatataactctaccgattattccctaatgataagaaccagccgataacaagctatatagtgcacactaacatagattgcaacagatatatgataactcgactgattacagaaatagggttaaagtatcataaagatggaagcattaaccccgataacgtaagccgccataacaagttttacctttagttgaagatcgaatcgatgcagctcaactcaaaagtaagaactcgtcgaaataaacgaaagtaaaaagggtggcgatgtgccgagattgtattgaacgattgttgtttgattacatgggttcgggtcatatttataccagagatacaaaatatgtccttgccggacacgacacttatctctaacaaactctaagatatcataagtcttttgcccaaacatatctctaaggaaattacataaaatatcctaattaatagatacaactgcctaaaccgagagctttatctccatcatggcaatccctgtaaagcactttgaacaattctagaaacggccttgaaaccatcttcatcggaatcgattgcattacctctatcggctgtatcttttatcctctgtcgggtaccgagctcgaattcgccc

SEQ ID NO: 71202 - DNA, 1555 bp, Oryza sativa
atcagatggcaatgatcttggctttggtagaagccctcgggagagccagtaacttggtaagagactcgcacatgcacgcatcgttcaggacatcctcgtcgtccctgaccaccttcagttcctctaaggtgggtgaccatctcaggagcagtccaacgagatcaatttcgtgttccagccccacgaaatcgttaatcgtcaccgtcacgaggtgatgcaaggtaggctcttcaatctccgcctgatcattatcccatattggctgataccaaaattcttcatcgctgtagaagctctgtagaagttgaagcaactagtcagtgcaaccacacggaaaaacagccgacggagggaaaatagtgccaagttaactgcagaagagtgcagggaagcatacccgtatctcaagttctctgaacttagaggcattccgaaatattgaacaagcacccaagactctgtccagacccaagagcacttctcaatacaaatcttccttagacgatcaaacacgcctgggagttctgccaacaagcacccttctgatagatactgccaccagaataaaaccaatgaattaccaatataattcaaccagcgtgttagttaaataacacaaaactattagtatgttactgtcaagaatgagccacttatagtaagttcttcgatactagttaggctgacaaaagcttgcttcagatagtttttcttgtcacccacaactgcatcagattgttctgcttctgttttgccgagtgtaagatacaacagattaggagcatgcagatgcaagtcttcaaaatccccttgaacctctaaaagctgtagtgtctgagcttgaatacggagacaactgataccctcaaatatttcagacgcaacatattcagccaggggcacgaggagatcagcttatatatatctctatctgtcaaggagaaatatttcagattcaagacagttagctgcttgaaaccttcaaactcctgaggcaagccaatggtgcatctttttataacaagtgtttctattctagttaggctgacaaaagcttgcttcagatagtttttccagttgaccgcttcttccgtttttgcgggtgaaatatacgcactggacagattgggtgaattcagatgaaagtctttaaagttccctttaacctctaaaacctgtagtgccggagcttgaatacggagacaactgatgccctcaaaatatttcaaacgcaatgtattcagcaagtggcatgaggagatcagattatttatgtcactgtctgttgaggagaaatatttcagattcagaactgttagccgcttgaaaccttcaaactcctgaggcaagcggatgatgcatctttttaagtgatttatactgtctcggcatggcgaccgatctatcccaatcacttgatttaagtatatatcgatacaaggagtatatattgttaatatctacagccgatcgagtagatttagttccttcttatttactcatggttgccgatcgatacatatatgacatcggctcaaagataaatgatatgtca

SEQ ID NO: 71203 - DNA, 4925 bp, Oryza sativa
ttgagatgacctccattatctcaatcgggcgcgaataatgagcccgtcaccgatgagtgtcatcggtgatgggctccaagaaggcccgattgagatagttttaatgcccatcaccgatgactcttataggtgtcgggcttctatttgtgtccgttagagattaatgtgcgcccgttagagatgacatttttttggcccgattgagatatactttgcacactatatatactccagcagtccgttgtctgtagtttatcccactgttcactattttggtgggaggttgaagggggcgaatttttgtaatttttttgcaaacaaaaacaggaaaatcataaaagtaagtaaaaggatactaaacatttcctattaatttagtagtacttatgttatgagatgttaactaatattttgttcattgttcaacgatggatcgaagttggatgtacacgactggcttgaggcgtcagtagaaggagtatagagatggcgtattaagttttatgaaagccgcagaggaggataggataagaagaaacgacaagtacatgtgttgtccatgtagcgattgcaggaatgagattttgtgggaagatgaaaaggaagtacacgctcacttgatacgccggggattcatggaaagatacacacgttgggtgatgcatggagagcaagatctgggtactgatggagcagctacagacggaagtggtgtagacaatcatgaagaaggagatgaagaagagcatgacatgtttgtcccatctccattgggcagtgaaatggttgatgtgtaccctgatatgctgcaagacatgttatgtgacattaatgacctagctatgaacgagagagattccatgaagttcaacaggttggtcagtaactcggagactcctcgatacgcaggatgcaagccaaagcacaccaaattatcagcaacattagatctaatgaagttgaaggctagtagtggatggtcagacaagagttttacataacttttgggaatactgaaggacatgcttcctcaggagaacacattgcccgagacgacatatgaagcaaaacaggttctgtgtcccctagggttagaggtccggagaattcacgcgtgtccaaacgattgcatattgtaccacaagcaatacgtggacttagatgcttgtcctgtctgcaaagcttctcgatacaagcgaaagaagagcgcgggcaagagaaagaagtcaaagcggggtggtccggcaaaggttgtgtggtatctaccaatcattgatcgtttcaagagaatatttgccaaccccaatgaagcaaagttagtacgttggcatgccacagagaaaaggaatgacgatttgctaagacaccctgcggattcgattcaatggaggaatatcgatcgaaagcacaaagactttgctgccgaccccagaaacatgaggatatgtttgtgtacggatggcatgaatcctttcggagacatgagcagttctcacagcacttggccagttctcattgcgaactttaacctcccgccatggttgtgcttcaaaaggaaatatattatgttgtgcttgttaatccaaggtccgagacaacccggcaatgacatcgatgtgttcttgaagcctgttatcgatgaccttgagattctgtggaaagagggtgtggaaacttgggatgcatatggtcaggagaacttcacactacgagttctattgttctgcaccattaatgattatcccgcgctgggtaatctttctggacaaactgtgaaaggaaagaaggcatgctctgactgtatggaacatacacgtagtaggtggctgaagaaatcaagaaagatggtttatatgggtcataggagatggctccccctacggcacacctttagaagaaagaagaaaattttcaatggtaagaaagaacttgggtctgcccctgcggatttgtccggagatcaggtacacaacatggtgaaggacattactaatgagtttgggaagaaaagaaaacgtagcaaggaggacaagaagaggatgtagaagaaaaaatccatattttggcggctaccatattgggaagatcttgaggtccgtcattgcattgatctgatgcacgtagagaagaatgtgtgcgatagcttgctggggctattgttgaatatgcctggcaagacaaagaacgggttgaatctgcgtctcgatctacaggagatgaacattcgcaatgaacttcatcctgttacagatgagaatacgggaagagtgtacctcccaccagcttgccacatattgttgaaggatgagaagatcgcaatgctatcatgtctggcagatattaaagttccttcgggctattgcgcgagaataagtaagtacgttaaattggaggatcttaagctggttggaatgaagtctcacgattgccacgtgctaatcacacagatcttgccagttgctataagaggcattctaccaccacaagtccgtcacacgatccaacggctttgtgccttcttcaatgcaatcggtcagaagattatagatccagaagacctagatgggttgcaggctaatattgtcagtaccctgtgtcacttggagatgtattttccactagctttcttcgatatcatggttcatctcactgttcacctagtgaagcaaacaaaaatatgtgggccagcttttatgagagaaatgtggccatcgagaggtacatgggaattctgaagtcctacgttcggaacagagcaaaaccagaggggagcatcattgaaggttacacgaccgaggaagccattgagttttgtatcgattacatggccgagactgatcctatcggagttcctacgtctcgccacgaagaaaggttggcaggtgtcggcacaactggtagaaaaagaattgttcccgatcaagcttcctacgcgcaggctcatttcgcagtgctgcaacatatggttgaagtaaccccatactttgaggagcatttagcgaaggtccgacaggacaatattgatcgatcagatatttggatcaacagagaacatggtgctcgcttcaacgaatggttcaaggatcgtgtagcacggtcgatcgatggcccaagtgagatattacaaaggttggcaaggggtccatcttgggatgtagacacatggcaagggtacgatatcaatggatacacattttacactgtcacacatgatgagaaagcacagtgcaaaacagtggagtccgtatagatgcatatcaggatcaggttggatcgagcacatactacggccgcatagagcagatatgggagctgaactatctgaacttcaaagtccctttgtttcgttgcagttgggtgaatatccgcacaggtgtcaaggtcgacaaggagggcttcacattagtggacctggccaaggttggatacgcagacgaaccattcatactagcgaagcaggacgaacagattttctacataaaagacctcgcaaacaagaagatgcacgtcgttagggatggcaagcgaggaattgtgggggtggacaacgtcgtcgatgaagaagaatacaacaagaatcttcatgtcagacctcatatcgaccttgacgatgatcccgaagacaaagtggcttacgttcgttcagaccatttggaaggcatatcactgtgaatgatgtatttaatttgtattggagacttaatgaatgaattgcatatgtttcatgccattccagttaaaactctttgaagaaatggatttgttaattatgtggttttaaaaaactatacttgttattttaaactatatgtgagatagccaattgttaattatatgaatttaaaaagagtaatatgaattttaaactatatgtgaaaaaggcatttgtcaattagatgattttaaaaaaataataggaattttaaactatatgtgagaaaggcaattgtcaattatatgaatttaaaaaattaataggaattttaaactatgtaaataagacatttgttaattatatgtgataaatcaaatgcaatagcaattttaaatcgggtagaagataattataaatgatttttataacttaaaaatattttaataagtcatctgtgacaggctttagtactatgcccgatagagattattccatctctatcgggcttagttctaatgcccgtcacggataggtatcatctgtatcgagcagagtactaacacccgtcacggatgagtgtcatccgcatcgggcatagtagtctgcccgataaagatgaggattgactagggtttacttagtcaatcctcatccacgggtccttatccaccgccgacgccgcctctcactctctcagatccaccgccgccgccgcctcctcctcctccgccaccgctgatgccgcctcctcctcctccaagccgtcgcctcccgaccgccgccgcctcctcctcgacgccaccatcgcctcccggttcaatatccaccactgcctcctccatagtcgtggatccggccttcctgaccgcccccgccgcctcccggttcaagatctgccctccccgaccgccagcgcctcctccacgcccaagaccgccgccgccagcctcctctccaagttcaccgccgccagcttcctctccaccaagtcgtcaagaccgacgccacggccgcttcagcgactgacgtcaagcccgccgccaagaccgacgtcaagcccgacgccgccggcctcctctccaagtcctccgccgtgaccggcctcctctccgccgcttctcctcccaggtacgcttcctctcccttgttttttttattcattgtggatgcattgtggacgcagtgtgtggatgaattagatgtatggatgcagtggatgcagtggatgttttttgcattgtatagttggatgaattagatattgctatgc

SEQ ID NO: 71204 - DNA, 739 bp, Oryza sativa
ctgtagtccacgtgtagccagcgcggggagaagtttggccagccagttagtcaggtgttggagtgtatttttgatccaaaattgccaaaatttaacttgaagagtgggataaggaggctgcctggacatgcagaacccgtagtccacgtgcctgtcgtattccttcgctgccatgcacgtcgtctatggtgttgcaccgataccccactcacgggcgagtacaacatccaactgtgaagtccaaggcgacatccgcagcagtggcggacggcggtacgacactatttcaaccccattatttcgcttattcatatgcttatccaaatcgcttattagaaaataaaaaaatatttgtgactaaaatttttatattcgtatccttatatactcaaaagcaaatgttgtaaagtaaactacgataaaaaaatcaaattcaaaattaaattctaaaattaaaattttggtttataaatataagtataagccaaacaatgatgccctttgcctgtctggcttggcaacgcctagaggtacaagtgtgagtgagtccccttgctctgcttcttagaggtggggatcacaagtgtacgagcagaatagtgtactacctctattctaaaatgtactaatataggattaggaatatgaacattataggatgtgtgtaatctaattctcggtttctacattttgaaacggagagagtaaagttttctatgggcccattccgacagatctg

SEQ ID NO: 71205 - DNA, 616 bp, Oryza sativa
gtgggctcgatgatggtgccgcctggctgcagagcgccactgcgctcggccgcctcgaccatcgccagggcgatgcggtctttgatggaaccgccggggttggcgcgctcggacttcacccacacgttggcacccgcgccgaacaggcgattgatgcgcacatggggggtgttgccgatggtgtgcaggatgttgtcgactcgcatggtgtctccagggtagagggtgggaatccggcaaagcgggagaggcgtccattgtgggggagtcgttcagcggcgtcgcgatatggatattcccgctgtggatatggcgccggcgtgaatcgtccgcctgtgggtcggctcgattgatgtgcatcaagatttgccggcgcgtgcgcgcccgcctgcgccatcggtcgggtgtgcgcgcgacaatggtctcgtcttcactttccctcctgcgccatgaccttgctgcacaccaccatgctcatgctcaccgcgagctgtgcgctgatgctgatcggtttctcggcgcgcgagtcgcgctggggcccggcgctgatgatggtgggcatcgtgggcgcgctgctgctcatcgcctacaacatcttccagttattgcccgcgca

SEQ ID NO: 71206 - DNA, 18590 bp, Oryza sativa
cataagaatagaccatatacacttgtgatttttgggttttttcaataagaacagaccatctacacttgttcattttattttggggggggggagtggcagtatgggatcattttatatggctgttgttttttttttttgcataaggacaaaccctctagacttgttcttatatggttctttgcaaaatttttgggatatttttggtccaatgggatggatgaattgatgtgggttgtgatggttgaattattatggctgtttcttttttgcataaggacagaccctctacacttgttcttaatttcttttgggggtgggggcagttgcaaatgatgataattgaagcataatttctgagcaaaactgaggccaaacttattatatgtcatgacttgtgttttttaggtacaaaaataatatatatgtgacttgtgtagtatgggctgttttgggttattttgagggaaatgggatggatatgcatagaaatctgttattaaatgaagttactgaaattatggcatttaggagaatacgaagtgtcctggttgccaaatctggtttggtcaggttactgcctgcacgataccgaccaagacaaattggtaaacagaacatttcgttcaaatacaacatttctaaaaatcttttatcgttaccaacatcctagattgctttcaaggtcatttctttatggaccccattcccataaattcagtatccaaagatggttgctgtatctatgggaataagggttccataacgaaatgatcttggacgcaatctaggagtttgctgatgataacgttagggatcttggataggaagggttttggttgcctgtgtgttctatctgcatccacctcgtcagcagatatgtagcatccatattcctcagcagacgggatctcgacctcgacattcatatcccactagaacttgctaccgttgccactttcttatgttagtgacattggtagcaagttcgagtgggacactgatgttgaggccgagttcccggctgctccggctctattgagcatggatgctatggttccgtcgacgaggcgaatgcaggtaggagatagaggtatatcaaaccataagagaatgtgtttaaaaagtactttctccccgtacaacagtgacataggacatgtcgcagcaaggcgaaccgatgtcgacaaccactattgggactacatcgagccggaatcctaggacccagaataagattcctaaggaagtctacaccataacagaggtggacgatgttggatatccgacggctccgacgaaagttgtcaaaaagttccctacgatatgcggagtcctagggaggcggaacttcactattctgaaggaccacatcgatctggtccctcaagaagaaaaagaagaggcctggaggcaattcaaagaaagcttccgataccctacagaggccgaggcaggactgaagcggcaggctatccgcaacatggggaattgttggaaaaatttcaagacaacgctggtcacggagtatgtcctcaacctcgcccagccagaaccatttgggaaatacgcattcatcacccaacccgtgtgggatgagttccatgccgccaaatcaacgaaagagtctcgggaaaaaaaccagacctaccatgatctgcaggcaaggaaccttcacccgcaccggcttggcaccggaggctacacggggaaacaggcagaatgggacaaggaggatgaagctgcagcggaatctaacaccccgcaagtgcttgctgatatcccggtccagcgggcaaggaactgggcaaggacaagggtgaagaagaatagtgacggaactctttcgttcccaaatcctgaagatcaagcggtgtaccagaaaatcgtaagttgaacacatagaataagtttcattatgttgtatcttgttcttcgtctaacgcgtcctaactgtaccccaggtcgaactgaatgctgagagacaggcctcccaagaggtctgcccacaaaaacgcgaggatgacattctcacgaaagcgttgggaaacgaagaacaccgtggacgaacaaggggcattggctccaatgttccatggaagtttgggtttccccaatacgcgtggcagtacaagaagcacaagctttccaaggcgcagaaagctgcacgcattaaggcccaacttcgggaggagcttaaagaagagcttagagaagagctcactgccgagctgttaggtatagaggctcagatagaggcacgcatcagggataggtcgaccgatgccactcccggtcccatagtacaagtgagccccacgcagaggcatagcagctgcgcatcaactgaggctccggcagaacagcctgaaggccccgccacggtggaccacataacggtaagcacaacttaataacacatatattatattagcaccacaatacattgcaacatatactaaggacactaatgaatctatcgcaggaacccacatcgtgtaccctagtcgttagggtgacaccaggatttgcaattcctgccgcagagggtcaagcattcaagcctacccaggagacccgagtgcatggggcgcagctgcaagccggcaatgccaaagttcaggtggacttagtgaagcccgattgggttggctacactatcccacacccacctaatgacgagattctgacccttggggctgcacgtgggacctttattcaatggcccaagcacagcattgagatcaatataactccaaggctagcgccaagttctcgtccgccgccgacgcgtccccatcaaactgttgtatctctcccttctgccgttgaacaaagagatgaagatctccaattacagtatgatactgattttggggacgacggtatggaggttgacagcaggccgcacctcccccctcctgccaaacggagcaagagggcgaaatcttctccacccaagcttgacacacgcagaaaagctgctggaacggggagaggaaaaataaaggtgccattagccccaaagaagcttgatcttggcaaggcgccagtagctcctccaaagcctctagccaaattcatattgggcatgccattggtcggagacgatgccttattcaagatgggccctgcttgcaaggagttgcataggtacatggagaagtccaacgcaaggaggaagaatagagagacctccatgttgggccagcacgatggtcagccgttcctcgggcctactgccttcatcgccgtagacttcaaagatctatgggacctctacagggtgcgagcgatcgacaccaacctccttaagtgctactccttgtaagtatttgttagtacgcgatatggtagtgactgtccataaattacgcttaccctgactcttgtcttgctcgtaggttaacctggaagcatgtccatcgtaaagcaccccatgttgccttactcgatccagctgtcgtcaacgagacaacgctgaaaaacgatcgagcaaacatagtggcctatatcaaggactgcttatttgcccgtcaagacaaggacttcattatgtgcgcctacaattaacagtaagcatgtaccgtacttatactcaaatactcaacgcgtacaactgtagtatgtaactggcaatttaataatttcgcgggcgacattggattcttctggtaataacgccgaagtggagtttggtacactaccttaagtccaatatcaagccagaaatatacgattggtcggccatcgaatctgccttgaacgaggcatgggaccaatacgtggcaagaggcgggaggcataaggatgggcatcccaaactcggtcacaagaaatacttcccaatacgtcaacaagttggcgaccaatgtgggttccatgtctgcgataatatgaggagcttcgcagacaaggtgacattgctcgaccctgaggtgtgtaattcaattgtttatacacacataggacgacaaatttacaagtatgtagactaacttggcgccgaacatgcaggaatttatttcaaggattccggaaatcaacttcgaaatcattagagaggagatagcacaattcatactagatgatatcttgtcaccgaaagagatgtttagagtgaagtcctaggtagctcatctcggaatggcagaacatttgcaatgcatatgcgacaaacatttgatttttgtaaatattctttgtaatacaattttattctttagagtaaagtcctaggtagctcgtctctgtatatacttgcatttctagttacatataaaattgttccaatttataacttatttttgcaacttttgatgcatgtcggcggtttggagagaaaaatatatgtgaatgacatatatgtgaatgggttgtggatgtgaatgtatatgtgtttgattttgtgaattggctgtgatgtgatggaatatgaatgtgaattggctgatgtgatgctgggaatgggtctatatgaattggctgtgatggaatatgtgaattgatgctgggaatggggttgctgggaatgggactatgtatatatatgcttctgtcatttttgcagtgggcatggctagcaaaggcctgaggctagccaaaaagacaaattttattttttttggttctaaactcatccctgacgggcatttagctaatgcccgaaagagataactcatccgtgacgggctatagagtcctgcccgttagagattagtcatccgtgacgggcttttagaatacacccgatagagataagtcgtccgaattggactagtttgactcaacacgtggggtcaaacctatcggtgacgggctctggctaaatgcccgatggagatgactactcatccgtgacgggcttagtggtgtgcccgattgagattagtcatccgtgacggactcctaactacgctggtttgactgatcatactcatctgtgacgggctttgtttttggcccgattgagataacatccatccatgacgggcttttgcccgattgagatttttcctcacatcagtgacctttgcccagtgacgggggccttacccgacaatgatgatgctttcagcccgtcatagataagcgatcccgttctagtggtagcaccaggtagatgcgatcttcgacgactccggtgatcttcggcacactccggctgggtagcatcacgatggccttcttcagcgggcggctgatgatgatgattagtcgacgaagatgagcgctgcttggtagcgcctcggcgactcggcgaagaatagtcatcgcggacagagggcatgacaagtcagtgtctcacagcgactcggtgaagaatagacatcgcggacagatggcatcacaaagtccggcgcgatgaagcagaggcgtagtagccgaacgacacgacgacggtgtgcgggctccgggtagcggcgctccgaccggcgatctcctcgagcgtgaggaatgaggacgagcgtgaggaaaatggccaagtccgcgagagcaagcgagcatcgatgatgtcgcgaagagactgcaactggcaaagcgatgtctcgacagcatcacgtcgccgggtagagacgtcgcgaggtagaggtctcgtgaccggcgaggcggggacgtcccggcggcagatagacgtgtcatcggcggacggcgtctccgacgagagggaacgacacgatctccaggaggaagcagcagccggcagcaactcgcctcgtcgccatctcgtgcatgcatgacgacctgaaccgaaagagaagaaaacaaagagactcaagaggctatacccatggtgcggagattgccgatgcccgtggtttagcgccggcttcctggtcgctggtgaggcctcctcccgctgagccggtcttgcccggctgctccggcgaggctgcgtcggcgccgcgatgaagcacgccgctcttgatctcgatctcgtcctgagtcgttgccggcgtgcaccactcctattgctggcgagatctcctattgcagggccgatcctgtacggcggctccggcgaggttgcgtaggcggggcggctgtcagagcaagacgccgatggttttctcctccatgaccttcatctgtgccttctgccctcgcgagtgacgccatgcatgactccggccgcagctccacgatgacatggtgtgatgcatatatgtgctgattgctgaaagcctgaaatacagagagagagagataaacaggagaagaactggacaatgttagatgagatcgtcctagaaggagcggcgtcatcgtcttctccggcgagattccgtggattggcacggcttgttgacgtccgcggttgctcggacgattcccggcagcacgacgtggtgcgttgtcctcgctgcgtggcgacgggccggtggtgttgccgagtagaggcagcagttagcgaaggcggcgacgtccagcgtctcggcaagatcgtcgcaacgagtagaatcatcaccggcagcaaaaacagatgagctcagtcctgaggacgagtggcatcgatcttgacggaggcttgcgatcgatcagcaccaacagatcggtcgacacgacgactccggcgatggcagcacacccggccgtcctccatgcatgcacgtacgcactggaaccaaaagaaagtaaccaatctaattagagcatctccaagagtctagctaaatggctctccaaattaaaatttggctaacttgctccaacagagtagccaaatgcctctccaagccatccggctggctaaattccccaccagactagccaaagttgaccagccaaaaccggctagccatatatgggacccacgcctgtttccccctctctcttcacgcggcagtgcggcacgcacatgtgacgaggccacgagggtgccgtcgcctcgtcgtcgccgcggccggccccgccgtcccgtcgtcgctgtagtcgaccattgccgccccgtcgtcgccgcggccagccactgccaccgccaccgccgtgctccgccccgagctccactgctgcccccctctagatccgccgtcgaggtcgtcgtgagccgccgctgccgagctccaccctgagcggcgtcgagattgttgtcgcgagccgccggcatctcgcctcctgcctccccgcgttgccgcaccaccacgcgcggccgcacgcctcctcgcatcgctgcaccaccgccggcgaagagagtggcaccggcgggcggagcccgagcggcggcggcggcggtggatggcgacgcagcccgagcggtggtggggatggggatgaggcggcggcggcggatgggagagggaaggggggtttggagagaagaggagaaagatgagggagaaggaggaggtgtagaggctgacgtatgggtccaattgtcatagactcagaatagagaggacgaatgaagaggctgttggagtaaaaagacagtttgatttgctaaattaaatggagagttggcgaaatagacatttggagagtcaaatttggagatgctcttagctttaccagtagtggccattagcttgctgttcttcctcgcgatcctgctccccagccgacggaaggtgttgatgtagatggacacagcgcgcggtcggccggtgtcgacttgccggactgatcctccttgatgtcgcttcttgctatgacgggggttgagtgattgtagatgaatagatgagtccctctgagatggatgttgatgaatgtggatgacggcgacgggtcggggtggatgagtctcgatgctctcggcgagagtcggatgaatatatgtcgatgctgcccgcctggctgcctccgtcgtcctccatggacgtcgccagtagcagcgccggtgagaccgtctacgcctcctgtgctcccctccatctctcttgaagccccccgtcatagctgaggatagctgtgccttttataggcacaatgggtcggtggtggccgcgagtagcgcgcggcgtcgttgccaacaagcagccccgatatctctggagataaagcttatctggttgtttccatcgatagagataagaacatgatctcttggttgtttagttttgctgttgatcgatatcgatggaggcctgcatacgcgtccaccttgcccgcttgccggagtatatatacggtcacatatacagctggcccatgtaatcagagcccatcggcccatgtgtgtgtattgctgtacgtagcgaccgatcgagttgcagatggttccagctacccgtatatatatacgtagaccaatccatgcaatacggccgcatacagtttcacgtaaacgtccatgcacatatatatagacgtgtgaaataatcagcctcgatcttgtcctcttgctagctggtttatttgctctcatgcatgcatacgtgtatatatgtatagccaagcatgtacatatggctgaacacacacatgtatatataggccatatagatggacatatgccaagtacgagcatgactcatgcatgaatcaatatttagttagctgtcttagcacattggcattgctagctaaaccggttcctgaaaatggccattaaaacacgcaatatatatatatatatatattttataaatatgtacaaaataccgtcaaacaacagtacaaacagatatgaaacaactacactatttcattattgttccattatcgtgacacatgttgctctcataaattcaaggctttacggtttcaagtaaatatgtccaaatcagatatttacgaaaatatgtttaaaatatagttaagatctattttaaaaatatcatctacacgtaaacattcgtaattaaaattcaagcaacattaaataattgcctgcgcgtatgcgtaggctacctttctacttatataaacgattaacacagcaaatctatctgaaaaatacatcaggtccatcacgactgacgacgatagaaatgagaacaaccctattacaatacatcgatacttattgttacatcaccaagacataaacattggataaactccttatttcagatgtactagctactctcttcgtttcagattgtaagactttctagcattgctcatatatatttagaagttaatgaatctagacacatatatatatatatatacctaaattcattaatatctatatgaatatggacaatgttagaaagtcttacattgtgaaacggaggatatagtacttaatttgcggctgcctttcttgtgaatcttgcccatgaaacggccaccaaaacatatgtcttgtcatatagcttgtcacagaggtcgaagaaagcaactctccatgctttcttgaataataggctgcataagacggcccagagacttaatataaatcccagaataagtccaaagtgaaaaggctctagctgatggtcttggccattatttattgttaaatgaccttgttcgccgctggaacagtttttccgaagaggaggcccacaaagaccattgttgccttcgtacatatttggattttctgagtagagccttatgagacgtctttggcgcaagaaacgtgccaacaatccaaaccacaaaagcggttctgaaccatgagttcatcccatcggggaatgtcctcctgatgacttcctctgcacccttcaaagcgctggcctcaaaccctggagccccaatgtagtgctgtacaaaagaatccttttcatctttcgagttatccggcattggacacacctccatgccctcgaatggtatcccaagaaccctatgcacattccttggacttaattccacatcaaggttgttccccacccttagagtcctgctgtcgcaatttactctgcttagtagccatctggtgaatcttctgtcgatgccatttatctgtgggagttcaagcaatccgccaaacccaatactgcgtaccagatcagacttctctttgtcaaatttgccaatcaactcagcagcatgctttggtgaactcctgctagtcgccccccatacttcaggtacgttccgactgggtgttccggctcgttggcgcctgggaggggggttgcttcagactgatacgagtctcgaccgacagcaactggtgcttgtgcatgtctcatccccggtttggccgctgtttggccggtggtgttcattgtgataacaacactcctgcggtgcgacggtgagaaaaaaaaaaaaacaatcagaatcccctccgaggaaaaacaaataaaaaaataaaaaaaatgacaaagagaaggcggcgtccactatttgacacacagcaaaacgcgcgagtgtgttcctggccgtcgtctccacacaatctatgcgtctaatcttgtatgggttcctctggtgtgcggattggggaaggggaggaatgtttgtgtagggtttgggggggaggggagggaccgatttcttccggcgagatccgccaaagtcgccggagttcagctatcgccggtgtcaatcaagaggagggcatggcggcggcgtcctggttgtggacaagacgaagggatgggggatagaaagggacagagagagcgaacaaaaaaagaggaaaaaatgcataaaactgggacggggtgtggatcgatccgtacgcatggttgggaccacatgcgtcgtgtagctcttttgtatgtgggcccctaggtgtattctctaaaatctgatttactggtaaaatacctcctcagaacactatatacattccgcctcgtataggtacgtgcgaatcttgaagcagatgtgcggtagtccgcctaggtgcagaaaagagtttcccaaccagtaagatcaagtaccctcaaggaagaaaccatattcaccacatgaggccaatcaactactataccatgctaaggttgacgtctcccatgttgagataccgtaatcgtcgtaggcgtgttacccatgatatatctggtgagtaactatttgctgtgtaagagaggtcaagaactcgcaggttggaaagattaccgaggtgaggaggcaccagaccatggaaagggatcccagagagattaagatatctcaagcttttcagagagcccagaaactccggcatatcgccggttggcccttcaagtgagttgtggctgagatcgaggtgctgaagatggtgaagagaaagcagagagtggcttatctcgccgaacaatctcattgcaaacgggttgatgctttccctgctgccaaggttaagcttgacgatatgccccgtgcggtcgctgcaacggacgcctgtccaccggcagcagtcttggccatcttccggccgccatgacgcgaggaggcctgtcgtgtcgtcggcgatgccttccttgaactccaacagcgcgtccatctcgcctgggaagcagccgccggagccggacggccgccggagttgcgtcatcatcacttgcaacgccgtggccgctgccggtgtcagtagcaacagtaccgtggtggtggtggtggtgatggcaagggacaagaacatggcagtgaggaggctcatggtgtagctatctccggtgatcgaatcgatcgaccagttttagagaacatgaaaccgtactcactaacacagtccatggctttttaacccaccatcagacgaagctgcgctgcgggagcctgtgcgtacagtctgtctagtggataaaattggtggtgtttgaatctcatgaagataaacgattaagtgtttcacgcaatacgaggtggtaataacgtgtgattaattgagttttaattgttacaaacttgaaaaatggattaatctggtattttagattaactttgatatacaaagtattcacacgaaacgtaccgtttaatagtttgtaaagcgtgtcacgagtatccgaaatttaatcgcgagctgattaatttccatgtcgtacgtgctcgctcgctggtggaaattaatctcatctgtggaaaaataaaaaatttctccgcgactagctgactagcgacctacgagtattcttttcttccaagctgccggtttttgtcagaaaattgcctagcgtcaagggcgggtacagacgtactctctccgtccgcataatataagggattttcgactttttacttgtaatgtttaactacttgtcttattaaaaaatttatacaaatataaaaaataaaaaaatatgtttaaagtactttggataataaagtaagtcacaaataaaataaataataattccaaaattttttgaataagacgaatagtcaaatagtgcaagcaaaaagtcaaatcccttatattatcggatggagggagtttatctatctattatattatatactaaaagttcatgaaacatcctagctaaaaacactcctaagttgacacatggcactcctaaaaatactccaagccatcaagtggcactctaataaattagataaacatctaatcatcgattttcactttaactaggtagacccatcagtttttaccatcagattaaattctcatctcttcaccctaatatatgacgatggttgcttgctttggtcccaccaaaataataattaggagcaatcaaatgcatagaatcagttgtttctctcctaaaaaatcaccgcataattaattcttggaaagaaaaccgacgttgtggatttaatgcaggagcctgggtgcgtgcttccatcattcaaaaaaaaattgtaccatcgaaaactttttaagtgaatatcacatttgcatcaaaaaaggtgaaaatcactaactgttctaaactatttacagggttcatattcatgaatattgccctcagtagttagtttcagaattttcctgtatctgtttgattaccagggcctgatgaatttttcacggatgctaattctcactagattaaattttcatctctcctccctaatatatgatggtcgcatgctttggtcccaccaaaataattaattaggagtaaacaaagtagagaatcagttgtttctctttctctcccgaaaaaaatcaacaaataaattttcagatgtaaagccataagaaaaaaaagcaatgcgcctctagcccactttctcaaccaatatcaacgacatccttttcaggaacaagaagcaacaaattaaccaagtgagaaataatcctaatcgtatcaaacaggtgagtgatgcaagcaacttccatctttttattgtttgatctcttaacatagccttccacttctctgtttttttatgcatataatttcgcttttttacctacaattttatactactccgtggtgatgttgttcatattctgatctgttgctactagcttctacaacaaagtgatatatcaaagctgaaagctcttgccccttggacaatatattcactaatatcatgtatttgggtgctgtcagttaatttttgagcacttagtcaaggcgccttgacactgcgtgctttgccaccagaaatttgttaattgattttttagataatcattttggaagggtaatgcatgccgcttttttttaaagaaatatagtaccaacacaactgctcatatacacacacgtacacttatccatagaaatcatattcgagagactgaaccaatgatatatatatatatatatatatatatatatatatatatatatatatatatatatatatatatcttcaaattaacaaagtcaccacaagcgtcttgctatcgatgagaatatcgcctactgcaagaataattagccgtaaatatgatgcccacgtcaagtctaggtcttgaacctatgtaggtaagttccaccatatgtaacttagcagccacgctcactaattgcagataatgtggaccgcctcttccctatcctttaactccttttttccatatattatttgagataacatgtagtatataaataataaatatactactataacttttaaattatatatacaatttttatattcgaccacaattatattctttacaattaaatcaatccatatttactatattttcatttataaataataataaatattattttgatccatgatttgaccctttgcgttatatctaacataaaaaaggaaaaacataggttatagtgtcataaattactaaaactagatctaagatgtttgaaaataaagtttactatattatattatttaccattaacttaatttatgatatatattaactatactttaatgtgtaaaataaaattatattttaggacttttttattctttttctggaatccaaacggacatgaaaattataaaaaatatgacaatatggagtatatatcactatatattctttatcggttataaaaatatgtaccactaaattagatttacaatatcaacaagaaacatgtcatgtcttttccctttacatggcatttgataattataacaaatcgtgaaaaaaaattaatgatatatgtaatatcatcacataaatatgcttactatgtagggtgcactatatttggcccatatcatttcacaaatgtgcatgactaaattagatttacaatgtcaacaagtagcagttcacttccggggccttacatggcaattgagaattatatcaaatcatgataaaaattaacaatattgattatatgatcatataaatgtacttgccatgtggattccaatctattcggactatacggggataatctaaagagtccattctatttaccaaatcatgtataagttctacgttttgtagactacaccctaaataataagtaaaataacggatggagtacatgtcatgtttttcccctttgatttcagttaaatacgtatggtgtattttgtatatactaagtttggttaattagggaacataaaccatactaaagttaaatatgagaattcatgcattaaaaatacatttcataacaagaacttacttaacaaaagtgtactttagtctatggtgcttaaatatttataaattctctaaacatactaattatttccgcacttatttcaaactaaattcattttttccacataatataaggagtagaagtaaatagaagtttgccattaaatagataaaataaagacatctataatatacaagaaaatttgttgattaaggtttataaactccaaagtaagatattctaattgctaaaaaaacacacacttgggactcgtaatagttccatgtgacggagcactattgttgcgacacaatagtttctcatcaattaaaaaccacacggtttaaataattttggtttagaatttacatgttgaaaggtaattagaagaaaattaatgacgttcacaacaatctcaaacgaattattgattaaaacatgttcagaatagagtaaaagaatattttaagaaatactcatccacatataagtattcataattaaaattcaagcaacattacataaggtgcctgcgcatgtgtgcgggctaccttcctagtttaactaaaatgtctgaaggaattgaatagcttatttccttaaaataagggagaaatcagcaatggtactggatttgtcaagtgactaggttcttcaaacatgatagaccattggtggactaacactgtgtgaccactaactgacaacagaatcagtaagcatcacaaacttgacagactactgtggagtgtgcatgtggtccaccttaaatttcaactctgggttaggacttaaagtgatcatgtggtccaccctgaatttcagagtgggtctgaatttgtactcttaacaaacagtcctcatcatggcatctatgtctgggaagcaaattaaagagtctgacaaaatttaggctcacatagtgttgatttcacaaagatcactgtactagtttactgttaacaatcctggtacagaatttccttgccatagctgcattaaaaatcctaaaattcaagttgaattccaggtctattgtgtgatacgtatcacatgacttgccatatgaactaccagccaatgatgttgagatcatctgctttgtcctagcgtgccaacatcttgtccccaaggccaggctatctgttctatgaaggtgcccgacgtgttcagtggcatggaggtcaggtactttgatcttctcccagagagctaggaggttgatcttgatggagtgcaggctcttgctgacaaaaacacggttgcaatggtaattgtcaatccaaggaacccatgcacctatagctaattaaggcaagtactaactcagttgttcattttttgattggtgattgggaattgtcatagtgtttgatcagtagtctctgttttttctaggttgccgagactgcaaaaaagcttggcatctttgtcattgcagatgacatgaagtgtatgcacatttgacgttttggcaaaatttgtgcggatgagcgtctttggctcagtggctcagtagatgggttgtgcctggatggcgacatggatggattgtgacaagtgatcttaatgatgtatttcaaaggacaaaaggttcttgaacccaactctttcatccatgtactactgaaatcatcaatgaaatacatgaattttttagttaatttaacagacaatgtagacactttagatgaaacagcaaatctaagcttaacgaaacagcttagattcttgaatgatctaaaacctgaaccttacaatcagcaaaaattctgagtcctggttccattttcaggtagtggaaagcatcaagagttaccttgatacctcgtctgatcctgaaacatttgtccgtaaagatggaagcgttctcacctcccggaggaggctgcacctttgtatttatatgtgtcaaaaagagcccttgacgtggcttacaaacaatgtgataagatttgttacatcgtatgttatccaactcaactaccctattatctagctagatcaactaactagaagataagatatacattgttttacactccccctcaatcataacttggccaagttaagattgtacatgaaatgccgaagattctgtgtagacaatgcttttgtaaatccatctgctatctgatccttggtaccaataaatctgatatccaacattttattggctaccctttcttgcacaaagtggtagtcaatctctatgtgttttgttctagcatggaagaccggattggatgataggtaggttgctcctaaattgtcacaccacagaactggagactgatctatctttactcctaactcttccaagacagaccgaacccaaattaattcagcagtagcattggccatggctttgtattcagcttcagtacttgatcttgaaactgttcgttgttttctagcactccatgatacaagatttggaccaaagtaaatcacaaaccctcctgtggatcttctatcatctagactaccagcccaatcagcatcaaagaaagcactgactaaagtagaactatattttttgaagtgtaacccaacaccaacagttcctttaatatacctcaaatacgtttaactgctaaccaatgttctgaagtaggagcatgaagatactgacataccttgttgacagagaaggccaaatccggtctggtgagtgtcaaatattgtagtcctcctacaatgctcctgtacctcgtgctgtcttctacaccaagaggatcaccagtatgcaccatcaacttttcagaaatggctagcggtgtaggagctgttttacaattttccatgttaaccttgactaacagatctgaggcatactttgcttgattcaatattataccatccggaaccttcttgacttctatgcccaagaagtagtgtaaatcacctagatcattcaaagcaaaatcagacctcaaatccttgagtaacgcagtacctgcattacttgaggaacttgtgacaataatatcatccacataaatcatcatatatataatcacaccatgcttgttataaataaacaatgatgtgtcagctttggatgcaacaaagcctaactgaattagcttgtgactcaacctggaataccaggctctaggtgcttgttttagaccatagatggctttatcaagtctgcaaaccaaggttgatttaccttcataccctgggggttgcttcatataaacctcttcttctagtataccatgcaaaaaagcattttgcacatctaattgtctaagtgaccatcctctagagactgcaatgccaaggactagtctaactgtagcaatttttactactggactaaatgtatcttcatagtatattccatacctttgcctgaaccccttagctactaaccttgccttgtatctgtctattgttccatctgcttttctcttaattttatatacccacttgcaatctattatattcttaccttgtggcatttccactaaatgccaggacttgtttttaacaagtgcattatactcctcatccatggcttgcttccagcgtgagtttcccaatgcctctttgtcacgcccggaatttctatctaaaattccaaacgcttacatgtgtgtgaaccctcatcaggaatcagccgaggcacacaataacaaattgataatagagtacaattattactctaattaataagcgaataaaatgtcattacagaggtagatagttcct

SEQ ID NO: 71207 - DNA, 1472 bp, Oryza sativa
atgaaatgggttttataattaatgtatgtttaatactccaaattagtgtccaaatatccgatgtgacaggtacttggaataagtcctggaaaccaaacagccccctaattatcacccgtgggtgaacgggggcgagccgaccgcacccttcatctcccaccaatcgctattattgcctgtgagtgaggcacgctgtgcgggccccagtggtgcgggtcatcaaagaggccagggacgaggcccgggttcatctcttctagtaggatggggccgggtggactcgcagggggagcagggtggacccgcacctgtctcgcccccttgccatacctagttcttgcagctcatcgattgtgcgttttgatttgagctcagctgatgctgatggcagctaaggatcgattagacgtgtcatagtgactgctttgacactgcaggatcagcaaccagtggcgaatccatgatttacatcaagatggggctaaagcaaactagatatatcagcacgatcagcatttctctatgaaacccaaatacactacgataaacaaagagataatccatgaaatgctattgacaaacatctaagtcccagaaataccatcgacaagtgtgagttctaagacatgccatcgtacaaatgtttttgtcccaaaaatgccatcgccgttaggattccgtcatatagaatttaacggcgcgaaatggacggaaccctaacggcgatggcatttttgtgacaaaaaagtttgcacgatggcatttcttggaactcacacttatcgatggcatttccgggacttagacgcttgtcaatagcatttcatggattatctcataaacacaagacgttgtcttcttcatcgtaatttgcactgtattaacatctatccaaaaaatttatgaataaaatgatatggtatactccttccgttccataaaaactaacgtaatactggatgtgacacattctagtacagtactacaaatttgaacattcattgtactagaatatgtcacatctagcccgagcactacttaaaaaaggcaaatagatgtcgccactataggtgccggcacacaaaacaccgacacctttatgtccaaatatgtgccggtttttaaataaaaccgacaactaaaacctatgtcagagaaatgtgccggttctagacccaaaaccggcacctttaatcttctccctcccccactagccgttggcgggccccatacataggtgccggttctcaacccaaaaccggcacctttgtttcaatagtgcttttatgaacgacggtggccctacacaagggtaccggttcttggtatgacaagacaaaggtgtcggttctcgaccaaaaaccggcacctttaatattctccctcccacactagctgctatgtcacatcctgattttcgttttaggatttataaattatttaataaattattattagaatttatattaaat

SEQ ID NO: 71208 - DNA, 3749 bp, Oryza sativa
ttctggtactgcgaaaaattcaggaacacgacgtagtgtacgcgtcatgtgcatcctgcagctgcaaataatcgaaattcctcttccaaccttgcaattcgaacttgggatctgctgctaacactggatattgattaagagtacatgatggtagttaggctggcatgattggagcatcttttttggtgacattaaggagtcagcagaagcaatgttcaagtctgagctgatcctgctgcatgcttgcctagatccctaggttgcatgccccctttgcctttttttcccgattactgagcgagctgagctgcacgattcatgcactactgctctcaactgtggcatctgatccatgcgcagtagctgcagcagaatctagtgcatgccctcacttcattcatcgcaattttttcaaatcgtccggcaactccgcgaaccgcaccagccgcggcaaccccatagcctatgccgccgccgtgcccactttcttccccggcgccgaggacgacgacgacgacagcgccacgacctcctcctcggcaccagcgctgcccacctccgccgcgtgccccacgcagcaccaccctccctggtggcgcggcgttctctactggccggcttgcaagagagaagagtgagaaagagagagaggaagggagaaagatgatgtggcagcttgacatgtggggaccacgtgggtcccacgctgacttagtcatcacgtaggataaaaccggatcaaaaacactatgatctatcgtgaccggtttcgattagttaagggacgcccgatatctggttttacggttgagggatgatactgtaactcgacgacaagttgagggaccttcggtgtactttttcctatttggattcatcctgcgttgggcccctaaggctacttgaacgggctgggagtgggaggacgtcacgccagcgtgagctcctcagagaagccgccgccgctcggactcgtcaagggcacaccattgctgccaccttgaataggcctagtagagcacattggatacttgggcattttgacaggcattcaccgccgctttgtgcgctagatgttgccggcgcacggtgagcccacgtcgacccatgcctgcccgccttcccttttctttttctcgcgtctgttttctctctctcatgctttttttttgtctcgagaattttgtactcaaagtcaaattcaaacaaaaaattttgttcatcgatgagttgatgtctatactctctttccctcaactcaatttttaaaactttcaacctaaattatgaaaaaataataataatatgatacagacaccgatagtaagctaaaagtttgaaagaatatatatatatatttcaaaatatttgagacaagtaaaataaaaaaagagaataaaaatatcataaaaataaattatcacaaaaataaaacaaatgtacaaaaactaaggagacattatgatacattattgagtgcataaaaataatgttaaaactttgctacaattataatactactatccattcaaaattacttgaatttcctcttctcgtggcatctatctaaccaacagtttcataaaataaaattacatccatcaggctatgaataataacttggatgacatattttgcaacttgctagcttgcattgctcaagcgttctttctttgatgccaccaagttaactactagagcattcacaacttaaggtacaagatgatgcagaaatccattgcagtgctccattattcccaaccgagtaaactaagtatgatcattgctacaatatcaatggcatgcatacactatcctcatggaatggtccttttttttatttttttatttaggaagacgacggcagacctctgcaggaattcaattttgctcatggaatggcctcaatatgcaggtatttctcatttaacaaggttacctcagcaatagtagttcacggtttactttatgtactgacaattcacactgagcaagaataccaagttaccgaatacaaaaaatgaaaatattgacaatcagtcatcataataatgatcatttggaaaattgtaagtttgtaacaacattcaacaaattaaagaagcacagggcagctatcgaatctactctcatgtcaattagtcatcatggagtcagccctgaaaaacaaggactagtttactttgcaaattatggtgtacaacagaagagaagcataaagatacaatggtacatctgagtataacacctttgatgttcttataattgttaattgtgctatttctcgtatcgaattacggggttagacgtagtttatcaaaatcgagcagttacaaggttttagatccaaggtacatcaaaattatatatttgctggtggtattatgaggtacacaggtgattgtaataagaacaaaaggctatgacagtaaggtatgctgacatcttggattagatgtggttaaacacaaagcattactatatggcaacattttttttcaatttcttaaaatctaattgtaatactagattactggactattgtagtcgatccatagaagccttttctaaatacaaaaagggtctaatggactatcatctaattactctagtaattactaagactcctatatttctttttcataaaaaaagtgtcgtgtaacaaaaagaaaaattcaaaataggtggcaaacaaaatggttaaccttcacaagaaaagaaatagctacaaaatgaaaggaccttgatgtctccaggagggaggggggttgaataggtaaataggtagtcattccttatatcttaagctggcatggatgctgctcgctgattggttgagatggtgcacaattatacgttgacacgtgcccctcttactttcccccaagaggctaagagtgtggctggacaagtatttgggaacacaaaatactaaaatctagagaactctttccacacaattctagatctctagtatcttcaagtctagtctcatttcaaatgatttaggagtaaataagacaatgtcgtagtcaaactaatggaggaaaaaagttacaaaaacaacatttataggggtcgcattcacctaattaaatcaaagaaggagctgacaattgaaagaagaattgagccaagcaataagattgaacaggagcaatggtggtggcggcgactgcaatactggatcgaacaagcgatggcgctcgcacaaaatggctcttccgtgaacattgcagtgctatcgaagacttattgatcaattggacactgccactgcagtgaatgccctgcttgctgggtgttggcggctgttaagagccaattttatgccgccaatacctgcataaatcaaggaaataaaacatccaacatagtgatagaattaaattcttacgtattccacaagtgttgttgtatatttgaatgcaggtagtaaaccgccgaagttggataaaaaaatagactcaagtgaaggtgaaatcctatccatacaaagagtgggccagaaactaccaaaaaacaccgtcacatgggccttccacttgcagaaatggatagaggaagaggagagacaacaggccaaaacttggacctgttgggcctggcctgggttcggccgaaccactctcgcagccctccaattcagggtttggcagggacggtctggatgagctcctgaatggtggatggagggcaaaatggacttttcgcgttctataaccgtcagcccctatataaagacctca

SEQ ID NO: 71209 - DNA, 1567 bp, Oryza sativa
aggggaagccaagaggaggtacgacgagttcgtgaggaggaagaggggcaggaaggagtccaaggccaggcgagaggtgctcgtcgacctctgctgctccgccgtcagcgccgtcgccgtcatcagcttcctcgccgccgtcgtgctccggtagcttagcaagcagagtctttcccaaccaagaccgataaaaccaaaaaacctgtttttgctcttttaccgagagaaaattttgctctgtaaatatcactgtatcgagataaaatgtgttttttttcacatttggtaaccaagcagtgcaacatattcctttcgttcaaaaagaattaacatgtgatcccttctaaaacaatttattagaggggtcatttttcctcataggttaatttttttggccgggtcacttccacttctaggttttttttttttttataaagagagtaaacatacgtacagtagataccctactgtgttgcataattgcatcagatccgtcttgccaagaaacaccatgttcctctacactattggagctaaaaattcaggcatttcaacagaagaccttagccatgatagtgtcagcaataaaatcgtgaggtctacataccgatcgccgaggggggccgggctgaaggatattgcaatctgtcatggccaaatggctggcaaaagtccataaactgataaaaacatgcatttcggggtccataccgagacgtactcgtcgcgatcgctacatgacagtcaactgggcaccatccttatccgagatggtgctatcgtttgcatgtatatttgtgaacgaaaaataatttgtgaatgaaatttttatatacgtgttgttagcgatttaaaagcaaagattaaaaaataaattacgagaaaaaaaaacctcaaaatcaacactaaattttaggttgaaaatttaaattttggcttataatgtccgcaatgcagtgggtgtctgttgtactatggtgttcggtacctcttcaagtaccaaagaagaaatacgttgcatatatttttcttttccaatcatataaagatgtacatgcgcatcgcactcgctcaaggataaagagtaggaatgcaaactgatcggatttaaacggattattatcattgtatatttgattagaaaaatcaggtgttaggtacggcatgagcgaacttggtctagaaacatatcaaattatcggataatatgtgcatgtgcagataacataacaagtaaaatacgcaacaaattagcatcaactaaggaagccaattaggcttaggctcctaaactcatgaaaaaaatcacttaatagcatttgtatgagttatcatggtgtatggtctagccatatgatgtggtgaaatgggccaaaatataagattatatttatcttaatatttcctccgtttcacaatgtaagtcattttagcatttcccacattcataatgatgttaatgaatctgacatatatatctatctagatccattaacatcaatataaatgtgggaaatgctagaatgacttacattgtgaaatggagaaagtagtattttatctcatt

SEQ ID NO: 71210 - DNA, 1575 bp, Oryza sativa
ataaataagatgatggcatcttttttgtctattagagtaatcttttttctattagaaatatgttatcagataatgatatgatttatgagatgaatctatactactttaaaagaccccaactgtagaggtgaattgtgcattttccaccaaccatcacaactgtcatatgcgtcccccaaacaataaggtaggtgaaattttgtaccttctctaatcccaagccatcaatcaagggaaatttattttcaaatgatgacaaatatggactaaagatttaattaattgggaatattttattttaatttttgagctttaaggtgtacgggatgttctctttttttaatttattctcgttgcagtgcatgggcattcaacttgtcaatataatttgttatttttagttcttattgcaatgtacgggtattcaactagtcaatataatttgtgataaaatctagacactaatatatagaaatatttaatttttgtatttggtcaaatataaacatagcgggtacttagataactgtttgtggtactcatcatgatcaggtagttcatttaactaaacaacttgccaaaaacattttcacatgcggttacttaagtgatccacagttgaaaagtgtttgtacatgtagtttcttttaggtgagccacccgtgcaaacttgttctcgagggatgttattttaacgaaactgcccgtgaaaaggtttctccatggacagttgactttttgcatgtgtaactagtcgatttccataggcccttgactgtagacgacccaaaaacaacactataaatgggtcatcagccacctgcataagtgttttctataccagcattaccttgccatcgttagtcttgggcttcctataacctcacataacatggaatgccttactatcagcgtcctagatatgggataccctatgtatgtgtagttacctcgtagggaccaccgcataccaagttatttaaggaaaaaaaaacctcatacatgtggataaaatctgaagtagataaggtaagagtcctagttaagggcaaaaattcagagtcctatttgggtccaattaataccactcggatcatatccatacatacctacctagttctacttggacaagggagcagccgaagatataaatagcaggccttaggtagggataagaacatgcctgagagatttcaactagagacaaaacaatacaagacacctccgatctcaccatgtaaacacccaaagaagttgacaacaactagccgcctatcaccatactagattgatatacatatataatggcaacaacagatccggccaataggtgtagggctattgtccgtaatagggggccgaacctgtatagaaatccatgtattccttactctctttacaacttcgtttgcatcctcagacgagccaatccatatgacctaaaaatatatcatgtaagtacatatcctatgatcacggtataacccatcaacacttaccatatattattttgttctagctagcccatagatataccatagtactcacgacttgccctagcttgtacagctctta

SEQ ID NO: 71211 - DNA, 8300 bp, Oryza sativa
tgttgcataggcccaaccattctgaacaaccatcccggctgcacagttctatctccaaaccaggaatataccattccaaaccaggagctaatcaaattattaccagttatagcatcttttattatggtgagaagtgtgaaactaatcacgaaagacattgttagaccggcccataaccgcgggcacggctattcgaatagttttactctggccagaggtgtaccactgtatccacaagacacagccccacaacatgtcaccatgtgcctcaataccaccatggtacctcggaaaagagttgtgacagtacccctcgcacaatacaatccaccacagcacacctttcctggatcataatcacccccttataaacaaagcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttatttgtcatgagcacgactctcaaaatcatgtgctcacaacccacctttaccaagttttagttggcaaattaattaattaaccaatcatgattaaccatcatgagctatcattaagccatcattaaataatagagagtcataagttatcccaataatatgctaatgtttctaagcatggctaagcaatcatatctaatatctagctgaaccaatatataaagctcaactagtcaagttataataacccaaggtatcaaggaatatagtaatcaagaacaaaagggctataacaaacaatagattaattccacccaatgacattcgaaaataaatgcaatagttgaatataaacaatagctttaaacggaatcaacatgctcaaagggttgtttgggatctgtgtgacttgccttgctggccttggaactcttcaaattcttctcctgcaaaaacagactctccggaaacgttggaatatagacagaaaggagcaaaatcaccaaacagcacataaacaagcatgaacagtacatgtggatatttttaacatgtagatctcaattttagaaaaatttagagacttgaaccaactaaatccgagctaagatgaattagttatgaattttcaaagattaaatcggattaaaacacttatatggattttaattgaattatgacgcaataatgaattatttttgaaaaggaaaaaggggtttattgcgtcagcggctagggtttgcggtggaccgggtgcacggcggcggctcacagaaacgaacggccgagatctttccatccaaaacgaacggccgagatcgaccggtccatggccggaccacgacggacggcaacgatgacgtcagcggtgacgtcaccaccggcggtggctcgggcgcgcaagctcgccggcgaacgacggcgcgacgacgcgaacggagggcaccagcacgtagagaacacacaagttgattcttcttccgagtgattcttcttccgagtgggacgccatgcaaacacacaatccgtgccatatacaattccgccaactgacttccggaatatgttgtctttactgggatgaaatgagccactttggtaagtctgtcgactatcacccatatagagtcatggcctgatgatgttctgggtagaccagtgatgaaatccataccgatttcctcccacttccattctggtatcttcaaaggctgcagcaaacctgtgggtttctgatgttctgccttgactcgctgacaaacatcacatactgctacgtattcggcgatttcacgcttcatacttgcccaccaaaatctttccttgagatcctggtacatcttggtactaccagggtgaatggagtataaagtatcatgagcttctttcagaattgcatcttttaaatctttgttgtcggggacgcagattctctcgcccaaccatacagttccttgctcatcttccaagaaaccgatagcttttcctcttctcatattcttcttgatttcttgaatatcaggatcaataatttgggcttctctaacttgatcaattagagtgggctttgcttctaaggctgcaacgaaacctctactgacaattcccaaatttaatctttcaaattccttgcataactccaatggcaactgtcgtccttccgtagcattgcaatagcctttcctgctaagagcatctgctacaacattagcctttcccgggtgataatgaattcccatgtcataatccttaattaattacaaccatctctgttgtctcatgttcagatctggctgagtaaagatgtactttaaactcttgtgatcggtgtacacctttgtacgagtaccgaaaagataatgacgccaaatcttcaacgcatgaaccactgcaactaactcaagatcatgagtagggtagttcttctcatgcggacgtaactgacaagatgcataggcaaccaccttcccatcttgcatcagaacacaacctaacccaagcttggatgcatcacaatacacttgaaaacccttttttggatcaggcaaaatcaaaataggagctgatattaagcgattcttcaactcttgaaaactctgctcacattcttctgaccacttgtattttacatccttttgaagtaatcgtgtcatgggcttagcaatcttggaaaaattctctataaacctccgataatatcctacgaggcctaggaaactgtgaatctctgaaactgtctttggttgtttccagttggttacggattccacattactaggatcaacggcatctcctccggctgagatgacgtgaccaaggaacttcacttcagacaaccagaattcacatttgctaaacttggcatacaactgatgttctcgcagcttctctagtgcaagacgaagatgttcttcatgctcttctttggttcgggagtagataagaatgtcatcaataaagaccaccacgaacttgtctaggtattccataaacaccttattcatcaagttcatgaagaaagcgggggcattggtaagtccaaaagacataacagtacattcaaacaacccatacctagtggtaaaagttgtcttaggtatatcttcctctttgattctcaactggtgataccctgatcggagatctatcttggagaaaacggtggcacctttaaactgatcaaacaaatcatcaattctgggcagcgggtacttattcttgatagtcacatcatttagtgcacgatagtccacacacatcctctgggtatgatctttcttttccacaaaaataactggagctccccatggagatgaactcggtctgatgtatcctttctgaagcaaatcatctacttgtctcttgacttctgctaattcattggctgccattctataaggtctcttatggatcggagttgttcctggtaccagatctattctgaactctatatcccttttaggcggcataccaagtaaatcgttcgggaacacatcggggtactcccggactataggaatctcttccaaagtcatttggttcagacttgaccttaaagactcagaagataatgcatgaacagttacaactcgaccatcattgctggtgagaattacttttctgttggcgcagtctatcatacctttatatctggctaaccagtccatccctaggatgatatcaaggtctttggattctaacaggataagattggccagaaatggtacttcttgaatttctattctgatagaggggctacgttgcaaagagagtgcttgattactcggggtactaaccatcaaaggacgtctaagatcttctacttccatcccatgatttcccacaaaactcatagataaaaatgaatgtgtagcaccagaatcgaaaagcactgttgcaggaactgagttaacaaggaacgtacccaaaatcacatctggagcaccttgagcttctgcagcagcaacatgattgacacgagcctttggcgctggtgcggtagagttgctctgggcagggacaaccttcacgcgtcggggcttcggacacttgtcagcgtaatgtcctgggtctccacagttgaagcacaccccgggcttgctgccttgctccctcttggcaggctgttgctgtgttggagctgcaacagggcgtggagcttgattgcggatgttgttgccagcattgttgttgaagaactgtcgctgcggacgaacaacagaccaagaacctccctgtggcatggactggggtcctaaagtaagacgcggcctctgactattcccctgttgtgccttgaagtgagcaatccgacgtttcttctgctccatgcggttgtacttgtcctcctggcgaatagccttatccactaacttctggaaatcatgataatccctagtcatgagtgggtaagaaagctcatcattaagtccttccaagaacctctcatggcgctcttcatcagtgcgcacatcttccggagcataacgagccagacgattgaactcgtgcagatactcggtgaccgtgcgagatccctgggtgagcgacctgaattccttcttcttgagagacaccactcccgatggtatatgcgtcttccggaaagcagcggtgaattcaagccaagtgataggttcagcagtagttctgttaaggcggaagtgatcccaccactcagaggcagggccatgcagttggtgtgatgcaaatgagaccttctcctgatcagtgcactaaagcaaatccaacttcttctctatggcatgcagccaatcaccagcttcaacaggattagtggtgctagagaaagtgggcggcctcacacgaagaaattctgctaacttgttctggggaggtgcatggttatttccctggttctgctggttttggagttgctgcatcatgatgttcataagctgggcctgttgagccaggacttgggcaagcgtgggattctctccattgttgttgttgttattattggggccattcccattgctgcgagtgagcaccatctggcatgggcaggatcacaagaagagaaaccggggaaaactacttaggacagagaattaatttttctactaacttaacttttattgatcttaactgagtttcattattacaaaactgaagactctcacaccactaaactcaccaacttcctaacactcaaaagcaaacaaacgcatgcacttacatcccaccactgatgtaaatcacatgcgagacacacacaaccaaacttaaacaaacaaactaacacaacgatctaagacaacggcttgacaacgcactctaggtcttccgggcatcagagttgattgaaggctcgttcggctcgtctccatcatcttgagtagctccccactcgacctttgaatgggtgcgcttcgattcttctccttcatcatcacttacattgacgaccggaggatccgctagggctggggtaacttctttctccaccacacggacctttggcgccaattggtagcgagggacgaatagagctctcttccttgcggtaagacgaatcctggccttctgcggtggtgcttctcccttcaacgcggctagttccttctctaaacgatccaccttgtcctctagcctgcaaatcttaccacgattctggtcttcacgatcttgagctgctagcacaacctccgcgcgggtttcatccatagcccacagcatctcaaccaaatgccttgtggtagcatcattctcaatcccctcagtctcaaggtagctgccacggtcacttccctggggttggcgaggatggtagcgatactcagtgtcggccaactgatcactgtagcgatcgcggagctctcctatggcgatccttgccacctcctgacatgcatggatgtagtttcctcctccagcttcgaacatcactgatgggatatcttcactattactgttcaaggtgactttgactcggcacttctcttcatcatgatcatgaggaatctgggcatacaaaggggcagtcccaaatcctatggcaaaggacatcgtacgcaactcctggacaaatccctcaacaccaaacaagtactcaggcttgaagcgcggcatctaaagataagtgaaaggagggagttaagacatttatctaattaatagcacaagtttttagattaatttgaataaagttagaaaatcaaagtaaaaggtaagtaaataaagtaaaccaagcttgcaagataagttgaaacagttggaaacaagatcacaaattttgcacttttgaacaacaggttccaaaagaaataaaagaaagttataaaatcaacatgctaaatttatttcattgcagcaagattaaataaaacaatgttgtaaaacttttgctggtaaatgagccattagtacagtaatatatgtacagtactaacaacactggaataaattttgaatgagaaccactaaaagagattatgaagtgcatgtgctattagtttggtttaattaaaagagaaagggaggagaacagttctattttcccaatatttttagagggcttctatgggtaaccatttggcataacctagggtcaaggggctctgataccaacttgtcgcgcccagaatttctatccaaaattccaaacgcttacatgtgtgtgaaccctcgtccaggaatcagccgaggcacacaataacaaattgataatatagtacaattattactctaattaataagcgaataaaatatcattacagaggtagatagttcctctcaatcaataaaaatctaagcagcggaaaaataagataaacggcgcaaacgactccactccacaggcagcttgaccagggctacacctaatcctccacaccatcagcatcactgtagaactcttcctctgatgaatgattgcaaggtgagtatatgacatactcagcaagccacgcagcaaatatgcaagtgcacaggataacaaaggatggcatagtagggtttcatttgcataaacagcatttaataaacatttcataatttaataaaatatttaaataataattaaacaatattaatccaacgctatacaacataccctgttgcctaggcccaaccattctgaacaaccatcccggctgcacaattctatctccaaaccaggaatattccaaacaaggagctaatcaaattattaccagttatagcatcttttattatggtgagaagtgtgaaactaatcacgaaagacattgttagacccgcccataaccgcgggcacggctattcgaatagttttactctggccagaggtgtaccactgtacccacaagacacagccccacaacatgtcaccatgtgcctcaataccaccacggtacctcggaaaggagctatgacagtacccctcgcacaacacaatccaccacagcgcacctttcctgaatcataatcacccccttataaacaaagcatggactccctagcgacccccgtgggcttatctccgccacttctcagtctggtgctccgcaataaaccatgctatacaaaaggtaaagccgttgcccacgctggcttgtggttggcacggttaatgtttcacaaccgaaactcgtgaactggtccttaattgtcatgagcacgactctcaaaaccatgtgctcacaacccaccattaccaagttttagttggcaaattaattaattaaccaatcatgattaaccatcatgagctatcattaagccatcattaaataatagagagtcataagttatcccaataatatgctaatgtttctaagcatggctaagcaatcatatctaatatctagctgaaccaatatataaagctcaactagtcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagtgttgtttgggatctgtgtgacttgccttgctggccttggaactcttcaaattcttctcctacaaaaacggactctccggaaacgttggaatctaaacagaaaggagcaaaatcaccaaacagcacataaacaagcatgaacagtacatgtggatatttttaacatgtagatctcaattttagaaaaatttagagacttgaaccaactaaatccgagctaagatgaattagttatgaattttcaaagattaaatcggattaaaacacttatat

SEQ ID NO: 71212 - DNA, 813 bp, Oryza sativa
gtgaaacgaggaggagagcgcgcccaaggcagggataaaaggataaaaggcggggactttgcatcattcctttgccgactgctcacccgcacacacgctccataagccctaacactctcgccactccacagtactccacacaccaagcccctcgtcgtttcaccgccggtcgtcatggcccaagacgctggcgacgctgtgcttccggcatcgcgcatcacggcagataggcaccttagtcttccccgcaagattatgccggaaggcgccgccgtgagggcgggggaatcgcagccgcggccgcggtacccggagtgatccgtacaccttctgtccttcgccatggcggggttgatcccaccattctccaggttcttccatgaggttttggatttctacgagatccatgccctgcatctcgcacccaactccgtgatgacgctggccatctttgcgcatctgtgcgagatgttcgtcggggtgcggccgacgatgcgactgttccagtccttcttcgtcccgcagctgctgcaaggtgcggtggtggggggatgctacttccagccccggccaggcacggcggggcaatacatcgagagtcatctccgcaagaagtgggaggactggaagaaggactggttctacaccgcgctgccgaaccacccgcaacttcggctcaccggccgccccgaacgatccgccgcatggctggcggtttcggaactaggcgaggagtacgacgcagtgcgggatcacttcaggggcttgcgaagccagggcctcacgggggcgatggtcttcggcgattacttc

SEQ ID NO: 71213 - DNA, 8015 bp, Oryza sativa
cagctccacaactatagtgcattttgtgagagagctccacccaactccactcccagttttggtggagctgaaactgtttggttaagctccagctccaggaggggtggagctagagctggagatgtgccaaacaggccccaacactgggctcacaccaccgccaccctctcgttggtcagacgtgccctgtttgtggctatgccgaaacctttatgccaccacctttaccatgatcgatgttggagttcggctagccatctccggatctgtctatcttacaccttggcaccctcagaatcaatacctcaagagtagccacctgatcgagttggcaggagcacaactgccactagatcaaatggtcctctatctccacatccctccatccacatggatctggcatttgccaacatgaccaacatcagatcgggcaacccaaggtaccaagtaccataagccttctggagacatgggaggggaaggagagggcatcaccatagcgatcgccggtgaggacagagaaggaaaatggtgccatcgacaaattgcagaagaaaaagtcttagaaagagagaaaaaggcaacacggcggactgatcgaggcacggagccgtccagcgagacaacttgaaattctcactcaattagggcaaacaagaccactcgaatgtatatcttttagaaatgttacaaaaatgtattatttttttttaaaaaatatcttataaaataaatatcgtttaaagagcttacgggtttaaagcatccagttggcacgtctagtttctagtttaaaatgaaatgcggaagctaaccaaaacagtgtcgggttgtccgataccgggttggccagtccgatgttgattggattgtccgaactgagatcggactatttgacttgtagagtagtagcacaagcaaacaacaacaactagattagcacagaacaaagcaatccaacaagaaggtaaagagatggaggatatcatcgagttttacgtgaaaatgtattttccgaagttcaaatccttgaggggattctagcctccgttgaggagctcacaaagagctgggtcttttctaaccctatcctcttgaggttacacaaatgcactccttccgctaaggatatctagggatggcaatcttttcaaatccatgcccgacccagcgcccgactttttccgcccgaaccctacccgatagggttagcacgcaaaactccatgctcgtacccatgcctgacgggtacgggtatgccccatgggtatccagtgggtatgcccggtgaccttgttccctatgctcggcgcgacggtgagaagggagcgaagcggcgacaaaagtgcgatggaggagcgatggcgctctctcgccaaatctagcaacagtggccaccagatccggtcaggtgagcgcgcgagggtgacaaagacagcggtcatgcgtgatggagacgatgaagcggctgctgcctatcatggcagccaccaccccctcctgcatgcgccgccacctgcatgcgccaccgacgccacttgttcccctgctactgctgacgcttgttggtatttcttacggtcacagataaaatccgcaagcgcacggatatacctgtgtagcacttcacccaggagtattttaaggtatcgatttccacaagaaatgagtgtgttcaactcttctctaggttcatccaaggacacaaggcagatgtaggcaaaggatagagaggatttcctagtgagagacaatgtctacagaaaacttaatttaatcatattgcaatacttcaggcactggcttgctcgctgctaccagaatgcgttctactccgtaaccggacaggaaggactgcagcgatctagaatgctatcactacctctacaccaaccgctagcgatctgtgggatacgcagcaatcactggagattaattacctagacaccgcgtctacgcaattaattactactttagtgtttataaatcaccaaagtaataatctctatgtattaataaacaatagtgaacaatgatccagtacactaataggaactaaccaacaaataattctcacaaagtaaatcttatttactcagaagatatttctattaaagtagaataattaacaaggtaaaaaagtaagaggagattactgattacttcggaattcctccgaattcttctacataaaaagttacacaagagcctcttataaatcaacttttgcttggtgtgtgttggagggagagggtgaggtctttatataggccccaaatgacagttaggcagctggaaatgtctgaaatgtcccgcaaccatcattggggagtgatcaggagcatccacatggaaagaagcatcaacagctcagatgggggttcggccaaaccctggtcagctccccagcccatgggctttctcctaggcctcagtattttcctcccttatccatttgtatattgattgggctcagtttctggtgtttcaatgagattatgagctcaattcttttatggatggaattctcttccactttagtctaaatttcctcccaactttggtagttcattacctgcatcaaatatacaccaatacttatggaatttgttagaattaaactctaccactatgttggatgtttttttaatctttgatttatgcaagtattggcggcatataatttccatttaacagccgccaacactgctctggactaaggagggaggcagccgggtgaggtggcgtggtaattagtttagggtttgattgagtgagtttacatatgtctctagtcaggcatgggttacccacgggtaaaaaataaaacctgactgctgcctactatatcttcgggtatcaggcaggtatgctcacaggcaaaatattacacacgttcgccggcggcggcgaggcctccaggctaggcggcggcagatccagccccactgccaccggatcttctccagcgatggcgacggcaggcgcgatgtggaggcggcgcgtccggcggtggctgctgcggcgcgtggtggtgtggtcattgaggttcgtggtggccggctgttcgacgctcgggtggcggctgacggtgggcggcggcttctggcttcgggtcggtggcatgtcggccggctagggggttcgtcagttcttctggctgcctcccccccaccccccaccctctgaaaccacccctcctctcttcctttctctctaccttccttctctcttcctctttgtcccgcctctcgccacaagcagttaggggaggccttgcatcatcccccttcccctcccccagttctcctctctctgcgctggtggtgaagtcgcaggtggtcgccaaagttgattggtttgtcccacgaagcccggagttcctcgccggaaacatggttgacaccgatgtgtctgagccctctcttcagaacttagttcctctccaggccgaccatgactccttggtgcctccccccttccattggtcgtttacttccagatctggtcgtgctcttttggtgcttgaggagtctgttcgtctgtggtgttgatcctgtctgtctgtagttagggctcttaggccttgccggagcttcacgtgccctatgtctgtgtgaacttgttgaagtgccgagtttggagcggtgtgcttacccccatggtgcaagagttcctttcctcttgcttcttggagatccagcacctttgagggagtccggggcgaaagccctgcctggtcatccaggattggcaatatcgatgcctgcgagtgtcgtttcctccttagaggtgttgccttgtggactctctcccccctccccccggttgaaaacccagtccagctgttgggcgtgcgtcgacagcggcttatgtcgttgttcacctccttggaggcttcgccttagggtctttctcttccctcggccttctacggttcgtagtctttttgcctcaggctttttgtgtcttctgtgtaaagtttttgccggtttcactttagcaaaccgtgtagttgtatgatttttgggcccggttttccttataaatagggtcaactctatccttctaatatattcggaaatactcttgccgcttccacttaaaaaaaaaagatcaagagaaacatacactaagctcccaaacttcaaatccacaatcacaaagatccaagttacaaagaacaatggggatttgagagagagagggtggggggggggagagaggtcaaatatccaaagcacttagcacaaagctcaaagctacaagctacaaagatttgaatgaaaggactaaccttcgaaaagggttggtggggagttaacgttgaacggtccgatattttaaacctccaaggcaacgagagacagagaacaaaggtccatgaaattttggactttctaacacgatgtatatcttggtgagagctataatttttacataaaacatgtctctatccaaggtcgtttggaaatataagaaaaacaaattcaaaaatagatataagttaaaaaaaatgaatatttgaaccactgaaggttctcaaatgaacaaactttaaactacaaagttgtagatatcatcgagtgctacaattttcatatgaagtttatcaacattcggcttcatttgaaagagttacgattttctttcatattttagtacaactctcatttttaagctaggtggttttcatacgtacaaatcgaatattctaactcataaaaaaataatctcaaatgtgaaacctttcaaaagcaaagatgcatatctcgtcgagagctataatttttatataaaatttgtcttcatccgaatttatatgaaagagttacgtttgttttcctattttagtgatgcgcctatttgtaacttgtaagggcagttttcttatatagaaccactcgcgaaaatatacatatttttacaacagatttcttatagacggcctataaaaattggtttcacaggtggcactactacagaatgggttttcgcatacgggtgaacacgatcttcgcatgcggtcggccggcccgcatgcgcgaaatggtctgcaaagatcgccatttgcgcatgcggccggcccagccgcatgcggtcacttaagacggccgcatgcgaaaatatatcttcgcatgcggcccgtttaagcagccacatgcgaagatctattttcccgtgcggtcgacttaacaagaccgcatgcgaagatctattttcgcatgcggccgtcttaagtagactgtatgcgaagttcaatttccaaatagctaaaataatatttattctatccttttggtgagatgtgtctgataattaatattaaattattgaggatttattattgtatttcggaattgtaagcatacgagatagtcgggttgttattattactgtaacaaacatctaatacataaccataaattcaatcgtaatttacatacgaaagatataatacaagtgccacaattttttcatgatatgtataagtagtgtacatgtcattgcatatgttctttctcccactctctgagaggtttgaatttgtcgtccattgcgagttcactctggttgtcgtagaagagacctcttgcgtgtaggatcaaatcacaataactaagccaaccagagaggggtgaatggtttgtatacccaaaaactgaaaacttttagcggaaataaaagttaccctcgaaatcgacggatcgcggtctgaccgaagttgtcctgccggtttgaccgcctggttgccgtcggtctgaccgagattagatctccggtctgaccgccgagatcagctgttgctcgctgtcgccgccgccggtctgaccgcccgtatgcagccggtctgaccgccgcttaccgccggtttgaccgccggtatatcactggttagactgccgaaacccggtgaaacacaaatcgaaaaactcttaaagtggatgacgactttattgattttctctgtgtttacaaagtgcaccaacaacactccttacaaaaatttcgactaaactcgaaaccctaactcaaaactcaactcaattgctctcaaaagcgataccgggaagcctcacgctccccctctatttatacccgaggtaggcagcctaaagccacgaaccaaactcatactagaagtcctaaacaccttaggaaaccctctagtacaagaaacaaactttacataaccaatcataccaaatttggactccttccaaattcgactccgcattccatacgcacacaatacctccatcgtatgccatatggaatctccatcaaccacgtgcatcaactctagccttagtatcccgtatgatttttgaccaccacggacgtcgtcttatccccaagccgactcccggtccatcaccgcaaatactctctcgaggcatcgagtcacctacatatgaaataaacaaagaaaccatattccgagaccaagctatctctaacttgactcattagtagcaaacaacaatattacatacgtatagtatccatctagaagccatactcatgaaataatcacggatatccaaacaaataacccgaaaccgaaaccgacacagagtcggccggtcagaccgcggactggctggtctgaccggtccacataaaataacatcagtatcttgtagattcacctgtgaaatccaatcatctccaaaatcacttcgtaaataaattccaaataaaaaaacaattgttcatcacagaataataatcaaaaacacctttgattttacattgcgttgcagacatcacgacagaggaatcggcagagttcagcgcccacgttccagatagtactgtcgtcgattcgttgtgcaatatatgggattttggggatctgcgcacagaaaggaaaataaaatggtactcagtgagaagtttgtgctagatgggtttctttgtagagaagagttcgccgacttactcggttactggttgttttgtacctcccgtttactctgagcatctcgcacacgtaataaccgcacaagttggttcccagtggttgtttgtaacactgcaatataattatgagggaccgatctcagtagatataatttagtatgtattgttcgataattagttgtattggtatagatttgatagtaccggtcggccagtcttgatggataactgcttctgggatggaatatgtactggtccgcctcttttgcggtagtacttgtgtgctatgtttgaagaaaacaattgttttatcagtagttagaagattgaggatcgacctaaacaatttatattaatgaaatgtttatcacttatagattcaaaacagtgaggaattccataaatgtctccttgtcatagtgtacggggtccaacgatatgatcaattggtcttttggatatacaaggaataatatgtagtgctctctgcatataaaataggcttaatggagactgaaaattccgaagaagataaattaattaaataaaaagaagataaagcttacgtcaacgcgtaggggaccattaagacatctttgtcggcgtacgccaatattgctattgccaagtatgttgctacttctagcttcttcctcttgtgcaattgcttcacatattcttccttttcttgaggggtcttgccaaccaattgctcgcagtcctctcttagctctacggtgtgttgtgttttgcatattcttgttggatcgacgtatccaaccggtgatccagttctatcagcttcgtggaattgcatattgtacaatgaacaaagaagtaatgagatttggtttctttgtttggaatgatacatgtaacatgtaataaagagttcagacttacagacaggacgccgcaattgttcaagcaaaaatttcaagttgaaaatctccccctaattattgcttgctttaggagagagaaagcttcgttttcaaatagtcaagctcgggcctggatgagcatatatggccgatcatcgcacgcggttccttgagctagccgcatgcaaagatccattatcgcat

SEQ ID NO: 71214 - DNA, 3429 bp, Oryza sativa
aaatgtttgcaaacaactcgtgatacaaacaattgtttacaaacaactcgtgatacaatcaattaattgtacaagaagagtgtaaaattaccctggtctttcgatatctggagacacgaatacaaactccaatcatcctcagcaacaagcaatcaaatatcgtgcagcgtgcaacatcggccaagaacaggagatcgatgtcagggacgatctggccggtatatcgcagatggcgagtgatgatttaataatagcaattaattaaagtcgccatcatatatatccgcggcaaattaattaggcgccattcataagcggcttcttcatttcccacgctttcagatgtgaaatcttaatatccgcctccccattgttgaagacgtaaagatgggccttgtcacctatcgccatcgacgggtaaactctcgacaggatgcaggtcttgcccccggcgccgaagctctcaaccaccgaacggtcaatctgaaacgaagtcacaaacaatgatgcatatataagactaatcatggtcacagtcaataaagcattggtaagttatatacgagaggcactaataaaaaacgtggttaattaagctcgtagtatatgtgtgtactataccaagcttctcaaggagatcttcccggacgagatgtcggtgtcgacgaacccggcaaaagttggcttgtagagatccgggctaagagaagacctgctcaataaaaaaaggacagtaattaatcaacttcagagctttggatttagcattttaagttgtctactgtgtttgggtaattgcgaaaatgtgacaggagacgtatttgatagtgctgtgataaagggtgtgtgattccaactctaagatcatgtatttcttctctcattttttttttgaaaacgtggcagacattgatcagtgcatgcaggatgggtatatgcatgtgtgctgcttgcattgtaccgagacatcacaaggtagtagtatagatttggctggtagtggtatcgtacttggtagggtcggtgcacatgaggacgacgggcttggcgccgtgcccggccggcttgaagacgcggaagaagacggcggttttctcctccaggccggcggaggccagcacccacagcccgaacaccacgccgcccctcacgtccgcgcccttcgcgccgcacagcctctccgcgtcgtcgccgaacgccgggtccaacgcctccgccttctccagcccggacacctccaagctcacctccacgtcagcctgatcgacacacaaatatcaaagcaaaacttgtaagcgtcagcgtcacacctagaaggcgaatatgcgatgcgttgcaggttcctctccggccaaccggatgcgtccacgccgttgaaggtgaaacgggcgggagcggaagctgacgccgaccgagcggaaaaatcgccggtccggcgacttcgcgatcttcgcgtgcacgagcaggaattgggcacgcgatgatcgctgcccatacggaattggaccggagcgagcttagctagtactccgtataactaggaagctcctgcacatggggcccttgacggcagcaatatatatggccaatattctagtctcattttcttgtggatggaaatttcaagttactggtttttgattttgtagtgtagcaacctggtaggttccgaggcccgtgacttggaaatgttccccgggcttcaccaccttgtcaaagacgctgaccgatttgcccctcagcgtctccagctcctcgattggccactgcagaagctgcttcccgctcgggtccagccatacctttcttgggatcgcctgccaacgacacaagccaagccatcaatctccaaatcaattctaattaaacctctagtccctccaatttttcttttacgtttggttagctcttgaaattaagataactaataacatcaaacatttgtggaggtaggtagtacaagaaattaggattgcaaaattgtaactatgatttacatggatgccggcccagcccttcgccttgtcgtaggtgacgctgtcggactcgttagcccacccaagcaggatgcggcggtgcttcaccgggtcgaagaaggtctttgatgcgtagaagttgccgtagtcatagcggagccggtggtagtcgccagcagggttgtccggcacataccgctccgtcaccttgttgtagatgcccaccgtgtagtagtcataacgggtgagatcgaggctgtcttgagcacgtacttgctgctcggcacagatgtgtcgaggccagcctggagacctggtgcttgcaacggaaagaagtctgggcactcccacatcccagtgagcgccgaatggagtgggtgcttggcccgaacccatgtcttgaagtcccggctccggtagaggtaggcaaggccgaggcgagcccccttcaggccaccaacgagcatccgccaatgaccgtcggcgtaccaggccgttgtcggatcgcggaattgcgttgcgttcataccaggctccggcgtggccaccgggttgtaggccggcttgacccactcacgaaggagcgggtctgacgcattcttgggaaatgcgatattctgcacctggtagttgatgttggggcggtcgatcccagtgtagaggatcgccggcgtgccatcgggaaggatggtggcagagccagaccaacaaccgtactggtcggaggggatgtcgggcttgattgccggctcaagggctatccagttgatgaggtcctgtgataccgagtgagcccacacgatattgccccacacagctcccttggggttgtactggtagaataggtggtaccatcccttgtaatacagtggccctgttcaatgttctcaacttatcaactcaaaagctcaaaacatttttcatgtataactggggcggatcccccaatttttttttggggtgggggtgggggttgggggggggagcccatagtacacatgttaattagatctattcttgtgtacaggtacaacttattgcttatcaacttatcactttttatatggtttctttactgttttacaaaaatgagttgtttaaattaaagtttattgtgaaattgattatgtcttgtcatgtctaaattcgtataatcaaattgagattcacttccagacagtgatacgccaaaggaatccgttgattgatcccattgtcaaattttaagaccaaacttcgaaagcttgaccagcttaaatttttctgcctactgcaagaggccgttgtatatacgcattcgccttgcagcatgtgcgtgccggcatgcaccattttaatgttaaactgtcctttctcttagctccttctaaaaaattggtctttaatcttcccatatttaaaaaacacatgcacacaagcgttgctgttcattatactctcaacatcatagatc

SEQ ID NO: 71215 - DNA, 9769 bp, Oryza sativa
gcgacggcgacgcacggctggagcggcggcgacgacggcggcgcgaggtctcacggggctagggcgctacggacgacggcggacaaagatgagggtggcgacgggtagcggcgggcttgggggtccttttataggggttggaaggcggcggcgaaggcccacggcaaccggcgacggcgaaggaaggtctagggtttggggagagagacgaatccgattcgagatcgaatccacggatttccaaacgaaattagccgatgattccaaaagagaaaaggtagaggagatcccgaagatcatttcccctttattgattccaccggaaacggaaaggggcggccggatttggaaggagacggcggcgcggctcggctagggttcgggcggccggcggccggaggtagacgacgacctgacaggcgggccccacctgtcagcggcagcgagcgcgcgcacgcggcggctgcgggcggactgggccggcttgggccggggagagagagagaaggttttgggccgactttcggcccaaagccaaaagagacttttaaaaccttttccaatttaaattattcatgaaatgcaattctatttattaaaaatactttcttagctcaaataaatcccagaaaaaatctaggaattatagaattaagcaaagtatttaatgaaattttatctggccccattttatattggaatttattaattaaaattagatctactcttctaggcttttaaaataaattctaataattctaatttagacaacaatttatatatttgggatttttagggtgtgacactcttgtacattagctggttcacctgtagagcaagccaaagaatacttaattgttccatcaacatctaaccagctggccttagttatcccactctgcaagcgagttcgcggcctgacgggttcagactgctgcacagaagatcctgaaccagccgtgtcatccacagctgatcctgtcgggttcccatgtgtcgatgaagtggtcgcaggcgatcctgacgacaatgctgaattcggtcctgattggccagaccccggggttgaatgctcctgggatccagtacctgtgcttggtgtagactgtgcatgactgtgactgccctcggatccgctgctgctgtcagccatcaaatcatcctcgtgcccagcaccgcttgcttcaggcaccatgattttcatctgagttttgcaccagattttcaccattttgcgccgaattttcgccaacgacctgtgctcctgttgcttgatcaccacaagagggattagtagaacatgttagcatatgatcattagtaatttctcccctttgatcagtgacgggaagcagtcgagtgggaagcaaggagatttcccgtcgcaggcgggcacccgcgttgggatgcaaggcagcaaaagggaaaattgtttcatcaaagacaacgttgcgagagatgtacacacggcctgtagagatctcaagacatttatatcctttgtgaagggggctatagccaaggaaggcgcaatggatggatcggaaagatagcttgcgggcgttgtatggtctcaggttcagccagcaggcacacccgaagatacgaagatgactgaactcaggattttcagaaaaaagttgctcatagggagttttaaaggagataactgaactaggtagcctattgatgtgatacgtagcagtaagaaatgcttcatcccagaacttaaagggaaccgaagcttgggataggagggcaagtcctttctcaacgatatccctatgtttgcgttctgcagatccgttctgctgatgtgcatgaggacatgagacatgatgaactatgcctattttctgaaaaaaggagttcagtttttcgtactcaccaccccaatcagtttggacagtgagtattttggtgttaaattgtcgctctacatactgttggaaattaagaaaggcttgaaacacatcggatttctttttcaatagatagatccatgtgtatttgctaaaatcatctataaagctcacacagtaatcatgttttccaatagaggtaggcgccggacccacacatcagagaatacgagagcaaatggaacattggataaactcatagacttagggtacggcaattgatggctcttggccctttgacaagaatcacaaatgtgttcgacattattggactcactagaacaaggaagcttaaaacttttgacaactcgattaacaatttgaaaagacggatgagctaaacgataatgccacctaatggaagatggcttgacaatgctcaaggcaattttattcagacttgggctttgaccaccgggttctggagccaaaggatagagccatcccttacttctgccgtgatgtagtagcttcttcgttgcctgatcctttatattaaagaatttggggtaaatttcaacaaaagcatcattatcaaaggctaagcgattcgcagagacaagatttttgttcgcagtaggaacgtaaaggatattctttagatgaagatctttatttggggtagaaattactgaatgaccaatatgactaatgttcatacctgagccatttgttgcatgcacctgatccagaccattgtacttctctcgaatggagagtttgtcgagttccccggtgatgtgatctgtggcaccacagtcgacataccagttggtatcgaccccgtaggcggagtttgttgccgcagctgcaaccttctcttcaggctggtaggtttgatcaaacctataccaacacttaatcaccgtgtggccagttttgccacaaagttggcagaccggacgcggtccttgctggccgccaccgcgcccaccgtttccacggccacagcctccattgccgcgaccacggaaattgttgttgttgttgccgcgaccacggaaagcagcatttgcagaagattggatctgccctccgccttgaagatgatccatgcggttgtcgtagctaaccatctaggagtacaaatcactcagagaaattggatcagatctgcctaccacagtagagaccagcgggttgtagtcgatgtcgaggcccgccaggatgtacgagaccagctcgtcgtcgtcaatgggtttgccagctgacgccagatcgtcagctaggcccttcatcttggagaagtaggcggcagttgttgtggatcctttcttggagttggtgaggctgatcctgaggttggtgatgcgtgctcgagattgggaggtgtacatgttggtgatggccgcccaaacttcagcagatgtgtttagtgtcgctacttgctgtagcacatctttggagagcgaattgagtagataggccaggacttgctggtcctgggccatccacatcgcgtactccgagttgttgctgacgatctccttgtcattcttgtcgacagtcgtccttgtcttggccggttcttctgccgtgctgtcgaggtagttggtgaggagcgctccgcgaagcgccgggagaacttgtgcacgccacaggacatagttctccctcgtcagcttcacagtcaccggaggaccaagcgcagcaggcgcggcggatgaggaagatgagcttgccatggggaggaaatgatctagggtttttggaagggtagatgaggcgggctctgataccacgtaaagatggaagcgttctcacctcccagaggaggccgcacctttgtatttatgtgtcaagaagagcccttgacgtggcttacaaacaatgtgataagatttgttacatcgtatgttatccaactcaactaccctattatctagctagatcaactaactagaagataagataagatatacattgttttacacaggtaactaaaatttcctctctcttttcttctaaagctaattcatacgtatcttaggagcataacaagaccaatgaagatatttaagcatgcactgattgtgtacatggaaaagcagaatgatttacatttcactttgacacattttgtttttttttctggggacgattccacaactcattgagaacacaaagggagaatttttgtgaaaaaaatgtcgatgtatgtccaaaatagtttacattaggtgctgtaggcttgtatctagctaggcaaatcaaccaactgcagctatagtctgccaacctcattccatctctcctatattgatgcctcttgagtcctatcctctccaagtagtgtgtaccaccactggataccgcaattaattctagagcattggcgcaacgcagcgaggaattgccgggtgatctccgcgaagcccaaagatttgagagttgacatgaggaactcgatgccaagcgggacctccatcatgctactgaggttgactagatatagttgctgcaggcttgccatggaaccttgctgaatctccaaccgtttcaggcgaggcatgtctcctatgtatagctccttgagggcaggaaaccacccatggtggaagacgagctcatctccaatgtacgctctgttcaacaaaaggtccgtcagattcgaccaccgagacagagatggcagtgggtcatctaccagctgggaccaagatagatgtatcgaatacaagtggttctgaccccctgctgcacccaacagcatgtttgcttgtgccaatctcccgcgcaatcttagcttttcaaggtttggaggcagtgggttcaaactactcaaattgaggatatcattctcatcacttgctgcaatgcttaagtaggatagaaattccatgtgacgcaatgacgcgcagaggcattcgcagcagcttcccttcacgtcccatatctttatgcttctcatctgcctcagctcccccaaccagctcaaaggctcatcctgagcttgcagtgcttgcaatgtctgtagctctctcagattctctagtccactggggatgcatacaccagtgcgacaccggagttgtcgcccagaccgatcgttcgctttctcagcaaacaagtgcctaagcttttttagcttaatgatccctcttggcagctcatgtatttccgatgtacagaggtccagtgttagcaagttggagagcttctcaatagaatttgggaggagcttcacattggaatcccgcaggccaagatgtcggaggttgaatagatcacctatggcatctggaacattgtcgatgggtagcccgcttaactcaagtactgacatatatctacacttctcggatagcagaggtagcagagtggatgatggcatggctttatccaatgcgatgaaagatcgaaggcggcattcacttgaaattacttgattaatatccttgtctaatctgtgtattaccatccgtcgttcatcattctcctcaagaaactcgaaacgcttattctcacaactgtatgaaacaccaaaacattctctccggcacaaatcaactgccaactcgtgtacgatatcatgcattctgaatgcttttatcctgccaaatgagttcctttcaacaagctgtagcatgttcatgtgaaccaattccttgagatacccttctgccacttcctccattgtgcttccacccctcttctctacaaacccttctgctatccaccaccttacaagcttctttcttgtaaaaagatagtcgtctggaaacaagctgcaatagaggaagcaactttttagttgtgttggaaggtagatgtagctcaggtaaagaatattcctaacatgttccatgctcgggttgttgatgagctcccagtcaagttggttatgtatgcgcctgaattcctcttcagtcttgtcacgcacaaagaggagtctgccgacagagacaattgcaagaggtacacctttgcacttgcttgctatttgatatgctagctgtgttacttctgtggggcactcaagtttcttctctcttggaaaagccgccttatagaagagttcccatgagtcgttttgtgatagaggttctagcctaatcctcttgtttgggaaagcaaggtgagttacctcatcaatgcgtgttgtgacaagtactctactccccctgagattagaaacaagtgctccgaacaagttactgatggcttctggtgcccaaacatcatctaatatgaccaaatacttccggtcccttaggaatgccttcaattcatcttgaaggccttcagctttcatgtccccaaggtttaccggaggattttgtttggcatttctgaaaagttcagtgatcagacatttcagaatgttcttgatggaatatgtttgagagatggagacccaggcatggcattcaaacttctctctctcgttcctatacacatttgctgccaaggttgttttgccgagacctcccatcccatgcagcactatcacctcacgttccaattcatcacctgccagccactcgcggagtctttttctgttttcatccacccctacaagatcttcttcactgagggagcatgaaatgctagctagatgacgtgacgcctcaacaatgtaacatgagctttcaccactagtctcatcggcaaccatccgaacccatcgctcttttgcctgaaacaggtgcactagattggcctctgcttccttaacagacggagctatcctgtttaaagagagcagagcatttggtcccttcattctcttgaatcctttctttagataggtagtccatccagtgtcatcatgtttgtccttgtggctaacaagatgcaagtagtcatccacaatgtcctcgatctgatgtgctaacattctcacatcctccacccagatttcatatatcttgttgttgcgattgcggatatccattcgggacagaaactcgtgcatcagcctgagctccctcttgatgcgccccatgctaccttgaagctctgtcagttgtgtgacgtacttctgaaaatatgaagtggcttggttgattgcctcattccctagggcaacaccaatcttcttcacaactagaagaatcacagcctcagacattaggttcttgtcgagtctgattgcacacctgaccagggtggcctgagtatatctctctaccacaaaacctagaaaggaagaagaaaggtaaaatacaataagctgtattgatatgttatatctaaaaaggaaggaaaaaaagatgtagaacatgataagtaccatattgacaggttacatataacaattgggaacttcgccatgataatctgtttatttttgtttttttctctatctgacctctttagtgcttaagaagacatatctcttcccttgttgtagataacatttcctaacatctgttttatggcccatgataattaaatctgaccataagttagctatgaccacttgcatattgaaaattctaaagttttctttaaacaaaaggaaataaatcgacttgcaccatttagggacattatattttggttatcgtagacaagttggttacattcgtatgtgtgataaggtcaatggtgacaacattaaatcaaggagaattctttacagtacaccacttttatgtgagttttgtttcttttgatcttagacaagacaagatgattacagtacaacactttgttattgatgttaatttgatcttctaaagattattgttgtatttgcataatgcataagtgaaaggtgttaattagagttaatatttttcttcatacagaaattgcatgcatgcacagtgaaaaaatattaattttaatctctttatgcatgtgatgcactgaaaaaaattgtaaacataaagctgtcactctgaaaaatatgtgaacatatgtccatttatatttcatattagtccggagtatacttgcctagacaacaaaattaaaggggaacactattgttttgcaaattacatttctactacacaaattttgcaaatggaagaacaatatgcaaggttgaatgtctctttaatttacctgttctgtgtctagttaaaataatgaaatgtatgcaaattgataacaggatcaaacgtggttcagcaagaagttagtacttcatatatcctcgcatgtccacatccgtacgtcatgggtggaggcaaatattatatcagtgtaaaatactgatctcaatcgggcggtaagccccatctcaatcgggcacagcgtccgtcacaggctagaagtcactgatgtgaagagttatctcaatcgggcaaacggccgtcacgaatgaatatatctcaatcgggccctaagttaagcccgtcaccgctagctttgacccagacgaccagtcaaactatagcccgtcacagatgacctatctctatcgggcgacaactagcgcccgtcacagatgacggttatctgtgacgggcgttaactatagcccgtcatagatgagtcatctatgacgggcattaactatagccatagttaatgctagacgagtataatccaaacctacgcaattttataaattaggctagccctgccgtcactcgtgtgcacccacgcaggaaattcaaacttcccggtcgttcacccatcctgaaattgctccagatgagattggtttccggaagagtagttgtaacttattagtatgggtattctattaatcctattaagccctaggctaggatatcaaattggggttattaaatgatttcaaatggaaaagtcaccaaaaccaaagttgtagaactcatcaaggtgcaaaatttttattttggtcatttctccatctgactctatttaaacaatttgaaatttgaaattcaaattttgaaaagttcaaatagaattttagatcagtgaacggcttcaactgaaaaagtcatcaacaacaaagttgtatcactcatcaagatctacagcttttattttggtcatttttctatataacattttttgaaccgtttgaatttgaatttaaaaatataacaacatcaaataacattttaaaatactaaatgatatcaactgaaaaagtcatcaacaacaaagttcaataactcatcaagatctagaacttttattttggtcatttcttcatacgacaaagtgatagtaacattgttcacaaaattgacatctcttatctggttttataaactataacacatatatgtaaaatttgtgaataatattactaacatttcgtcggatgaagaaataacaaaaataaaagttttagatcttgatgagttattcaactttgttgttgatgactttttcaattgaaatcatttagtatttgaaaatattgtttgaagttgtcatattttcaaattcaaattcaaactattcaaaaaaaaatgttatatagaaaaatgaccaaactaaaagttgtaaatcttgataagttatacaactttgttgttgacattttttccatttgaaatcatttactacccgtaaaattgttttgactcaaaaataaattattatactgcacttaattattttgctatagtcaacttacacaacttgaggcctgtttgagatatggaatgttatctcaatcgggcctaaagttggtgcccgtcacagatgatggtcatctgtgacgggccgtaactttaggcccgtttgagatatggaatgttatctcaatcgggcctaaactacggcccgtcactgataggtgtcatccgtgacgggcttaagttttatgcccatctaacatatctgtgcgaccatatctcaatcgggcacttttcggcccgattgagatgactttcttatgacggcccgctatttctaagcatattagagcccatcacagatagaaggat

SEQ ID NO: 71216 - DNA, 1756 bp, Oryza sativa
ccttttggtatcgcccgtgcccgttgtgcggttgtcgaccccagtacccgtgtactggtgtcggtagtcgttcgcttgtgcgtgtggtgaccgtgtaagtgtgccggctcggtagcatcgtggttccaacgtgtgcagcccgtgtggtgtctagtggagtccgtttgtcgaccacttgcctcgggttgacacacgggatccgcttcagtcgacccgtggaccatctctgtgtactcggtctaccgtggtcctttaggttgacatgtggggtctgcatgtcacaggcgcagccttcctgtcttttccaggctagcgcttacacatgttttataattgcaaaacctaatcacaataatccgtaaatctccattgtcacgaccggaaataacccaacgggcgttccttacgtgcgtgcattattccttgtcccaggaggcaaggtataccaaaagttgatacaattcagagttcaacaagcggaagcgtaaatagttaatttataacatgggcagcgaaggcccaacacacacaaagacaatcgaaaacagcggaagactagggcgacgaccacaggcgcttgacggcaggcacaagctagacaccaaaaccttcatcttccagagactcctattctgggtttgggaaaaattgagcaagactgagtacaaccaccgtactcaacaagacacacccacaagtgcataataaatgcaagggagtacaagggagttataatataaagggttcgggttgcagcaaacagcatttaaagatacttagttgctcaaagctattttgtaaacacgattctagaacgatacaatattatttatcaaggccgtgaacccacacgaacctgtcttaacccaaggcctacgatgattcagaccaaaccggcaacccgaccctgggtcccagctcgttccaagccaacccaggccaaccattccacattgtagttgttaagcaggttttaagaattaaaacactaacttgggtacatagctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggtaggcaggactgagcccccagcagcaggacaccggccctgtgccatgacatctcgactaccgggccgcagctcgtgtagccttcatttgccctggagatgtccatcgacccccgacttcgtccatctctatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagagggggaggtgtgtgtccaattccaacataagccaaccattccatagtgtccaaatgatatgagaattcccaaagtctaaagttataaaaccacctaatgttgcctaattaatcagcgaagcatctacctaaattcatactagtggaaccatgaatagagtacacactagttggggtttggttatcctagggtgaacaaaggaataataacaatagca

SEQ ID NO: 71217 - DNA, 22176 bp, Oryza sativa
cgtacatatatcatttgacgcatcaagcactcatggtgggttaacatcacattccactgagtatacaatccttccatcatgcattggttgctatgatggtctcgtgagggcaataactttttttatgcgcatgcatttacttggactgaaaaaatcaattcttttgttagagcaatggatggagttcacgcatatgtgaactatcacatctatgaaaacgagtatggtattgtgataattattattcattggatctcttttggttatatatgtatatgcttgttttattaatgggtataaaatttgtgttctaatttgtactactccgtccaaaaaaaaagagataaactctagctacaaatctggacaggtagagtttgtgtctttttaggacggagggggtaccttttgagattattttctacacttgcataacatatttccttgcaggttgttatcctcaaatatagctgtagcacgttttgggggaacttaggtagatgcacgcacacgaagagccttgggtttttttatttagtttcataagagcatttcctattcttttatttaaacaagtagacttggtcttaagcttttatgcaaataatttataatcattttcttgttattgttttttcattcagtagtggcaatttggatacaacattggcaaaaattagaaaaatcaaaattcatatatggcttgaataaaaaaggtatcgctttttcaaaaacgatacttggttggtcgggaatatcggccgcttttacagaaatgttgggttacctaactttttcctttgatactgaagatttaaggacatcgtcgaacagaattgcattgaatctttatcatgtatcaactgttattttgcaaaagtttaggatagtaatgattgtgtaggtgacatttcggatagtatggagacccaacaagtatgcttatattatttgctaatcttatactcggtaaaagtattaaagtaactccagttaatttgtcttagatctaaaccagctcttcctgcagagttgcaagacaagatggagtaacttaatttaaaagctccaagaacagaggaggtatatattgcaaggatatgtgcaatgtctgatgtatacataccatgcagatctcacgaatcatcatgctggctgctgccttcttccccagtccccaagccaagaccctgttactaaacccccaaaagaacaaagaaaaaattttaaaaaaatctgcaccattggaagatagtagcaaagtgcaccatatttagattcttaattaaaagaaatttgctgattcagaaaagaaaaccggagttaagtgctgtgttaagattcaagtgtgtacatacctgttgtcgatgatcacaaattcacaatggtgaggactcgatggataaaacctcttcttcactcttgcattgcaattccatgttcttttatgggtttctgaaccttgaaccgccgtgtggagtgagtttgctccgtcttcttctgtaagtcttcaatttaggtatgaatggaagagtatattctactactactactacgtaacgtacagtgccaagatatgaatggaagtgaccaggactagtactccctccgtcctaaaaaaaaggcaaaccctggtttccgtgcccaacgtttgaccgtccgtcttatttgaaaaaaatacgaaaaaaattaaaaagacaagtcacgcataaaatattaatcatgttttattatctaacaacaataaaaatacgaatcaaagttggacacgaaaacccaaggtttggcttttttttttgggacggagggagtatgatgtttacgagatcacgaaattacgtttcaggataaatttagatatacaatttctacattatcaaactggtgtctgatagttgttaatcattaagatctcaaaagtttgaccggactgtatactcccttcgtccaaaacatagcaacacatagcaacctagtgcttaaatttataatattagattatgtcttatcctatcctagttgctatattttagcacgtttccatccgtaatccaattttactaagactataagtatttctatactactatgtacttaattatgacatgaatcacctctcaaccttaaatacgctaaacaactacaaaatgcttaaattgtttggacgggttgaacatacagtattacatgttatgatcagagagcgaatattacttgctaatatctaaatgctactctcaccgtctcaaaatacccaaaataccaaaaatataagaatgtagaattggatgggacattttctagtaaatctagacagatctgtttagattcgttatactataaaatatttcattcgattttagattcttatatctcgggacggtggtcgaataaagagtgtgaggaacggcacggcactgacttggagtcaaccaagactcgctccttgtgggccaagatgagccttttttttttgttttctggaccagcgatggaactccggtcaaatttttggtaagaaaggttgactataaggtacagtggcataagaacaaatttattgacgcaacgcaacagccgtaagctaggtttttttttttttgaaacttaaacacatatattagagcaacagatcaagagggcaagcccccgaacatcgtcaacagagacagcaagatgcacataatagaaaactggaccaagaacacaaacaacctcttgaaactaggcagcgcaaaagggagcagcggcgaggccgcgacgattgcaaccttaggtctcctttagcatgcagaccgcttgacgaaccgttaatccccgtcggtcgcctccacagaaactgcacaaattggagatttgctgttgagccatagattttggtgtaagcttcaccggactcaaccaaactttaccacggagttcaccattgaatctgaggagcttgaactcaacccgaatggcacacccagcgtggatgccactgcccggagacaaagagaaagaagggtcccagatccagccaccctgatgcagtgaaaagcacaaccatcgacgaatgaactgttctctatagcacaacgttggggaagagtggacttgcacaaggttgttagcggcaaaacgataaactgtagcttgtctggcaaaacagaaacagagcaacacagagtattttggcgctgcattaactggcagcttttctggattaaagcttaaccttaaatagcaaattacaagaaagttaaacgtggccatagtggcctcctaattgtgtgtgccacactccttgccacttcgcgccatcccacaaactggagcacaccacgcacgacaccacggactccgcacgaacgcagcgtgtgtcaagcccactatgcacacaaacaggatgaacagatcatgtgcaagactcaacgtaaaaacagagggaaactaactactctgagcagctagacttattactaacaaatcacccccttaagtctgactgctcttgtcaagagaacagacactgatctttgaacgaagctcctgaaacctggttctgcccagagatttggtgaatatatcaccgagctgctccgcagttcccacgaacatcatttcgatcagtttcttttctgcacactcccggatataatgatatttgacatcgatatgcttactccggtcatgatgcactggattttttatcaatgatattgtggactggttgtccaccttcagcagcggtgcggtgatctcgtcgcccagcacctccgctaacagccgcgcgagccatactccttgacatgttgcggcggctgcggcgatgtactcggcctcacaggaggacaatgccaccaccttctgcttggaggactgccaagtgacaggcccgccattgatgaagaaaatctggccggacgtgctctttcgctcatctggatcgccagccagatcactgtcagagtaaccaaccagcattggcaaagcgcaccgtgcacctgggccaaatcgaattccccagcagcgagtgcctgccacatagcgcagtatgcgccgaacggcagcgagatgatcttccctgggtgactccatgaagcgactgacatacccaacagagaatgccaggtcgggtcgcgtgttgacgagatagcgcagactcccaaccaagctgcgatacagtgtagcatccacaagtggaaaatttgaaccctttctcaatttcaaacgtacctccatgggagtctgacagggattgcagtcgttgagtcctgccttctcaagaatcttgccggcatatgcggcttgccccagcgtgatcccatcactatcctgggtaacctcgatgccgaggtagtatctgagtgcccccaaatcactcatcttgaagagcttcatcatctctcccttgaagctgcggatctcgtcgtcgtgttcgccggtgatgatgaggtcatcgacgtagacgcccaccgtcagtcgtcttcctcccctggtgcgtgtgtacacaccatgctcggagctgctgcggtgaaagccgagtgacagcaaggagctatcaagtttggcattccacgcgcgaggcgcctggtgcaagccgtaaagagctttgtgcaggcgatacaccttgttcttgtggttgtcgtcgacaaaacccagcggcagcgagacataaacttcctcgagcagctcgccgttgaggaatgccgacttgacgtccatgtggtggacttgccacccttggtgcgcggcgacggcgagaaggaggcgcaccgattccagccgggcgacaggtacgaagacctcgtcgaagtccaccccctgtcactggacgtaccgcttagcgacgaggcacgccttgtagcgcacgatcgccccctgttcatcacgtttcagcttgtagacccattttagcccaattgcacagtggccatggggtaggtcagtgagcgaccaagtgtcgttgtcgacgatcgcgttaagctcgtcttgcatggcgccacgccagtttggatccgcctcagcctcagccagtgaagcaggttcgtcggcgctcacaacatggagctcgagctgttccagcacccgcggagcgtgtccgggcggtgaggcattccccagcaggttatccaccaggcggtagcgaggcacgacgtcgtcatctgtgtcggcgtccaggatggaatcctgggtaggcggcgtgacaaactcaaccgcctccggcgacggaggcgacggaggtgccggcgtcgtgggggctgacggagccggcgatggtggcgagggcggagtaagcgaagaagcaggtgccgtcccgatggtggtcgtcaccacctgttcgacggtgaacggctcgagctggggagcaccatcgggcgtcactggtccccagtcccaggcggcgtcttcatcaaacaccacgtccctggacacatggacgcgctcgctgactggatcatagagccggtaggccttcgagccttgctcgtagccgaggagcaccattggcgcactccggtcatcgagtttcttcagcccgggcttggtgatcttgacgtgccccacgcacccgaaagtgcgcaggaaatgcacagcgggctgttggccataccatgcttcatagggcgtctggttgtccaagctttacgtcggcgaacgattcaagagaaagaccgctgtagacatggcctctccccagaaccgcccaggaacacccttcgccttcatcatgctgcgggcagtggtgacgatggtttggtttcgacgctccactactccgttctgctgcggggagtagggcgccgtcaactgccgaccaactccgagattggcgcagtattccccaaattcgattgaggtgaattcgccgccacgatccgtgcgtagtgcacggagtttgcgcccggactccacctctgcacgggcctgaaaatgcttcatggcgttcgcggcctcatccttgctcctgatcaaggttagccacatatagcggctcatgtcatcgacaagcaacaaaaaataccgattaccagccggcgttgcaggttcgatcggcccacagagatcgccgtggacgagctccaggtgttcgtcagcgcggtacttggattgcgtcgggaacgccgctcgccgctgcttcccgagcaaacagccatcgcagacttgagtgacttgttgcagcagcggcagcccacgaaccatttcctgttgcacgagcttgcggagagcaggaaagttgaggtggccgtacctggcgtgccaccgccacgccggctcggcgctccttgccgcgaggcagaccggacggtcgatgtccagcttgatggtgtagaggcagtcgtcggagcatcggagacggacgagtaggtgccctcgaggatcccacacgcgcaggacaccgtgatgaatcagtaccttgctgccggaacgatccagctgtccaaggctgacgatgttcgccgtgagccgcgggatgtagtagaccccggcgatgccgcggtgttccccgaacctgcaggagaacaggacggtgccgcggccctcgatgcgaaccaccgagccgtcgccaaacctaacagtgccggtgaccgccgtgtcgagctcggcgaaagcggagcgggacccggtcatatggttggttgcgctagtatccaggatccacatcgccggatcatgttcgccaccgtcgtctagctgcacgaagaccttggcctcgaccacggcgagttcgcccatcggctacggcgccctcggcgcgctcggtggcgagacgacgtttgtcggtgcagcgacgcgaggacgcggcggatccagctgcaccttggccaggagcagagcaggctcttcgtcctcctcctgggctacgtaagcttgctgggccttgggctcgctgcgatagtctttggcccaatgtcccctcttgccgcaattcttgcaatttcccgggttacggcctcccgggttggctggcttgggctgggcctccttcggggctccatcgtccttcttcccatgccctcgaccccggcggtcgccgttgctgccggaggagtgagcggcgtcttgcagagaggccgccttgcggaatttcgccagccattcttcctcggtgaagaggagacggccattggcgtcgacccgactcgatgccgccgcagtcttgcgctgcttgcgttgctcgacggagcgcagacgcccagtaacctcctcgagagacagctcattgacgtcgagcaaggtctcaatcgagatggctatttgctggagatgttctgggacaacctgcaacaatttctgaacgacctcagcttcagtgatattatcacctaaggtgcgaaggttgttggcgaggccgccgatccgcatcgagaagttgtcgacggtttcaccgtcctcgaagaggatatcaccgaattctcggcgcagctgctgtgcattcgcctcacgcacgcactgcacaccgatacggcgagtcttgatcgcttcccacgcctcctgcgccgtctccttgacagcgagcgtggcgagcatctcggcgggcacggcgcgaagtatcgcggcgagcgcctgccggtcctgccggtagtcgacgagatcatcgccctccggctccaccgcgccccacagaccttgggcctgcatgttcacccgcattaccagcgcccagtcttggtaatttgtgcgggtgagtgtcgggtagacgacgctgctcatggtcgcctcgcggacgacgcgttccaccacgacttggccgcggccgccatgacggccacggcgcggagacggcgagcgccagcgacgacgcggtggtgtgtgggagacgtgcggcgttggtagcgacatcaggaatcccggcgatcaccgaaggctctgataccaattgttagcggcaaaacgaaaaactgtagcttgtctggcaaaacagaaacagagcaacacagagtattttggcgctgcattaactggcagcttttctggattagagcttaaccttaaatagcaaattacaagaaagttaaacgtggccatagtggcctcctaattgtgcgtgccacactccttgccacttcgcgccatcccacgaactggagcacaccacgcacgacaccacggactccgcacgaacgcagcgtgcgtcaagcccactatgcacacaaacaggatgaacagatcatgtgcaagactcaacgtaaaaacagagggaaactaactactctgagcagctagacttattactaacaaaggtggagcagaagcaccagactaacaccaccgatgctgacgtaggccacaacagcgcagtcatcgccgccagagacagcaacagcgcagccgtgggcagcatcagagcagccaccaccgccgcgggccgcattcgagccgccgccgccaccttgggccgcatccgagcagccgccgccgccacgggccgcatccgagcagccgccgccgtcgtgggccgcatccgagccgccgccgccgccacggaccgcatccgagcagccgccgccgccgtgggccgcaaccgagccgccgccaccgccgccatggaccgcatccgaacagccgccgccgccgtgggccgtatccgagccgccgccgccgccacggaccgcatccgagcagccgccgccgccgtggaccgcttccgagccgccgccgccgccgtcatcttcggtcgtaatcgcgtcgccatcaccgagtatggctacatccgcaaccccgccgccgactccaacctccataccacaccaacgagaagcaaaacgggaagaacccgacctaacgagactagcccggctactaaactatactaggggaggggggacgacccctctccctccctccgccggcgacgaggccgccggaatcgaggaggaagaggggtcgggagaagggaaaaagaatgtagtaggcgagggttcgagagagagggttcgagagaggaaggaagctgccgtaagctaggtggctcagctgttttcagtttacttaccggatggttaaaacggattgttgctccaagcttcaagaaacatattttatcacaaagttttcttctgttgtacatctcttgctttaatttatttgttaagttttgtttattagaatattttagacgaatatttaattagatcatactttaatcaagtagataatccacaacaacaatttgtttaatatttttttcagctagtcaagttccctattccttttttggaaacagtccctattcctcaatagctcccaaatgcgtcgtcagcgacagtggcacggaggtggttaattaattttcaccctcaaggggacaccccctccccttgttttatgcacataatctgaaaggtaataaatatatttgtaagatcgattcacaaataaatagaaacaaatataactataaccattgtacaatgttggtatatctattttcataacttgcataggtcgaatgtgaatttgtgtatttacatagtgatagatattaatattgatctatcttattatttttttatgattttttaatgacactagtattataagtagagtaaattacattttggaccataaattcttgccaaagttttactttgggtcaccttacaatgtctttttcactttgaaatatatattattgtcaaatattgcactttggaccgggtggcccacatttaagtgacacatgaacaatagaggtggttagtctgattgatatgtggaccacccaatctaaagtgcaacattggaaaaaaatacatggtccaaagtaaaaaaaaaacatggttcaaaatgaaactttggtaataatttgtgacccaaaatgtaatttattcttataagcatatgttttttaaagtaaaccaacacatatatgtgatatgaattttttttaagaaaaacaacacttttagtatggaaccgagtcaatgacaagagagcccacaccaaattgtctgcgttcggcaccaggtgagagagaagatttatttagttttccgcatatacgcttctagaactactaaacggtgtgttttttgaaaaaaaaaatatataggaaacttaccttaaaaaatcatgttaatctatttttaaaatataaaattattaatatttaattaattatacactaatggctcaccttgttttatcgcttatcaaccttctcttttccttgacactctctcaccctcagtgacgccacgcgtccgtctccctctccatcgcagcagctgcctgtcatcctcctcacctgcaatgtctcctcgtctccgccgccgctgccgccgggttagatatcctctcatgagcaaccagaataggccctatatatactccctttctccctaaatatttgacgctgttgactttttaaatatatttgaccgttcgtcttattcaaaaacttttgtgaaataggtaaaactatatatatacataaaagtatatttaacaatgaatcaaatgataggaaaaaaagtaataattactttaattattaagttactaataattacatgaagaagaataaattacttaaattaggcgagagagaggtggagggggaggaggagcagcggagggggagaggcgtcgccgccattgttttgagagagagagagggggggaggggaaatgattttagagttacagtttggactgttatataggtcgggatcaggtcgggatcaatcaggattgtccatcagatcagacggccccaacttctcccgcgtcgcgctgggcgccgttctgtaacaccctgaaaatttgaccaacgaaatcaaaacaccaaaaatacggattttcaaaaacttttcaagaaataaattgcatcatgccgattatattcgcctgtttcattggattttgatctgggaatttattaatcgcgaataatgaataactaactaggaataaaccctaaaaatcaagttggctaaataaataattaaaatataaattaaaataaagattaggtgggattggaaataaataaaatattatcgcaaccatattagcaataattaaattttagtacgatggaatgagaattaaccctaattaaaaattcaaataaattatataaacaaaatatgagtgatattaaattagggtgaatttttagttaggataacacaaatatggagtaaacttcatttatgtaaaaattaggaattgtggaatcaaatttataaaagaaatagactaaaatgagaaaaataggaaagtgcactgttcattgcactctaggtgctcgacgtggttcccctagccctagcccctcctctgccacgctgcctcgcgcaccgcgcgccgcgcgccgctccgcctcccctctgccgtcgccgctgtcgccgtcgcggtcgacgtcctgtcgccgctcgcgcgtcccatcgccgcctcgcgccccgagccgccgcgcgccgtcgccatcgtcgcttgccgccgtgcgccgccgtcccattgccgctgccgcaccgcgtcgccgtcgtgtcgccgtcgccctcgagccccgcgccgccccgtcgccatcacgtcgcccgtcgccgtcgtgtcgtcgtcgccgcgcgccaagccccgcgccgcgccgcgccgtcccgtcgtcgccccgcctgtcacgccgctcccacgccacccgtcgcgtcgcccgtctcccgtcgcgtcgcccgtctcgagccccgcaccgcagcccgtcgcatcgccgttccgagccccgcgccgccatagcgtcgccgcccgcgtgtcgccgtcgtcccgccccgagcgccgccgtcgcgtcgccattacgccgccgcccctcctcctctcctttccccctctctacaaatacccccccctctctccattttcccccaccccatctcacccttcctcccctcttccctctccactgcgccgccgctctcgtgccaccgcgccgccgttcctgtgccgccgcgccgtcgctctcgtgccgccgcgccgccgttcccgtgctgccgcgttgtcgttcccgtgccgccgcgccgccgttcccgcgccgccgttcccgtgccgccgtgtcgccgctcctgcgtcgccgtgcgccaccgtcgccgccatcgtcgtcgccgctgccgccgctggtgagccgccctccttcccccttgcgtccaccgccgccgctcgtgtgggagagagccgagagagagagggagaggaaaagagaggccggcagagaaaaaaaaggagtgaggagagaaaaaggagagaaaaagaaagagagggagagaaaagagagaaaaagaaagagaggagagaaaaagagggaaaatagaaaagaagaaaaggagaaaatagaagggaaattgggggagaaattaggaggatttaggaaataaaaatggtcggggttaatcatagattatttttggaaattcctcgagcgtaatagtatttcgatcaaaattccgagttaattataaaaatatgtttcttgatcagattagattaaaattggtagtaatttagatataattaataactaaacaattagatgaattcttatagattattatagattatttttggtaatctctataagtcatcggttcacggtagaaattcggatttaattactaggaatcttagccgtgtattatatttaatcgtttagtcatagactaaattaaatcgtataatatttctaggatttcgtccgatatttagctcgtaatagaaatttctaacctattatatggatataatgctcgggatgagtaaattaaaaacttatgacaacaaaatatttatacccgcaaaatagtttaaatcgaaattgggtttgccgtagttcgcagatagtaaagttaataaaaaggaatcgactttcgcattcgactttcatttagatttatttggatttttatttgaattctaaccgaattcaaatcaattttcgcacgtaactatagagcccgagggagttgcagatccaagcgaaggccaagacccgcaagactttgagcaaggcaagtcatcactattccttgaacatgttgatcctaattgcgtaattgttttgtttacaaataagatgaacatcctacttgtgattatgccatgccttgattattgtttacccttaaaatccttgtaaccatgattacgtatgagtccctagtcaattatgacaattgcttagaaatgccattctagaatcatgcatactcatatttatcaaatgctatatgcttgggcaattacctttgggaaggtaattgagatgcggcatgtggagacatgagcgccacattgccatgatgttgatgacatgatttgtgagaggagaaataaaatttaaacaactgttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacggtgggacagccgttgaggtagggccgagaggcgtgccctacatcggtgtcgccattggtaggactgccatgagtgtgtgagagagagaacttaacttgaaccataatttaatatgtgtgtgagacttctctttcccgggagcgccagaactcctctcactgctagaaacatggacgcctagagtgcatgaggatttaaattcatggagcgggtactgccaatgcaaggttatcgaaaagctttgccgtgacgcgtctcatgtgttgggacgaggctcatgtgttgggcagtcgcagagtgcgggtaaagtgtacatccactgcagtgtgagtaaaccaaatctatttgaatagccgtgctcgcggttattgagcaccgggacatgtattacacttggttagactctaaattctttaacttgtgtgggatgagatattgcatgatgatttttatgctgatggagccacttcctgagaggcgggaatgtggacgtcctcagaaaaccataacgactcaatggcgggaagctatccttgggatcacaatggatggtggacagaaccgtcattgtttaatatgaacactggtattaaaacttgatcagtctatgctaggtcttaggcttgtgaaaagaattacaaaacttgctttgcgcaaaagaaccatagccatcctttgaattcctctgtcatgtgcatcattgctgtggtggcttgctgagtacggttggtactcacccttacaaatataaaattaatcagaagcgggagatgaagcctcggaggatccctatgcctactaccaggagggagatgaagacgatggcgctcagtaggtcttagtacggtcgttgcctgtggcaatggcatgccgctgcctgaattccgctgccttatctatttcttcttttggatgtattccggaccgctcggtccgatgatttaagactgtgcctgcgggcttatgatgtaataattcgtactagactctcgtgtatgtgcacttgatatttcagctatgagttcgtgtgtaccagactacttgatccagggaaatggtactgtttacacaattgattcctgttataaaaacgggggtccacacgttcccatgccacccacactattgggccgcgtgtaatcttctcacagaataagttcactttatgtccctaaagttatccccccactattggccgcctcatgggcctgtatgctccgcatggaataagtacacttgtggtcccttaagttgaacttttttttatttcattaggaatatattttcttaaagagctcatatcatgtgaaactaaaccctaatcatctaatatttttatatttagtatataactaaaaaaaatgcccgtgcgttgcaacatgtgaaggctattttaattatattattgttatgctagaaaaatgcgcgtgcttcgttacaggtaaaaacagttaaatgctataaagtctagagttaacatgtatatagtaatgtttcaagatagataaattattcattaggctaatgataatcacgacggataaaaaaatacgctcattctctccctcaacccttgtgtgacaaactgtgatatcatttccaaaatcgaacacatactcacgtagagatggatcgtgtcaggactcacgcgtggacgacagaataaaatacctgtgcattacattgggtaacattgggtaatggttaggtggatgaaatttgacctcaatgatttactgaagcacctaagtatgatcataaataccggcgataattcatagttgtcacaaatgtcacaaatgcatatttgtgcttcgacaattaatccgctctacgcgtgcagaatatgaatgatgtccctaacacatggtcctgatgattgtagcattggagaaacggatgtccgagcaacgcatcttcacgtataagtcaataatgaattttttgggaggtcattaattattttaaactacatttttatgacacttttataatcttttttcataattgatgattgctataacattgcattgattataagcacaatggaacagtacagtactaagctctaaccgactaaacctaaacagtgccagccgtatcataccattcctttttcttttgtagaaaacctcgtagcgcatgattaattgagttttattgttacaaaattaagaaaagttatctcgtattttatattaacttgtatatagaaagttttaaaaacgcgctaacaaaaatcgagataaaaggaacggagccatggtgtgaagtttcatgccatgcacatattcaattttcatgttttaaaaaaataccggttggttcacgtatttatactgatttttttatataatataattatctttaattttcgaattaaaaactagtgcattataagatttcagaatcactaaaagtctgttgaagaaagcggtgcaaaacttttgatttttcagccattggatgtgtatggtccgtgctagtggttgagagaaaaaaagtttacgcgcaaatatgatttgagaggagggagggaaagtagacttattctaggacctaggtaaacaatatatttatattgatttttgtgtatataatttaattatatttaatttttgaattaaaaaccaattcattataaaatttcataatcaataaaaatttgttgaaaaaagaggtgcaaaacttctgattttccagccatcgcacatgcatggtctgtgcaagtggtggagagaaaatttgaaggcaaatatgatttgacacgagggagacaaagtagacttatgttaagagaggcctatagacttgatcaataaaaatctgttgaaaaaaacggtgcaaaacttctgatttttcagccattgcacatgcatggtctgtgcaagtggtggagggagagaaaatttgaaggcaaatatgatttgacacgagggaggcaaagtagacttattttaagagaggcttatagccttttttttaacaaattggtccttttcaaaaacttatttcgaaactagtccctacaaaaaacttcaactaaaaataggccgtgaactcagcgccattgacattggcgctgagctataacgtctcagcgccaacaacgttggcgctaagctcgaatccgaggtagcatgaatttgctgagtcatcatagcttagcgctaaggtatttggcgctgaggtcctgatgatttaaattgttgcggaggcattcatcttcaacaacgcactaatagcatagtggtagcaggcatctactctatccctatggagcagggttagatcccccttctctcccatttttcttctctctctctttattttttttcttctttttcttctctctcttactctttattttttttctttttcttctttttcttctctctctcactctttttttttcctttttttgttcttctttcgatcccccatctctcccatttttttttctttttcttctctctcactcttttttttttctgtttgtctcatgatactatcttcaaaagatatgtttaaattgcaaatttttttgaatttggaaaaaaatattaaagtggtatattatgtgccaattgagaacttaaactattttgtaaacaaaaataaaaaattaattttgaaagaatgctatgaggaagagaaaaggaaaaaaacattttaaaagaatgctacgaggaagagaaaagaaaaaaaaacctaaaatacaaaaaagaaaaaggaagagaaaaggaaaaaaaacattttaaaagaatgctatgaggaagagaaaataaaaaaaaacctaaaatacaaaacaaaaagaaaaaaataattttgaaataatgctatgaggaagagaaaaggaaaaaaagaaaaaaaaagggaaaaacattttaaaagaatgatatgaggaagagaaaaaaaaaacctaaaatacaaaaaagaaaaaggtgaggaagagaaaaggaaaaaaaaagaaaaaaaagggaaaaaacattttaaaagaatgatatgaggaagagaaaagaaaaaaaacctaaaattcaaaagagaaataggtgaggtgggatacaggattcgaacctggaaccctacggctcacagcttgagccatcaaccactgggctatcactattttgctatactagagtgcttgcgcttctattaaaatcgtctgggcttcagtgccaaacaccttggcgctgagttatagtgactcaacaaattcataccacctcggattagatgttagcgccaacgttgttggcgctgagacgttatagctcagcgccaggatctatggcgctgagtcaacggactattgaagttttttatagggactagtttcaaaataagtttttaaaaaggaccaatttgttaaaaaaaacagggcttatagatacagtgcaagtaataataggttggaagaggaaactgggagtggagcccaggtggctgaaatgaaaactttcacccttaaccaagtaggcagacacctacaggtgacaggaggttacatagaagatacatacttgtatcatatcaaacgcggttttggagtggataaaaaaagggccgattggactgtttaccggattaaatccggattttagcgaagcgctggtgtgacagacgaaaataaaacacccggaaaccttacgtattttttaattaggtatatagatatagattttagtttacccgttacaacgtaccggtattttttttagagcatgaaaaaagaagaagcaaatagtaaaaatataatgtacatattatttggggacaattgcttatttgaccctatttcagagcctaactaccaatctgaccctactttttttagtttgctcatttgaccctgcttttaaaaaatgaagctgccgtctgaccctatttctattataccgttagggtttcatttaggaaaagaaaaaaattcaaattattattcaaacggacaaaaatacccttgaggactcaaccctatccattcgcactcaaccccatctctctcggcgccggtgagcagagggcagcggcagcagctgctccgcacggaagaagggaggcgcaggagctcgccgccgccgggcgcgaagggaggcgtgcggcgcgggagctcgctgccgccgaccgcggaaggaggcgcgcggcgcgggtcgaggatggcgcgggagctcgccagcaggtgtttggctgctgctttgtttttgctgttgctgctgctctccgtttctctctggcctctctttgttcttgcctggctggaggtagacggagccggtcaggaggactgcatgctgttggtgctggagggattaagtgaaatctaagtgaattttgtcaaaaaaaaaagttaaatctattaaaaactcgtcaaatccctcaaacctaatttaaatttgtcacttatcgtaataaaaaaaaatatcacatttttagataaaaatacacgaaattagacaagcaaaaactttgaaaaagttgagtcaaatgagtgagggcataaaagccatttttctctaaattaacaccgttatgttggcttaacaaaaaagagggtcaaaagagcaaacttaagaaagtaaggtcaaattagtagttagaccttaaaatagggtcaaaaacgcaattgcccctattatttgaatatcatgttgcaaaatgcacgggctgacgggcatcgtgttagttttagaaaaagaaaactctgatactatttttcttataaaagataaggggaaaaaaaacgaaccgactcgagcctgtcgatcgatctgcaacaatggcagctgagacgtgcgtttcggtgtcgcctgcagaggtggccgaggcggcggcgatcctcgacgtcgccggcgacggcgacggcgaggcgaaagggcagatcgtcgtcgtcgacgacgactccgactccgaacccaacccgtacgagtaccgcgtattcttcgagtggttgtgggacgactactgcaagatcgacgacgtcagtaagtagtattaatttttctgttaattcctgaaatcttagcaccaacaatattaattcgatctggatcataatcgaatatatatatatatatatccaggagaagaagatcaaaacacgacagatataggtggtgtttggatccagagactaactttgagtccctgtcacatcgaatgtttgcacattaattagaattattaaatatagactaataataaaactaattgcataaatgagagctaattcatgagataaattttttaagcctaattaatccataattagcatatgtttactatagatcacataggctaattatggactaattaggctcagtagattcgtctagcgaattagtccaggcttatggaatgtgttttatcattagtctatgtttaatatttttaattagtgtccaaatatccgatataacacgtactaaaatttaatccctagatcccaacatgaccataataatctctctaatttgatcttttttgcaatttgctgcagctaggggccccacgttccgaacgcccggggcgcggatattcccctgcgtggaggtgtactcgtgcagggtgattgacctcacaggcggattggagtggccgatcaatgtcttcggcttcgtcgcggtgcgtgatgggctcgaccgcaagcgcaactacatcttcaatcgcccgaggggcgacgcccagacactcaccacggaggtatattatataaacttataaattgtgaaaatgtaggttcagtatatctcggactaaaatttcaggatttttagttccccgtgttagggaatattttttcagatgtggttgaaatatgttaaaatttggaactattcagaaaggaacttctttcaaaatttgggtcgatctatgggccggtcaacccatccgatactttttagtaatataaaatttgcgatattgaaccccgacttgtttgtggtgaatttaattatatgttagcttagaaggattaccagttaataactaccgcaatgttctagcttattatgcattgacatcacattgctatgattatattttttttagacaagtcaattggaggggagagatttctcacctgaatttcactattcaaaagatgtaggcagcacatgtttgagattggattgaattgagatttcgaagtggggaggaaaacaatcttttccagaccgaaacattgacagttggtacggatttcaacaacataaataagatgttataatctaactgaactgatgaaactccatatatgtccagctgttgatcttgcataagctatttgcaagtgtggttcattgtagctaaatatttcatgccattgttgctgaaaaataaaattttaaaaaagacctatttgatcactttttttatggatacttgattaattcagatatctatagatgaaatttcacctagattttaaccatcgatgctacattctctataacatcgattgcttgggttactgatcaaagttctaaatggtttacttcagcgaatatatcatgtcaatattgcttgtgaatgaaacatatttggtacaataatatatgtttgctacttgtttttactcgggagtttttttagtatggttctatcaactttataaaaaaaactagtttttacccaaataacttggatatgtttgcaggacccatctttcatcttgacagggcctatccgtgcaatcaactgctctcagcgtatcgaattcgaaatcgatctcaaggttagggggaaaacacaatccgataaggataaggtgttgagtgccagatacattgtgtatgaaactatggggccaaatagtatagttgggcaggttagatcaaaggcaaggccaggcaagcgttgctcggtagaggtcacctttgcccatctcgcggggcggtggaggcggcgatcgaggttagagttgttcaaggatcaataagcggttttcgtggaagattcgtcgcgagaaccgatggttacgatgacgatgtggtgcttgttgattccagtaaagatggttctgtactagctgttgctgatgatggtgtgatcaagcttgctcggagtgtcgccgtcgtcgaaagtacaggggtgctgaaccttcatgcgatcatcactcgaaatgatggtagtagtagtggggatgatggggttggtgttgctgctgaagatcatgccgagttcgctgctcaaagatttgaaagttcttgtagaacacttgatcttgggttctgtaagatgctggcaactgtctcctggtcaatgattcctttgatttagtgtctccctaaagaatgatctcatgaacgatgacaatgtcaatgtgcatatgtcaagagttcatccttttatctgacttgagtgcagttaattgtaagctatacgttatcttccgtttccagcctaaattgatcaactcatggtcttcagagaattaattctgaccagcctgactgagaatgtacaatctcacttaggttcaatgcgagtacatgatgatttgtcgttcgatttatcagacgatgtacatgatggatctctctttggccagataagtccttcctttctctccttgcatcatctgaagcaccttgacctcgcatggaaccagctccaggggcccgattgaagtcttgtgatttt

SEQ ID NO: 71218 - DNA, 6396 bp, Oryza sativa
gggttagaggagagaaaacgaatccgaattgagctcgaatccaacaatttccaagcgaaattagatgtcgattctataggagaaaagatagaggagatcaaggggatcatttcccctctaccaatttgaccggatcgggaaaggggcgatgtaatttggaagggggcggcggcggctggcgcgctagggcgtggctgcggcgtgaggaggaagacgacggccctgacaggtgggcccacctgtcggtgggagagaggagggagagcgggcggcgcggctcggcgggctagatgggccaggcgctagcaggccgcggagagagagggagtgaattgggccgactttcggcccaaagccaaaagaggattttaaaacctttttctttttaaattattcatgaaatgcaattccatttattaaaaatacgtccttggctcaaataaatcccagaaaaatctagtaactatcgaattaagagaagtatttaataaaattttatctagcccacttttatattggaatttattatttaaaattagatcttttcttctaggcttttaaaatcatttctaataattccatttaaacaacaattcataaatttaggattttcagggtgtgacaaagtagcaaatcttgcaaagtagaggcaatagagtttgccaatgtcgaaaataatgaaggtgaagtcgctccacatggtgacaaagttgcatagccgtgatgacgtgaacacaagttggcagcaacagaagaaaaccggtggcgaagatgtgtagtcgtgaagatagatactccggtcagctccagaaaaaaaaatagtcgatgtcaaacaaggcggccagcaatgaagacgatgacatccctcagtagtggttgcggtataaaccagccgtagaggcgagggcactagtcagcagcagacgagacgactggcgatgaagacgataaggccaatcaacactagcagaaccatgcagccatggaagtgaagaaaccagtcggcatcatacgtagacagcttgcgttgaagatgatgatgcctattagcggtggcggcgacgtggccggtcggtgaagacgtagacgcccaacaacggcggcataataggccagccgtgcaggcggagacaccagtcggcggcggtgaaggcaagcctgtcggtgaagacgaagacgcccaacaacggtggcagaataggctagccgtgcaggcggagacaccagtcggcgacggcgaaggcaagccggtcggtgaagacgaagacgcccaacaatggtggcagaataggctagctgtgcaggcagagacaccagtcggcggcggcgaaggcaagccggtcggtgaagaagaagacgcccaacaacagcggcagaataggccagccgtgcaggcgaagacactagtcgacggcagcgaaggcaagccggtcggtgaagatgatgatgcccaacaacggcggcagaaaaggccagccgtgcaggcggagacaccagtcggcggcagcaaaggcaagccggtcggtgaagacgtaaacgccctacaacggcagcataataggccagccgtgcaggcggagacaccagttggcggcacgaaggcaagccggttggtgaagacgtagacgcccaacgacggcggcataataggctagccgtgcaggcggagacaccagtcggcagcggcgaaggcaagccggtggtgatgttctgactgatccaatcctgaagcgtaggagataagcttaaagccatgaatcccttttatgcatatctggatctggatcctacagaacaagcatataggatgagtagtatctgatgtatatataatattcaagtattttaaaatatttataaatatatatttctcctctactcaatttcgatttccccgagcagatgactctgtacgtttaaacactctgtccgactagtcatagcccccaagcatcgggagtcggtctaggcacttcccaaacatgcatatgagtgacatgagttcgtcattaatggaacaaagttttacgaatcataatttactactcgggtacttttgcaattgtaaagagcagaaattaaatttatcttatctctatgcttttgatttattccgaataatacttagcaccttgcgttactcgctccatccaacgagccctcgggtgctaggaatcagcccaaaggcaactatccatcgacaaaccaaacggaaagcataggaagatagaactccataactcgataggcacttttgtactcagattatgtcgcaagcaatcaagataaatattatgatatttgttaaaaaaatatgatataacgtctgtagcccctgattcgctagtcaacggcgaaccagttgacatagtgagacagaggaaaaggaaaatatcatataaagaaaaaaaataatgacttagctttgtaatattcctcttgatgacggcagaggtggctgatgtgggagcaaagttgtccatcaataacaatgaagacaccgggcaacggcggtgaaggcaagccggtggtgtagatgacaaggcccatcaatggcggcggagtccgccaactgtataggcgaaaacaccagtcgacagcgacaaaggcaaaccggcagtgtaagcgaagacgcccatcaacggtggtgtgaccaaccaaccgtataatctaggatactagtcggcggcaggcgaggctgggcagcaatgaagtcatagacgtccaacaacgccagccgtgtaggcggagacaacagtcggcgacggcgaaggtgagccggtcggtgaagacatggacgcctaacaacggtggtgtgaccaaccaaccgtgtaggcgaggacatcagtcggcggcgacgcaggcaggccggcggtggagtcgtagacacccaacaacggcggcataataggtgagccgtgtaggcagagacaccagtcggcggcggcgaaggccagccggtcggtgaagacgtagacgcccatcaacggcggcataggccgtgcagacggaaacaccagtcggcagcggcaaagcaagccaacagtgcagacgtagacgcctagcaacggcgtcataataggccagccgtgcaggcgaggacaccagtcggcggcagacgaggcggccggcggtgaagacgtagacgcccaaaaacggcggcataataggccggccgtgcaggcgaggacaccagtcggcggcagacgagggggccggcggtgaagatgtggatgcccagcagcggcgacagagacaattggcatgggtacatgcaaaataaatcaactaacagattaatctgttcagtaccacataaaataaatacaggtataaagaagcttgtgtatatacgtttgcatttatcaatgcgtatatgcagctcgcatatattgattggccaattaatctcctgtagcatgaacgcttgatatgcatccacacatcgcctgaccaatccatgctcgtgcaatctagttgggaagcttgtcttcttatgaatcggactcaaccgttcattagacatgcaaaaatatatatcacaaattaacttgtgattagtgaaaaataataattaattaattaatataatcgccgtaaccggccagatgatcggttgagaactcgacacggcagtaagcgatgctatccgaaatctcattatagatctctattagatcagccattgaatattggccgacttcagccaaatcgcagggcaagatcggacgcagaagctctccgccaacgccgagccatggtgcatatggttatccggaggcgatcagcagatctcatcagccgccagtgcatgcacacaaacaaagcgtctcacagaagagcaatccatgattagaagaatcaatctaataacaatatattgaaacgacaaaccagtagacgtttggagtggtcgaaattgttgagattaatctcaaccctgcttttggaattgattccatcacacttctttgataggaactcgacgtacccctacctggagcgccaactgtcgaaacatgaattcagcaataataaaaggggtagcgcacgagacctaaaagtggatggatgcggagacaaggatttagacaggttcaggccctctcaatgagaggtaataccctactcctgtttggggatttgaatccgccaagtgcattgtagatctgacgatctggttgtgtgtcatgccccatatagagcctcctgcccaccttatataggatggggggcaggactacaagatagaaaccttaatcaatacggtatcggtttcctaaatctactttacaatcttatcaaactaggactttaggccgttccataatatacagggaaacgtaatacccaagtcatgatccgttacatattccatagatataagttatctcctataaccagtctaataaccatgccgtgtgggtatggggtacccataatctccacacgaacgatgacagatggcgacggtggcgaggtcgaggtggcgatggtcttcgggtcaacggcgatggtcttcgggtcgaggtggcggtggcgacgacggcggtccagcggtcttcggtgaaaacggagggtgggacgatgacggcgatgaccttgccgctccggcgacggcaaccccgagcgacgacggcgactagagtggtggcgcggcacggttggacacgcggcaacggcggcggcgcacgagctagggcggaggcggctctaccagctacggcaagccaaggcgaggatggtggcgaatggacgaggtcccgggggtcattttatagcggcaaagcgcggcggctaggcccacggcgagcccggcgagatggaagatttagggttagaggggaagaatcgaattcgaatccgggctatttccatagaaatttgcgatagttccaaaaaggaaaaggaagaggagatccgggggatcatttcccctcaaacaatttggccggagatggaaaggggtggccggatttggaaggggcagcggcagcttgcggcgcgggtatggcggctggaggttgaagacgactgacaggtgggccccacctatcagcggaaaagagagaggagggaggggtgcggcggtctgggccggcatgggccaagcgcgcgcaagccggggagagagagaaaggccaaacccaaaagagagattttaaaactttttctatttaaattattcatgaaatgcaattctatttattaaaaatacttccttggctcaaataaatcccagaaaaatttaggaactatagaaacaatagaagtgttttaaaaaattatctagcctactgttatattggagtttattaacttaaaattagatctcttgttttaggcttttaaaattatttctaaaggcggcgaaagtggtttgtcccgaccacaaattcggccgaaccgccccagcttccacatgtaagctcatcttggtcgccccagcagttacctccttaaaatatggtataatttatcaaagatattaaaagttcaaataatattaataatgtggactagtgttaagagatggtctcctattaaaaatctaaaaagatagattgaaggttgtagagttataaagaaatgtgatatgtcttatggattcaacggatatcaaatagtgttgttcaccggatatacatattattatccgtgtctgttagaaaccccgataccatattcgtattcgcattcggaaagattagccgtgtccggacttttcgagaattatccgcttcaaaaggaatccgtatttatttttctccacagcgaatagaaactatccgctccgttttaatccctagctagggcgggcttgcatctgtccatctaacttgcttgacattttcggtctgttcatctatatctcgggttggtacgtggtactagttactactagatcagcatcgtagaatatctggtgggagtacgcgtaggagattggaaggacagtgtgatccataagggtacaatatctgccaagcacgtgctttccctgagctaactaaattaatgcatctaactagtactgtacttgataagatcgggtcagcaaaggtggacaatatatactacttcctccatatttaaatgtatgacgtcattgacttttcgattgactttttgactgacgtttgaccattcgttttattcaaaatttttgtgtaaataggaaaatatttatgtcatgctttaaaaacatttgatgaagaatcaagtcataataaaataaataataattacataaatttttttaaataaaatgaatagtcaaacgttaaacaaaaagtcaacagcgtcatacattaaaatgtggaggtagtactttattagactccaagtcccaaccatatgcatatagctcagattggtatagctctcgccgtggct

SEQ ID NO: 71219 - DNA, 1560 bp, Oryza sativa
atccgtacacttttacatcttaccaatgatgtattcatctatcctataccaatgatctaaattttctccactccctctccgcgtcgcaccttcccgttccccgttccctgttcccctctgcccgcgtccctctcccgtctcgctctcctctctctctgaggtttttccttgcatttaaaaagatagtgtctgcctctgtgccactaaaaagttcgagcctccctctctgtcatcgtcgaactttatcgtgtcctccacaccattccgtatgtttttggtcgtaacggtgggtaacggcgtagccaaattacttagttgcccttaggcttgagaggccatttggtccaatatgctctctcctagcactctcctctctctcccctcagatgcagcaacaacaaaggagcgggaggggagaagacggcggtggcagcatcgctgcgacgatgacgatgacggcggcgacgacagtgctgggcgaccccgctgctctcatcgttcccgtccacggccgtcaccgggtgtgtccccacccgtgcaggcccggaaggtggatgacgacgaggcgctccttcgcgtgccccctcctcctcctctccgccccaaccccgtcgctgtcctttcgccgcgggcctagctccgcgtctctcatcgccgcgagcgccgacgctgcctcgtcgaatgcctcctccccccgcctacaccaccgaccgttacgacggccatgagacggtgcaggcagaggcgcagcgccgccgccgcgggggtcgacttggccatggggctagctgctggtggtggtcgcggtcgggccgctgcgaggatcggagggtatgggcgtagtggtcgccttggcgtcacggggaggagggggaaggagtggtggtggtggggaggagaggagaggagaggaggaagaggattgaagagaaggggttaacgatgatcggtgagcagccgcgcggtgagggcgacagcgagcagcgagctacgaggcacggtgagacggcggcatgacgctaatatctcaacggagagagggggatcgagggagaagagagagggagagtgattgaaagggcatgcagcgatatttttcctgtctgaacccacatgtcagagctgccaaacggttaaacccaaacagaacagtgacaggatggtgtggagggcatgataatggcacaatggcagacaccatcttttaatggcacacatgtcagagctgccaaacggttaaatctaaacagaacagtgacaggatggtgtggagggcatgataatggcacagtggcagacactattttttagggtgtgtttggttcttggtcaagattggatgggatacggcggtccatattttgctagatatggcggtccagtattttgtttggttgtgtgaatatggcgatccaattttttgtttggttgtagggacaaaggtggatttggtgatccaattttttgtttggttggaggaagtatggtggatttgtaggtgtggtcacctctcacttgagatggtgaatatacctcatcaaattaatacataatacacat

SEQ ID NO: 71220 - DNA, 2511 bp, Oryza sativa
aatcttttgagcctaattacgccatgatttgataatgtgatgctatagtaaacatttgccaatgacggattgattaagcttaataaattcgtctcgcagtttacaggcggaatttgtaatttgttttgttattagtctacatttaatacttcaaatgtgtatccgtatacttcaaataaattttagcacacgaactatcacacagcctgcgtttgtattgtgttttaaaagaaaacgatatgagaaagcaaaccacagcaagacaagagcccaagacatcttgagaaaagctaaaggaataagtctattttacgtccccatacctttgatcgaatcatctccttgaaacgcaaaaccggtataatacctcctccatctttgaaaatggactaggcacagttttcaaagataaaggaatcaagatagactttttttgagaataaatcaagatagactcaattgcaaaactaaaaggaaaagacgtaccctagcatatactgggccgcgttacgacaaggagcccaaaggccgaagcccatatgcccccagctgaacactacttatataaagcgaattgctccagcagccgtcccttgagctagggttttatcgccgccgccgccgcttctccactctcccctgcccccgtcgccgtcgccaccgccgccgccatggtatgtttcctgtgacacacactatctctctctgctctcctcatgttaggccgaatgatgcgttgcgatgaccatggtgctgcgtttgcggttgacagtccgggaggaagaagacacgggagcccaaggaggagaacgtcaccctcggcccgaccgtgcgcgagggcgagtacgtcttcggcgtcgcccacatcttcgcctccttcaacgacaccttcatcgtcagatcccgccctccctctcctccccccctttcccgttcgattggtcgattgggattttttttttttgcttacccctgtgcgattttggttgcgttgcagcatgtcaccgatctgtccgggagggagacgctcgtccgcatcactggtaaaatcctcccctcctaagccccttccccgtttatctcgctctctatgccgatgtgatgcattaggggttgcttattgtctgaaatggtggagacaatttgtgtttttgagttcatgtcgcgatgttttttttttgctcatttgttaagcacggcccttaagatcgcctccctttcgtcacgtgggagcgtttcgagtcatagctgtgctaaagtaacaatgagggacctcggagtttttctttggtccttccctcttcctgttttgttctaggtatctccatctcagcttgtgtatcccttggtgtggctcggacttttatcagtcgcaattttgtgctgattgcctgagctgttcaccctgggaagcctcggtgaattgaatggagatgtctatattatgggagtggacatggtttatttttcttcaagaatgtatttttatttgcccacgctctgtgtgtatatataacttattaccgcattttctgttagacgtaattattgtaggatgttgtgaatatatcagttgagattggtaaaaagttcatgatagcaatcaggcagtttcacagttaatttaaattatcgtgtagtcattagaaaatagttgtttttgttttcagagaaatggtctcatttttgtctttactgtggatgttgctgtcattttctttataaacttgaattatttctgtggttatctttgttaaccggttgtgcgacggacttaagttaaatgggtgaaatcacaacttaattttacatgcttaagattaatatcagattgaccatttaatataatttatatattcattctagatgtgtcttttgtaggctgttatcattttctttgttataacaatgttcagttgttttaatatgttaattgtttgttgtcaaggtggcatgaaggttaaagctgatcgcgacgaatcttccccttatgctgctatgcttgcttcacaggatgttgctcaaagatgcaaggtatccccctactttggtcaagataatactgttgtttgtcagttaatgattaatgccttgtatccattttgtaggagcttggaataactgctttgcatatcaagctccgtgctactggtggtaacaagacaaaaacccctggtcctggtgctcagtccgcacttagagcacttgctcgatctggcatgaagattggtcgtattggtaagcatacaaacatttatttttctgcatgatgcttgctgatatatttgttggatgatggttggtttatttgtttattctgtttgaactgttggcctgttctgttctaatattattggacagcatgaagtctgcaccaggaggagcacttcaatgttaaaattttattgaaacaaatcctgcatgtaaaatatcaacgtataagcattgcttagtttataacttgtttcaatgctatatcaacaaataaataatatatagtttaaccactct

SEQ ID NO: 71221 - DNA, 948 bp, Oryza sativa
aaatttttttagatttttttatgacatttgttagttggtgtgcacgtgtgtacacatgagatcttgtgtgcataggatatgttgccgatattgatggtgttagtatttattacaaacaactaactaccacatatttaaataggcaaccaagtaatactaacatatttgattaaaaatgtatcttgtctatggcatattatgatatttttttttactcatagctagcaaaacatgtgcattttgatagtgcgtgtttattatactaccactctaccaataggtacgtataattatcatatatatatatatatatatatatatatatatatatatatatatatatatatatatatatataacactcactgtcacgggacgatttaagtaacgatcgatctgtacatatatacatgcctgtatgtataacgaccgtgcgagagtacgtacagttgcgcgagttgcccaccgtacgtgtattacgtaacgtatacgcgcgtacgtgatcgatctatcgccgcgctggatccacctgcatgcgtaccgttttctcagcgcgtacaaaccattattttactagtttgtcacaattactagctagcttgctctgtttggcctacctctcttatatctaacctacaagtgcagctatagttctagctcgcatagccgacggtcgtctcagtctcgtgtcccatgtcaaaatcgattctcaccatcaaatccggtcgaatctttatcaatcttctaattaagattggttgatgatttttgatacactcgatcttctctttctgtttttatcaaaatcgaagtgaatccataaaactcaggataaaaaaaaggtgaatagagattaaattcggtgaattaaaacggaattgaaaggagaaaaattgagagcagtggagaattaacttttacaattaattgagagaaggaacacatggg

SEQ ID NO: 71222 - DNA, 1449 bp, Oryza sativa
gcacctggtgtaaattttttcttgtactacctttttacccttgatgccacttgtttttttggaatttgatactgcagaaccaggtagctgcttccgctgatgcatctttcttgcttgagcagcatgaaggactctagtgaaaacagaactagagccaccaccacctgaaacattcgcacctgctgcaggactgcaaaggtgctgcaaatgcaaaaacataaccaaaacaaattagtaagagatacgatcaaaaaaagactcaaagattaggaaaaaaaaatccatcaatggctgccgcgagcttcgacggcgccggcgttggggcgctcggcgtgcacgcggcacattggggcgctcctctccggcagcctgcagcctgacactgctataccgtaccaatgtcgggttggtgctgttcatcgtcgccatggccggcaccacattcactgcaaaataacagatgaatatggcaacaaaccttggaactggagttctccatgctagacctttcaacgttatctgcaacgcagccgccggcgaggctactaatctgagtttagatgggttaagaactctcaaaacgcaaagaacggttttagatcgataatgttctgctcgacgggataatcatcctgctttctcgctttggataagcaaactgaagagcgaaaaaaccaccctgaaatatatctggtcagctgtctccgaacaaaattctatctacaacaaactcaggaatcttgattcaattttcgaatctgctacagaacagaaacaatcttgttgaccccgagggaaaaaaatacgggtaaaagaaaacgggtaaaagtattcgattcaataaacccgttaatagtcattaccattatctgggcaaacgaattgaattggtggcggacagggagggagtagctactcccggtagtagtatataattttcctatatatatatatatatatatatatatatatatatatatatatatatatatatatatctaaaaaataactattgcaacaaatgaaattatcaaatcctcaaaaaaaatttatcacaatcctaagtttctaataagagaaaattgcactttacataagataaaatataccttgtttcgttgtacaccagatttagcacgtactttctccttacaccagagttcattgttttagttaagtttcactcaacatcagggtactttatcaaatatataggattttcatgatatttcataaattttgaataaatcctcatgaaacaatggtataaattcaaaaaggttttataatttttaatcatatttcacacgatttttctttaatatagagttcactagtgaaagtatcagtaaacccattgcagagtaaaacaatatacgcattacccggcgcaattaatatatgcacaatttactcttctcataactcaaacaaagtagtcctaatctt

SEQ ID NO: 71223 - DNA, 6584 bp, Oryza sativa
cttcttgatgagattggtggcatggcaacttactgcatccatgtcattgactttgatctcggtgttggtggtcagtgggcttccttcttgcaggagcttgcccaccgccggggagctggaggtatggccttgccgatgttgaaactcacggctttcatgtcgactgcttctcaccatccactggagctgcaccttacccaggataacctctctcagtttgccgcagagctcagaattcctttcgaattcaatgccgtcagtcttgatgcattcaatcctgcggaactcatttcttcctctggtgatgaagttgttgctgttagcctccctgttggctgctctgctcgtgcaccaccgctgccagcgattcttcggttggtgaaacagctttgtcctaaggttgtcgtggctattgatcatggaggtgatcgtgcagacctttcattctcgcagcatttactgaattggttccagtcctgtgtgttcctccttgactcgcttgatgctgctggtattgatgctgattctgcctgcaagatcgagaggttcctaatccaaccaagagttgaggatgcagtgattggcgggcacaaggcgcagaaagctatagcatggaggagcgtttttgcagcaactgggtttaagcccgttcagctcagcaacctcgccgaggcacaggcagactgcctcctgaagcgggtgcaggtccgaggattccatgtggagaaacgcggagctgctcttacgctctactggcagcgtggggagcttgtatccatatcatcttggcggtgctgatcagccataagcttcactccaccaaggttccaccaccgtttgcaagcatcgaccactccagtaatgtccatttattcttgcaattaaatgttgcaaatgaaattgttgtcttgagctgttgaactcttcatattgcttttcgttgcagcttattagctagcctagtggatttaggaatattggtgtcagtctctatagctaatgatgttgctttaggttgttgccatgctctgctcaattagccatgatcatctcattggaaacactgcttatgagtagagactagagggtaatttaacctatcaaatggttgtgtggtacagaattaatattatactgctgttgctctgtaattctttgggtacgttagttctgcatttccattgttatgcattgaactgaaatggatgcacaatgcataccattctaatagttagtggggatggctatcataggactaagacatattgatataactacatatgacttagtacagcaataaaaggttttgccaaacagctcaaatatatttggagtaataggtcataatcaagtttcagaaagcgaaacaaagataataaatttccacgtcattctctcctttttagtttgtgtaagctgtgcttagtaatttttgcagattagaatatgatatgcagagcaactaccggtgtcgtagttgattttgcatagcaattgtgtatctatcgatctgcacaagctcctgattgaaattctctcaagtaagtttgtctaaactggatcaaaccttagtttataacccccttgactgaccatcaacggtacaagaatgccaaacgatgtttctttccacaacaaacaacaaaataaatttattttgtatctctactctagaaatggatagccaatgtgtaaaaatatattgcccgtaacatgagaacttcacgcttcacagtccattcagttatatttccacaatagacgtaattccaggataacatgacgagggcgaaactaaaaatgcttattgtaacttccatgttatgtcctgtgacgaggacacgaggtatgcatatattcccattggcgagatggtacataaatcaatccttgtaaacttgtcaccttggttttagaccgtattccatttcgggagaggcctagttttcttggtgatatgttgtaaacttgtcggtgttggtaatttgccggatttgctccatgtgtatcccacatctactttgactccatttcactgcattactggacactgtaattgtcatcgtctgagttgtttcactctacagtggagacatttctaggctatttttttatgcatatctactgcttcaataatgcacatacatacacctgcacatacatacacctctacccgtgctatcatgtgattgtgtcctatacctcggattagaaaatgtgaagggctattctattaacgactggagagttgattaaatttactacagaactgggaaagacccggacaagaacactggctactatcagggcttatttcatctttgctcatctcccacatggacgtgtcccctcctgcatgatcgcctgcccctgcatttccttccatccatttacaaaaactaatcacctggagtctcaattataaaactagttttttatgatttgaaatttctgaaactccgaattaattaatagagttgtactcgatctagattctcaaatattatgttatacgatttaacaaattctgaattaatgaacataaagttataccccctttgaagtcttgggtatagtgtttttatgatttaacaataccggaattcaggattaatatacattaataaatattgtgttgtaagggcagtttcaaccctccacttaggataggatggtgtttatagcattaactacattgtcatgtaggacttttaacttatgtggcactatattaattaagagagaaatgaagagatgaagaaactgggtcttatgcaagacacagctttaacacgagaacctatgcactagacactatcaagttttgcattaggagagaataatgtcttcataatagatgaagaataaatatgattggtagagaagagaaatgatatatttattaatggtccactttaagaaaccatgggttgtggagtgtagtttctattgtggtgtcttgttgacatggcaccatagacactacttatggatactgtgggttgggactgccctaaggcctcgattagtattttttataatctaataattttgaaattccaatagttgaaattaacaaacaccgagttatgcttagtttagaatctcgataataatatctctatgatcgcataattctgaaatcaaaattaataaatattagtactagttaaaattgattgtttaaaatgtatagcacgtgcaggtgcactacttgcataattgatggctagttaaagggaacgtattttatgcgcttaagtttttcgtgtacatatcatgtatactagctaacaaatttcaaaaaaaaaatctaaaataaaattatacaggtacttttattagtattacttatgtgtcaagttttacctttaaatttattatatttagcctaaagaaaaggataaaattcctgacaatttcaagagtataaatcggttcgaattttatctttttttcaatcatatataaaataaatttgaaaatgagactttacacataaatgtactactaaaagtacatgtacaattttttctcgtaatttttctagaagtttgttatgtgtgcacaatgcggatacgagaaaacttatatgcatggaatgcgtttactaattaaaaagtaacaacaatgcgagtgtaaaatataggggtataccgagaactggcctggtcgaagacgatttgtggcttgatcctagcctgatccaccatgtttgtctggccaaggaccttgtttgcttgccatacggagatcctctgctgctcacctggaacgatccatctttgcctcgcaaattgcaattagcctgggcttcaaggcggcagcgacgattttatgattaccacggtaatcttaatctcgtagtacgccacaaaccgccgccgctgaatcccgtttggccggatcctgccatgacttgtcactcagatcccacaacctacacgaagccactcccgtaggtctccttcccaaatccttgacggatccgcgaagccatccgccgcgcaaagctctcgccatggcctgccggctcaccggatctcgccgtcgccgcggttttgcgcgaagaagccggagaggcacagaagtcgatggcggcttgtccaatctttccgcccacattgctgtagcctgaagcctgaagccgtaattccgtaaagcagttgatcggaagcgatagaaagcggtaaatgtgtttttggcgaagcttctgcggaataaaacttgcaggattttcagcggaattttttacatcgacatagattttggaagtacaattagattctatgagtctgtttggcacagctccaactccagcccagctaaacaatttcagctccacctgatagggagcgtagctgggtggagcgctctcacgaaataaactaggaaggtggagcagggtttaggaagctccataactccactccagactaaactcttagagctaaatttagaaattggagctgtatcaaacatggcctatatgcaattattattttcactatcaaaatacccgtgatgaagagatttttcattgtaaaggttatcacttattgcaagttgcaacatacaaatatattttgtttgtataatatatatttagagtttatgccttaaaaaaatgaattttagcggtttgcctaatgaaaagctgtaatggacggggaaatgtggatatccatccatctacaaccattgacattcaagtagtcttaaactcgaatttcaatgtctaacatcccctctccccctctcctcaaccaataaagaaaaagcacgccctcatctttcaattgttcacctcacatctcagaaagttcgagccaccggcccacctttcaaaccaccgatgacatgacatcctggctctctcctctcccgcgtcactgctgctcatcctcacataccttagacacgcctacgccccttcctcccacacaccatcgctattgacatcgcagggcaagatctccagttcagcttgaatcgattgtcctgtctctagctactagcttaggtgcatcatccccactcacgcgcctcgagattcaggaactttggcctggtttagttggtgaaatgaaaatttttgagtgtcacatcggacgtttgaccggatgtcggaaggggtttttggacacaaatgaaaaaactaatttcataactcgcctgaaaaccgcaagacggatcttttgagcctaattaatccgtcattagcatatgtgggttattgtagcacttatggctaatcatggactaattaggctcaaaagattcgtctcgcgatttacatgcaaactgtgcaattagtttttctttttatctatatttaatgcttcatatatgtgtccaaagattcgatgtgatgtttttaggaaaaaatttttggaactaaacaaggcctctatagaaatatggagaggaaactagttgtattgggatatcgagtgttgaatataaagagtctactggagcgtgcagaaatatagaaatggtatgttaaggagaatcactcatatggatggaagaaaagcttgttgactctaaatttgatccaacactcgaatgcctgagagatttacttgactctagtgtagatcctaaatttcaggttcaaagcataccttagttgactctaaatttgatctaacactcgaaggcctgagagatttatttgactctagtgtagattctaaatttcaggttcaaagcatactggaatttaggatatacactagagtcgagtaaatctctcaggccttcgagtgttggatcaaatttatagtcaactaggttgatcctgtatgttttgatcagtaaagaaagatacttcgattgtttatacgttatataagcttagccgatgatagcacatttctttatcaaaagcaatcttactatatcggacttaacggagataatataaaattgaagttgataagaggatatttaactactgagtatacacaattaataacaaaattttacttaattaactacaatctaatagatcagattcaacccagtacaagattgatagcaataggtagatctaattaagccgatagattctatacaaagtaatggatatataagtcaagctaagatagcaaaacaatcaaagaaaaagcggatatatgggaagacggtgtttgtaataaattgattagaatgtcggaccgaagcgagagtcataactaggtcgatacaaacaaagttgatgaaacttaccttctcgctgaaaattgtgacgatgtatcctgctcgaataactaagaactcgctaaaaagggtggtgatgtgtcagaaattgtatattgactagcaaaagtgtccgtgcgcgtgcgttgcaccgggtgataacggagtgtgtatattgaccaaaagtgttgtttggtttagcaaaagtgcccgtgtgttgcaacggggatgcgtacatatcagaaaaatattcaattaattaaaatacaaatttgctaaaatatttggtatttttaagtaggtatatgtgtataattaaataaatttacaagtaaagcaagtgtgagaaataactataattgtaatgcttctaaaaa

SEQ ID NO: 71224 - DNA, 22018 bp, Oryza sativa
tcaatagatgggccagcacacaagacacacatacataactagtctatttacagcccaacactccccctcaagatgggtgatagatatctatacatcgcctccatatgaccacttcttggatcatgcatatatcgactcaccatactgacagcatatgttatgtcaggtcgtgtatgacatagatatatcaatcttcccaccaatctttggtatctttccctattcactggatctccagactccgcacataacttatgattttgatcaattggtgtagagactgggcgacatccaagcctacctgtttcactaagcaagtccaatacatattttcgctgtgaaataactatccctctaggagatcttgcaatttcaatacctagaaaatatctcaactggcctaggtccttgacctcaaattctttgcttagattccgtttcaacctagttatctccaagcaatcatttccagtgataatcatatcatcaacatagacagcaagaatggttatatgatctccacaatgatgatagaaaactgtatgatctccattacattgcttatagtccatagcacacattgcacgcctaaaccgatcaaaccatgctcttggtgactgtttaagaccatacaaagatttcttcaatctcaacacctttcctttagtttgtgaagtggcaaatccaggtgggacatccatatacacctcttcttgaagatctccatgtaagaatgcattcttgacatctaactgatgcaatggccaatcaaaattagctgcacaagatataagagttcttaccgtgctcatctttgctactggtgcaaatgtttcatcataatcaattccatatgtttgactatatcccttagccaccaaccttgctttgtatctttccacctttccatcaggattttgctttactgtataaacccacttatagttgacaattttcttccctttaggaaatggtacaagatcccatgttttgttcttttcaagagcctctagttcatctagcatagcttgatgccaccttggatcttgctttgcttctctccaatcctttgggatttgcactgaatctagtgatgctacaaaggccttatatgtggatgacaaggagtcataggaaacaagttggatatattattttcatcatcactctcatcttgagcttcaaaaccataccttagtggaggtttacctgcattgcttctcacactctttctaatggcaattggtaagtcagattcttctctaacttcctcttcttctccccctgactccaaagatccttgctcacggcttacatcttcctctacctgattatcctcttcaacttgttggattactggacaccttgttctccttgtgtatacttgaagatttttctcttcatgtggcttcctccattcttgctcctgtgcaacaggaccacccatgggacatggaattgaaccaaccacaagcttttccttctttggttgttcatctccctttggacccaatatttcatctttcatttggtgaccatcatgaccattagttgaatcatcaagatcaatgaataaagaacttaaatctgtcttctcaccatagaatgggacagattatctaaaagtaacatccatacttacaaaggttcgtctttctgatggactccaacacttataccccttctggccagatgaatagcctacaaagatgcatttgacagcccgaggatcaagttttccaatggaaggtctatgatctctaacaaaacaagtgcaaccaaacacttttggtggaacaacaaattcattctttccaaatatcatctcacatggtgtcttcattccaagtattcttgatggtgtgcggttgataagataagttgctgtcattactgcctcactccataagaatttaggtatattcatagtatacatcaatgagcgggctgtttctaagagatgacggtttttcctctcagccaccccattttgtggaggagtatcaggacaagaagtttgatgcaatattccttctgatgaaagaaagatactaaattcattgtttatatactcccctccattatcagttctaataaactggacccgagcattaaaatgatttttaatgtatgcatagaaatttagaaaacatttaagcacctcatccttatgtctcataagatataaccatgtcatgcgagagtagcaatcaataaaggtaacaaaatacttcattccactcatagagaccacaggtaaagtccaaacatctgagtgaattagcataaatggtaacatactccggagtcctctactcacatatgatgttcttgtatgttttccatactcacatgcatcacatactaacttatgtttatccactctacttagttctgctgggaacatcttactcatagtttcaaaaaatatgtgccccagtcgacaatgcaaaagtaataccttagcctcttcttcgcttgtagaagccatcaatgcaagacatacatcttcacttgtctcctttcgatccaaataccaaagtccatcacgcctgacgccaatcccaagtttcttccctgtttccctctcctgaattaaacaattctcacgatcaagggagacccgacaattcatatgatcaacaagagaacttatcgaaaccaaattcactggaaaagaagggacatataacactgatgataaagtgattgaaggagtacactgtactgtaccctctcccttaactgggcatgatgtcccatcagcagtttgaattgtttcttttcgtgtaaatgggtatggtttatatgatgcaaattctccacacatacccgtgacatgtctagatgtacccgagtcaagtatccaatttgaatgagaactattgatagacataaatgcttggtttgagttacctcaggaagaatgaacaagattggcaacatcaacatttgtagatctagaacaaccctcttcaagagtgaccacattagctctgtgatcacttctatactcatagcctctacctctgttacctctacctgcataacctcttccacctcttgctccacccctatcaccaaatcttcctctcccataactaggcttgcgaggagcgcggcaatcacgtataaggtgccccattttaccacaattgaagcactccctagtctctttactttgtgcaactacataggtggggcttggtgaagatggtgtggcactaggcaatactttcttcttaagcttctcctgtgccatagctgcaatagcctcatccaaggtaggaagggtggtttgatgaaacattgcattccttcttccttcaaactccgaatttaagcccttcaagaactcaatgacccttctacgctcaatccattttctcatttttgctatacaatcagggtgctctaacccaagaggattataatgatccaaatcagaccataaatgcttcaattcagcaacatattctgcaacagaacgctccccctgtctcaaaacacttatcttctcctgtgtctccaccattaacatcacatttccttctcttgagtagagattagtaagagttttccacatctcacttgcactagagatggtctcaacagttgtagcaatagcagggataagtgaggttaacaaccatgctactactaacgagttggtagtactccaagtcttccattcaacacttgatatgttctcaggctcctttatctccccggtaacatatccttctaacccctttgtcttcaaaatcaataaagctcttcttgaccaactcaaataattttttacaccctccaacttaatgtcattttgcatcaactcaattttttgcaccgattcagtatgaggaaccactgcactactcgtagttggagcctcattaaacttctttgcaagcatctctaccaatttacccattacttgttccagtccctgattttcccccattttaatcaagcaatacttgcagtagaaagttccttattctcaccttctataagttgtagctagggctgtcaacgagccgagctcgagcgagcttgtctgcccaagctcgagctcgacacaagctcgagccgagctcgagccgagcctattccaccttcgagcttttaggcaagctcggttcgagctcattcgagctcgagcttggctaccgagctcggccataagtagtataatatatattttaatgataatcttttgataagtataattattttctagttaatcacactaagaaaagagtagaaaatgattaaaataaatatattgtgctaacacatgctaatttattgtgtaaatagatactaatatatgtatttatctattagtttattatattaataaggtgaacatgcaatatgaattatacacagtcaagctcggccaggctcggtagaagctcgcgagcttttgctcaggctcgggttcggctcgtttgaagctcgagccgagctcgaatcgagcctaggacgagccaagctcgagctactcgcgagccttgagcttttttaaccgccctagttgtagctactctaaccagcagcagctacacaggcaccaaatcctcccttttcctttcaacagcaacagcacaagcacctcacctcctctctgtctcctccctttttttttcctttcaacagcacaagcaactcgtcgcacagctcttctctgtctcctctcacagcacaagtaccaaatccaagcagcagcaacagcgccaagcacactaccaacgcacagctcttctctgtctcctctcacagaacaagtaccaaatccaaacagcagcaacagcacaagtacactaccaaatccaagcagcagcaacagcacaagcacacttactcactccttccttcacaagcacaagcacacctagcactgcagccctgctccctccgtcacaccggccgcgctgcagcagccgtcgccgtcgctccgcctcagcagtcgacgggtgcagcactcctccgctcacagcgccgccgccacacgtcctccccaacaccagcgtctccctcctcgacgagctctggcgaggctagggtttagccgtcgccagccactagccggttggctctgataccatgaagtcttgtgattttttctctggaagcttcactttctctattgccattctcacttacatatacatgggatgggccctcttcaatagatgggccagcacacaagacacacacacataactagtctatttacagcccaacaccgatggccgtgtcccggagttcttgggttctttcaagaagttgagagatatctcaacctctccgggattctgttctccggtgaggttcctcctcagcttggtaatttctcgaagctgcactaccttgatctctcactgtctgacaatctgtattccactgatctctcatggttagcacatctaccaacatctctgagaataacatcactgggcatctgccaacatctatttaccatctctcatagtttgctaatgaagaaaaattgctgacatggatgtgagagatgataggagagagaaacaccgttgttttgcatgacatcggctagacaacgactctagaaaaacacgaggatactgaaaaacaccaagcgtagtatactgctgtcttcaacaagagaccgtccatgggcccgattaattcagatccgatacacaaatatatgcatggctgaaatttatatttgatctagtatatatgatgaatttattagtcatttattagatgtattaatggagagttagctaagagacagtcctttgtagatatcagttttttcgctaacatggagtgtagagagagcctatgctggtctctacctttgaacatgccctaaggcatcttaaaagtttatggttccttgacctctccgacaaccaccttataggacatgtgcctctggaaatcagtacactcactaagttggcttggttggatctaagctacaatgacttggatggtctgatcacagaagaactttttgatggattgaaaagcttgaagaatattggcttatctgacaatcgattgaagattgttgtaggttcagactggattcctccctttcgactgaaagtagctaatttagcatcttgccacataggtcctttgtttccttcatggtttaagtggccgatgggcatttcacacattaatatttcacgcggtaatataattgataggcttccagactggttcagtaattcattgtcaaatgtctaagtgttggacatttcgggtaatcaaatcattggagcattgccaacaaacatggagaccatgtctttgagtaaactcctcctgagttcaaacaatataacaggtcaaatacctttattgccaagagaactatattacttggatatctcaagaaactttttatcaggacctcttccattgaatcttggagctccaagaattgaatgcctcattctacgttccaataatttcaccggtcaaattccagtgtcattttgtgaatttgatgagttgtatatattggatttatccaacaataattttgaaggggagcttcctagatgtttcaaaatggaacacctgagctttcttttgtagtaaaaatggtttatctggcaaattcccaccttctctacagagctgcacaagtataacttttctagatctttcatggaatagattatcccggaaattgccaatgtggatcagtaacttggttagactgcgatttctaaaattgagctacaataagtttgatggtcatattccaaccaatatcactgatctttcacaactttaccatttgaatcttgcagccaacagcctatccggtgttataccttggcagctatcaaatcttgaagctatgacaaaaaggaagtctatgctacgtaagctcccaaacaattattcacggggagttgaccgttatctttcgaggttcaaacatatggttggtgaactatcagtcactaccaagaggcaagatcttaaatatcaaggctttgcacttttgggaatagtgactattgacttatcatccaactacttgactggtgaaattccagaggagataacatatcttgatgcattaactgaacttgaacttatctttgaatcacttgagcggacatattcctgacaagattggcgccttgatttcattagagtcgcttgatctctcagagaacaagctttcaggtgaaatcccttcaagcatatcaaaattaacatacttaagtacattgaacttgtcctacaacaatcttataggaagaataccatcaggaggtcaacttgacacactctacaacaataatccgtctatgtacgatggcaacgccggtctctgtggggatattcttaagaagaaatgccctgggaacgacgcatcaaatgactacgggagttacaaagaccactatgagttattgtatctctgctttggacttgtcataggatttgtacttggcctctgggtggtgttttcgacccttctattcaagaaatcttggaggattgcttattttcgtcttttcgacaaggtatatgacaaagcatatgtgtttctggttgttacctggaacagtctagcaagcaaggaggccaccaaataatcagtgctggcgatgctgcctccatgactgagtgattatagatttgtagtgtactatctgtgttagattgtgtgtgtttttttttgtcattcttaagttgaaaataatgttgactgttgtcttgttcagataatgtactgattgttgtcttctgttttgtgattctttactgtctctgttgtcatgataaatacaacaatttggtcattttcggttaaatccagttccactcatggcagtgcctgacaaccacaaagatatcaaacggaatctggttcagatattcctattgtccaaccaagatattattatgtgaaagaaactaccccattaccatcatctctctgcagctctaagctttgaagggtggataggggacacagccttgagccaatatcctgccagtccagcctattttggcctattgaacttagtatgcatggtgaaaattaatttgagttatagacctttaggcccatggagatccgcacttgtcaagatgcgtcactagtatagaagaccaattcaatgccagtttcaaaacaaccatcagtgctggacttagaaccgacacctctataccagtactgatgaggtaagcttatcgatgtcgaattgagaggcagcactgattgggaatgaacaactaaaaataaaagcacagagatcggctcaattcatcgagccgatgtttcgagccatgatcaatatcacaaattcagaaattaaatctcaaaatcatcacaaatccaacaaaatgaagcagaatatatcatcacataaacattacagactgataacattcatcacaaatctgaattacaaataaaatacattaagccaccactgtcatcggaggccaaagccactgccgccgtcgctcaccgaaggcccaggctcaccgtcaacggagatggcagcagatcttgtggtccggacaaacaggtggagcatgtcaccaccagcgactggtcgaaagtgcttataaggagcactccggtgatgggtggagcgtcgccctagaaagatccaaggaacaataggcaccatgccgacacagctcctcttccaccccttcttgcctcggtggagtttgaagctaagggcttaggttgctgacttgtcctacgggctccctctcaggcaggtcgatccagctgcgggcgcacaaaatcgaacgcctgagagctgcacctgagtcaggtgagatttccaggacatgaagtaaacaggccctaagtcccaccactaggccacatgcggaagggttagcataaaccatgtactgtctataggctgcgttcgttcgctctccttcccaatacgaacagtgcgcacggaaaatggtgcggtccattagcacgtaattaattaagtattagctatttttttaaaaaaatagatcaatatgattttttaaggtaactttcgtatataaacttttttttaaaacaaacatactccatccgtcctaaaatataagcatttttagcatagggacaagtcaaatatttctaactttggcaattaatagcaaaaaaaaaagatcaatcatgttaaattgatgttactagatttattattaaacaaactatcataatatttattattaaacaaactattataatatgcaactatttttatttaaaatattttagtttgatagatattgttggtcaaagtaacatatcggagaccgtgtcagagtaaaaaaatgtttatattttgagacaggagagtactatttagcagcttgaaaagcgtgcgcgcggaaaacgagagggggagctgaactgcctggaacgagaacgcacctaagtttcaggactggagtaaaaaaaaaactattttgctccatgtaggacaaatatatggtgtcgtgtcaagttacaatcaagactgaggtggtgtttggatccataagtcctagggacttattttagtcttaggactaatcaattaagttcatggctgtttggttatagggactaaaagggacttaagttcattaaatgcactgcacaatgaccatattaccccctaaaaccatgcaaagtggactgcaccatgcccttgctgcagcatgctgtttgctgccgctgctagcattttacaagcaaaccattgttgctgcatgacagcacaaccaaatgcaagccaaatcaatgtttgaccccaacatcacatgatttaatccatcataatttggacaaacacacaccttcagcaagccgaatcacaagcaataacccccacatcaatttcattatcaatatcacagcccaatcacagaaattcaaagaagctcatatacatctcaagttgttgaaatacatcacagaagtttcaatgttacaaattacaagcactcatggttcaattgacaagttaaaccaaatacaattcacaagaaaaattgaaccattcattacattcctttcaaataccacaatccatcggcaatccagtcccgaaattggttcatgacacgcgagtccaattcgtttgttggttcgctagatggagaagaggttccacccaatggatcataattttcatcatggtcacaattgtcgaactctgtatcagccatttgactgtctctaatgaaattatgaagtgctatgcatgcatggataattctgctttgcttttcctgcgagtagcttggtaaactaaacaaaatcctccacttgttcttcaagaccccaaatgacctctctatgacattccgacacgaagaatggcagtaattaaagtgctcccttcttccccttggcaatgtgctttcgttgtactcttggaaatatatgttatacccttgtatggtgctagataacccggcctatttgggtatcccgagtctacgagataaaactttcctggaggtggctttggaaacttggcactaaatctagtttgtgcatcattgaataccctcatgtcatgaaccgaaccaggccacccagcaagcacgaaagtaaatctcatatcgaagtcacagacacacataacattctgactcttctccttatatctattcctatgttgaacagcagctgaatttggcaccacaacttggatgtgagtaccatctattgctccaatgcaattatccaaatatggtgtgtactgaggagaaagcaatttcttatggactgttgtgaataagggatcttttggcctaatgatatcttggcaagtttcagtagagcggtcaaaactgctttgaacttactatgtactgttttaagagacctaacaaatatgtcttgggcttgcctaactgattggggagcacctactatccataaaaaaagacccaaacactccatggaatccatgttgtttttggacttcaactcatatgattccacaagcacagaatgtaacctctcaaaaactggcctgtgcatcctaaacatgttgtaataagcagttctattagctaatgttctcataacccaatcatgtccagactcaggtgctacccttcttggagccttattagagtaaagttccaagtaatacgtaccaatcatggcggcaagcatacatcctcttctcctgtccatttctcttttcttcaaaatataaatgataagatcaatctcagcatcactgctatcttcatcagagatatcttcatcaccactgccttcaccatcctgcaagagtgacatatgcatagaaagaaagcacatcataaatataatatgaacaaacttcaagaagaaaagaagggaaggtttaaataggtccacacatcacatgttcattacgtcacatcacatcaaacaagttgatagttcaacacaaaagtagatcataactaatgcagctaagacacaactaatgcagaccagacccatgatatgcagctaaagaaagggaccatctaatacaaattcttctgctggcaccatctcctcagccacataaatcttgcttctttagtgctaatgttcttaaacataactctgttatgattggaagcaaacaactgtgtggcacaaaagtattccacactgtcttctgctgcaccacactctactgccaacctctgacagtttgtcaatgactcagcaatttcttctttcttctgctcctttaacttcttgctgttaacaagttcagtaattagggtatttgacttatcacaatcagagttgaaagaattgagcagccccttcatgagcttcaccactgggctcttgctttttttcccaggactagaagctgtggacacatcacagctgctactccctctcttcctgctgttagtgctcatggggctgttctcataaccatcccctacagctctttcccctctagctgcctcccctgcatcccctgcttcttcttctccttcctcttcatcttcatcttcaaaacaagggatgtatgctgtggaaccatcaactgcaactccttgaaatatctctataagaaaatctaagtactcagggttgccatggagaaatttcttggcgtcccccttctcctgtattgacactaaatcaatatcacagaaaactctaaaatcatgtaaactagctaaatttttgacaactgcataccttaattttttttcccaccaagcatttgatgcaattatttctccactagcacttctaccagctccagtttgttggttcagccacacccaagcaatgtaataattctttagatgggtgaatctattctttatctgtttggttgaatgccttaggttagccctttggaaatatttggccttcaaattctggtaccctctagttgtccatgctccattaggacaatgcccatcccttatttcctcacatgctatttcacacaatgtgtaagttttttcttctgtccaatttgccttgtcatacgtattctaggaaagaaaaacatgatttaaccctaaattaaccaatgaacaacatatactgtaatacaaatgcttagatcacggcatgcatagcagtatcaatatcatgagcaacaattggcatatttcgcaatagaacaaatcaaacataacagaaagtaaccatggggggtttaccatgtgctgaccatcaggaccaaagtcctcttcgtcttcttcgttgccatcgtcctcggacacatttgtcccttgagacgacgaggcaccggctcgccgtcctcctccgaagactccaaagttgaaggcgggtggcccgctgtgcgacatggatgccccatgacctcggacgcctccttggccagacaatgagccaggaggaacaaatcctcgcattcccctgccagatccagcgccattggtcaacgacctgccacggcctcgtcctcctcctctccctccacgacttctgccacgtccccctcccgccgctggaggaggacgtgacggggggactgtggatctgctccctgcccgaatcggaggtaacacaaggctacccggttcaaggatctgttggtaggaggcgaaatcggggaaggcgtcggcctgggagttcagatcgaggccccccgatccccctcccccaaaatggatgccggtgccagatccaccatatcctgaagacccctgcgagaagccgtagtcggagccgtccatgtggcccgttggagcttcattgaacgactgggagaagaaatcgtgaggatttccacccgccattgctgatgcgcgattcgtgaggcttgcgcgagcggcgtcggcttgcacgacaccggcgaaccaagcggcgggcagaggactagttagcgcgtagttgcggtgggggctaacgcaggacggcggcgagggcgcggggttgtgagaagcgagagagagacggcggcgagggtgcggtgttgtgaggagcgggagagagacgacgcgaggaagagatgaggcgaggaaagagagtgggcgaggaaatggatagggatggctggcgtgaaggggcagtggctggaatagagccactttttcccaataagcacctccattcgggacttctggaaaatgcactattagggactttttagtccctcctgtttgtttctctagggacttaagtggggggacttcttcttaaagtccctcaaagaaacaggacctgagtaaacgaaacaatgtactcatcattcgaggtacatcgatctctcagctacaagtcttttgtcaaagcgacttatcaactgaacgcaagtgatacccccaaagagaagtcgtcgttgatctcgtctgctatatgacactagaataaagtgctatactaggtgaagtgagttggtgactcaagaatcaagataccctttaggagatttttccttcaaaattaaagtagaacacggaaaactcattgctgcgtttaaaatggaatggaaggaaggagtacataagttggtcactgttggagaggtacagtgactttgacctagctttcttgaaatggctttttaaccaccatggagagtcacttttgctgatggataataacacaagcatccatcaagccacttgctataccaaaacacacagtgaaccagcatctcacactgcagctaatcaatcacttagccatgctcatgcgtcatccgaccatcgccgccgccgccgcctcctccttcctcctcctcatgatcgccgccgatggccaggcggcgacgccgccaccacctgcagccatcggcaactactgcgaaccgcgcgagagagacgcgctgctggcgttcaaggaaggcgtcaccgacgaccctgcaggcctccacgcctcatggcgacgaggtggcggtcagctgcaggaggattgctgccaatggcgaggcgtccggtgcagcaacctcaccggccatgtcgtcaagctccgcctccgcaacgaccacgccggaacagcgctggccggcgagataggccagtctctgatctcgctggagcatctcaggtaccttgatctcagcatgaacaaccttgcaggttccactggacatgtccctgagttcttgggctctttcaaaagcctgagatatctgaatctatctgggatagtgttctccggcatggtgccgcctcagctcggtaacctttcgaacttgcgatatctcgatctttctgggataagattatctggcatggtttcatttctgtacattaatgatggttcatggttaggacacttgtccaatttgcaatatctgaaccttgatggggtaaaccttagcacagtagttgattggtcacatgttctgaacatgatcccttctctgaagattgttagcctttcttcttgctcacttcagagtgcaaaccagtctctcccagagcttagtttcaaggaactcgagaagcttgatctttccaacaatgactttaaccacccagctgaatctagttggatttggaacttgacatctctcaagtatctcaatcttagctcgactagtttgtacggtgatattccgcgagcgctaggaaacatgctgtccctccaagttcttgatttctcatttgatgatcataaagatagcatgcgcatgagcgtgtcgaaaaatggcaatatgggcaccatgaaagcaaacttgaagaatctatgcaatttggaagttctagaccttgattgtaggctagaatatggaaacattacggatatatttcagagtttaccacagtgttcacccagcaaactgaaggaagttcatttggctggcaacactttaaccgggatgctaccaaattggattggaaggctaacaagcttagtcactcttgacctcttcaataatagcattactggacaggtgccttctgaaataggtatgcaaacaaatctgaggaatttgtacctacatttcaataacatgaatggtaccatcacagagaagcactttgcgcacctgacgagcttgaagtcgatatatttgtgttacaatcatttgaacattgtgatggatcctcaatggttacctcccttcaaattagagaagtcttactttgcatctattacgatgggtccctcattttctagatggcttcaatcacaggttgatattgtcgcacttgctatgaatgatgctggcataaatgacacattcccagactggttctctacaacattttcaaaggccaagttgttggaatttcccggtaatcaaatcagtggtggattgccaacaaatatggaaaacatgtcattggaaaaattatatctgaaatcgaaccaaatagcgggtctgattcctcgcatgccgagaaatctcactatattagatttatcaaacaactcattgtcaggacctctgccattaaatattggatctccaaaactagctgagttgaatctgttatccaaccgtatcaccgggaatgttccacaatctatttgtgaactgcagaatttacatggcctagacttatccaacaatctgcttcatggagagtttcctcaatgttctgggatgagcatgatgtcgttttttcgtctgagtaacaatagcttctctggcaacttcccatcttttcttcagggttggacagagttaagcttccttgatctatcatggaataaattctctgggaatttgcctacatggattggaaatttcagcaagctagaaattctgcggcttaagcataacatgttctctggaaatattcctgccagcatcaccaaacttggaaatctttctcatttggatcttgctagcaatagtatatcaggtcccctgcctcagtatttggcaaatttgacaggaatggttccgaagcaatattatacgaacgagcatgaagagagactatctggatgtgactacaaatctcttgtgaccatgaaggggctggaacttgagtatgatgagaaaatgtaactgtggtgaccattgatttgtcctcaaatctattgaccggtgtgattcctgaagacattacttatcttcatagattgataaatctgaatctatcgagtaactatttgagtggaaaaattccatattcgatcagggacatgcagtcattggaatcgctcgacctctcgaagaacatgctctatggtgaaatcccacaaagtttgtctgatttatcgtctttaagttttctgaacctatcttataacaatctcatgggaagaataccattagggacacaacttggcaccctctatgaccaaaaccatcatctgtatgatggcaatgatggtctttgtgggcctcctctcccaaaaagctgttataaaagcgatgcatcagagcaaggtcacctgatgagaagtaaacaaggttttgacatagggccattttccattggagttgcaatgggatttatggcaggtctctggattgtcttctatgcccttttgttcatgaaaacttggagggttgcttacttctgtctcttggacaaggtgtatgacgaggtttgtgtgattgcggtttttggttgggcaagattgacaggaagaacagatgcgagactgctgatgtcacaggtcgcatggtcatccatcgactccgacgaatcctatgaatagtaatgaagatgaaaaggctgaagcaggtgaacgacactatttgttgggttgtatatttgtcatgtatggaacttattagagcaagtgccataaatgcatatgatgcatagatctacaatgatgtatatatatctgtttgtactggtacagttgtgtagtgtgtcagaaatcatccttcagactaaatcctgaactcactctttctatcagagctctgttctgaatgttgtcgaacagctacagtacctgaagaaaaatgaaaacagagcatgcagagctgggacagaggttttgcgctgcaaacttcatcagcttttctgggcttatattctcccctaatatgcgtgcaaaataagcaactacgattggctgaaaaaaattctaaatcagctagtccatgaaagactaaacattctaattacttcctgttgaactgggcttacaaactaaataaatagtaactgaaatgagactaaatcagagggaaaatgcaatgaagtccactggcatatcgaggattatagatatgggtgatccaacttacataaatttttttaaataccacaaatataacaagacgatattcaatagaaatataaaattgatcaaacgcacatcaggatatattaatgatgttttttccccttttcccaagagttttattcttttttttacttacatgggcttttggctatgtatttttttccgtttcatgttataagaagctttgacttttttttctagtcaaacttattaagtttatagaaaaatgtagcaacgttgtcaacacaaaagaaacatactatcaaaatataatcaatgtatttaatgaaactaatttggtgttgtggatatttctaaattttatacaaacttggtcaaacctaaaaaacttttattatgaaagaaaatcaaaatatcttatagatgggagtagtttgtaaaattttaagaagactggttgtctcccggagctaattttttatattttaatcctttttaaagaacttattttacaaatagaccattggaaaagagtctattcctaaaataagtttttccaaaggactatttgtaaaacaagtttatttgtaaaaacttatttggtctatttggtcggcaccgacaccctcgccctcctgtagaagccaagtcactgatgtgaaggggtccggtgccaatgacactggtgtcgagtacccatttgtaaatagaaatctaaaaagggttaaaatgtaatttttttaaaaaaataagccctcaggactagtatcattggctcctaaaaaagtttcattcctgagataatttttttagacaagttttttaaaaggattaaaatgtaaaaaaaaaatccagcctgtcgcaggataccgtgctgcagcccattggaccaacgttactgaactacaggccactagcctttccggccgccatctaggatttttaatggaaaaggcagtaacccgcacttgtatatgtcgacgttttagatcacgactacggtatttgcatggtatggggatcgttggtaccaaagtatatgcgagattgaagtaaaaagagatagagaaaatgatttttatacaggttcggccccttattcatcagaatcaggtaataaccctactcctgttggccgaagccggtgttgctcttattcatcaatatcacacaggtacaatgattgggataacctatctagtcatcgttgacttggtggcaaggaaaaccaacacgtagtcgacaacaggggtagtcttcctcctcgaatacgtactcggcgagataagagatagcgctagatccctcttgatggcctccgatggtaccagattaggtatgtctaggctaatctccgatctcctagggggtcttgtatttatatccatagatgtttcccgtccaagtataactagggatataaatatggatacgattcgagtagtccttgttgtttccaacttgaactctatttgtccttctttatctggaactccttatatatacgaggtatgatttcgtataagacttggtatatcgtgggccttgccgagcttagtcgattactattgggtatgtgttatttataaccctgatagtatgtatctgataaaatagtaatagcatagcccacttgatacttccggctactccggcaaatgcctaggcttgtaggcaaacacacaataaaattttgttgctagtgcagcgttttgaagataattctttaaagcaaatattcaaggtaggtagttttaggcaaaatttgctactgaatatccaaactttacgctattttctgccggatgttgcaagaatgtttatctcctagagggcaccggaaaaaaaatgataattggctgctggacaccaatggcattattttattatacgtgctacaaatggaaagagaaacaatgccaaactcctaatctgcccctgtctccattggttttgatgccatggcggaaggtgaggacgaggtcaaagtccaatgtgatgtgcgtgtatgggtgccacgcctgctcctccaccgcctctgccacaaacctctctagcttgaactcctccagctccaggaactgcagagcataccctaggtgccaaccacagggcggcggcgaggtggtggtacctttgggaggaggtggacaggaagctcgtggctcgttagcttgctcagctcatttaaattttgtaacgagccgagctggctttaaagctcgttagagataacgagctcgctcgcgagccttaacgaggtagcactctaaggcctaagcccaacagacagcacaagttacacaacgggccaagcccaactggctgcgctggctgagaggaaaaccctagagtcctactcccggtcaacccgtctccagcaccctgctgtccttgcgctgcatctctcattctctctcactcgatcccctttcacaccgccgcgtgctgccgcaatgcgccgccccaccgccgccagccgccgcgccgcaatgcgtcgcgctaccgccgccagcccgccactgctgctcgctctcctctcctcacgcgttagtgacgccggcgtcacctctcgccgccagtcaccgcccgcatccgaccgtcttaactccttagccaccaaaggagcgccgcgccgccgcctaccccggccccgccggccacccagaagcccactgacggccgtgtggtgagtgcgatggaggaagaataagaggtgcaatagcctcaggttgcaagtgttgctgagctgaggggctgagtgctggccgcctagctgcctggatggtttggctcgtgagcctaacaagctagctcgagctttcaaacgaggcgagccgagctgggtttctagctcgttacgataatgagccgagccgagctagcttgttatcctaacgagcttgaccgagccgagctggcttgctatccaccccttgcagcccatcttcgccgtgacgtctttgcggtcctgccgccggccagcgatgatggcgtcgatgcagcgacacagcaggcgctcgttctggtccatcttgtagtccgccttgctgatcacatggcgcaacagccgcttgcacagcatctgcacgcacgagaggaagagccccaggatggtggacagcgagcttgacaggtccatcttgagagaagggcaaattcgtactttcatcattgcttctctctccatttatagcagaaataataaaataatatcaccgatgtccaacagtcaattactactttttacagtgtcctttaacaaatacgcgtttatttggtgccatgtagcaaattttgcctttgctatatgcatgcaaatatagggtagatggaacacataaacagataaaaacaaaagtgttttatgagagccaaaaccgaaccgaattttgaactgcaagagttcttagtttagattagaagatattaaatcatgagtagttacgagaaaagaccagccgctagtatggccgataggtttcctccccgaatagttatcaacctaatattttcagttattttctttttcatttttatcaacaccgatcaaacaccgatcatttatatccttgggcctgcaggttcacgcgcatcgacaccgatcaaatggagtaattggagcgtgtaagggtggggtaggagacggcgccgctctccttgaccaggcactgcacgacgagttatcggccgcgttgccgtggaggcaacggctagtgctgccgcccggtgcgccgaggggtatgcgattgcccgccggcgggagccgacatcacgctctgatacccattgtcagccgcgctcgcaatttcccaactcaaccaagaactcacaaacgcgaaaatcagtagaacataggaagttttggtgctgcgcaaagcttgcagctttcctgaccttatctctgaaacttaaatagcagtatttacatgcagactcaaaaactgaaactcggagatcctgttgggtttagtcccacatcggtaattgatgatggaggaacatgatttaaaaggtgggggcggtcctcattcatcagactagtcttttgggttgtgtaggctcagggcctaaagttgtggctctggttgggcctgtggtggagcaggccaaatgtgacctgtgtggcccacggttagtgggccgggctgcgcactctaacaagtggtatcagagcccaaggtttgaaacccggaataatttccatgggtcacatggtggggaggccgagtaacaagtcttcagggtcacatgccaaacccggaacaattttcatgggtcacatggtggggaagccgagtaacaagtcttcggggtcacatgccaaacccggaacaattttcatgggtcacatggtggggaagccgagtaacaagtcttcggggtcacatg

SEQ ID NO: 71225 - DNA, 1111 bp, Oryza sativa
tttatatgcatgttacttaatttatctcgtcatgtgttttagatggtcttttatttcaataatatttatttttatcaaaaattttagttatttataaattgtattcctaattgaaatcttatttttctttttctaatttcagaatttttttttaaaaaaattagttattaccgtattgtgttcttttaatgtttttattttttattttcaatttcagttgtttcaaaattgtattcctacttgaactctcttttaaattttctaattttggatattattttattttttatcctaaattttaattaatctcgtattgggttcttatatggattcttctttaaatattgcttatttttaattccgaatttcagctaattttaaattatattcctacttgaactcttcttttattttcttttgctaatttcggatttatttatttttattccaaatttttattaatctcatattgagttcttatatgcactcttcttttaatattccttattaatctcatattttttttattaatctcatactgtgtctatatgaattattcttctaatatttcttattttttattcctaatttcagttgtttgtaaaatttatttttacttgaactcttatatttgatttttctagtttctaaatctattttattttttattacggatttcaattaatctttaattgtgttctatatgaactcttctttcattttttattgtgttatttcaaaatcaaataaaaatccgtgcacatgccatcatgcttttctggttgctgacgtgtgcatcacccaaatacggctcactgtgcagccgcacggcttgacccgctgcttcggatttccatcgctcgccgttagcatctatcttcatattaacaaaaacgcatccaaattacggttctacagtggttcgttgcccgctgctttatttatatatgtatattatagcctaattcatctctaactttggttaattggtttaggaaatcggacaaaactcttttgagtccgtttgcatataaaggtcctagctagagattgattctaattctacacgcgtactgtactccgtatctcttaattaacatgccaagtttat

SEQ ID NO: 71226 - DNA, 5989 bp, Oryza sativa
ggttggtggcggccgcgcggatccaagggtgggggcggcggcggcggcggctccctccaccccctctagcctccctcccgcggtagatccggcggcggctgcgtctcccttctcccctctcgcctccctcctgccccagatccggcggcgatggcggtgtcggcggcgtcagcggtggcggcggccgcgggccggcagtggcttactcctaccctctcacctccctcccgccctagatccggcagcgatagatccgacggcggtgtcggcgtcggcggcggtgcccccaccacccacggcggcgtcggcggcaccctcccccaccaccggcggaggatctagcgggaggggaggcaccccgtgagcgacggcgacggcgcccctcctcccgtgagcggcggcggccctctcccccaccaccggagagcgccctccgccgccgctgccggcggatctagcgggagggaccggcggaggcggcgctctcccctccaccagatccagcaggaggggagccgctggcggccagccgtccctgtggcggtgacagcgacggcggtggttcggcaacgacggcggcggcggcggcgacccccttgatctaatttttggttttgatttggatatatatgtgtacatgtatcatgatttgtgtgattgaactccgattgtgatttttttccggggtttgattgcatacggattgggatttttttttggagggggggggggcgacgaagcgggacgaaaaaccggtgtgacgaccggaaaaatccgaatatttatattacttatatatttgttgataatttacaaggcttgtgtgcacttatatttatgcccctaacctaactgagtttgattcgaatacaattcaatcgactaaaaacttatctcctaaaaagaaatgtaaatctaaaaaacctgcctaaacgtaagtacacgacatataatttcaaaagtaaatctaatactatcttaaacaacctgatacacttttcaacaaaaccaactcaattgatggcgtcaattacttccattgacccgtgttttaccaaagactatgtcaaattttaccgttaacagtttggtttggactcgtattaattggctctcaagctgagcccaagcctccttcatatacagccctagctgtgggtgtagagagaggagaggatgaagggatctgctagcacatggtggtagtgtggatggtgccggtagccgacttagatgaaactctcgccatctcatggtgtctcaacataacaccgcgggcaccgctttagccactactctcctcatctcccttccctcttctccttggctccacactcactccctcctgccgccgccgccgccacgctgcgccgttggccggtggcatgatgtgcgtgaaaatccaacctcatatagcatttagtctatacgatcggatgctgttgtataagtatgtgataaaataggcggtatatttaaggataaatttaaaatactattttagtaaaaagtaaattttaaatagtaaaattattttttggtcatgttctttttataggggtggaaaatacgagcagataaaacatatagtagggcgttaaaaagacgacgctaggagcagagccgattgaaaacgatacagggagagagagtgacacttttaaaccttttttatgttgcacgcatccagggaggatggcagcggagagagaagagtccaccacacagaggagaggagaggagagagagaccgtagcaagaggagtagtagtagaggagagcagagagccgaggacttggccaggagagagaaggggtagggggagaccgggagagaggttgcagcagaggcagagccaactgcacaaggcaaggggcacgcagccacgcagtgctcctgcttgccctgcccctgcccacccccacctcctcgctgttctactgctgctctactctggctggcaacgcatcgcgtcgcgcgcccaagcaaaggctccatcaaacacacaccaagaaagaagaagaaaaaaaaatcccccgccacgccgggctgctccagatctctcagccgcgcgcgcgattatgtgggattaggtagatgagggcggcgctgttcggtgccgagaggagcggggtagtggacctcggcggcatcggcggcggtaacagggggctgttttggcccgcggggaaagggggcctggtggtggtggagccgaggtcggtgcttgactgcacgcgcagcccgagcccgcgcaatttcacctcgacgctgtcgtcgtcccaaggcggcggcggggcggactcgaccggtgtggcggcggtttccgagagcagcgccgccgccgccgaagccaccaaatggggagccccccgggaacaccggggcggctgttgctgccgtggccgccgtgggaaagaagactggagcaaccgctgtgagttgcccccgataccggggaccctggatgtggggctcgtcggaggagagggctgggacaccatgctcggcaacgccgccgccgccgcagccgggcaggatcagtcgttcttgaactggatcattggggccgccggcgacctggagcagcccgggccgccgcttcttgacaatgcgggattcgggatcccggccgtcgacccgctgggcttctctctggaccactccctcaccggcgtcgcctccgacctgtcgtcctccggtgcgcaaaacgcaaccggcggcgcgggtggcggcaaggcttccctaggattcggtctcttctcgccggaagccacctctctcgagcagccgccgccgccgatgctgttccacgaaggtatcgacacgaagcccctcttctgggcgcgcagccgccgggcctcctgaaccactatcaccaccagccgcccaaccccgccgcagccttgttcatgcctcacccgcccttccccgagcacaatcaccagtcgccacttctccagccaccgctcaaacgccaccacgccatgcctgatgacctctacctcgcccgtaaccagctaccgcctgcggcggcggcggcgcagggtctcgccttttcaccactacatggcccggttccgttccagctccagccttcgccgccaccgattcgcggggcgatgaagacgacggctgcggaggccgcgcagcagcagttgctggacgaactggcagcggcggcaaaggcaaccgaggctggcaattccgtcggcgcgcgcgagatattggcgcggctcaatcaacagctcccccctcttgggaagcccttcctccgctccgcctcctacctcagggaggccctcctcctcgcactcgctgacagccaccatggcgtctccagcgtcaccacgccgctcgacgttgccctcaagctcgcggcctacaagtcgttctccgacctgtcgcccgtgctgcagtttgcaaacttcacggcaactcaggcacttcttgatgaaattggtggcaccgcaacttcctgcatacatgtcattgacttcgatctcggtgttggcggtcagtgggcttccttcttgcaggagcttgcgcaccgccgtgctgctggaggtgtgaccttgccattgttgaagctaacagctttcgtgtcgactgcttcccaccatccattggagctgcaccttacccaggataacctttctcagtttgccgcagaccttggaattccttttgagttcaatgccgtcagtcttgatgcattcaatcctggggagcttatttcttcaactggtgatgaagttgtggctgttagcctccctgttggttgctccgctcgtgcaccaccgctgccagcaatccttcgtttggtgaagcagcttagtccgaagattgtggtggctattgaccatggagctgatcgtgcagacctttcattctcgcagcacttcctgaattgtttccagtcttgcgtgttcctccttgactcacttgatgctgctggtattgatgctgattctgcctgcaagattgagaggtttctgattcagcctagagttcatgatatggtgcttggacggcacaaggtacacaaagcaatagcatggaggagtgtttttgcagcagctgggtttaagcctgttccacccagcaaccttgccgaggcacaggcagactgcctcctgaagcgagtgcaggtccgaggattccatgtggagaagtgcggagctgctctcacgctctactggcagcgtggtgagcttgtctccatatcatcatggcggtgctgatcagccataagcttcaccccaccaatgttccaccagcgcttgcaagcattgtcaactccagtaatgtgcattttgttttgcaattaaatgttgcaacggaaattgttgtctcaagttgttgaacacctcatattgcttttcatcacagcttattagctaggcctagtggatttagcaatatcggtgtcaatctctgtagttaatgatgctgctttaggttcttaccatgctctgctctattagccattatcatcaaattcaagacactgctgatgagtagagaggataatttgacctatcaaatggttctgtggtacagaattgatatttgcttgctgttgctgtgttaattgtgcatttctgttgttatgcttatggattgaactgaaatggatgcatttctgtatttcaattttgcaatggtagaaatcattcaaggcaatgggaatggctataataggagtaaaccatatggatatattgtacataagatttactacagctatatagccttttggcaaacagcaaaggtttccgggtatatttgaattcgtaatcaggtttcagaagagaaagaaagatattttttggaatttataatatgatgtgttaaggagccaatggtgtcaccatcgtttatctggccacctgtagctccaaattttcaaagtttagtttgtctatttctggatgaaacgttttctcaacaacccttgactgaccatcaactgtacaagagtgccgatgatgtttctttccgcaacaaacaacaaaaagaatattgagtatcctcactctcctggaatggatagccatattggcgcttcatttgataatgtgcccaacacatagagcaagtaacatgataaattcacgcttcacagtccattcagttatatttccacaatagacttaatgccagtataacatgacgagtgcaaaactacaaatgcttattgtaacttctaggttatgtcctgggacgaggtatgcatatattcccattggcgagatggtacataaatcaatgcttcggttgtcaactagtcatcctgggtttagatcgttttgcatttcgggagagtcctagttttcttggtgatgtgttttttcatgattgtgccttgtcggtgtctgttttcttgaccaactgcccatccaaatgtgccggatgttgctccatgcatattccaaggaggccatcgcttcccttatccatggaataagcgaaacggtatatttgtaaacgaaaaataatttgtaaataaaacttttatatacgtgttcttagcgacctaaaagcaaaggctaaaaaataaactacaatgaaaaaacatcaaaatcagctccaaatttaaggttgaaaattcaaatattggtttataagtataagcacaagccgaaagatgagaccgcaaatattcttttgctccgttttccattactggtcactttaattgtcatcgtctattttttacactcatatgcattttgaaaaaaaaaaaaattctgtacgatttgtatcctattcagcccattgaaacaagagattaattcctactaattcctttaaaataataaattcttatagaataactatcctgaaggaaaataagcatgaataatgagcatgttttcccttttcctacatcttgctcctatgaaagttcttgtatttcaaaatccgatagtaatgctatgagcatgccatttggggttatactggctcctttagaacacacca

SEQ ID NO: 71227 - DNA, 3677 bp, Oryza sativa
tgcagagatgaaatctacatgagtctgcaaaatattttgtttggtaaccccataggaagaacataggacctctacacaagcaagagagaatatgaggtgtgatgatctcaatatgtttgttttcttctaaaaattccatgaaacaacccattctatatgaattttgaaggtatcttcagagctattccttcagaacaaggatcatataggattttttttccctggggattcatgttgtagggcacttttgaatcgtgcgaatgaaaaaaaaatagaggaataggaaaaacgtagaattctaataggaatacaagtacaaaatagatgattgcaaaacataacaaaaacacaggaatgaccgattgattgaaccataggaaaaatgcatgaatcagatgagagagatagactcaaaggaaagtttccaagaggttggagctcttgctaaattttctccacaatctctataagattgtctgttccattggaattttagatgataagatatgattcaatcatttgttttaaagggtttcataggaaattttcctataggattgaaatcatccaaaattcctatgtttttcctctaaatcgaaggggctcatattcttctaagggctccgttgaaacgcgggattcagaagacacgtgaataggaaaaacatagaaatagaaagtcatgtctttttgaatattacagaaaattgattcagacatgaatttgtaacagataacatgttataaaaccggcctcaaaatcacatcggaaaccaaacgcggaagaaacaccataggagatccaaacacggtgacgacaccgagacacgatatttgataacggagttcaaccgaagcctatatctccagggcactgattacgggcacttctccctaatctagcatattacagcatatcagagttacaacgactcacggccggtcaccgccggcagccgctgcctctcgctatgctaaattatcatgtggttacaatatgcacgcccctctatttatgagagatcctaggatagagtccgactcttactttagtcttaatatattttaccactccaagttctaaactgtaaccgactacatacacatattcgacacaaactctaacataccatttgtcaacaccaaaacaaaaccatagaaactgcaagtcttgcaagtctccaggaagagaaaacatgaggctagacctcacgttgacttttctccaaaattcctatgaaatgggagatttcacaaaaatttcaaaggattttgtggaggccaattctttggaacagaggacctagtaggataaatttccatccgattttaatcctctatttttcctttattccaaagcagccctcagattctagattttcgtctgcacgttttctaagctattaaacaatatgtttcgtgtaaaagttttctactttctattagttaattcatacgtttatacactccaataattatataaaaatcagattatccatcaatatatcaattttagctctctcggataggacatgtcaatcataaaaattcctttagttttcgttcgttctaaaggagcccttcatttttactttttctttagcaattaattttatgttttttgaattcctttgttttataatagtcccacgttgcaaaggagtcctgttcactccccgtagagacatgtctagcctaatttttttactcatctactgcttgaacacatataaaaacatctctaccagtgccatcatgtgattgtcctacctcggattagaaaatgcgaagagctattctattcgcgactgaagggttgattaaattgactacaaaaatcggaaagacctggacaagaacactggcccctattttttctagggcttatttcatctttgctcatctcccacatggccgtgtcccctcatgcctcctgtttcacattcttgcccccatgatcgcctgcccctgcatttgcttccatccacttacaaaaaccaatcatctgtactacaaattgtactagctggagaagctggtttttctcgaagcatgcgtacaaatctatgatttgaaggatttaaaacaccatgttactggtgtgacatcagggttagtactccacagtctctcacttttttcccctgtgccagttaggatcctctacatcaagaaaaaaactttatcagagggttattatgctaatcaagattcagtaattcaggatgagattttttactgttcatcggaagctgaaacagcactcaaattgtaaattttgttcgggaggtctgacacttgctaaacacagggacgaggaacagagtaacttttgaattaacccggagaggtagagaggttaaccggtcaatcggtgtctattcacacgggtgaaatgttgttacagcagggactatctagatggtatttgacagaaaaacacctaaaaattatgcgaattctataccgttggatcgctttaagattagtgctggcagttctaaccctacctccccttgtcattctaggccccccgccgccttctctcgcgcgcactgtgcctctgccgccaccaccccacgtgccgtcgcccggactcgctagttggccgaaaggagtcaacggcgccagcgagccctcctcctcccctcccctaccctaccccctaccccctaccccctctttttctcaatggatcgcgcgagtgcccccgccccaccgtcttccccgtcttcggcggctccctgcctccggatccgccaccactagccgccaccttctaaccactaaccgccggatccactgtctcttaaccatttgcccccggcggcgacgccggcccaccgtccttcttcattcccgcggattttgcgccgccgccggcgcctcgccgtccgcccgtgtcaccgcccaccgtcgggctaggcctcccacgggcatccctttaagcccagcgacacccccccctctttccctccccccacctctcctcttacctccatcccaacccgggaccctaaacactaattccattgctttcgtcggggtcgtcggagttagagaagatgttgccggagctgtaggagaagagctaaggtcgtcagagcacgaatcgcgaagcaaatcccaaaatcagtaatctgcatgattttggcttcaaaaatcattcgccagccatttagccctttccctaaaaaaatggtcatcctatcctatctatcactcactctgattttgatagcacaacgaattataatgtgttgcaatgcaagtagaggatcaggagagagcccccgttcctgcatgagaacgtgcacttgatcatgaagctgacagctccatttgtttatccaaggagtgacgacaagctacacatttgtttatgtcgccatgcacccctattgcccccctcctctacccttcgctccaagtgtttcaagctagctacagcgtgcgcgatgcatgcatacgccactctggacctgggactccgggagagagggctaaaccacgctaaagtcggtgctgctttttcttaatccaaggagttaagcagtgcccatccattcttttgaagccatctactttgctgcaatttttttttgttaggacttgcagctttcaatccaatatagagtactcctacattggtttctttgcttctgtagagagacaag

SEQ ID NO: 71228 - DNA, 2128 bp, Oryza sativa
aatcagctgaaagcttacctcacctcccccccatcctagtagccccagggccagaggaaccgttgctgctctacttggctgcgaccccccacgcggtgagtgccgcccttgtagttgaacgcgatgagggtgacccgcattgcgaacccggctatgggaagggaccaggggcccccttgactggtgatggcctatcggagcttagaactaacaacttggatccgactaagataatgtaccaatccctggatcagtaaatattgatacatacaatataactggttcttcattgcatatgttaaagttttacaatactaagggttttacaataataggtactcacctagctaattaatacacagcggaagtttctatacattctgactaggaaggtataacctttaaggattctctaagttatcggggtcatcgtagtaatagtcataagggtccttctcttgacccaaatctgaaaaaggggttataagagtaaggatgagtattcacaatactcagcaagttatcatggaaatatgttatgcattgacatatattagggttctttacaaaaagcagtactagacaatctggaagagttatagcaagaatttataaaacatatagactttagatttctaaccagggtaccatatgagtcccggtactcaactccatgagtacggctattcgaatagtttcaaaaatattctactgcagcagatgtacgctttacccgcagtccacgacttgctgataatcatcggctttagtcatggcccattattaagtcattaaaaattatggcacctgttccatgaacttatatcctcatatgctctgaacgtattgttaacagcaacaagaggagttctggcgttcccgagatatttaaggggaactgatcgtatgacaccacatcatctcgatcagggtttagaaatataccatatagtttatactcgagtatcacaaaccatttacctgtacatggtaatggttaaagttgcccttcgcggctatagttgcctcctgtgcgaggacttaaaaataagaaccactatacagaggtgccatattgctaattaacataataactaggtttgtccccattctagaaattgcggtcatacccgttcattcgacataagtaccttggtaaacttatatcgatcgagacagtactagccacccgggagtcaaccaaatcttacgtactgtcccaatctaagtataaggtattttaaccagattgtaagcaaagtaagcaatactaaattatatgggtttctatgattatactatgcatggaaaatagtatattgaatataaggctataaattaataatttataaaatataggcttaaatgatcaaaaggtatatggtaacttgccttgctcgatgtcttgagattgattgatattatctattgagtcagaagaatcctcaagacctagggttagacatatatagaattgaaattctaaaggtgttcagataaatccccgagatatgacaaatagagcggataaaatagaatgccaacatagcaaaaaggggctcaaaagatagagaatgattttagaagaatattggtccgagtttcactggaattggatctatattttaaaagatatgggcttctaaagtttgagaatcaaataaatgtgaaatggcactgtgtgcgggtcccacctgtcagtctctctctcttctcttcttctacctccggccgatccccaaaagcggctggcggcgctagggttgacgattacagcggtgatggagggggaaagtggttcggccgaggaggggagggagctagggttctccggcgacggcgagcgacggcagagggattaatttgatatgtgaatggcctatcggctagggcggcggtggcatgtttagaccgtgatggtgatcaagatgatatgagttagacatggctagaggaggggttctagagcatttacgaggtacctagatgaattccggcagcttgccaacctttggcaaggcgtggattaattcggctggcgacgtgttggcgccaatccgggcgcgacgcgcggcggcggcgagggtgaaaacggccgactcgggggtgaatggtttgaattgtgaga

SEQ ID NO: 71229 - DNA, 797 bp, Oryza sativa
atgaccaagttggccacgtcgtccagccagcgctaaacaggagtctccggctccgggtttaccgggggatgccgtagaagggcgcctgctgcctgaagcgtgccttggggcgaaccgccgtctccatagtcgagacggcgtcgtgccccgacgcatcgcggcctccctccgccagggggcggagagagagccgaaccacccgaacgagtgggatcctccctcggcgaaggttcgcagcggggaggagttggagaaccatggcgacggtgacgaggacctcggttctcgctggaatccccactcccggacggggtgggggtaaatgccaccgcctcctcctctacttccaggacctcgaccatggtcggctaaggcctggagaaacttgggacggaagaaagcgacttcctctcggaacgcccaaccgccccctacctggcgcgccagctgtcgagggaagatcctcaatagcggggagtcatgggaccccccccccctttcgtgagttcggccgggggcggaggcctgcctctcggaaatcactcgctcgtccctaagattaccggcaagcttgcacgtagtcggattatacaggttcgggctgttatggagcataacaccctactcctgtgtttgggattatggatgagttttacaagggtttcttcactccagagagcgcacttgcttcctctcttcttgagttcagattttctgggagtcgtcccctcatctcagtgggaagggtcctccttttatagcttaaggggggtaccgagctcgaattcgccctatag

SEQ ID NO: 71230 - DNA, 1846 bp, Oryza sativa
tggtcctcacccatcagactagtcttctggattgtgtaggcccagcatctaaagttgtggctctggttgggcttgtggtggagcaggcccaatttgacctgggtggtccacggttggtgggccaggctgcgcactctaacaagtagttcgtttgtttactttgcatatttacacgcttgattcgtcccatgcatctcatgtgcgtgtgtagcacgtactccatatgtgctgtccgtacccacgtatgcaccgtagtcgcagcactcgtgttcaccgtccacgaccccgtcgtcatcggccctgcacgtcagccgcgccgcgccacgctcgtcggcttcgcccttccgccgctagcctccctgccaccacggatccacgataaccgcgtgcgtcgggcggccatccatggcgctattcctctgatctctccggtcgccttcggccacgcccggcctcgatttccggtcacgttccgccatcgccggtttgatcgtgagtgaggccgtcgcctccgcaacgtcctcgttgtacaccgatcttatcgccacgactgacgatcttctatcgatgcacgatctccacctcgtgtttcctcctccacatgtcttcttgatccaatgctgaaaccttctactatgatatcacttgttataaaagttagtcgatatagcggaacgacgactaaccttctcgatcgcttcagtcattgatcacccaagacatgctagatgacgacacaggaacacacgatatttgttaacaaggttcagccgaagcctacatccccggggctctgattatgggcgctcctccccaaccaatatagctcctagccactacgagtccatggcctcgccgccatcctctccctgcgtgtctacgctacattgtagtcgccatggttacattgtgatgcccccctctctatttgagagagttgccgggttacagagttcgactctaactctatcccctaacacctattacaactccaagtccaaccgtaactaaatagaactagtatattcaacacctattctaacactacaggctgcatgcaaattaattggtgtattgggcatgtgcttggtcaaaagtattgcacctctggattggcttgggtgcagtacgcatgcaagcacaagctgatactgtcacaccctgaaaatcctaaatatataaattgttgtttaattggaatttttagaattgattttaaaagcctagaagtgaagatctaattttaattaataaattccaatataaaatgggaccagataaaatttcattaaatactttgcttaattctataattcctagatttttctgggatttatttgagctaaggaagtatttttaataaatggaattgcatttaagaaataatttaaactgaaaaaggttttaaaaagtctcttttggctttgggccgaaagtcggcccaaaaccgctctctctctcctcggcccaagtcggcccagtccgccgccgcgcgcgcgcgcgtccgcccgctgacaggtggggcccacctgtcaggcccgtcgtctacctccggccgccgccgcccgaaaccctagtttcgcgccgccgccgttcccttccaaatccggccgttcctttccttctccggccgaatcaaaagaggggaaatgatctccgggatctcctctaccttttctcttttggaatcatcggccaaatcagcttggaaagtgtttgattcgaggtcgaatcggatcggcttttctctctccgagcccgacctttccttctcgtcgccggtcgtcgtgggccttcgccgccgcctccgagcccctttaaaagcttgagtattctatagtgtcac

SEQ ID NO: 71231 - DNA, 8078 bp, Oryza sativa
gatcaaatgcatcgattactattctctaagaaacctgtcattatctaagagagcactagcaattatatttgctgttgtctgaaagcgtacagtcccggaagaaactgaacagggtacgcctccgaaaacgttatctgaaaatctatccttgacccgagatgactctcagctggttttcaggtttcagcagctaacgacaagggcttgcacagttgcgggggatgtgtagtgtactctagctcattaatgagatgtcaggtaagaaaagtagtcctccaaatcgcatcgacggcgacaaatgccctcgaataatagacatcacccgcagaccggctcatttggccatttgggatgcccacaaatggtaaacattccaacgcccgtattactacctaacacaaagtacagattcagagaaaatatggacagattttgtgcacactcgtgcagtctctgtccgttccctctcgtggcaagcggtgtaaacttaccaaactgcacaatagcaactgcactggatctcaatcctatagagaggagattttgccaataaacagaggaaagcctggaagctttcctggacacttatgtcactagctgcatgctttgctgcaattcaaagatgctgtattgtcagcaatcagagtctggctggattttctgtcacgtgataatttgtctgcaaataattgatcattgctctcctctctctagtctatattggcacacatctgcaagcaatcaagaaagagagactactcttcaggttcacgacaactacttgcacattttattcaactactgcaccgtcgctttgcattacacagaaatggaaacgggaaagatctgacgagctgctaaacactattgaatcgcaaaaccacaaagcgaggtcgctatggatagacaaaaagatgcaaaagattagccctaaaagcaccgtgattaagcagtcggtctgatgaatgcctgcgtgaaatgggtttcagtacttgctggaaagcaaccgacgcacattgcagagtattgctgtctggtccaaacagagcgtacaaagcaaacggagcgtaagttgcaccctcttaatcttaacaaagctcacatgggtggtagtataataccctggcaatctaacttgttcctgacattacagtacctcacctttcctacactaaagtgactaactatgtcgagagaaaacttccaaacaattcagtagcaattgattagttggacgacagaatcaaatgaatgagaggaacaagctatcatcagatcttttcctcagatacgccgagctgagcttagttgagatgaaagctggaagaagccaagaaaagaccaccagggtttaaggcctgaatcatgaggaggaggacgaagaataatacacaccctgtcctaatgcaaaagagcttccttgtccttatcaagcaaggctgcaagtctttgctaatcttctcatccgatcgaaaagaaagcaagctaggggagaagagattgtagtagtagtagtagtaaagtggatgcatgggggtgatagaaaaggagccatgcattgtaccaccaacaagcaagtgccgttgcatcgatctgcagccttttgatggaccggccggggaaggaagcagaaaaaaagatagccgtcgattaaaacagtctgtattgcaccagcgatcgatgcgtatgggtgtggtacgtactacgtagatagctaagctaggtcgtctctcgatcgtcatctccctggccctccactgctcgcaaagtcttgtaataatgcacagccttttcggttgctaaagggaagagggaaaagagagacagagaagacagaagtgatcagattgtttttcttttagcgaaaagtgatcatgctatgtacaagtgagatgatgatgatgatgatgataacggtggtctttctttctctcttcatgcacaagggccggcggtctgaattcaaaccccatgggggtacatatccttttaaacttaaaaggcgtaaaagaaaaataaaggagaaaggatatgccataaacagaactcagacagcagccatgaaaatgcatgtcttcatcagtgattagtgagaaaaggagggagcggatgaatgacaacttgtttaattctccctctgaataaagatctacttacgttgtgatacaggcagaaagatggcatacgcaactctctgtctagtgtgcacctgcagggctaatctaaccggcgtgggtgagcgcgtagggcaaacgcttcctctccctttcgacgaaatcttttacgtgctgcccgccctcaaaagaatgcactcaatttcatgcttgtcgaaaagccctgccttctcgagtgagagcgatacgtgtgatcgagcccctagcttctctctgtgaggaaacgcttgtgcagcagcagctagcaagacacctctgcaatcccaattttctgtcaatcactcgcgccttccgtgtggtcctcttgtcaatctctgtgtgcgtgtggactacttgcttggccacttgtggccaagtagaaacgcacggaaaggaagctctggaactcatcaattcgaccaccggaattatatttgctcgtcgatctgtactcccagctagcttccagcggcaaaatctcacacatgcacagaacagtaaattagtgacagatcgatctcagcgagtaggtagaagaactgtattagataggattttcctagctagttgagttaactagctttttttttaaaaaaaaaaatatcagaactgcattaggcaacacgcaccaagatgaaggttaatagagaggtcaactacgactccatccaaacaaagaaaagctcgtagctttcatgcatggcccacgcagttgtggccgtgcggcaccacacgtacagcgacgacgaaactaaagaccgtcgagtgagtgctcgtcgctgttgctggctagctagctgtactacccgctggccgcgatcacggttattttcgccctgcttttctcgcgggtcaatgctctaactcatctggatgtaataggcgtatagctcagctatagcttattagccagccaaatcgatgatatactgaaatgatcgatcgatcggatccatctgcgaaaagccatttgctagtaatacggtagcccacgtgttgggggcaaggagagatcactagctttcggctactcgctctcgctagctctctcctcttcccggtcgatgattcgcgtttcgctttcggtcgtctcaccatcgatccatccggccgcgacctgcctcagctacagctttttaatttccgttgtgcggtacgcatgggctcgggataatctcaggctcgcttgcgcggcgaggagaggccagcgtacgtacggcgtggcgttgcgcgctggccgatccgtaaatggatcggccccgcgctattcaccactagctagcagtttgtgttacacggaatggcgatggatagaaagagagggggtggggtgaggaggtgaggtcgacgtgaaggctcaagcgcgatcgagatcatgaattggtcttttgctgcgtgtgggaggtgtgtccatcatgcaagtggagctgtcgattacatgtattgtgtggttgttttttttgttcttgtatgtataggattggatttatgtatatgcacggagagagatcatttatgggtgtggagacaaagcagagattttgaaggcagcatgcaggaagtggtgtagatcgatcggattgtattgaaaacgttcggggcgtcggtgtacacaagtgtggttcatgcaatttgacactagaaagtagtagtagatcagatggtctctacttggaatgtagtagtactagtaactatagagttctttcgtaaagggcatcccctgtgcatgatattgcaggggaatatattcggaacatccgtcagtgtgaagactgttcgttacttatagtatcccctcctccttttgttctcctccccgcgttagccaacttgactacctgcgaaaaagaattgtggtatggctgtatattacttaacccgtaagtctaccgaatatttcatttctgagactggaaaagttttgcacaaagatcgtgtgtcgtgtctaaaagatgtggctggaaggtttggtgagagacgatgtgtctacttggaaatccaactagtaacgcagcccgcaacacggccctctcggcttaacccatctgcgcgatgccaagcccaggcgatgcgttggctcccagtgggctgttggctaacgccgcaacgtgtatgcatcagcttagcacgacaacctcgatagaataagtccattttagctcccttaactagtgacataatctgattcgtatccctaaatcacaatagcggatatctcgacccccgaactattggaaccggtgcaatttgactatctcgatagttttgaaagatggtttcgctaatgtggtggtgttgacctaatcttcgctaaggaaaaaaaaactataatgataacaaaatacgtatagtatcatctacgattctgaggaaacagacgcgttgatattcatttttgttctggaatccttctatttaccattcttgggagcacgattaacttcttattcttattagataatattttgtacagagacgcaagcggcacagcgtccttatcggcacgctgtttcgcacacctgccacgactaatacaaacacttatactgctgctaaatccctgaaccgtatagcaccaagatgggtcagaatcttgtttatggtatatggcaggttcactttcaccacgcagaactaggatggcgactggcgaggtaggcgttcacttgtgcagagcttgctgtgtaatcaggttgtgaaattggggaccttcaaacaaccggaataattggtcgggtaccaacgcgaccaaagtttaacaatgtcccattctcctttttttttcttctttgctgtacagaattccgatttcaagccaattccccgtccacctacacacctttttgcggcaaaaacaggtcgattagagcttccttgggtaaaatagcgcgaatccaccatagcaagctcacgactcgagaaccccgttgccttcctgcagcatccgatcccctatcttcgagctcaactgcagcattaaggaaacatcaggtaaacatgtcactattctgtgcgccagcagtgaacttgttaaaaaggcctcggagatagacactgatgatgtataaacagtaaaagactacaagcgtcaatcaggacctgaagatagtagctagatgaggaactgggtcacttacagcaggatatgtgaagactatgagctgcttgtcagctgtcgaaacaagaagattagtgttatctttctgtaacgcaattgctgtaacgttctgtccttccccaagttttagcatatgaattatctggcagtatatcccttattggttagaattctggtcatagcaaacaaagataaaaaataagttaaaaagttgctcatggttttcacctcaagtttgtatagatcaatgaagcagaccgagggcacatgaacagagggcttagtctcatttaattctggcaaatcatcatcaccgttgggtttgtcaagctcataatcatctatagcactaaaaccatcacgattgcaactgttggacaagcatgttccgatcaaagcaaacttgccatccacagaaatctcaatgcaactaactcgaccagagaaaggtgtcagaaccgaggtaccaatcgggattccattaacagtgaatgtcgataatcttttctctgattcattccaaatcaatatgattccttcagaagataaacacattaaatgtgcctcctgtttatccagcttcctaatgagcctgcctgtcctcaaattatgtagaaggacaccagacgtacttgaagaggaagcaacaagtcccaaggcagaactaacagaacagcaagttacttctccaagatgccctcttagtacatgcataggaccttcaattcgtcgcctcctgctggtttctagaactttgcttgaattgctagtgctgctatcaccagaggctgaatcatttggtgttgttggtgtagatggtggaggttctggagtacttttcttacgtaaagagcctatctgacgtatcctccaaagtattactgtggtgtcacgagaacctgtgacaagataattgctatctggagataaagcgacgcaggtcacaggagcaagatgcccaaatgccgtttcaatggtccttgctccgtctggggatatcaacttcacagaattatctgcatgcccccctacagttagaagggaaaaaaggatatcagaaacagcagagggagcagtttgatgatagttcatagtgtaaatacagttcaaaaaaggaaaaagaatgctgctgtaaaagcagaataaaaaaacaacattttctacatgaattaatgaagatgtcagttactcgtatgatctcactttgaacaccaggttttcaaccagaaaaagatctaggagggctttcaatacaaataaaacatggaaaatgaataatagaaaaaaaatactagctttccaacaatataattgagggggaaaatgaagaataaaataattaccagttataacctctctctcacatgtgacaacaacaaccgatgaattttggattgcagaggcagcaaaagcaatagcccttgggaactgatagtcgtctacagaaccagcagatcctttgaagatacgcattattgcaccaccacttaaatttatggcatttcttccatgatgaaagaggaaaggtgtccctgggccatttgaagtatttggctgccaatggtgcagtgccaaatgtgctgcaggaacatttgcacctacgactacaatagagtcatcggatacaagcattgcactagcaggaacattgcagttttctggattaggtagtacataagatctgacttcagttgggttccagaatattgtctgcacagaaaaacgaagagataccatgcactcacttcaaacaaatctaaatcatgaattagcgaaatgaaagctaacaggtacaatagatttcatctgatgtaagtgaaccatggtgcccataggatcactttaaccccagtaccccactgctccccatcctctccgacattcaaccatcgactgaggactaacaagtgaaatgaggcagcttgactttcttttagaactgtagactttgcaatacatgttggtatatctcctagaggcaaacatggagatggttgtgtccctatgattacgatgtctataaactcttcaataacgccttacttttcccttgaatatgctatgccattttaactcagcaagtatgtagcttactcgtgaacctctgtattgcttgatgatggctattctaaattgcttaatctgtattctaaaagttcacaggccaccgtgcttaccaaatagtgacatttcattttgtaaaacacagaaggataacttgaaaacctacctgcagctttaagatgtctgccaatggccttctctttgtatgtgggattgtcagcaattgagatggtgtttgtccaaaattacatatttgatcttgcatggatcgccgttgcaccttcagcattttcagcagcacgttaacaactagctagctactggcaaaatctaaaagttgaatgcagaatacttactggattagtgatttgatcaatatccaccatcccctcatatgtagcatagggaaaaacattgttagccatcactgcatctttacctctttgtttatgtctgaacgagaaatagttgatgactaaaggatgttaacatagagattaataaaatataattttaatacaactagcagaacccgtactttgttacgggattaaaagaaaaatcaaatgcagtggaaaaaatatattgcttttctttgtaatttttaattaaatatggagtatatgagtattaattagatgtgcatgctgcaaaaaataatcactgtgacttcatcgtgggttgtgaccattggttattttaatcattctcatccactccaaagacccaagtccatcttg

SEQ ID NO: 71232 - DNA, 1101 bp, Oryza sativa
tttcagagcgtcaagaaatccatacttgtcagtcaaaaccgccaaaaaaaatcattactttgggtgctctaaaaccgccaattcaatatgatttgcacaataaagaagcaaacagtaatgttcattttatacgagaacgtacacgaagcaattgcacacaatttaatgtgtttcgcataaatatttcactagttggatatataagcaaattaatccaaccggtaatgctcttgtacacattccattaagttttatatatctaccagctttaggtgagaacacagttcgatctgatttatacttccagttagtggttcatttgccctttgttttcctctaagatttgatagagatgtgtaatccaataaattattggcagatagaaacttattggacagttttatggattatttgtacactgatccatatcatactggcctctcaatcgatcgtgttaataaacaatagatatatgtcgtttttatagtgtaactacatgagtacttaatcccttaatttgcaaacagtacagtaattagttaggtgcccccaatcattctacttgcaatacctgttcttgtactattttgtgttattttatttctttcattttgagagggccgtgtaccatacatagctagatatagaataactatgagctcaacgttaagcaaaggtaatgcagaatgattctttttccagtgcagggagcactcaatatctctggaatgaattagtggggtctgatcaagattacttctaattatatttcccacaaaattatgcgctatgatagcatatgtacgaacactttatgatgaggatacaggaaatatgaagtcgaatatatcgccagcgtagctcttacagtgtatgccaatggcgctctgacaacgaaatagtaagagaaaaggacagagagaagggaaaataaaaggaagagatcacgtatctgtacgtatatgtgctgttcggtacagaaaaagagattttacggtcattaagatgttacacttcaaaaatagcttgtggcgcctcctaaagaattgctaaacaacagtactaagctagcaaggaatgcataatttgattaattagggg

SEQ ID NO: 71233 - DNA, 1096 bp, Oryza sativa
cctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggg

SEQ ID NO: 71234 - DNA, 2416 bp, Oryza sativa
atgagtatattgcgtttagggccaccttttattatcaaagtttcattttggaccaccctttaacacattttttcactttgggctaggttactttacctttctttcactttggaccaccccataaactttttaggaatatataaatgacttttccaattttaaacacatcagcaacccgtaacccagtaatcttttccaacttacacatgcaattctttacaatattatagagtagatgtaactaaagaaaataattttgggtggtccaaagtgcaccaaaggtaatcttacctagtccaaagtaaaaatatgagctagaagatagcgtaaagtgaaactttggtaacaaaagatggaccaaagtgcaattaactcatattttattaacgaccaaaaaataatttatgagtaaaatttttatatgtgtcgtttgcgacttaaaattcaaagtttttacaggtgttgtttctttgtaagccaaacgatgagcctccataattgcacatcgatgcagccttgttgcgatatacatgaacaccctcttaatttattgcagacagccctcaaccataactacgtacacggatcatcacggtcgaaaatatggcctgctcgtctgcgaagatctatagtccttgcagtgaaaaatcggttttagtattgtttgtccagcgcgataatcaagcaagcctagctaaatgctgattgacaaatcctgagaacaaatctcctagtaatgtataaattatgtagcctgttgctcttctcgtaactcaaatctctagtaatgtataaaaacaaatctgtaacctgttgctcttctctcttctaatttatcttcttaggccatcagcaatgggtgccttcgacccgtcccctcgcaaacggccatcaacttttgcatctgagccgtgccccaggcgagacgcgcgttttctcccagagggacacgcccctcggcgacttttggcagagcaaccaggcaaggagccatgttgtgcgcgtcgttgcttgtggacaccgctccccacacccatattccctttccacccttgccagagctggaggcggcgctggcgaagtggacggcgacgagcagaggcggggaagagagggggaaagagcggatctagcgccggcgaggtggatggcgatgagtgacgggagggagaaagtgggagagagagagagaggcgagcggcggggcggcgacggcacggccgtgccccgcttgctgtggccgtcggccccctcacgccgccgtccggggtcgccgccgccgcatccggggtcactgccgccgcctccggggtcgccgccaccaccttccatgggaaagagcggcgggagagagaaagggagagagaggcggcgacgacgggcgacggcgagatccgcccacgacgcgccggatctaccgcctccgaggtcgccgccgccacctccgggtagccgccgcatctcccgggggacgaacccctcggcgacctcatccatctccgtcttggcctcctccgcgcggcgccgagagagaggcaagtggcggtggtggcggctggggagggcgaggagggaggtggcgccggcgctcgcgggagagagagggaggggggaggacggcgatgtcgccgagcggagggagtgatgccggcgaagaaaaaagaagaggagaggaaagagcggaagaaaaagtggagagagagaggggggagaagagaggggtagtataggaaaacatctaatgtgggtttttttgttaggacacccattgtgggcttgagtaccttcatctagttgcttcagattttgaggaactcatctaagggtgtctattattgcgagctaagttcctctacgagtgtcctcagttagtgaggacactctaggagtggctcacattgtggatgcccttaaattatgtttacagctgacttatagttgtacccgctttgagaagtcaaacctcctagtaatgcataagagctagccaactaccggcttcaattcatctataaccaatctaatagctcattgcctataagtatatactacatcactaatatatggtcctacatcttatacacacaaaacgtattaaagtttgtactgcagctggctataaatttatagcccgtttttcttttcttcttcatatgtgcttacagctgacttatagcctgctattgtactcgctctaaatgcaagacatcgaatccatacaggtcatacacacgcatgcacacgcgcgcacggttgacttttttctaggttccgtgcagtgtgtttgcgtcgcgtcgtccatgcacatgtggcctaattacttcggcatttaagagacacgcacacaagaacgaaagttactgcagccgtagaccattagatgagatctgattgattagattaatattgcgatgaa

SEQ ID NO: 71235 - DNA, 896 bp, Oryza sativa
gaggcagcggcgccagccatgctggcgccgccccagggaggagggcgccagcatggctggcgccgctgcctccattcctgtttctctgtatggagttgcaatgtgttatttttattttattttttcggatgttttttcacactcaggatcatgatacaaccaaccacaaaaaaaatttaaactcgaactaccacttagctaagtctgaaaatatctagtataccacttagtctactttgcaccttcactaaaattagaccataactcctttagtaaaaccctttgatcagcatgttaaacataatgcactctaccactatatgaaattacttaatctaattcaaaatataaccacatgaaatgacatatataagttaaacagtacatagagatgcaattttttttttattttatttttttgatatttttttcacacttaggagaacataggaaccaaccgtataaaaaataaactcaaacggataaaatatgtgacatgtagaattttccaaaactctaccgaaacggacaaaatatgccatctattaaaataggcgtaactttctcatacggactcggaatcaggcaaataatatatgcacggacatctacagaaaaatttacatccgattctccccagcttttccgggttcggcgatattaaaacctccaaattccgcttgcaagattgtgttttcgaggagagaagtttttcggtggagctttggaaaattccacatgccacatatttcgtccgtgtgagtttattttttacgtggttggttcctgtgagttcctatgtgtgggagccatatcaaaaaaataaaataaaaataaaaaagttgcacatctctctcctctgcactagttcggagagaggagaggagaggaaaaat

SEQ ID NO: 71236 - DNA, 2096 bp, Oryza sativa
taagctaccagcataccaccacaagcccacgactatacatcctcatcttttctcttatgcttatcactcaaaatttatattttcaactttaaatttaaatttggagttgatttggaggattttttaatcaaagttttttttagactttgcttttagattgctaagaacacgtatgtaaaagttttattcacagattatttttcgtttgtaaattattccatcaataagccaaatgaccggggcgagaggctccttgctgacacgtggaggctgctgggctggccaaggtggccgacaacgttggcgtttgcatcgccggtgacgggaaggccgccttgcccgatgcccagcgacaagcgccattggaggcaagggataataaccgtcgcgaaacatatcaatcatttgtataaccattttttttaaaaaggtaaagctgaaaacgaaaacgatgttgagaatatcggaaaacaggaaacggactatacagacggaagcatgtcgatatcgatcggaagctgataataaatatcgaaaacactaaactataaactcatatgacaaaataaattgaaggttatactaatactctcatatttagagtgacttgaatataagaagttggcgtgagaataccaaacaggcatctggctgacaggagtagtacacactgtaaacagcaaaggccctgttgctataaatattgtagtatatgaaaaatttaaagtcaaaaattaatttttaagattttgttaagtttaactacgtcttaataagtgagacagagggagtagtacatttgccctcctggggtcctggtgcctgcagataccatagcactgaattccaccgtgtatggaatattttcctgaggataatgttgtgtacaaagtcttcctccgtctacaaatgcatcccctgcatttaacatctaatgaagaaacaacattaggtggaaatgcccgtataccatcgcttaaattcacattttgccaaaaaagagatcactggtgtgcccacatatgaacgaacacatcagtgctattttggcaaactgtgaagtcggtcataacatgtgaggatgtgccctcgagaaattgtgttactattacactatatcacacagatttaaaatctgcatgtgcacgaccattcacaattacagtaatcagtaacatgagcgtctccacaccacccccccccccccaaacacccccaaagagttacatagagaatcaggctcccatcggatagcctattcagccaaagaaaaagccaaattttgaattttcaaacttaattttgatattgattttgagatatttttaacgtagtttctttttcagcattagctttttaagtcaccgagaacacatatataaaagttttacctacaaattcatttttattctctaataagccgttttggcttattacgaaaaaagccaaacgatgaggctctcaccagtcctgcaacagtaccacccattcaacaattaacaagcagtttcaatacagtttaccctttaataaaacaatagaaaaaacatattttatgaacaaagcaacataatgcttacattgtaaacacatatgtaaattataactgaatagacatgtgttctaaaaaaaataactgaatagacatacaaaggtctacttatgagtaaagaaaatgaatttaatcctgttaaaccaatgttcttttaatcgacaaagccttgtcctttgctttgactatatcactattctatacagactaacactacatcatttctaggagaaatgactaccggtacgatctggaatcgcacatcccactggattgttatacatggttcgtcggcttctcgccttatcaatcatccatcatctgctgcctttggatctcaccaatatatgatgtcaaagaagatccagaagaattggccgtcctattattgacacggcattgcagcaattgttgctgaagattctggatgtgctcattcaatagccgaatcatcttttcttgagataagattatctgcaagaaagtttaactcagccagcgcagcaattttgtgaatttgcaaaataaaaataacttgtctcta

SEQ ID NO: 71237 - DNA, 621 bp, Oryza sativa
ggagtatactatagcctccgttgatttgcagatggatagtggagattatggggctagcttatgcttgttactgtgcccctctgcgtaggatctcgtgttcgggtgatctacacgctcagctcgctctgatatcctgtcatattggtcttctgaattctgatcgctgaattcggttcgttcacgcggtgcggccaacggcgatcgagcaaatggtccgagcacaaggctgtcctatgtcagattcttcagatagaaggcccgtgcggtaaacttaaatgggcctcgcgttctcgtcgttcatgcatgtttgggccagaaaggacccatattcctccaactgttgacaggcccattatcctatgtcaaaacttcctttccttgggataaaggtccaaccggtgagtacctaaatggctaagggccccttgaatcgtagggtagaaaaaacagaggaataggaaaaatacaggattctgataagaattgatgtgtaaaatagagtagtgcaaaacatagtaaaaacacatgaatggtcatttgattggagcgcaggaaaaacgcagaaatcgtatgagagagatagactcaaaggaaattttctacgaggttggagctcttgct

SEQ ID NO: 71238 - DNA, 1519 bp, Oryza sativa
tttaaaaaataataagatagataaatcatattcaatttatacaagtaaaaaaaattgactgcacgtgaatagtgttcgtgtgagtactatttgcagtcactaatgagttatataccggccaaaaatatttcaagaatgtgatataccactaattagacgatttaggctgtgttcatgtgttatggttggaaacttctttcttctggacaagtagcaactcattccgtataattagttaagtattagtttaaaattaacttaaaactagattaacgtaatttttaaaaacaacttttctacagatgttttataaaaagaataatatttaacagtttagaaaggatgtgcgggaagatagacttaataatgcagccttaaaaccgtgggtaatacggactatggactatggtaattaaaagcaccttgtgttcttcacgcaacacgtgttcatacttacatatgcagtcatttccaaaggtcaaaagtccagaactatgccgttgaaattcggtgcattccgcgggccagcagagcacacacacaactcaactccgccatgcttgctggctgcggatcagatagccaagttgcaagcccagattgactactgcgatagtttcttgcataggtcagcttttcacacggcttttgtcttggcgtcggcatggttcacaagttctctggaagaagaagaagaagaagcagatgcttcctgcttctgctgctgctgcagctttcagatagatagattccagatggtccggtcagcaaatgccaaagtcgcaggccccggtgagaaaatgttgatagctgggttttgttcagagtagctagctgttgttcggacttcagactttcagaatctgtgaagagagttgtgattcttccacggaataagttcactttaggtgtcgtaggctgtatttagtttctggaattgaagagaagtttgggaaaagttgatagtttagaaaaaaaagttagaagtttatgtgtgtaggaaagttttggatgtgatatgatgtgatggaaagttgggagttggggagaagtttggtgtgaactaaacacacccttaatttattgcctaatttaattttcgtccttgatccgaaaatccagatacaaccatccctcaatttataaaaccgtgcaaacgagatccctcgataatattgtctccagttttggctaacgtggtgtctttgattagatctttgtccaacatagcattgatgtcattgatgtaacgtttacatggcagtttgatccaaaaaaagaacaaaattaaaaactaaaagaataaaacaaaatatgtgggatccgtcgttagccaaaaaaaaaatagtgggacccaaatgtcttccaatactcttcacctctcgattttgctatatatttgtcgacaaattttctcccaaaaattttacagatgtaattacagtacaatcgtagtgtaattacactgtaacttgtatgtaattacactgtaactatagtgtaacttgtatgtaacttt

SEQ ID NO: 71239 - DNA, 1958 bp, Oryza sativa
cgatcgggcggtagccggccgggaggcaggcaggcaggccagcgcccgcggcgccgcgattcgtgcgctgcgttgtggccttgtgggtgagcgaactgtttccttcgaggtgagagcagtacatccgcccaaatatgaaaaacaaatttggattggaacgaaacgtcgtctagtacaacgaatctccatacgtacaaacgaacactcatccttataaatacacagttacactttacctctgtaagtatattcgaaagattggatcggcgtatcttgagattgacgaaatcaccacagacgtcttgctgtcgataggtacatctcctatcactaaaaaaaatagccgtaaatgagagcacacatatcgtgtctagcacataaaatctgggtggactgattcgaccacaaggaacctaaccatgttaaaatttgataagacaacaaactaatggcttgttcactttgctaccattttcaacattaccaagttttggcattgccaaattttggtaaggttggcattgccaaattttggtaaggttatcaaaattttggcaaggttgtcaaattttgacaagatttcatatgtacttactgaaatttggcaataaattaaatatagccactttttggtaactttgccaaaaaaaaaaaggtatggttgaaaatagtagcaaagtgaaccagccgtaaacatgctattgtcgatacaaacttactaaattttggtaattctggaactttccactcttagggtatgtttggggggagtttctagcagctacagcttcttctagaatcttcagttgctagaagctcccccaaacaatccagctttttatccaaattctaagaatgtaaaatttagaaaataaactagaagctagaagctgagtttcccagcttctccagattctcaccggctagcttcttctcaaaatcttaagctactccaaaaagacccttaaatgttttaccaaacttttgtaagaacacaaactaaacattctcattcacatcttaccttattaaagattgataatgtcaaataaatagcattatcaaaatataattgttttttaataaagtgggtgtggagattatggataccccatacctacacggcatgtataggccgactgggcgtggggtgccatgtatagatagaatatctttagagagattcgggttaaattctaaacttgtatgtcaaggaaatacccgagatcctagtcggttacgattgtattttatgctgtcactacttattccgttaaggatatggactgtattttgtaatacggatcccatctcccatataaggaggggtccgggtgccttgaggggcacgattttcttcagatcatacgatcaataatcactcggcggatcaatccccggataggagtagggtattacttcttgattaagaaggcctgaacctgtataaaattccatgtctctaaacccatccacttttccagcttgatagccacccccttttagtattgccgaaatcttgtttcgacagttggcacgccaggtaggggtagcgtcaagttcttcgccgactagtgagatgggtttcgtttccggcatcaacgacttcgtcttccctcctgggcaggcgtcccggttcggcagcctcgacttcatcaccaacgacttcggcaagatttctctcctcgactcggattcgaaccagtcgggaagaggccagatctccgccccgttcggtatcccgaactcggccgaggtctaccccaagatcatctccaccgagttggcttcaaaccactcggacaagatccaatctacttcaacacgacccgatcaagatgatggggcctattcgccaatcctgatgaaactccccgatgatttggctgctgtcttcaccacaagggcatcttctcctcgcaagcctgggcggaatccggcttcagccccggcccagc

SEQ ID NO: 71240 - DNA, 949 bp, Oryza sativa
agaaaagcttggcgcacacggaagagtgcgagagctcaaaagatccctcgcagagtcccctacctggcgcgccagatgacggagcgtggggctcctcaccgggagaccgcgcaggcccccctttgccggttcggccggggaccctgggtgagactctaagctcccaatctgtggaaggttcgcgagacaggaaacacacaagacgccggcgatgtatacagattcgggccgctgagaagcgtaataccctactcctgtgttttaggggatctgtgtataaaggagctacaaagtatgagccagcctctcccttgttctgggttcccaatctggaaaagtcccgtcctcccctctaagtgggcaaggtcctccttttatatcttaaggggatatcacatgcaccatttccctcttatgtgtggggacttaccctaccttttcataaatggacggagatttgtatagttgccgtccgagtcaccttctgatgggacggctacctccactttcgttgggagcagatgcgacgtggaatcgtggctgtctactgacgacatgaccggtgtcagaccagtcacgtcggtcattcttgtccaccacgtgtcagcttagcaatctacatgttcgcccttcttcacacaacatcttgcctgtaatggttaggatgaaacctggcatatatctgaccaggactaacgtgccatctctgggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaatgagtgcactgtactgcgttacatgcggcgtaacacgctcagccaaaccgcaataaatgtggttaggtgagccccactgtgctcacctaacccataca

SEQ ID NO: 71241 - DNA, 2771 bp, Oryza sativa
gtggcagaatacgaggcgcttcttcacggactaaggattgcaatctctttgggaattcggcgtttgatagttcgtggagattctcagttgattgttagtcaagttatgaaagagtggtcctaccttgattgtcacgactggaaataacccaacgggcgttccttacgtgcgtgtattattccttgtcccaggaggcaaggtacaccaaaagttgatacaatacagagtttaacaagcggaagcgtaaatagttaatttattacatgggcggcgaaggcccagcacacatgaagacaaacgaaaaacaacggaagactagggcgatgaccacaggcgcttgacggcaggcacgagctagacaccaaagccttcatcttccaggaactcctcttctgggtttgggaaaaattgagcaagactgagtacagccaccgtaatcaacaagacgcacccacaagtgcagaataaatgcaagggggtacaagggagttatattatagggggttagggtttgcagtaaacagcattaaaagacacttagttgctcaaagttacttttaaaaacacgatcctagagctatacaatattattaaataaggtcgtgaacccatacgaacctgccttacccaagccctacgatgattcagaccgaactggcaacccgaccctgggtcccagcttgtcccaagccaacccaggccaaccattccacattttagttgttaagcaggtttttaagaatttaaaacactaacttgggtacattgctaggcttgcctataaccgagggcgcggctattcgaataggttatactctaatcagaggtgtacatccttacccacaagacacatcttcctcacgtgtaaccacgtgccacataccaccacggtatacggacaaaagacgtgacatagttcccaacccatcatagccatagacaagagtaccgacccagccccacctacggccggaacctccgggacaggtaggcaggactgagcccctagcagcaggacaccagccctgtgccatgacatctcgactaccgggccacagctcgtgtagccttcatttgtcctagagatgtccatcgacccccgacttcgtccatctccatccgtgtacttttgtttataaccagactgagccacaaactaagccttacccactagacatgtggaagcacggtagtgctttgcaacagaggcccgaagaccggtccttatgtgggcgaggtgctactatcaaaaccatgcaccccgagcccaacctaaaaccattttgatggttttgaatagagggggaggtgtgaatccaattccacaataatctaaccattccacaatgtccaagtgatatgaatattcccaaagtctagagttataaaaccacctaatgttgcctaattaaacagcgaagcatctacctaaattcatactagtggtaccatgaatagagtacccactagttggggttttgtttattctagggtgaacaaggtaataataacaataacaataataataaggtcataacaaaggtaaataggcatggctaaataaaacagtgataacgcgagaatttaaataaagcgataatgcattaatttaaatcaaaataattttataaactgggattcaatatgttcaaggatgatgtgacttgccttgctcgctttcccaaacgtcggcttcaacctccacgtatagcggatcttccggagctgcagcgtctacacgaccaatggaaaggaaaaagtcttttactctaataaactccatataacaagcaggaacaaagcacaaaaatgggttcttgacttcttgaggaaaaattagagacttgaacggtccaattccgagttcaaatggccaagttatggccatttgaagtttatatgctctttaagtgaatatttgcgaatttcttcatttaaattttaatttaaaatggatttattgcgtcagccgaggggagggggcgcgtggaccgggtccacgggagtggggcccacgcggcagcctcacggtccacggtggaccgggcacacccgggctcacaccggccggcgccgtgggccccacgcgtcagccgcacccgagggcgcgggtggctgacggctgggccccacgtggcggccacgacggtgcagccggcgggaggcggcgcccgcgcccctatggttgccggcggcggccataggcacggcggagcggcggccgagagaggggaagggaagggggaaaagaggcggcggtccacggctcaccccgagtcgacggcgacgacaaaggaggcggccggagcggaggaaggcggcggcgcggctcgggtggatggggacgacggcgctctggcggtcggcgagctcggcgaggtggtggacggggtcggcggcgatgcggagaagccgaagaaggcgacgccgaggcgggagacggtcccggcgagcggagagggccggccggaggtcgtcggcgacggaggagagagagggcgacggcgcgagctcgattccggcgggaagacggtgcggcaagtggcggaaacgggtgagggaggcgcggggagggtttaaatagggttgggagggagagagggcggccggcgggggaggaaaccggcgcgggaggtccggccgccatcaatggcgccggcgagatttgcgggagcaaatccgtccgtttgaatgcgagaaagagagggagaaatgggggtaaagggggaggggatcacggggaataattccccccacttaattgctcgcgg

SEQ ID NO: 71242 - DNA, 28503 bp, Oryza sativa
tggtgatgcttattctctccgttccaaaacaaattcaatcctcggtgtgaatcgcgcccagattcaaactgaggattggattttttttttttgacagaaggagtacgtagttgctctcgccaagccaagcagcacgcaaccactagctaaataccagtagagaatttttattttaaaaacattttttattccaaaaaagaaccctaaaaacctatttccaaacctattttcaagtgtgacgaaacaacaccatcactcccaccgcatatagtgggcggccacactctaactagcatgaaaaacctcgtcatgcgagtcgtgataaaaaagttcagatttggatataatttgtataggagagttcagttttgaaaataaaaagttccaaaaaaaaattcagattgctttgtgccaacagcttttggccgtacaggggcagtcagtggcgcgtacgatcagtgggtttgggtggcagcgcagcttagctttccctgacgtacccgatcggtttgacttgaaatggtaggcataccgcatacgcatagccattacgtagtacacgtcgtcctaaattgcaatctcatatgcacatgtactgatgtaattacgctaattaaccaggagctacaccctccatctcgtattataagttgtttgatttttttctaatcaaaccttctccaaatttgaccaaatttatagaaaaatataatagtatttttaacataaaataaacaaattatcaaaatatattcaatgttagatttaataaagctaactagatattttagatgtgctatttttttctataaactgatcaaacttgataaattttgactggtaataaagtcaaagctactcactctatcctaaaatatagcagattcatcctataactataaaaattcgtagtaaaatatatctaattccatcctaaattgttacacagtgggacggagaaagtagctagctattgaatcggaaatctctccattcaaccgagatacttggtgctatgtttatatgcgttttgtccccatccaatcgatcgatattttgtgtttcaaaagggcgtggaatgtggatatatagatatgtatgtcactgtagcctagctagcaaaaatcctgctctccataccgtcgacagagaaggggcatcgcgtcccatttgtactcgctatgtctgcttcatctttttactagctctagctccctccttcaattcggtgtcaacactcaacatgcatgccgacagtatgcaaaattacgcccttgtttagttccaaaattttttttcaaactttcaacttttttatcacatcaaaacttttctacacacataaacttctaatttttctgtcatatcattctaatttcaactaaacttctaattttagcgtgaactaaacacaccctcagtgacttcacaattaaaaataaaactgaaactacacgttacttcacactgcctttcgaatatatacattgtcactatatagacactgttcatttttagattttgaccgctcatgttttgtaagaagatcatgtaaatacttaagttaaaagttataagtattgaaactttcacaaaacataatgtatcaattcaaacaaaaaaaaagaagtgttgcaattttaaatctatagtcctttaattaaaagaccccaatgatgatggtgagtgatgaatctcgtcaccatccttcatcatggtcacgtgggatccccaaacagtgatgtaggtaaactttggttccttttccaactccaagtcattagagagaattttcttttgaagtgaggaaaaatgatgacaaataatatgaaccggagattttacaatgacaataattttaattttttagcctttaaagtgtacgacaggtttttcttttttaattgccattgcaatgcacggacatttagttagtgactgaaaaattataaaacaaaaaattacgcgcctaaaatttactccacattgccaatgtgagaaggagtgtttttcatatttcatcgtcaccctttccccaaaaattatcatctgtagattaatcctcagggtcaacaattcaatttatgatgctgctatatctttgagctttgagggcatattagaatattaataaaactgttgcttcgtatctaatcataaatcttatatataaatatttcattttggaaagccttaaattcataaatggtatttagtaaatgtgcactagaaaaatatatagttgtgcataatcgtcctaatagaatactatctccatcctaaaatagttttatttttagcccatcctacatatactacaaaatttaaaagaccgaaatacccttcactcaaacaaatcccaatacatttatcccattttatcaagtaccaatatatttgtccacaacttttatcatgtctcaatgcatttgtcttaactttatcaaaccccaatatatttgtacacaaatttataatgtcttagtgcatttgtcctaactttatcaaatctgaatacgatgtttttgtaggacaaatgagtggaggaaagatgaaattattttgggatggagggagtaatagttacagtcatattatcgatcgtctgcatatataatcatttttacttcttttttttccttttgaagaaatgcgcaaaccattatttcatcaacaagaattttatataaattgatttaatttcccatgggaactgataaaacgaaaattcctgtgttcaaagttgaggtgggaaaactacaaccaagcatggatgtttttccctcatggtacctcttccttggtacgtcatggaaaatttcctaagcaagagtttgaaaggaggagaaacataatgcctaacttgctctaacatgctccccttgtttcctcccccttggactttgaggtttgaacaactccatcccatcctatactaatataatgcaatgctaatactagcactagtagtactatataactaagcttaacaaccatccctttttttaatttctattgtcacacatatatccttttatactactcctctgtccctcctctccctaacccatatatctccacccctcttctcccctcactcaccatttgctctcttctctcttctctcttctccacatcaccacagccacaccacactagctagtgttcatcatcatcatcatcatcatcatcatcttcttcttcttcttcttcttcttcctcgcttcgttttgctagctcgatcgtgtctagctggtcgtcgtcgtcgtcgtcgtcttcgccatggccggctgtttgcagacgagaagcaggaggaggaggaggcggccatggtggtggctggtggtagcggcgctgctgctgctgctgctgcaggcgtcgagctgcgaggcgacgcgaggcatgcagccgttcaaggggaggccgctggagagaggcgtctccaacaacttcttcgggttcttgccccgtggccccgcgccgccgtccggcccgtcccggcagcacaacgccattggagccgaggaccaaggcaacccatgaattcgatacatgtagagagagagagagagagagagagagagagagagagagagagagagagagagagagagagagagatcagagttgcatagatatcatcgaaattaatcttcttggttaattaattgtagctagcactagcagtagcacatgtagtagtagtagtagtacgtagcagtagcagtatatacacttcggcaagaagaagaagaagaagaagaagccgcaggtatagtacagtaggatcaaggatgatgtacatgaagaagcttttttttcttttccttttttttgggtagggctctctgtcaaatgtgttggctgttcatggcattctcttctcttttggaaaaaaaaaacacaaacactgggtgctctgaattttgttcagtcttttggtggtctgaatttcgttggagttatttcatatctttactccactctttggctttgctgccatcccttttcggtgcagagctaggtgtgctgctgtgtgtgtttgatgcctctgctgcaatcactccttttctttctcctttcctgcttttctaaaagctagaagagatcgagtacgagtgtacaacaactacagctatagctgcacacatcagttacgtacatcatgcagctactgcttggctttctgatgatctgcatgcgtagttccgctgctgcttcttctccatgcatgcaagatctgaaatctgatcgatgcgagaacagaggactagactactagagaagagacacagagagagagagagagagagtttgtgtgtctgaaaatgaggcttttttgcagcatgcagatggtttgatgatggatttggttgttgaaaaaaatgtcgaagaagagagtttgggaagggtgtctaaccattgatgtagtactttttgactgccggaccctccttctcttttcttcattccttttgtgtacctccatcttttaatcgccataatttaatccactattgtgttacgtactcatgatctgcatctaggaaaagaaagaattactattaggcattaaggtgtagaactacatgaaaaaagaagtgattttgcgtaacatttgtgatgcaagacacatacagatacagtgtgtatactgctgtttctatggatgctgtctcagtaatcttcaagtttaatttcttcatcgttgtcaagcatcttccggtttatttggtggtaataatggcgattatttgcaacccaagagcctatcagagtagatgctgatgcatgtagtcagattgcattcacatacatacaggctagtactccaatgtaatcttggtcagtcattgactactgctatcacgttgaatccaatccaagattgattatgttagtcgcagtagtgttaggcttccatggaaaaaaatgtgttcagtattcagttcagtaatctgccttgttttcaacgttttctttttgacaattcttgcacgtcattttagagattgagatggagaagaaaaaaacaattaggcagagaaatcacggcggccggccgctacctctcagcagctgaatggacagatcagataagaaaaggggcttcagtgtcaacagcgaaagttcagtgtttgcaatctcgaccaaaagcgacaaccatgtactaaccctttttttagataatggaagtggtaactaaccatgtagtacttactaactaacaacttaattccttttctggactgctaattaagctagtcctaatctagtcttgatcactcttgctacagatactaaatactactaaacgagatgcatgcatgcacgaaaggttcaatcagcttcttgcgcagagcgagagagagagggagagttctgagagtttttgcttgcgaagctagatgaaccaaaggaccattctttatgtcttttgcaagtgatgtgacaagaggatgatattgcatcaatgtgtgtgttctcaaatgggccccttgttttgcgtcctccttttcttcgacgatgacttgctgccaactgcacaattctctctctctgaatctctgaatgtttggttcgtcaggaaacagaaaagcaaggggcggtaggccatgaagcaatccaaaccggcacgcccggttgacttgattgcctgcacagtgaacgtaccacgcactcctgatcaaattactactgtcttggtcatcgggtcgatctgtgatctgacgggcaaggcaaaagtctttgcaagagagtggttgcgaagttggtgaatgagattgtgtgtcgaattgtatctctcttctgaactctctgaagtttcgtttttctcttctcctggtgtaggaagcaacatgttgggattttcttttaagaactgacgacaggagttccaccggatatttaagaagaaaagagtgttgggattgggattgatatgtaggagtattatttttcagtcagattgtgtaaacatgtccgggcttctgatcgtacttacgtacgattctgatatcgaagcttgcttgcaaattgcaatgatgcaatcacaacaatcactatgcttgattgttactagtaagagtaaaaggaaattgattcttaagatcaagagtgatatactagtttgatcactctttcatgttcaggtctattttcgaaagaaacagtctactgtggcaaaagttatgagcacaatgtaggatcaaattacaataactaagccaaccagaggggggtgaatggttggtatacccgaaaaccgaaaacttttagcggaaataaaagttatcctcgaattcgatggatcgcggtctgaccgaagttgtcctgccggtctgaccgcctggttgtcgtcggtctgaccggtgtagatcgattggtccgaccgccaaagtcgcctgcctgtgcctgtcgccgctgccggtctgaccgccgtgtacccgccggtctgaccgccgcgattccgctggtctgaccgccggtgtgtcgccggttagaccgccgaaacccggtgaaacacaaatcgacgaactctcaaagtagatgacgactttattgattctctctgtgtttacaaagtgcaccaacagcactccttacaaaaatttcgactaaactcgaaaccctaactcaactctcaactcaattgctctcaaaagcgataccaggaagcttcacgctccccctctatttatacccgaggtaggcagcctaaagcacgaaccaaactcatattagaagtcctaaacaccttaggaaaccctctagtacaagaaacaaactttacaaaactaataataccaaatttgtactccttccaaattcgactccgcatcccatacgcacacaatacctccatcgtatgccatatatggaatcttcaccaaccacatgcatcaactctagcctaagtatcccgcatgatctctgaccaccacggacgtcgtcttatccccaagccgactcccggtccatcaccgtaaatactctcccgaggcatcgagtcacctacacatgaaataaacaaggaaaccatattccgagaccaagctatctccaacttgactcattagtagcaaacaacaatattacatacgtatagtatccatctagaagccataatcatgaaacaatcacggatatccaaacaaacaacccgaaaccaaaaccgacacagagtcggccagtcagaccgtgggctgcaccggtctaaccgcgcgatacacgccggtctgaccggcaacgactgcccggtctgaccggtcacataaaataacagcacctgtaatttacctgtaaatccaatcatctccaaaaccacttcgtgaataaattccaaatatcaaaaccaataatctccgatgccaattgttcatcacagaataataataaaaagcacctttgattttacacacaacgccgctaaatatatcttttaggagagctattgttggccaaaagctaatcgagtggaacgatttgatcctcgggctaatataactctgtcaaatgaaaagaatagctttgtatggtcgctccataagaatggtcaattttccatcaaatctatgtatgccacgatcatgaactgtaatgttcggatcaaaaagagaattctgtgggacttgaaaattccactaaagatcaaggtctttatgtggtttcttcataagaaagtaattctaacgaaagataataacctggctaaaagaaaatttggggagagggggagggggacaaacattgttctttctgctatgcacaagagacaatccaacatcttttctttgagtgtcatgtcactcagtttgtttggagatgtgtgttttttgcttttaatatcccccaccccgtaacgccaaaaacattttcggtaattggcttagagggatatctaggtccattaaaaagatgattctaattggagctagtgctatatgttggttaatttggtgttgtcgtaatgataaagtttttaatggtaaacaattatctaaccttatacaggttatcttcatatcttcctactagctccacttttggtttacgatgctaccacaggaagagcaggatactatgcgcaatggtgctatactcttggaatcggtagctaagggtctcttgttccactatgggtggcgtagttctattagaattgctagctaaaaaaattttatgtggtttaacgctagtcaataataaaggggagttggagatttgtcccatcaccttatttctcattttgatttacttttaccttacctttttattactattaaacttatggctgtacttatggctgtgtgtcttatgacagaaagccagagatgtaatccattttcattattaaaaaaaaatgttcaggtctattttttctacctagccaaaccgttgcagaaattctggtactgtatatacgcacttgtaaatagtacaagtagtaggagtaagcagctatgagcaagaaggcgacaagatgcaggcgaaaaggccgacacacgagtacgatcgatccctgctcgatcgaatccgacagatcgtaattgcagcaccctgcctgcctgctgccaaaatctagcaaggactccatctgttaccagcagcgaatgttttttcacgaacacacataaagattgaacgcagtggcgtatctagaaaattgattcgttggtgtcataatgtatctactagtgtcatagtatgctaattatgcttagatcatggtgctataatatatgaataagtagtttaactataggttttgccaaaactcgtcagtgtcacctgattccagccgttacactgtatatccaaccctgattgaacgtcagtatataaaaagaaatagagttttagttagtagcaacaaatgttttttccatcgtttaacaaattgttaggagcatcgctcgactaacaaaggaaaaggatttgaattcttaggatgaaattcctctgaaatcatttggaagagaggactgatgcatgaaaatcctacgaaatgaactaatttatatagagatttgaaggaaaacatacatgaggtcctactcctacctcttggtggtattctattctcgtgtctacaattacttcgttttccctgtgtatcacccaaatgactatttttaagaacattcccatgtttctaatttcccgagaaattcacaagatatgatatattaaacctacgtttcttgtgcttatgttttttgaaatcatgtgttgcaaaggagccgtcagttcctgtcaaaaatgaaaggctgcctaccaagcacgaacactgcagttgggccttccacacgatcggtacgaaatgaggacggccgcacgtgcataaaaagaaaaacaaaaaagaggagaaaaacaataaactaaacaaatttactctctcccaattctaccttcctttcccggttcagctgtttctcttcgttaattttctgcctcgaatctatctcagctctattctcaaaccatatatatccaatgaagattgtgatcctctaccgttgctgctcgttatacagtagcgttgaacgtcattgtgtattagctagtagttccttctttttatattataagatgttttgattttttttctacttaaatttttctaagtttaactaaatttatagtgtggagtgccttaaccccgttatagagttgatggcgaacagtcatgtataacggttggctcgatgttagtttatgtcctctaataggtgtgtaggagtcgtcagggtgtggaggtgcgattttttcacttttcctgattatagttttctaggctgtaattttatagttttttctatattaatataaaatctcacatcatctggtgtagttagtttcaaaaaaaaatattgcgcattagctagtagcgttttctatcgcttgatctaaaatgaatggtctaaataaatgtgctacaatgttcctacaacccagaataaaacagcacatcgtggctgcagtagcctagtattgtactatgtactactccctctgtctcaagttatagggcatctcttttttaaaaaaaattaaacttggtaacttttaactaataatcatactaactatgtatatatactaagtattatgcatattatatcccttgattcatactatatatatactaagtatgatgctaattttaaatttttaagaacataatatgaaataaattaaagtcaaaatcaataacaccgtgtaaaaaaatatataggcattataatttgagacggagtgagtaataatcactacgggtaactcattatattgttatcgcagtggtaatttggcaattattttactccgacaaagctgactatagaatttttcaagtcataaaaatcgtggctaggatgaatatagtgacacacaatagccgagctgaaaaaatctactttctccttttcacaatgtaagtcattctagcatttcccatatttatattaatgctaataaatctagatagatatatatgtttagattcattaacatcaatatgaatatgagaaatgctagaatgacttacattgtgaaacggagtgagtatttcaaaactatacctacatgtttatgaatattttgataggtaattagccatcccacgcaatgcatatgatttgataactgaaaatccatcacctccaccaccgctagttaggccggcagcttggcgacttccactaataaatgtaagaataaaacactacagaaagctttgtcatctcgtaattaacctccttttctagcattttgtcggaataaactactggggtgtcacctatccaacgggtgacaccgaactggggtgtctcctatactggggtgtctctctttggagtatacgacatctatcctgataatgaactgctgctagggcaacatgggctcgtggacaacatctgttcccacaagatttataagttgatgtcctaaattgcacaaagttcattcattgacagtgcaatttacataaatcatttcttccacttgaaacctaattatgtgctttgtgctattccgtccatgcccatttctggagcttcaaaaacctgatttcaaaattaatgtacatgtttacactacgtcagaactattcacctctgacagcccagcagtgatgggccaaagtactcatcaaggatagccttacctttgataggttcatcgggagaccgtatcaggtgaggccaccggccgcggcccgtttaaaacactttgggacccctagcatctcgtattctatcgtttttttataacttaaggcagttttgaacaacatatcataaaaattggttactacgccttgcatctactcaataattgctactttgtatctttcaattgttttatcccttttttaaatggcagctcatcgttcttctttaaaaggcatatgctacaagtaatttgggtaagtttacagcttcatgtgcaatgcaagaaattgggtaagtttgtggcttcacaagctcaaaagaaatgtgaggtaagaatgtgcattgggaatatgtgactgtctatgtaatttttatgggattttagaatgcatgtgtagaatgttaattttgggatgcatctgtgataaattgtaaaaatatgtgatattgggtgtggttggaatatctgtaatgtactgttttttagagagcatgcctaccaaatactgaggctagcaaatatttagaaattattttttttccgaaattacctcatcactaaaggtcgtaaataaagaccgtcacaagtaacctcggttgtgacggttttggtatatcactccgttagaggtgggtaacttgtgacaggcgccaaagtagattcgtcagagatggggtcatctctaacgggccgtgaattttgcacccatcacaggtgtctcagctctaacgggttacaaccacatattgatttgtggagatcctcacttttgacgagccaaaaatatacgggcccattagaggtgtctgtcgccattaacggggtgagtgtagtcatcagtaacaattcatctctaatcagggtcaaacccatcaaagatgatggtgcgcgagtccgtcaaaggtgatctaatccggcgtagtgttatgaattttaagagagttagggcatcccaaacaataagggtgtataactgaaaatccacccccatcaactcgttatgccggcaaggaggcaacttggtgacattccacttccatgtcgttgtcggaacatttcaaacgtttgtgccagcaaattagcgacatcttcaccggcatctatcacgatcagtttgtccgacgaccagcaccgcggtgacagccaagatttacggtctgatattatatatcgatatgtgcactgattaattagcttccatgaacattcatgagctccatgattaggcatcgtcctcctctctacagaaaaccgagcaggaataacgtttcaacatgaactactctactatatgcagaataagagagctagctaggtcgaggacctaattcttttctgattaattaagatataaatttttacctcatttttattatcacattttttaaacagctaaccggtatatttcgtacatatattttaatatagaagatgttataaaatatagagtaaatttcacaaaactacatatattctgatcaaattatcacaaaactacagatgtaaagtgatgtatcataaaactacagatttagcactaaatttatcacaaaactacagatttaagatggagtatcgcaaaactacaaatttaataacaaaattacagattttagagtttaaatccttagcattagtgttatgtttgagttataaacgtgcaagttttgtgattaaattatcactaaacctatagttttgtgataattttattactaagtatatagttttacgatattctaccttaaatttgtagttttgtgagaaatttagtgttaaatctgtagttttgtgatatatcaccctaaatctgtagtttgtgataatttggtcaaagtatctgtagttttgtgaagtttactctaaaatatgaagtaaatctaatttttagagtttgaaataattaaagtttaataaaccatggagaaacaccaggggtgttccggctaactccacaaagtggtaggctaggcgacctgggttcgaagcctcaccccttctaattattgatattaggttttttcctaacattcacgtcttatttgtaggatcgaatcacaataactaagccaaccagagaggggtgaatggttggtatacccaaaaaccaaaaacttttagcggaaataaaacttaccctcaaattcgacggagatcggtctgaccgagattgatctgccggtctgaccgtgtggatgccgtcggtctgaccgatatagatcaatcggtccgatcgccgaagtctcctgccgcgcctgttgccgtcgccggtctgaccgcctcgctcccgccggtctgaccgtcgccttgtaaggtgtttagaacttttagtatgagtttggttcgtgactttaggctgcctacctcgggtataaatagagggggagcatgaggcttcccggtatcgctttggagagcaattgagttgagttttaagttagggtttcgagtttagtcgaaatttttgtaaggagtgttgttggtgcactttgtaaacacagagagaatcaataaagtcgtcatctactactctaagagttcttcgatttatgttttaccgggctttagcggtctaaccaacgactcaccgatggtaagaccggcggcaagctaggaaaccctctagtacaagaaacaaactttacataaccaatcatactaaatttggactccttccaaattcgacttcgcatcccatacgcacacaatacctccatcgtatgccatatggaatctccatcaaccacgtgcatcaactctagcctaagtatcccgcatgatctagaacgtgtattttaagtgtgcattgacacatctagaacaagtggttcaagtggtaagacacattcctactcctagctaagtgtgggttcaaatcccatatgctgcagataaaaacccatgctcaccgtatttttttagtttgccatattctgcatcatatacatgtaacatattaacaaaattattttattcaaattgaacaaatcgtcttttgggtttgattcttcttgcaatcacattttttatttttctttgcactaaatatgtttattttttattgtttttaacatattaacaaaattattttgttcaaatttaacaaattgtcttatgggtttgattcttgttgcaatcacatttttcatttttctttgcactaaatatgttttatttttttattgttttgggcaaactagcgtatgatgaatttaaaatcatacattgtgacagtcgtgataaaaatgtcacgagttagcgggctgtgaatatccactgggctcatctgtgacgaaaaacaaaatatcgtcacggtgtatgtttgtcagtgatgatatgtaaatccgtcaccgagaatccgtcacggattaacaagtttcttgtagttaggaaaccctctagtacaagaaacaaattttacataaccaatcatactaaatttggactccttcaaaattcgactccgcatcccatacgcacacaatacctccatcgtatgccatatggaatctccatcaaccacgtgcatcaactctagcctaagtatcccgcatgatctctgaccaccacggacgtcgtcttatccccgagccgactcccggtccatcaccgcaaatactctcccgaggcatcgagtcacctacacatgaaataaacaaagaaaccatattccgagaccaagctatctccaacttgactcattagtagcaaacaacagtattacatacgtatagtatccatctaaaagccataatcatgaaataatcacggatatccaaacaaacaacccgaaaccgaaaccgacacagcgtcggccggtcagaccgcgggctgcgccggtctgaccgcgcgatacacgccggtctgaccggcaacacctgctcggtctgaccagacccaattccagcagtacctgtagattcacctgtgaaatccaatcatctccaaaaccacttcgtgaataaattccaaatatcaaaaccaataatctccgatgccaattgttcatcacagaataataatcaaaaacacatttgattttacattattaaccatgtgttttttctcgttttgtgtatgtcaacacttaatcttcatccgttatgttattgtcgaacggggctatagctagcaggaggaggaagggagtggtctatattgccatcaatcgatgctactatgttgcttaaaggcgaaataaagctcgatcgatcgattggcagctgtggacaacatgattgatcattctcttgtgtgcgacaacacaaaccaaaagctagctaattaaatcgatggacgagggacaaatcatacgtatatatatgctcgtgcatttgcgagagccttgtgaaactgttgtctacgatggatgtacgtgcagtgccagtgagttgacacttgatagagaattctcgatcgccctttccagggtctctgcatcatgcacgagactaattaaaataatggttcgatttactggaaataataaaggtagaatatacgtgtgtattaaaaaagatgagcatacatatatttatattatgagtgagtgtgtttgtactacaatatttctaagaaaaattaatcaccatacatgcacgctgaagcttctgaatctcagaacctgagaggagacggaggcgcatgtgaaaatttaaaattcatcaaactactaccgccatttttaatatatgaggttcgaaataaccaatatgacatatagaataacagagagaaattcacatccagacaccataacacatacggatatatggctctatcaaatctcacaagaaagtgtcatataactcataaattacattgctactcttatcaattgcatcataataatcgttctcaaaacaggtacttcctctgtttcatattatgttaatgaatataaatatatatgtgcgtctagatttattaacatctatataaatgtggacaatgttaaaaaatcttataacctgaaacctgaaatggaggtagtagtacaattccttcaaaggaatagtactcaatgaagaaaggaaagacgtctctaaaaatattttgaatatcacaatgaatattttaataataattctaatttttatatgctaaaacttcgtaaatggaaacgtagagagtactattatattttttctcttaaaatcatgagagtgctactatatatcggaagcaccaaagagggagaggataaacacggaataagttcgcttcgtgatccttaaatgtgatcgaaatctaatccatgaccctaaactacaaaaccggatatctcgacctccaaacttctaaaaccggtgcaatttgactccctcagtggttttggaggatggttttgctgacatggcgccacgtggcgcttacatggcgatattgaccgagtcttcgttccacgtggcacttacgtggcagcagaattaaaaaatatgtgtgggacccattagtcattcacacaaaaaaaaaaaatgtgggcccactgacatgtgggggccacatagcagtcctcttccttcttcctccttctctcccttctctctctttctctccccttctctcccatgctatgcataggcgctccgccctgtagctcacacaacggcgccaccgcttgcgcacggtcgcgacacgccactgcctcagcgcaggcgaccagcaactactgcccaagccgcatccggtcagctcctcctcctctgccaccgcagctgtcaccatcaaccagacaacatcgacggcggcctgcgtcggcggccatgatgggtcgatggctgatacatcaagctgaagccatcatggtggccttgcagacccttggagacgagctctacatgtctacctcattgccatcaaacgttgcctcgtcctggaggctgaggctctgcatctgttgcgcggcggcaacgtacgccggggaggtcggtgttgttgatgtggttggtgcggttgcaggagatgtgcggccaggcggcgttggggtcccatcccagatgaggagctcgccagccggacggcagcgccgcgcgcgaggaggaggttgccggccgtctgcatgctagggaggtagacgtcggccatccgcgcggggggaggagcggcacgcgcggacgcgcggaggccgccgctgctcgttctcatcgcccgccgcaggccaaaggggaagaaggggagagagagaagggagagagggaggaggaagaaggaagatgattgacatgtggaccccatatttcttttttatgaatgactaatgggtcccataaatatttttttaattctgctgccacgtaaatgccacgtcaacgtcacgtggaacgaagactcggtcaatatcgccacgtcagcaaaaccaccctccaaaaccatcgagggagtcaaattgcaccggtcttaggagtttgggggtcgagatatctggttttgtagtttagggtcatggatttcgatcacatttgagggttacgaagtgaacttattccggataaacacacacaccgacacacacgcagaaataagccgatcagcggcagatagggcaggtactagcaagtgttgccttttgaggcccacatgcacaagttcatgggtttcgtcgccatgttgttgcgttttaagcccattttgtaccttgatggcctttaactagtcgggccgagctagtgcatcattgttaaaaggaggaataagttcaccagcatccctcaactttacgttgagtttgtgtgacatccctaatcctcagtatcagaaatcttcacccctaaactatataaaaccgtgaaatttatgtcccatggtattatagatgtctggtttcgctgacgtggcattctagtcaacaaaaagaatagaaaaaaatatgtgtgcccacatgacagcggccctcttctttcttctcttttcttcccaagccacacggccagccggagagggtgggagaggcaaccgacgggagatgggcgaggggagaggcggtcggcgtgacattggcgatgggccatcgcatgggctactgctgcaggcggtgtgctggatctacggccggcggcgcctcctctactcccaagagcgggggtcgctgaatccgcacaccggcagcacccgccccctaagccgctgccgctcgcgagggcgggggagctggatctgtccgccccaaggccgcctccacctccacctcttccaccgtgaccggctgctacgagcacatacaaggtgatgtaggtggcgataagcggtggtgttggcaaagtagaggtcctggctcccaccggtgatggggatgaagacggcggcatttgagttgaggtggccacctgggacaggtacgactacgcaatcgaagagaatgtcgaggtcgaggtcatcgtgatagtcctcctcaccatcgtggttgttggggacgacgacgtcgtggctgcaggatccctcctcttggccgctgctggggatgtggcggtggctgttgtcgatgtagtgcccctcatcctgcgcaaacctgtcctccaccatgctgctggttggaagagtaccaaaaccagccgcagcaagggtctggtcgcgccggtgctgaccttggagcccgacctaagtccaaggtaggcttgccggctgcccctctcccgccggctaccgccctctccctcgaggctttggaagaaaagagaataaagaaaagggcgctgacatgtgagcctcacattgttttaatttcttttgctaactaggatgccacatcaacgaaaccagacatatatattgctatagcacctagattgtacggttttgtatagtttacgatgaagatttatggtattggaaataagggatgacaaacaaactcgatgtaaagtttaggaaccgcaggtgaacttattcctaaaagaaaaaaaattttgggcttcagttccaattgaccagctcacaccttccatgttttccgtcgacccacacggtttaaattaaattaagggactacctatatgggtgtcgttctataaattgttaactaaaaaacgctaaaaaactgtcgatgtaactaggatgtaacatcgtagttacactgtaactacacattctaagcagaagtacaatgtaattgtatatttggatatggttaaattcttatatttgagtaattgtatattcggatatggttaaattcttacatttgaattattatggtgttaaattaggtataaatatagattgtatgttgaaatagaagagaatgagaaacgagggctgagaaatgaacgcctttggtgccagcttgtaaagggtcataggtgccggtttttcatgcaacactaattcaacaatgcgtactggcaccaatgataaatttagaatcagcacctttatgttccaggagccttaaaaaaggccgactctcaaccagctcgaattgagtcgattcgttgaaccctcatgtccttaagatatcatatcccccaaaatgatgcctcagatccctgaaataaagatgaatacatgaacaaccatcaatattctatataggactttgtatatggtgagcccgcctagccataatacataagtataaggtatctcatatctagaacattgacacaatcaatcctttgttttaaaatgcttcataattatttcccatatataggatttaaatcctctacaacttttatgtttttctgttttgttctagaagggacctaagtagtagcatgccatgcatgggaccaactgaattactagtagaccaagaagaaacaaagcttctgtactcctttttgcctttgccacaaccacaaagacggccgttttcgtttttaggctgaccgaattggctttttggaagcttgatagggtttcagattgctagctagtgctgcatttagataggggagaagaaattgcagtgtgtagagtagtagtagataggaacaattgtactagtacatgttaaattggtcctagattgttcgtttttctccctggagtggtagggatgctgagattttgggggcatatgcttttggaatggctggaatggaagggatgaagtgtgtctgctagctgctgccacccatcttctctgctgtgatgtgaagacaaactaacaaaagggctaaaggcataaagattacggatatttaactaactaattaattaagtttattctttgtcaattactcacttcgttctaaaatataagaatttttgttatttaaattttgtgtcacaataagcattcaagcactggcatcttcattttgtgtgtgtgtggggggggggggggttgttatgcaaataataaaaaacatcttggtaaaataacgattttgtaggccatggtgctgaaaatatactgcatgcgacgatgtggcaaccaagcattttccataaatagccaattatgtacaatttaactgtgacaattaaatggggacggcctatacaactttagcaagaaaatcctctcccatctcaatctattttatcatccctcaaataaagattattcaacgggctagatcaactctcaaacactgatacacatatataaagagagaaaacctaatcctcttgttttcccacattccagtcacatcaccccaatccccgctgcccagccccttctatgcgcctccttcctcaacaccgatagccaacgccggcgatgccgggctccccaaaccgtcactaccgccacccaccaaaaccttttgtcgctccctggtgccggtatcctcttctctgtaatcaaccacccttctccacaaccacggtcatgaagcagctctctagtaaggttccccaacatcgtcgatctctcctacctccagcagctctcttactaccatctaaccagttggccaagatgcctctactgcttgcaccatcctccaccgactatgctgctttggcggcaccaccgctggcttgctaacgacaccccctccccccaacccgtattcaccactatcattgggatctttcccccttggccccaaccccaaccctaaccccggaagctaatgagtggatggagaagatcccatgctccataaattacaatattgctctaattttttttatcaaatgccaattagcaaaatctgatttaaatatgttactaccccttgtggttagaaaagtgaagccagaacaattgatctgtttttcaaggaaacaaacgtgtacatatatatatggaatcaagagtgtcttcagaaaattctttttccaaaactgtgtgcagaatgtattccctactatttaattgtacttcttctgcaatccatgttgtttggctactattaattggtccattcactgaagtagatgcttaatgcatttattgttagaataaatttctatggggggcattaacatattatggctattatgactagttgacctaaaaacaaagcgatcaactagagttgtattgagatctaagcatctaattaattatatggaagcgtacttttatatatgtgtagagaccggatattggtttcctattatgtgatgtgttagaatagaaatccagcaacttattggggcacacgcaccaatccactatgcctcgtcaatagtttaagaaattaggtgtgcctaatgttttggtgttattcaactcatgattatggctacagattttggcacgctttcgcatcttaactaacttataaggtggatttattatgacgttttagttcttcatgtaagatcctaggttgataattccgacatgcatggtgcacttagcatcagagccatcgtttaaggtatatttcgcggaataagagaaaggcatatttgcaaatgaaaagtaatttgtgaataaaatttttatatatgtgttcttagcgatctaaaagcaaaggctgaaacataaatttcgatgaaaaaaaaactcaaaatcagcttcaaatttaaggttgaaaaatttaaattttggctgataagtataagaaaaagataaggctgcatattagatggagcatggaacacatatttctcttgatataggtttgtgataaggttggaggtactctatattaactattgcaattaattagttatatttgttgccggaacgaaacatgtgtttgtacaagttaatattccaagctagtcgttcttttgttgcatgcacacataatcttgtttgacaaaatgaaaagagagatcgagacgaagtagcctcaaataaggaaaagaatttggcatttgcaagatcctgtgcatccatccattgtgcacttcaaatttaccgtgcgaattaaccgtacgtccaacacgaccctgaaactgtataacaactgtcaactattaccataataaattctcagatcaatcaacggtacatcgtatgtatgtacgactttacacggcataactctttgctagtagctatagtatacagcgtgcgtcactggagatggcgttttggagtgatctagcttaggccagaggctgtcaccgtggcagacatgaaacaaaatatatgactcacttttttattattttttctgggaaaataaacctcgatcactttggtcgccatcacgtacgtatacgctccgtatgtcatgccagccagaagttttcttgcttatgaaacatgcatgcatctttaaattttataataaatagcaaaaataccagtgcgttgcaacggataaaaataatttacatactccaattataatgactttcaagtttcaatgttagattgttagatcatatatatctggctcaaatcataattatattgatacatattgattgaatatggtgcttctgcatggggaagcgatgcagatgagaaaaaaacatgtcctaagcgcaccagctgcgttctcatgcatgcacgacgtattaccgagtcagaatcggatggctacattatcatgcacgaacgacacgtcgctttattgagtcagacgactcggactcggacgacgctttgccttgatatgccagtaaagcgcttgcggcagccccctctgctcgagccatattctaccctaatacgggcatggaatttttccactgcgttcccaaaagatgtataaattttccccaattagacccttgataagcatgtgagaattcgcaataacacatgagaagctgagatgacatagaagcgatgtaacatggacctgtgaacaagattgaggatggagattgatgagttaaaaaccggccaaatagagaaaagttttttaagaaaacaataaccacattgctctggtggctagatgagcgcagcatgtagtatgtaccctaggagaccggagtttgaatcccacacacacatgcatgtatccctgatttttgcatagtatatagtccacgtcaccggtagatggttttcccagtctttttcttgccggtagacagtttttttccggtccaacagtcgtatcgctactatatggtttttttagtccgatccgggttttatatgtgtttaactcggatgacggacgaaagctaaggtgagtatggaatcatcctcaatttttataataggtaaagattattattattattattattattattattattattattattatttggactgggcttcttttattattggagtcaacaagtaaccgtccatgcagatatgaggaggtcactgttggtgtcgtacatgtcgtccattccaattcttttatacactttaaatccgttactccctccgtcccgttttgtttgacgttgtagttcattttaaaaggagtctaaatgtttgacgctgcagtacaatcagaaaaaccgtttccatctttacccctctgttcgacggcgacagtcaccttcctcgccggagacggcgtggagaagcaggggatggcggcagcaggcgcgggacgacttcgggagcgccgccaacgacgacgctagcgtgaagagtggcagctgcgagatgagccgctccatgtccgccgcgtgctccaccaacgcgggacgcaccacgacgggaagcaccggcgcagcagaggaagacgccgacgacgcggcggagaaggccgacgagccccgggcggcggcgtggcggcacatgtggcagatgaagtagtggatggagacggacgccaccatctcgtcccatgtcctccacctccgtcgtcggccaccatcggcaccctcctctccggcgacggcggcggaatcacagccgaagacgacatcaattcctccggttcttgaatctcctcctctctcgctgcgttcttgcgttcttggtggtgaagaggaaggtgagctagcttagctgctgcacttgtctgtggcttataaataaggtttttggcatgattcatccagcacacagtggatgcccttgctcatctttgctgttgtcagggacagggaggaactgagaagttcagaaatgaaaaagggaaatgtaggttggttgtgagatgatgagttcttcagacctttgtttgcctgagaatggtagttgtctgctttgatgaagctgtaacctaaggtttcagcaaggagtgctactactgtcctgcgaattcacagtgaaatgctgaattcataagaactgtcataaattctgctaaggggacaaaaaaactgaagtaaattcaagatttaaaaatgaacagtactattacaaaatctgaatgtaggtctgaaagtcacatcctaattgctcttggattcttcctctccaacattatcacaaaatctgaatttcaacatgcacaaaatctgaccatattgtcacttttcaggcctattatcacctcacaaaatctgaccatattgtcactttttagtcctattatcacctcacagcaatgacgcacaaaatattgctctactaggagatgaagccaggaaggttcaagcagcccagcggcaaacatggtttctactgaaggattaattcagattttgtaaataaaatgaaactcaagaactgagtacactcaatacatactcttccagttgaactgcaactgaacaagtctgaagacactgtcagcctttctttgtctgtccgagcatatctgcccactgaaaattactgagccaaattcaacataagatgatctttgtctgtctgagcattatataactcacttgtttgcatagctcaggagttactgtcctgttgcattagatgatgaatgcacttcttctggcagatgatggtctgaatcttcttttcccagaagattggacgttgaaatttgataaactagtgtactactgcaaaagagagtttttctgagtgggcaatgaagggagtaaatcatcagaactgctatgaaatttcagccgaaaaactggcaatccaagagcagctctgaaaatactgtaaaaacacaaacttttaaagtaaaatctgaatattgtaaacacaactgattcattcttccttattcatctttagaaaaggagatttgaatgttctactgctcacctgcccggccgagtcaatctatagctatttcttgcacaggataagcacaatttggcagatgcagcagttgcagcgtgcctgaacctgataaatgataaggttttacagtgttcatagatcagtggcaaatggcaaatggctcaggtgatcgatcgatgccgttgtaggtgaaaaggagggcatgagatcttactacaagtgttgtaaaattttgtccaaagattctgctgggtctcaggcctggggtgcccaattatgagtagcggcgtcgggagagagcgccggcggctccggcaaagaggggtggcggcgacggttccagcgagtacgggtggcggcggcatcttggaggtgagccccggcggctgggcgtagcggccggcgtttccggcgttgggggtggcggcgtttccgcctctttcttccgtcgcgggctcgcggcggcgactcacgcgttgagaggagaaggcccagggcaaatatgtaatttcacacgttccttaattttcacgatctggtcggaaacgtcaaatataacgggacggagggagtactgtatacatgaaaaatataactctgaccatcgtcctatgttttaggccatcaaatgatctgagcttcacattatatatgctattgtgtgtgccccctccatttttctatatagtgttggttagtacaatattttgaaccaaaccaatgtcacatataaaagaatagagggaatatatactaattatttaacgaaaaacattattatgttagcggttaactcgcttgtttcccgttataacatgaaaatttattgttatatctattggagatggtaagaatattgtcttgcactcttggtggtacgtagagtgaaatcatatttggctgtttccttttattgtcctttatttataagatatggaatgatatctaacaattgtattgataaataggaataaaagttagaagaacaagaggtggagaaaaatatttgtgttggaaacaaaatagatcctagcttctttcttaatttttgccactttttgtttggtttgttggcggttcttttttgaagttgtgggaatttcagactttctaaactaagccttaaatatttcgaggttactaaccatgatgttgagtgaaactttatagatctatccgtttcagattaaaaaacaaaacggacatatataaaaataaatattatatgccgtaatcatattatggcccaattaaacaattcttaaaacgatagcccaggttgccttaatttgttgtccgtccagatgtattggtaaattatggcccaccaatctttagtatcaagatgtcgtacaagtcttgtccttcgctcaactatagccatgctcctatttaattttctagtatccgttatgctttgctcgcttctatcgaagcttctatttaattgtgcatccgtcatcgtgctaagcttagacctactcaaattagcttttttaaattttgtggcatatatccgcaatgcttcgctcagccctttctagacacctattaatttgctcccgcgcttttttgaaatggcaactttatatggctagtacacagagaactgtttttgcaccaaaattattgcaaaacaatgaaactagaagtatggtgatcatcctcagactatcaatttagaattgaatgctacgactacaacgtgattgtacggtaagaaatttcgatgaataatttcattgtctattctttagtttctgcatatatcggtgtcaacctatttcaatgtgtttgctctgaaaattttccaaccggtttttcccgttccacatctccaaatctgatgcttaattagatttgaaattccaatacacattttgaaggcaaatttttggtgaaccgacgatcgagaacgaccattattcctcggaatcactacgtacaggtacgttttgatagattggtttgcttcctggaacaagaaatatagtggctagctagctagctttttggatcgtttacgaaattctttgctttgccgatgattattgtgcatcgcgtgtggagggctccagccatacgaaaagccgggcccacatgccagcggcgaacagtgcaaaaaaaaaaattgcaaacaacatcccccatcacatcacatgtacagcagcaaagcatacggtcagtttgcatgcttatgcatgggaaagtccagaaaaagaccacctggtggaagggggataccggggcgtgcacgtccacgtggagggaggaggcgagtgccacctgtcagcggcggcaaaaccatggcggaattggcccacaggatatgcaataccgggcgtgcgtggggggcgagaggggcaccggacacgacgtatttaagcgtcggattcgtcggtctccttcttcttcttcagagtccacaccatttcagagttcagagttcagttcagttcgctgatcgacgccaagaaccctcccgaccaccgggaaaccgacctgagaattcttcttcttcttctagctgctgtttcttggctccggaagagaacgatcatgaatgcctcaggtgagcgatctgctgttggtttgagactttgagctaataagctgtggtgttagttcttcttctgcatcatttctgtctgaatttgttttgttttctttctttctttttttttttttggttctcctctcgcttcttgatgtgcttagcgatggatagagttgtgagatgatcgttgcatttttggtcgttcgaatggaacagtagtagtactctctgaacaattcagtctctttgataagaatttctgcttcttatgcttgctgtctgcgactctctatcttgcggtagaaaactaagtgaattc

SEQ ID NO: 71243 - DNA, 1896 bp, Oryza sativa
agcatcgcgggctaccggaatgtgacaccagcagcgagcccgacctggcgagggctgtggcggcgcagccggtgtccgtcaccgtcgacgctggcaacttcatgttccagctctacggcagcggtgtctacacagggccgtgcaccgccgtccgccgacgtcaaccacggcgtcatcgtggtgggctacggcgagtcccccaacactcccgccactgacggcccgcccttcccccgcgtcgtcggccgccgccgccagacctccccgtgaccccgtggcgctggagagaggagaggggagagatggggaaagaggaggtgtgagaatgctacccaccattttttaattcattcaaactgacatgtgggtcccatgagatttattatttttcggatcgaattgccacgtaagcgccacgtcaatgctacgtcagatgaagaccgagtcaaattagccacgtaagcgccacgtcagccaaaaccgccatccaaaccgtcgagggacctcatctgcactggttttgatagttgagggacctggttttcggttgaaggacgaaaatcggattcgttgacaagttaagggacctcagatgaacttattccatacgggtttggagtgtcgcgcccgtttaggctcgaggaaacgtggcatgggctttgcccttgcagagtgttgcagggccgcgtacgtgtgctcgtgggctgttttgcgggagggaactgaaataggccattgggccgagcgatggcacacggaacctggaccaggacaagctgtgaaaagcagagttgcgaaaactactcacaacattccaagatttaaatacttctatgatttaaacattgttcgacaataaaataatttttagcactatttacttatcatatcaatcgcttcccacttaaatttctacctatcttacctctcccaatcttaaccagtcctcatttatcgagggtacccaaaatctgttctcctcaacctggctataattgcttatatcagttgatacacgcgctttgctttaggatatgtggatgaatggatgtagatagatatatatgtttaaataatgtgaaaatattttggagataatgatttgacattgcttgcatattgtgttttaaaactacaataaaattgtaaataatatgtcatgtttgcatgatatttaaaaatactctagataataattgctagtaggtgatcatgttgcacacttacgtatgatttaaaatactttaaataataattgctagtgggtgatgatatagcacacttacatttgagctttaaaaattagtggacattaagtatatagatagttgaaacagaggaagtagaacacattccatctaatgctagtgttgtaagttcaagtgtcttaatttggtttcggtgattaatgacaaatctaattatatgagactaacgtttttatgagtctttctttgactagtcttatttggatatgaaagtaaaaatgatgggaggtatgtattaaacttcatatattctaacttggtctctcttgtggatccaaaatatagtgtgagctccctcattgatcttgattgattatgtgcatatgcattccttcatatccatatgtatgcacatcttgagagggagcttattctatattttgttcattataagatctctaccttgatttgaaattatctttcatctcatctctttgtattgtttatatcggattattatctatcacaaaagagaaaaaagattgaaagatcttggattaaacaatttgtgtaattgttactttggtgatagatgataaaccgatgtttatgggattaacctctcttttacataagttttcaacaaggttatttcccgataatgagatgtggtagatatgcattcttt

SEQ ID NO: 71244 - DNA, 788 bp, Oryza sativa
cgaccacacacacacacaaactcatgcgtgagcttgagccactcagaatgtcgtagatcagctgaagacgaagatgatgagatcatcggagctaattaagttaccttgacgacggcagccttgccgtccttcccggaggccgacggctgatcggccggattattcagcctcgacggctggccgccggccgccgccgccgccggcggccgcttggaagagccggcggcgatggcgagggcgttattggacggcgccgagttgatagccgccatggatgatgatcccttgggagaaggctcgccggcgtgcattggctgtgaagggaagatgttgagggtttctgcatccatgtagagatcagtaaagtagcgattcagaataatactgagaaacatatgtccaaaaatatatgcatgttgatgaactaaattgtccaaattaactatatgtaatgcatggcattaattaatatattaacacatatatcaaatggtgtaacagcatgtcaacatgcatgtggttgtaagttctgttgtttcacacttatggtcctaatgtaaattaaagtatgaaaaagtgaacaaaagggagagaatatatatgtgtgtgttcatgtttgatgtcctagatatgtaaatagctagctagctagcagtagtatatatacatatatatgcaaatcgttgttgcaaatgtctctggatgattaaggttaaaaatgcatatatctagcttgctttagcattacatatatgtgtatatacgataatcatcctagcaagaacgac

SEQ ID NO: 71245 - DNA, 7855 bp, Oryza sativa
ccttagtctccttcacattgagaacatggagatcatgaatgtatgtgtttttttgcttatcttcatcattactacactatgccttctctatgtgtataggataaacccccattggttcttctggacttatgcttacacttgtctctcttgtatatttctttgtatgcatatacttagggggagcaaatcctatacatttattgtgcatgttttagatccatgttgttcacctattatatatatcggtatctttgcacttgagcttgcatacgagtatatgacacttatgatgttaatgaatactcaacaaacatatccatatctttcatatgtaactggttggtcaccaagtggaggatgccaaccgatttgttgggactaatgttttcctttgagccgtgcaaaggaatagatctaattgcgatgaggctaatgaatgacaccatgggttaatggtcaccaagccaaggacatcgtcatgttggcaagaatgaagtcaagcttgtgatgagaataaagtcttgacaaatgatggcaaagacctcggcataaacatggttcaaccgaatggtcacaagtgttgatgttggctcaagcattgaccccaagttggatggcgcaaggcaaaggtataatggagctaagaatgttttcttagtctttttcccggtcttggtgtttggtgtagactggatttactagataggtgccgtactatcaagaggggtctatgaagctagcatgtggatgattttgtaccatattagttcatatgcatataggttcattttgtgggcttgtctagccaagtgtggtgagttttatcaagtcccaaacaaagagagatgtgggcacatcctataggtttgggtagcctcatgtggttatgtccggtggagtatccttttgagtgtgagccatttctccctgagaaaatttgtgtttcttggatggattgttcatgggttggatatccctttgaataagctttccatagagtcctagaacaccaaattccgagatccgagtcaagagatatcgccgttttactaacggttggttgtgctgaaaagtgacctgcggtctgaccgtgggccttaggtcggtctgaccagggctgttagccggtctgaccggcgtggtaaggccggtctgaccggccctactggtctgttgcactggtctggtttttggtggcgatacagagcccgccagagccgcaaccggtcagaccgagccaatggcggtctgaccgagccgtggacggtctaaccggctgcttcactgcggtcagaccggccaggttgagtgggctcaatgattgccctgtaacggctaattttctatccgttacaaagtagtccggtctgaccggccactctatggtggtctgaccggcagagcacagagttggagatttcgactctaacggctagttttggtggttgggggtatatatacccactccccagcagcaagggcaaggttttggcactccattgcattatcttgaacccttgcaagagctctcacacccttgtgcacttagtttatctagtgaggtgttagagagtgagttaagccaatccaagtgcattgcttcattgttatagctagtgtggcacttgatcatcctcggcaagcatcctagacttgttactcttggaggttgccgcctcctagacggcttgtggaggtgttacccggtgacctctccgaggagattgtggaggaggcccggcgccggttgtgagtggtttggagttcaccaccttcggagtgaaggaagaactaccctagtgatcaaggctttggtagtcctctccgtgggccggctcccgccttgcccaccccttaacgaagggggcgtgaggtggcttcgtggttgagtggtggagttggggtcgtctcaacggggattaggaaaccggcgagtttctgaatctcggtgaaaattccttgtctcttgtctcctttattttgggcaaatttactttgagcaagtttacatactagagtttatttgtgctattatcaccctaggcttgcaaacctcaacataggctagcttctttgtgcacttacttgagactagttgatttaggttttgaattgtgcaaaaccattttgatttacgcttccgcatacaaaactcggttttagccaaaagtttgaaaaaccgcctattcacccccctctagtcggccttcttgatcctacaagtgtggaagctgagaacttaccaatgttttatacagttggatggtactttgatgcttcggattattacataaggtatcttttgggtcttacgtagaaaatttctatcgtcgcttcccgatattatttatacaaggtgattccccgcgcttttgcatgagaattactaagcagttttcaatatatatttttcgacaatcaagctaggagaaaatagaaaataaaataatgaaacgtgagggtttatcagtacttatcataaaacaaacaaatgatacccacgatttaatgtagaacatattgataactatatgttaaatattataaaaataatatatatatttgttaaaatattgtagaaatgatgtgaggggtaataatttgataaacttgcatgttgatttgtataattaaataaattatagatgatgttgtgtgcttgcttaaggttaaatatgtaattattgatagtgggtgatgatgtggcatggttgtatgttgagttttaagagttagtggtcatcaaatttatagtaagataggatttgtaactaaagtgtacattgctatataccaataaacaacaacgatgtcgtagaataacacatgtgttagtgtcctaggtaaatgatgtaccctgcattgcacatatctcaaacggaaaataccgcacaccaaattatataaaaaataaatccacgaaatagagattgggtaagaagtggtggcatattggggtaaagtacatggttcgactggcctacagccacaactgctcagtatgtatccttgtctcccaaactttacttgaactcttgaagaagggggcaaccctaaggtataatgacatcacatccttgaatgggagagcatcaagttatatatcaatcaagataagccgtaggtggcgtagccagcgactacaacctgtggggttaaagttgtaaaattctttaagttttatattgttgcaacacaaatatcaatagttttttgggttgttttgcaaaaactatttcctcgtagcattgccattactacacgtagcttcgctactgtaagccatacaaaaacatatatcgatttgatattcgaaggaatcccaaagcccagccaccgaccatatcgccaaggtccaccatttagaatctcacagacttagtcgaataggttacactatgatttatccatgcgttcttattctatcttggtgtatacccttataagttcatagtcaagcatgaacccaccaacattttggttaagtagtgggtcgaaaccacgctcattcgtggtagatcaatatgtttattttcatattgcttatagaattaatagcatgccttatgtatttccatggccgtattttttttggtagttatgcctgtcagggttacggataaggcataccctctatcctacgacttatggaatataccgatgaggtataccttcacgtatgcgggttgtttccgtatacgctttaggaatttatctcaagttatggaaaatatctctatgagtttaggaattgccgaagtcctactcggaaagggtaaaatctctagtatatcgtgtcagtttacatatctccaagttttacttgggggtgaaggtattccacggtataaaagggacccttagggagaggcaaagggcatcgcatctcatcgccaatacacccaccaaagtttacgaagccggagttcacggagccaactcgtcaggagatctcgtcgaatccctcgactacgatctcatcggtatcgcctgtttcggttactttctttgtaatatgttctcatcatcatcaatcccatataaactggactagggctataatctgataaggggcctgaaccagtataatctttttcttttgatgttttgatgtcgtactacgtagacccctgctccaacgtaccccaattctctattcatccggtccgcgagtatcactcgtcaacaatgcatgttgtatattttcctgaacatgaataaatcaaatggctagtcatattttacgtacttacggcccttgttaaggccaataattcccagttagtttttctttgtgaaactaggcaaagttgtaacaaggtccgtcgtcttcgtcgtaggttgggcttaagtggttttgtcggagtggatagtaatggcctgagtggaggcctcgctttgttttggcatgaaagttttaatgtcgaaattaaatcagttaatgatagatttttgatgcttatattcgtgtgtcccctactgcacctctttggcatatctcttgtgtgtatggtgaacctcgtacagagaacagacatcttatgtggcaacaccttagcagccttagacaatcttccactttaccttgggtagttctaggtgacttcaatgaggccctttggcagtttgagcacctgtcaaagaatcctagatctgaaatccaaatgcaagcttttagagatgttttagatgtttgtaatcttatagacttaggttttgagggtaatcccttcacttatgataacaggaggaaaggcagtaacaatgttcaagttagattggatagggtggttgctgatgaaagttggagggatatttttagtgcggctcatgttgttcacttggtttcaccttgttctgaccatgtgccaatccttctgagattattgcaggaggaaaaccataatcaccggaagaaatgtcgacactacgaaatcatgtgggaaagagaggctgagctaccacatatcatttcggcagcatgggaagctattgaatgcaaaacagatctaggcaacatcgaagtgggccttgacaaggtcatgtcagatttacatacatggggaagcagaaagtttggcaatgttgtgaggaaaatagaaaagttaaggaagaaattaggggagctccagtactctaattcagaccaacatgagatcaggaagatcactgatgagatgaatgagttactttacagggaagagatgctatggctacaacgctcccggatcgactggttaaaggaaggtgatagaaatactaaattctttcatggtagggcagtctggcgatctagaaaaaacaagatagaaaaacttaaggcagctgatggcaatgtttactcaaatcaggaaaccatgggtaccatggcaacaaattatttcaaagagttatttactaaagatccaaatctggtgccggctaatgtggcaaacttgttcgccccgcaagtttcttcagcaacaaatgaagccctgtgtgcagatttttctgaggaagaaatatcaacagctctgtttcagattgggccaattaaggcaccagggccggatggctttccggcaagattttttcaaaggaattggggactcttcaaggacaacattgtccaggctgtaaaaaagttccttgatacaggtcaaatgccagaaggagttaatcatactaccatagtgctaataccgaaggtggatcaaccagttgaaatgaaggattttagaccaatcagcttatgcaacgttttatacaagattgtctcaaaatgcttggttaacaggttgagacctctgctgggtgatattatctcgcctaaccagagtgcgtttgtccaggggagaatgataacagataatgctttgatagcctttgagtgcatacatcatatacaacaagtgaagagaccagacaactccttttgtgcttacaagctagatttatctaaggccaatgatagggtggattggtgtttcttggagcaggctatgcataagataggtttctctaaccggtggattacttggataatggcgtgtgtttcctcggttaggtactctgtaaaattcaatggaaccctattggaagcatttgctccatcgcgtggactgcgacaaggtgatcccctatctccctttctttttctgtttgtggctgatggtttgtctgctttattaaaggaagcggtgcaaaatggtgaaataactcctgtgaaggtatgtcgtagagctccaggcgtgtcacacctcttgtttgctgatgacacacttctctttttcaaagctaactcagatcaagctaacatggtcaagaatgtattagagagctatgcagctagtactggacagctgatcaaccctcaaaagtgctctatcctatttggccatgcatgtccagaagagttacaggaagaagtaaagaatgtcctgcaggttggtaacgttacttttgaagagaagtacctgggcctcccaaccccggaaggacgaatgaaaaaagggaagtatcaacggctgcaagaacgtctgagtaagaaattgatgcaatgggcagagaaccacttgtctcagggtggtaaggaagtcatgatcaaagccatcgctcaggctatcccagtgtacgtcatgggggtcttcaaattaccagatggggtatgtgaagaactaactaagattattcggaacttctggtggggttttgataatggaaagaggaaggtgcactggaaagcgtggtctcaactcaccaaatcgaaaaatgctggtggtttgggatttagagacatgaaagcattcaatcaagctctgctcgcaaggcaagcatggaggttaattgataatcctgtcagcctgtgtgcaagagtgttaaaggccaagtattatccaaatggttgcctaatggacacggttttctcaggtaacgcatcgccgacgtggagagcaatcgaacatggtctggaattactgaaggaaggattggtttggcggataggtaacgggacaagggttcgcatttggagagacccatggattccacgatcgttgtcgaaacatgaattcggcaataataaaagggggtagcgtacgagacctaaaagtggatggatgcggagacaaaggatttagacaggttcaggccctctcaatgagaggtaataccctactcctgtttggggatttgaatccaccgggtgtagtattgatctgacgatcaggttgtgtcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatattccatagatataagttatcccctatgactagtcggataaccatgccgtatgggtatggggtacccataatatccacaatcgtcaactcgtaaagtgataaccagccaaggaagatgcagaataaaatgggtggcagatctgttggatgcaaacacaaactggaatgagcaattagttagacaaatctttcttccaatggatgcggatgctattctgtccattcgcacatcacgccaaggggaagatgatttcttggcatggcacctggagaaatctggtatttttacagttaaaactgcctaccgtttagccattgaaaataagctgaattccgaaaatagcaatgcttctggcagttcaattgaggggagtaaaagcttatggaatacaatatggtcttgtccggttcctccgaaggtacgtatttttgcttggcgagttgcttctgactgtttgg

SEQ ID NO: 71246 - DNA, 7545 bp, Oryza sativa
atggcttacagatcgacattagcacatcatccaagtatcctagcccactcctaagcaacttgggactaatacaccactaagaatgtcatcttcttgcttcaccttgagggttgtcaacgtcaacaccattttgctattgggactattctcacctacactcattaagcatattagtcccaaatcaattatacctttgctttgatcaatgcccactttggattttgacttgatgttcatcgaagaaccacatcctcttgatcctcggcattccatcttgcggtcttcttataattgatacggattactcatagcttcaaatggcctcacatggtccatcatgaccatcatgacaaagccttcactcgcccttcaccaccggattcggtccatcggcgccaagcctcttgcttgcccttcaccccacgcatggtctattgtagccgagccttgcttgcccttcaccgttttgccataaatagtcacttcatactccgcatcatcaatgccttcacttactcctcattaaggtataatgtctgtcacgcccagaaattcaatagcaatttccgaacttatttgtgcattaaatcctcgtgcaggaatcagccgaggtacacaaactaacaatttaatatacagattcatcaatataataatgttacatacttacaaaagaaaagaaaactgcagcggaattacggtctagcgaagctccggctccactcccacaggtagctcaactggggtataagccaaacgtcttctccttcgcaacttgtcttcaactgaggtttgattgattattgcaaggtgagcatatgacatactcagcaagccacacagcaatatgcaagtgcacaaggataccaaaggatggcataatatagggctcatttgcaaaagcagaatttagcaaacatttgagaattgtaaaacagtagagtaattaatcatcaatattaatcaacactgaacagcacacccatgctgcacaggcccaaccatcctgaataaccatacccggctgcacagatctatctccaaaccaggaatataccattccaaaccaggagctaaattaaattattaccagttatagcatcatttattatggtgagaagtgtgagactaatcacgaaagacattgttagacccgcccatgaccgcgggcacggctattcgaatagttttattctggccagaggtgtaccactgtacccacaagacacaacccaccagcatgttaccgtgtccgcgcagacacgtcaccatgttgagtgattgtgacaagacccctcgcataactcaactcaaagcagtgcaccgttcccggatcatagtcacccccttataaacaaggcatggactccccagcgacccccgtgggcttattttcgccacttctcagtctggtgctccgcaatgagtcttgttatacaaagtgtccagccgttgcccattatggcttgtggttggcacggttaatgtttcacaaccgaaaatcgtgaaccggtccttaattgtcatgagcacgaccatcaaaaccatgtgctcacaacccaccattatcaagttttagttggcacattaattaattaaccaatcacgattgaccatcatgagctatcattaaatatccatcattaagtaatagtgaaacattagttatcccaattgtgtgctaatgtttctaagcatggctaagcaattatgtctaacatctagctgaaccaatatatataaagctcaactagtcaaattataatatcccaaggtatcaaggaatagagtaatcaatgcaaacaggccataacaaaggaatagattcacaccacccagtgacattcgaaaataaatgcacagttgaaataaatagagaatttaaatataggatcaacatgctcaaaggaactgtgtttgggatctgtgtgacttgccttgcaataaagggtcttcaattaatcttcttaacacttccagcgcactcacgaaccttcgaaacgacggaaacgacaagctaacacacaaaacgaggaaaaagactaataaaaaccaaatagacaatacataaaaagtaaacaaacatgtagatcataattttagatgaattatgagacttgaacggcctcattcggacttcatatgaatttattacgaattttacaagattaaatctaattaaagcctatttaaaaaggattaaataaatttaattcaatttatggataattttaatatgtagatctttattttatacaacttttgcaacttgaaccacattaaactgagttacaaagaattagttatgaatttttaaagattaaaccggattaaagcatttttatggattttaattgaattatgacgaaataatgaattatttttaaaaaggaaaagggaattattgcgtcatcggctagggtttgcggaggaccgggtgcatggcgacggttcacgaaaacgaacgaccgagattcatccatccaaaagggatggccaagatccattggtccacgaccggaccacggcggacggcaacgatgacgtcggcgatgacgtcatcaccggcgacggctcggcctcgcgtgctcgccggcgaacgatggcgcggcggcgcaaacggaggacacctacgcgtagcggacggcacggcgaactcaccggtgaccaaaacgacggcggaagatcaacggacgacgacggcgacgaggaagagtggcggcgacgatcgggtcaacggcggcgacgatgctccggcggctgacagtgacggcgaaaaggcggacgaggacggcgacgcgacggcgaccacggcggtgacctccccgagcgacgatgacgactggagcgacgccggcgcacggctggagcggcggcgacaacggcggcgcgaggcggcacggcgctagagctctaccggctacgagagactaaggcgagggtggcggcgggtagaggggagctcgggggtcaatttatagggggtagggagcggcagcgaaggcccacggcgaccggcgacgggaaggaaggtttagggttcggaggagagaaatcgatccgaatcgaactcaaatccggcgatttccaaagcgatttagacgatgtttccaaaagggaaaaggtagagtggatcacggggatcctttcccctcaatcaatttcaccggaaacggaaagggacgaccggatttggaatggcggcggcggcgcagctcggctagggtttcagcgagaggaagacgacgactgacgggtgggacctacctgtcagcggcggtcgcacgcgcgcgcgcgggcggctcggcttgggccgacttgggctgagggagagagagagcggtttgggccggcttttggcccaaaaccaaaagggacttttaaaaacctttttccctttaaattattcatgaaatgcaattccatttattaaaaatacttccttggctcaaataaatcccagaaaaatctaggaactatagaaacaagagaagtatttaacaaaattttatctagcctacttttatattgagatttaacaaattaaaattagatcttctcttctaggcttttaaaatcatttctaataattcccttttagacaacaatttataaattaaggatttttaaacaagaaaagcacttaacataattataattagatcattaatgattaaataattactgaactgttctttgtatcatttaggaattgagctccgaaaaatccgagaaaatttcagagagtataattaatcatggagaatttaataaaaattaaatccatccatgctttaaatttaggaaattttatttcccacatttaacttcacttgtaaattaatgaacatttaatataaattctattaataatttattagataatttataaatcctaaaacaaaaatctggttgtgacaatgtccatcttctagccgagccttgctttctcttcaccggtttgccatagatagccatttcataccccgcatcatcaatgtcttcacttgctcctcatcaaggtataatgtccatcttctagcttcaatcttttaacttgatgccggaacttaacctaatctcaccaactcatggaaatagttagttccaacaatgggttgtcattaatcaccaaaacaatcaccgcactcttaggatcatagatattccaatctccccttacaaggcaattctagtgcatagatctttcaatctccccctttttggtgattgatgacaacactaccacaaaataggaatttaaagagaatactctagtatatgttaccatgagcatgaaacatatactagagggttggtttcatcaacatatgaaacgagtatacactttcccctctatctatctctctttatacttctccccctttggcatcaaacaccaaaagattgaatgtttgggtgggagcataaagaaaaagaaatcatatcaagtatataagaactacacaagtcctatacacttgaaggagaaaaggtttaacatacctttggtgttccaaagaggctacaacaagatgaaactctatcaaaagcgttagtttcaaaatagcaaagtacaaatagcctcgaggtacacacaagaagatatacaagaaaaacatgtgcaccaacaccgaataaagcaattgaactcatcgaaattccaatagaaagagttggagtccaaagaaacaccaatccaaatcaagctctttttggttttgtgcatatgaaccacaccaattgatagaagaataccaatcaaaagagatagacctagataatagtcacaattggtaagaacccatatgcacatatagcaaatacattgattagttaaactcgcttaatttggagcaaggcacaaaagcatgattccaaaaaaaaaatattttatctttaatgcatctcccaaaactcacttaaaggagggcaaaaagtatgttgggcatatgatgctatagacaagtcatgtatgcccgaaagaaatgtctcataagccaaaacccaataagtagtgatgatgaagagacatatcaagacttatgaaacatcacaacataggatgaactccttctaaatacgtgcataccaaagagtgaaaagaaatcttatgcactttcacaaaagaaatgaaggaacacaagaatccatcctatattatgaaatcaaggttgcaaagaaaattcatagaagcaataatgaaatctaccttaggagtcgtccacttccgacatgagactaaaaggataaactcaatttaaaccattagtcttccaaggtatagaataaatttcccctcaaggtgtgcatataaggataaatttaatgcatacatatgcactttactcaaatgagaataggggagtagtttacactatattttgggtcaaggaggcaaatatcaccaaaagaaataaatttaaggactagaattgtaaagcacactttcataaacctcacatctcaagatgatggtacttaaccaatctcatccttcgttatccattcctttggttatcataaatcaatctccccttgatccatcattttctcttttctctatttgaatcaatagaaaagagaaagcaccaaaagcacaagagtttcacaaataatgatcctttagatgtggaggaaaattggatcacttattcgtgaaactcataatataaattaaattctcccaaaagtaatgcacacatactgtggaaggcaaatttatgtgcactatttgacatttaaatcaagcaagggaatttaatctatattatgaaaggtagctaggtaaaatataagatgaaaaggtaattgaattaccacttgtaaatagcatacatttgagaatgtttcacttcccatgagactaaacataaaatacacttaacaagaagttagtctcaaaaatacaaaacataggacatgctccccctaaatatgtgcatgcaagcatttgaattacttgatagaagcatgcacttgtctaatgaaaagaaatgaggagtacaccctataatttgaacaatttgcacataaatgatttgcaagaatatacatgtgccaaacattgggtagtaaaaatgcatgtaaattgccacaagataatagatgaatgcatggcaatctaccataagaaagaatattcatgacacttgaagcttgtatatgtagagatgatgtaaaagatttaccattggagcatacaagtccttagtagaccgggacttccggttgacacatgaaggtaatccaatccatgggctgaaaaatctacaacaaacctttgagatagatcacacgataatgcacaaatttcattgtgggagcattgcacctttctcaaccaacatgcatgtacaaggatcacaataattaagaaagctgaaaatttgaagatgttcaaatcttggaaactcaaaaaataacttagaaggagcattgaaatgacattcaaatgacctttgataatttagacaaaatttggcaatgaagtccaactatagagaatcgaaagtcacaatgtaagctctttccaaatcacaacaacacaacccattttgagatataaagatcacgaattagctcaaagtcagttttttctgaaaatttctacaagttgagaaaagagagaaaaagtccgaaataattcaagcttgcaaaaaatatctttgaacttgagagaaacttctccaaaattaatttcactaaatgaattttctatcaagtgtatgacttttaaaacaatgaatttcaaccaaaggatttttttaagaagtttgacatttggaaagacttagatgggttagaaataccaaattaggccaatgttcacaaagaacattagtcaaattgcttaaacccaccatatgcatgtttggaccaaatatgattaaagcaacatgttggagaaatgacattttgttccaaaaacaaaaatttcactccaaaagctttttagaacacttgagataaaacttgaaacgctttgaaacatttttcacaaactttggaccgtcaaataagagttttgaatttttaccagagggactcttttagaaaacatttcatgtaagcttttgaacttttgaattttggaagcttgagctaaaagtatttgggtcaaaacaaacttttcggttaagccaagattttaaaactatgttttgaggcaagttggaccggaagttccggaaaaattggtaggaagttcctatcaatttttccggaacttcctatcggccctctttgtctcaacagagactgctgaccggaacttccaagcattttggccggaacttcctagccgacaaaatcagtacccgagagtacccgagaacttttaagattttgctccaaatcacccgaacaaactcggaatttcacgaaatttgaaccacaagctcacaacaacatgggaaatcagatgaaacaagaaattaccaaaatatttaatatttcatcaccaaatttaaagaacttggaaaaccaaaggtaaaaaccaagtttttgggaaaccatcaaaaaccatggtgctcgtgcgaaggg

SEQ ID NO: 71247 - DNA, 8648 bp, Oryza sativa
agggctctatgggcagcatagcgcgaggtgtggcagataccggaccagacaaccaggacatatcaaggtacgaaatggctgctgcttacacttgttaaattatctgaaatggaacgaatgttcattctaatgttgttgtggcgtatttggcatgtacgtaatgaggtggttcatgataaacggcctgccccgattgaggtctccaagcgattccttgtaagctatgtggactctctactgggaatacgtcaacacccaacaaaggatatacacaaaggtaagggagtcatctgctaccagctgcggaattcatcaagacaaggtggttcagagagatcgcaggggacagacgaggcttgggtgaggcctccaccaggctggtctaagctgaatgttgatggttccttcaataacagcagcggccaagcaggcatagggatgatcctcaggaattcagaaggagaagccatctttacaggccgccaggctatagcaaattgtgttgatgctttggaatcagaactactggcctgtaaatttggtctggatttggctctacattggtcgattctgccaatcatccttgagactgacagtatcctggctgtctccgcgattaatggaaaaactgaggataaatcaaggtttgcttacttgatacgtgagctgcgtttgctccagaaaggagaaagggaagtgaaagttcagaaagtgcatcgagatcataataaaattagccatgttctggcaaatagtgctcgagtagcaaataggtcagacttctggtttggccacgagagcaactgtgtctctgcactcattctggaagattgtaatcactcttctatagattaatgaatccccttttccccgcaaaaaaaatattttacgtacttctgaccaaatttaggtagcttcctttgtttaatttgtcatggactttttatcttgtatttcaataattcattgtctgaatttcagctgttttctaatttgtgggtttgttcggttgcctgatacatgcatgcagtgctacatgaccaccagttatagcgaacgaactaatcacggcctacgggccagggcatcgttgtaaccaacggccgaacatgctagtgtatgtattttgacatggtctcttcagtattaatctagaccattttaatttgaacatgccgcacaaccaataacttttttttcattttctttgaaatgcataataatttatacccctttgagaacaagtttgaactttgaaggcttattcacaccgtgataatatatgaatatgaatatgaatataatagctaaaagtaggaaacgagcaccttccaccctctatataaagacaggcaagaggtaccacgcaatcgaagatcaataggaggaatttgtcaatttgggtccaggaaaacgagagtagttcatagtcatttcttttttgcatattcacatttttttcgaaactcatattcatcgatattatagcacccatgaacacttctaggttttttatacggcaatttggtaatctcctatgagatatctacaaaattctggtataactggttttcttctcacacgagaaaaaaagcactccacattctagttagatggcttaacttaaactatttcaacttcgggtgaactgtgcatatgtttagttaacgagtgattttttttttggccgaggaaactgtttggtagagctcaaactgctaaatttagtttcaggagttgagttagttgtggagttgtggagctgcctaaactgggcctatttggcacaactccagctctagctgcacccctcctactccaactgcacccctcctggagctagagctcagctaaacagtttcagctccacaaaaaatgggaatagagctgggtttaggtagctccacaactccattccagacccaactcctagagctaaatttaggagttggagctgtaccaaacaagccctcagctccacctctctagttcattttgtgatagcgctccacctagctccgctatcattttaggtggagctgaaactgtttggctaggttccaactccagtagaggtggagctggagctgtgccaaacaagcacagaaaacatgagagaacatacaattctcaattctttctggttaaatgtttcgacaatataaacacagcactctcatctagtgacatgttgcatgtagtattaggaaaagacatgcacaggggcgacatccaaacagatgagaaaaatcaaaggggtgaaaactcagtgatttactacggtacaccgtacaacaggcttcacaactggcaccatatgacgccacggcctttactgatttagcataccagcatggtggaaggactcatgagaaaagtatccaagtctcaaaacgaaagcatgttctagtttacagcagtaacacgactatggcaccaacgacgggggaaagagaaaaacggcaatacagtctcatacagaatgcaacacatttgcttccaggaaaagaatgacaagaaaatggttgaccatcgccaacgggaaggaattgtaggcagaggagctgtagcaaattaacgccttttcgctcctggggattgcagtaaccggcctgtgtttctcagagggctcgcgacttgacgatgtccatgctcatctcactcgggtcagtggcctgcagctccacctggatgccgtccagctccctcttgaaccgatccttggagctagcatacagcatcttgctcctcacccttgatgtatcaggagccctgcagagagtaagatgcacaaacacattgcctcagtgttacaattgaaatagcattatatagttctgttacattgggcgtttgacaagctgatggatataaacatgttttatgatgcttacagttaataatctaactgtcatgatttattcattattcaaataaagaagaaactggtagtgccaaacagcttgcagtgtttagagacataatcctgagatatgttgattaattcctgaagttatcgatccacaaatccaacatatgggaaaaagatcaattcagtgtctgtcaggctgttatctgtaattgtaatataaggttgctttacatttttttggcaaggaattcaattttctttacatgctaatatcagtttcttaagatccatggcttgggtgaacagtgaaacaatgggcacaaaagagctttagcagaaatgaccaaaagcagcattgttcctttagattattggcactgttcattgtctcactgacctcatttccctatcaaaattgttccttaccgtaaaagtagataatatgtctaataatcactagtggcagtgaggcattctcataaaaaagaacattttaagtacaggtagcgaagacattagtgctgataacaattttgataagcaaagagatgcctgatatcaaagtgtctaattttagatctatgatgctatttttagctaaaaattgataggctaataattatgcctctttcttgttcctgtttcaacctaatctaagctaattttacacttttgtaaaatagaaactatgaaatatatttctgcgtttccctttgataatgaatttgaagtgctaatgtgcttttgaacaagtgacaaaagtgcagttaacccatcctataaaaaagtgtttcgttacacctggtaagtctgaagatcgaagggaacaccaaactgcaataatctaacgtaagcaggcaattgctcacaaacaactcaatccaaattgagacttttaggtcagtaactgccacacgtaagatcgaaacaaaaccaaacataaaaaatatgctatgtaaatagaaatttacatgttgatgaaatcaacaagaatatgacactatgttgacaggggaattgttaccaggagatgaagaatatcttgctcttctggcagttttcatcagtgacaaagtcaaaatcaaataccgcgtagcggcactcatctgctggtaagcaggcagtgaagtcgtcatagctctcacccggctgccccaacctgtccaccaccacctgctggaccttctcattgatcttgaacacgatgaagcggaagctccttttcgccttaagttccaggaacttgagtttgcattcgtcacacacggccattcccgacgccgaattcgacttacatatccccacaacatacaccatttcgttaatggacagatcttgatcaacattctgaacgaaagagattgaactgcactcaccatggttgatgatccttttttttcctcttccttccttctttccttccttactatggtgagaaacagacaggccctgcaaggaggagagaggagggaatgtgccaaaacgcgagcaggagcaagatttgaaggcctgaaagagaggaaggaggaggcaaaatatagggagggaagggctggcggtggagatggaggcttgcatgatgccaccacgttcggagaggagcatttgaccaagcacgtcccctccttggtgtgtgagaaccagaagcgttgtgtgcaaccaacatgcgcgccaccacccatcgctatagcagctccccttgcatagaaaaatcatttgtggcatcaaaacaacatggcgtgagtttgatacgtttcccgtttttttaatggtgcaggtactcaggtactccacgtctctagtttctttggtttgattccaccagtaagatccacatgtaatcttctctattgtaagggaagactatttattaattccagggcaacaattagttttttttcttaaaattttagtcaattttccaactgatagaatctgcataaaagatgaagtgctttgatctatctcatataagtacaaaacttacattctatggcattgctgttcggcattgtacagatcttgcctcaaccaaactagatcctggttcttttaggaggcccctttccaccatcattctccggacatcctgaacatccctccatctgtcagctgcagcatatatgttaccaagcagcacgtaactcccagtgttctccggatcaagctgaaataatcgctttgccgcaacctccccaaactcgacattcttgtgtagaacacaggcaccaagcagagcaccccataccgaggtgctcggctcgaatggcatatcttggatgagacgatgagcctcctcaatcctcccagcacggccaagcatgtcaaccaggcacgagtagtgctcgccatttggcatcaaaccatggacgttgcgcatgtccttgaacaccttaatgccttcgtctatcatgccggcgtggctgcatgcatacagcaaagtggcgatggtcacagtattcggcttccctcctgactccaccatcctgtcgtagagcaggatggcagttcgggcgtgaccatgtataccgtacccggcgatgatcgttgtccaggcaacaacgtccttctcaggtagccactggaagagagcccacgcagcatccaagtcaccagccttagaatagacatcaatcaaaccagtggcgatctctgtgcttctgaggaatccgagagtcagtaagaaacagtgaatgttcttcccttctttcaggtctgcagattctgcataggccggcaggatgcttgccattgttgcagagtctgggcgcaccgattcagcaatcatccgcttgaacaattctatagctttcttctcccgtccactgacggtataaccagacaaggctgcattccatgtttctgcacgccatgagcccctctcaagtgttaatctcatcagcttcatcttaccgcacctcgcataagcgtcgataagcgcagtttcaacagcaatgtctgatttaaggccaagtctaatgcagagtgcatgtgtgcacttggcatgcttccctgacggcatgctggcgcatgctgagagcagatacaccattgtcactccattgggccatgctgccccagacatcagcatctgacaaccaagagaaatggcctcaaaagcacggtcgttcagcacataagcgccaatcatcgctgtccaagaaacaacatctttatcatgtttgcagtgatcaaacacccttcgtgcatcctccaagctcctacacttcccgtacatgtcgatcaatgcgttcttcactgcaacataatcccccaagcctttgtcctcaacaagccggtgcacggctctcccagtgttcaagtccttggcttgcgcacaagctggcagcactgacacaaccgtggcacggtcgatcccgacaccatcagcggccatctcgccgaacacttccagcgccctctccgcgtagccgttcttgacgcacccggcgatgaccgcattccaggacacgactgtccggttccgcatcgccccgaacaccgcctccgctgcgcccacgtcgccgcagctcatgtacatggaaatgagggcgttctgcacgtacgtgtcgccgccgaaaccagcggcgagcgcgcggcagtgcacggcacgcccatggcggccgagacgaaggccggcgcaggccttcgcggcgaaggggaaggtgaggtggtcgaaggcgcgcatcgccgagtaaaccgcgagggcctcccggtggcagccgaggccggtgtacgaacggagcagtgagttggagaaagaaaccggtggtggttggggcatttgcgcgagcaggtttgtgggcgctggagggacggccacatgcgcaatacaccatgaagagcggatggaggccgtgatagcggaggaggtggccggacgtgaggaggagcgcgtggagttgagcggcgacggcgggagcaagcggagccgtgttcttcgagtggaagatggtgacgagcgagcattgccggacaagcggggctgggtttcatccaggaacggagttgagacaaggggatgtttcggcttttgggcagattggcttctttcagcctcggtctctctcggggatagttcgattttgaacttttgggagaaaaaaaatcagttgcaaacttctaaaaactaatttgaagtttgactgaattttttacatattggtccttttataaagcttattttagacatggatactaaagtaggcagtccaccttgcagggcagtcgtcggaagaagttcgccacaacgtcaggcagcctctgccgcagaatcgggtgccgcatcaggtagaaaccagtcaacagcgccaccgcctggaacggcaccgagaacgtgatcacggcaaggcacaggcagcccagcaggtacaggcccgtggcccgcgggtcccgccacgtcatcacgcaccgcgcgcgctcggcgtgcgtcgcgatgtcgccgacgatctcctgtatccgcgcgttgaggctcctcagcttgtcgtacctcatccgcaccacctcgggcggccgcgccgtcgggaactcgtcgaactcctcgtcgagctcgtcagggtgcgccgtgtcggcgtgggacaccctcatgtcgacgtgccacgggtgcttgggccggcgcaggtagttccgcatgccgagcatgaacttgtacaggaagaaggtgggcagtacgagtctcgggtagcacacgagcatggtgaagatgacgtggaccgcgacggtggtgaccgggttcgtccagcggcagacgtggtagaaccacgcgctcgccgcggacaggggctccagcgcctccgcgaggcggaagaagtgggccttgctgcgccgcatgctccaccgcagcgcgtgcgactcgcagaggtgctcgacgcactcccggcgcagcggcgggtccatccgccccatccggtgcgcgatgatcgtgaccgcctcccgccgcagcatctcctgctgcacgacggtcagcggccggtggtagtgcatcggcggcagatgcggctgcgcgtacgtctggaacaggcccagcgtcgacgtgctggagaaacggacggcgagacgaagctcgcccatcttcttgacgccgccgccgtggagggacataagcgggtaggcgtaggcgtatgtgcggccggtctcgagcgtcgagagccggatccgcaccttgccgaggaggacgtccttgacggggtcgccggccacgaggccgcccttgtcgcctatctgagaattgtggaagacggcgacggtgagcacggtgcagtggtcgtgcacttcccagtggtactgctggtggaaacgcggcgagatgctgtcggtgacggtgcgcgtgcggtaccacttcaccccgtacttggcgacgcagtacgcgtcgcaggagcctcggccatcgcgcgtgcgcgtcgcggtgaggatggcctcgcggatgccgagctcgacgaggccgatgcacttccgctcccgctcctgctcacgcgccgccggccggacgtcgctcaggtagtggaccggctctgacagcaccttgtacccgcattcgaggcaaagaacgacgcttatcttggcagagtacttgtcaatcttggcggctccctctggctgcatcaaactaaacctgtcaaacagcatttgcgtagcagttagctagggacaaattcaatcttgcttgcctaataccaggtactttgtcgttctttgctagtacatgagatggatggacattgggcgtaccatcttgggctgtcgggcgggcgtcacaccggcgttcggagctgtcaag

SEQ ID NO: 71248 - DNA, 2154 bp, Oryza sativa
cccctcgaccaccggcgcaagcctcgtgttgcggaagaactgcctcagcacttgggcgatgagcttgtggagcgagacggggaggaagtgcagccactcgttgatccctccctgcggcctcgtcacacgctgcaagccaaaaaaaaaaacagagcaattcgttcaaaaaacggagagagagaaaaaatcaacagtagagcaggaacaactgcactggggtgagagagagagagaggggggaaactgacgtagagggtcaggtggtcggcgaggccgagggcgcggacgaggccgaggcactggttctcggcgccgggggagccgttgccgatgacgacggcgcggcggacgacgacggtggcggcggcggcgccggtgaagatctcgggcgtctccatgccgccgacgccggggggctccggcagccggatcggcctcatcggcctagggttcgccggccgcaggccgatcccccacgaaccaagccaccggatgctccggcgaggatctccttctcctccacttcgatgaggaggattcgctcgtggtcggggtaggattggaaggttcgataattcgatgtgttgcgagatgtttggggggtttggtgtcgattcggcggccacagcggttgcgtgtttctgtagggttctcgagtttcaggcagttgctgtcacccactctctcgaattctccagttttactgtactactacttcccagggtcaaaaatatttacagtaccgtttaacacaaaatttcgtcaaaacttttaaaattcaactaacaactaattctatgaaattctagcaactaattctatgttaaaacaaaagttaagtttaagatattaccatcgtactcttataaacaaacctatgtatattatttgttttggttttaaactatgcttttgagaaattataatggtcggaattttaaaggttttatcaaaccataaagtacaagatattcttttttaccggagagaacaataccaattttcatagaaatatttgaggcgtacggtagtgaattctcattgtgcatgatttaacattagtcataggcataggcatttttagataaatgggtatttcagggcattgtatcacctacccctgagcatggcccgtggacagtgctcgggtcacattcgccccaccccccacccccctaaaaaaaaccaccaccacgcggtcctcaggggcggtactatggacacttctgtcacctgccctagtatcccgggttagagcctctccaaaagactctctatttagctctccaagttaaaatttagccaatacatgaaaaaaaacaagcttcaacagactctccatccagatagctaaattgctccttcggctagccaaatgtagccagcctcctccactggccaaagatgggtccgaccaccactcccagcaccatacttcctctctctcccatccacccaccactccaccagcaagctgcaagcaggggtgaaccgagggcgtcgttgatgtctggtccacagtctgccacggcagtcatcgtcattgccgccgcgccacggtcacgcatgagccgttgccgccgcagggagccgtcaccgccgccactgcctcccacttggcacgcgcgggaagacgtcgccgccgccgccacctgggagccgtcgccgccacgaggcggtcgaggatggatcgatgggccgatgcgggagaagagaaggaggaagagaaagagaaagaggaagaagaagaagaagaagaagaagaagaagaagaagaagaagaagaagaagaagaagaagaagaagaagaagaagaagaagggaatggaggctgacaagtgggtccctttatgattttggagatgtaaatagagagtctgtttgagcgaacacctagtttgactacccaaattagttgaagagttggccatataggtatttggaaagtctaatttggagatacgattggagatgctcttagaagcaacaaatcaacacagtcaaaccttgcatttaattgggcgtctgggtctagctgaggcttgttgagtctgggggtggtggaatggtagtgatgagctcccttcgctctgggtcctagacggtcacacaactggcctagaccagagtcggatctgcgatggtctcttattt

SEQ ID NO: 71249 - DNA, 3354 bp, Oryza sativa
  unsure (1)..(3354): unsure at all n locations
ttaattcattgctcaaaaaacgataaaatgttgaagttccaacaaaatgacccaaaaggcaattttgagcgaatgagttgttttggagacgttttggtttttatgagtttgaaatacctccatgaaccaatatacatcacaatatatggttctagtggctaaactcactcgatgccataataggaccaaatatggtcaatataagttttcatgtgaattttgagatcaaataatttcaaatcgtttatcatataaaatatatttaaataccaaaaacatttgaaatgaccaactctagtggcttgacaaaaggattatttgcaaaaaccttttaggacatattttgacataaacacattttaaaagcaaaaacaagatcctagcatctacatttagaggctaaaaacattttctttccaaaacttatttttgttttgaatcaacttttgaaatacttctcaaattggtgtaggaacctttttgaacaaacaaaaccaagttttcacaactaattttatagagtttgactttttaactaaaatagaattttgaagactattatagcatcaatttaatcaaaacacatttgagggatgcaaatgatttgagaagttataacactctccctaaatgtgataaccaaaacattactcgaaattaaatttgaaaaatgaatcaagcaacattaaaggatagacattatacacaagcgaaaacctacacaaggttaggacatagatatttcaatgtaaatacttgttaccgagatggcattggttcttaatgtagagcaattattcacatccttgattccatatttggctcatggtacaaacttagttcttcaaggatgaattgagcctccaatgcacctccaagtacctaattgacaatctaagcatattttggtacccaaatcacgttgggtccatggatgttagtcacaagagatttaggcacccaaatggcctttgtgctagcatgtagtgaactaatcaccctagtagcacaagtgccatttatggccttcctaagcaaattgtgatgaaatgagaggtttggcttaggaatgttaccaatgggacaatttttaccaatatgtcccttagcctggcaattgtagcaaagttgagttttgcttttatcttgctttttgacttgtttgttgccggtttgcctcttgcttgatcggttgcaatgatcatccttcttgtgaggacaaaatccaatttcatgccccttctcatttcaaccatagcacttccttttgttgattctagatgtctttgttggaagtgtgatttcatcatcaatcttgcgaggacaacttgaggcaaagtgtccctctttggtggacttgaagaacttgtgagcaagatcctcattcttgttcaacttcttctctttcttccaaggacaatctctcacatgatgtcccattttcttgcacttgaagcaagtaatggaagttttgttcttcctttgatcttgccccttgatcttgttgttggacttgatatcttcttgatagaacttgttgcaagctacggttgttcccttctcaagcttcttcaccatgctctcacggttatcttgagaaggttgagcattgccaacaagtccatgatcgatgcgcttatcctttttctctacataatccaggtcacatatagtgctcggaaaaatatttgcttgagagcaataagagttagcacaagtaaagtcaacttgaatatgaggcacataggattttaccgttgttatgatcacctcatgagttacttctagcatggcatgtgaatctacaatatttccatgagagcacaaaagttcatcatacttttcttgtaggtccacatgcttgctagtgagctctacaagttgagctttaagctctagattttctttctccaaagatgatttctccatgatgcaagaatattcatcggagcgtggagatgagcatcttggagatgtaaattcttcacttggccatttttttccacatacttcttccttcaaaagattagtttcacaagcactgtaggaggtagaagtatccacattgacgctactcaccatttcattaccttcaatgaagacatgtgtctatgaggaggtgaatgtggtgaggcaatcttgaccattggatagaatcacttgaggctctttacaaattgtcgatgaatttgagtactccacaagtggttcttctatagcgagctttacctcatcacactcggacttgtcatatctctccttgagtgtgttccaaatgagatgagcatcctcaagtggcatgatggattcaaacacatcttcactcaaagcactaaacaaaacattagtagcttgagcattgagatgtatgcatttctcttcctcttcaaatgatagcatttgatcactaggaggagaaatgctcacaactataacttgctctatttgaggacccatggccctaaacacataaagaatgcgagtactccaagacatgtaatttgaaccatttagcatgagaagttcaaggaaattttcacctcttgttgacattgtagcatcttgagtatcaaccatattaccccttcacacttttctcgccatcccccgacatcttctctccaagcggttaagccaatccagagattaggctttgataccaattgaaagggccttgatgtcgcctagaggggggggtgaataggcgttcctaaaatttacttcaaatcgcagcggttaaaatcagagcccggaactttctggcaaaaggtccggaacttccttgcagctttttctcacaagcagagaaagctgcccggaacttccggagttcttcctaggaacttcctagcagttgtgaattgctatttcaagcacctcacaacaagtaaattaaatcacaaggaagcctaaaccatagagaggtacaacatgtctcaaacaagagtaatacacatgaaaatacacaagatatcacaagtgatcgtacaatgggagacatgatagcacaactaggcaaataaggagataagcatcccaatcacaaagataaagagagtgggaggagacaaaagatttgttttccgaagttcggattctccactgagaatcctacgtctccgttgaggagctccaaagaaccgagtcttgattaactccttgcctcaccaagcaaaggcctaggaagaggtctccggtattcaagccaacacccctaggtacttctctttggtttcaagtgaccactaagatccctaacttgaacaccaagagaacaccacaagtgaggattgctctaccaagacgacctcctaaacctgatgngctncttacagagaagtccatcaatcgccg

SEQ ID NO: 71250 - DNA, 538 bp, Oryza sativa
  unsure (1)..(538): unsure at all n locations
aaatgcttagtcgcgacgacagcaantaatccatgacactttgttggagnctaacgnnnccngggntgnanttnaagggaannnttgngatacaaaaanangnnnnaangtgatttttttgttannagnnannnnnnaaggaaaaaaagttttttttttattaaagnannaaaaaaganagccccaaaagcnnaaaanccaaannnnggnnnnnnnnggnnnnnnnnnnnnnggggngnnnnnnagngnaagaggaggggaaaaaagggannnaaaaaaagaaaaggnnnnnnggnggannaaaaaaanggnagnggaaaggaaaaaanngnaaaagaaaaaaggaaggngaaggggnaaaaaaaaagggaaagaggnggnaaaagggaaaaaaaaaaaaaaaaaaaagagaaaaaaaaagaaaaaaaaaaagaaaaaaaaagaaaaaaaaaaaaacaaaaaaaaaaaaaagaaaaaaaaaaaaaaaaaaaaaagaaaaaaaaaaaaaaaaaaaaaaaaaaaaaaaaaaaaaaaaaaa

SEQ ID NO: 71251 - DNA, 1639 bp, Oryza sativa
cctgatcccgaactcattgttcggcggcagcatgccggcggggcgggcataagacctcggcagtacgtcgcccatgtcggcgaacactgccgccggtcgaacgagatatgctgggctggtctggtcacactagctggtcagtgagcaagttgcatttatatatgtgtgttcagcagtctggctggccaccaaccggccgcgcgcgtgacgtcgtgcgtggcgagcgaatgcgtggatttttgggatttggtgatcgacacagtcggggtgtgtgcttgctgacggacgattggtgatccaccagggttagttagagtaagtcccagagcaaacagacatgacatgttgatttacatgacttcagcagattagagaaccgtgtcacggcttcacaggcgtttataccgtttagggaagaaatcaactgatttgagctgatttgcatgaacctctaggttctgggccttgtgttctggcagaataggccatggcaggacaaatgctaacggaataagctcactttaggtccctcgagttgtcgtcgagtctaaagttcgtctctgaaccgcaattccagatagatatatatgacgcgtctcttaactcctaaaattagtgcaaataaggttctaaggtggtttggacatcgtttctcgatgacatgacgttaacgtggcacttaaagctaaaaataatgtaacacccatacatcagtgtttggttaaaaataaaaaaccgcgaccggacccacgtcatcaacccctatttattctcctcttctatctgttcttcatctctttgtccctttcctcaccatcgactcgtcgacagcgcacgcacaatcctgtcagaaaaccacaagtccgcaacgccgccgccgccattgtcatgtccatatccatctctgcgcccacgcctttgtgacgaaacccattacgcagcatctctgcctccattacggtcgtctccccgtcgaccgtgaccaacgctctccgctccctcctcaacgctggtgtcaaaccgggcggccaccccgctcccatgactctcctcatcctcctcctcccgtctcgccttcccccgcgtggctgtggcgccgccacctctatctggcacatcgcgtggctcctacccgcatgcatgccctccttgcagggctccgctgccacacccttatatcatcgtggctagggcttagagtgagatcttgtgatctttttatcttcgggtttgcatctatttagtcttgattaatttataccataattttatgtatttatagttttattcgcatcattttcgaagatatatgatttttagaaatatatattgcaagtaaaaatatattttattttgagggcataggttacgaagctcgtttatggccctctgaaatttagagccggtcctgctcacaagtgcttccttgaaaattcctcagccctgtaaaatcttgccaatgaaccatccagctcacatttgcatgataataatcgttgatgaatttggcatgtggcaacatcaaaaaagaaaaatcatagttgcatctgcatcatcagagcagaatatgttagtgagtagtgttctgttttttcacaaatagtgagtagtgtacttacgtggtgtttgggaaggaggg

SEQ ID NO: 71252 - DNA, 2618 bp, Oryza sativa
ccgattgatgaaatagatgcagcttccattcaccccaccatctgtcaaagtttttgcttctaaatcctgccaactcaatattatcaatgctacccagagggggtcctggtaggttaagtagtcgatccatcattagagtggatgtgatttgtcctcggcactgaatcttgtcggcaaagaataagccgattgggagttggcccaatccaagttgtctggccgagctcattgggtgataaaactcgtaggagacttggatgtttctcccttgatgaatgccgacaggaaggatgcatgggctgattgcagctataagaacttctctggatttttggaatttttcatgattaatgtcttcaaatctaaagtctgatggaagttcaaggtctgctgagtcttcataaggaaaccagattcgtgcatctttcttaaaaccttcgtagaatctgcagaaccagtccttgagcagctcagccgatagcttcgctccagcatcggttggtgtggatgcatattctccatatgacatgcatctgcgatgggtgcgctcttctccgtcatcttccacaattggctctggcaatgggaattcagcttctattacagagggccgattgacaaccttcatgactatcaggtttaaccaagtttgcaacagccaccatggttcacctgctccaactattgagccgacggctattttagccgatgcattgttcaacatttggtacagatagccgagaaggatttggcccaaaggaaattctttctttgattctaaggcttcggctacaaactgccagttggttgtagggccacaactggatccacagaagaggaacttttccaaccacatgagcaagaaagctacatgctctcgaggagtaacagatccttggcccatatatgccgccacatagccagaccagccacctatacttttggtcttgaagtcaaattggttcttggtgttcatactcatagggttagccgatgaagttacatctaatctagtaatcatggtaatgccgattaaagttggagtcatcagcccttggttgaataagaaagcattgatggtgttggaccagaagtagatggcggcagtcatcagaggttcatccttagcagaattggctatggtgagagcaagcgcttggccgattccaatcttatcccagtgaactttcttactagccgatacgcattggtaccaggtgatccagctcttatcaggagtaggtttttcaagagatggccaagacttgaaggtattcttccagtgacccaggttagggttggctagtctaaaggggatccggttggtttcaccgatgatgaaatcagtggggtcgagattgccgattgggccaagaaaatagtggtttttgtgcgaaaggctgggaatcgcgactaggttggagagatgctacaaatccaaaacaaccgaggaaaagagagcgatataagataagagaaaatcgatctgctgctaagaaaggggatctagccgacgaagacttacctcagcgtactcagctgatggcgcatcagatgggttggtggaggacgacatcgctgcgggcggaaatctcgccgaagatgaagtcgcctggaattcgcttttgcatcggaggagtcgccggagagagagaggacaaagtttcgcttgagcggtgaaaacggaagtcacggtgtgagatttctcgagggtgatggttaatatttaaagcacggcagtaacggtcggaaaacagcaaagtgcgaaacttgcttggagtcgatttacagcaaatccgaaacattaccaaatattccggacttgggggccatgtgttaacaaccaaatttggtaacatcggcgtcaagaaagaagattagatcgaagcgaagtcggaggcggagatcgagttcgaaaacagagcaggaatcggctggagtccagatcggctacgattaggatcggctgggtctgagtcggactaggtaagccgatgtagccgattccgacaatgcaacttgatgtatgatatcgggttgaattgaggcatttcaaggtgattgccgcacatggatagagtcctgagaaggcaattgtatctattaattaggatgttttatgtaatctccttagagatacgcttgggcaaaagtctgccgcaaagacttatggtatcttagagtttgttagagatagtagtcgtgtccgttatggacatatcttgtaattctcgggtataaatagacccgagccctatgtaacttttaacacacacgttcaatacaatttcggtgcatcgccacccttttgctttagttttgtttcgacgagttcttgctttcgggttgagctgcatcggtttcgatcttcagcaagaggtaaaacttattatgacggcttgtattctcgggattagtgcttctatctttatgacactctaatcttgtttatgtaattcgtcgagttatcatatatcttacataatctctggcaatatcgctatctaatctacaatcggctaacatctatcgaagagggcagccgattaggttagattttgacgttgattcagattatataagatatctaccactctatgaaacttccagtggcttga

SEQ ID NO: 71253 - DNA, 695 bp, Oryza sativa
caggtcgactctagaggatccccgacgggcgtggagcatgagaaagaaaaaaatcatgtccttattccctcatgcgtccttatcttcatgcacatgtcgctcttctccccttcatattcgctcctatcctgaaccgtgcctatcattctcccttgcaaggccacatgcccctctctctctctgccatgcacggtgagccagcaccggcctctctccctctctcgcacttcctcctctccgtcccttcccgccgatgcttgggagcagccggatccgacaccgccccttctcatcagcgcttgggagcggccagatccagtgcctcctccctctcctgtatggcgtggcatacggccaaagggacttctctataacagtgagtgttggttacttcacggtgtgcgcggatggactttactttatttttctgatttgttcatcttattattttcctctaatgcatgcaaataatcagtgtaatggactctaattgaagtgatggaatttttcatttgcgccgaaatttgtgattcagtttctttgatttgtgccacgggtggatgtgggatggatggctggtgatatgtggatttgggatgagagctgctcgatgcaacggctcgatttgagccgatatatcaagccgcctttttttttcaaaggtgtcacctgtgggtaccgagctcgaattcgcc

SEQ ID NO: 71254 - DNA, 755 bp, Oryza sativa
tcattgataaggttggaagttgtgttgtagtatatcttagcctcgctcccatgctcgcattgaacgtgttacatgcccttagagaaaaggaccgacctagccctatcgctactcgtgatggctcaggctactacatcctcatcgtcattcgctagtccaactcacgctgcaagtacatcctcatcatcattcgccagtccaactcacgctgcaagaagaagcctgtagctacgacaacgaatatgatgccaagggagaggactatctttaaacacctctagtcgacggatttggtctctctagcctagtcatctccccctccccctaaccatcatgaaaatgccagaggtggagctcgagctctaacttgacatggaggtcgtcgacgaggagcgaaggaagactgccatggtggaggagacgggctagcatgcgacagtaccaaagaccattttctacgataggagggtagtcatcttcgaggaagagaggtgggttggccaccaatctcattgcctagtgcccaccttttcgtcgttgaccgatgagagagagggaagagaggctaaatcaatcaaaaccatttggatagataaaataaatcgattttttataggtgagtaagtcttcatatccgatttaggttgagggaggaaaatcggagtcagggcatctgttgacagaaaacacgaggcctgggagatctgcttaactccagtgcaggtccaaagctcgccttcgggtgtgctagcgtg

SEQ ID NO: 71255 - DNA, 557 bp, Oryza sativa
gagtgtgctcaagcttccaccgccctggttgcatccgccgcttcccctactcggtaccctctctctcttgaagtttttcttcgaggaaacgtttctcgctgtgagtccgatcctggtgcatggttcgaatttttttttcttcctgaatttcttttgggccgcagtttcggcggtgttgtgttccgttcatgattttttccatgtgcgctacagatttggttgcgatgttatgtttcgtgtgcttggttaaaccctaggtggaattcaagaaggggtagagccatatcgaaccctaaatcttggcctgttgagtttagtcatcgcgaccattttcgcaggctggcagcctgccagcgttgcagtccttgatcatgcgctcattttttttcttaaaaaaaatgggctgttttgatggatataaacctagattttgcatatcgccggttcattccgtgtgacctccttcacgtttctactcataaactgatgccttacagtttttttttttcaaaccaagtcctaacttgagtctgattttgcacgcaggttgaaagctt

SEQ ID NO: 71256 - DNA, 894 bp, Oryza sativa
ataactaggggcgtaaaaaagacgacgctacgctacagtacagagccgagattgaaaacgatagagggagagagagggggagggaccccccccttctttttaaaccttttttatgttgcacgcatccagggagaggattggcagtggagagagagagagagagagagagagagagagagagagaggtgtccatagcaagcagagcaggagcagagccaactgcacaaggcaaggcagggggcctctcctcgctgttctactgctgctatactctggcatcgcgtcgcgcgcgcaagcaaaagggtagttcctcaatcaaacgctccaagagaaatcaccccgccacgccacgccgcgccgggctgggctgctgctcccagatctcgccgagcggggcgctcgattatgtgggattaggtagatgagggcggcgctgttcggtgccgagaggagcggggtagtggaccacggcggcggcgataaggaggagctgttttggccggcggggaagggggggctggtggtggtggagccgatgtcggtgctggactgcacgcgcagcccgagcccgccgtattccacgtcgacgctgtcgtcgtccctgggcggcggcctcgcggactcgaccggtgtggcggcggtttcggagagcagcaccgccgccgccggagccaccaaatggggagccccaggcgagcatggtgacggcggaaagaaggagtggaaagacgggtgcgagttgcccccgatacctggagcactgaatgtggggctcgtcgggggcgaggctggacgccacggccacgctcgcaacgcagccgggccggaccagtcgttcttgaactggatcattggggccgccggcgacctggagcagctggtccgcgcttccag

SEQ ID NO: 71257 - DNA, 513 bp, Oryza sativa
tcgccatcctagttctgcgtggtgaaagtgaacctgccatataccataaacaagattctgacccatcttggtgctatacggttcagggatttagcagcagtataagtgtttgtattagtcgtggcaggtgtgcgaaacagcgtgccgataaggacgctgtgccgcttgcgtctctgtacaaaatattatctaataagaataagaagttaatcgtgctcccaagaatggtaaatagaaggattccagaacaaaaatgaatatcaacgcgtctgtttcctcagaatcgtagatgatactatataatgataacaaaatacgtatagtatcatcaacgcgtctgtttcctcagaatcgtagatgatactatacgtattttgttatcattatagtttttttttccttagcgaagattaggtcaacaccaccacattagcgaaaccatctttcaaaactatcgagatagtcaaattgcaccggttccaatagttcgggggtcgagatatccgctattgt

SEQ ID NO: 71258 - DNA, 1998 bp, Oryza sativa
tggtggctgtggctggtccatttgagtggagggtgatcgatcgatcgagctcgcgaagactgaggagaacagcgtgtgcaggtcggtcgggattgtgctgtggcatggatatgcatttttcatgcactatatattgcacttggtgatgatacgatcgaagtggacggatcaaaggacagctcgatcgggatttgtgttgtggcaagcagtggcaatggatgcatatttttttcatgcgcttggtgatgatacgatatgaattaagtggagcaaataatggatatggacttgtgcaagtctgaggctctgatgacggtctgaactatcaattcagtgcagaggtgcaggtgtgatgtgaggcttttctgaaggttttgccttcttctagcacgttttgtcttgttgttgtattgattttttggtgatttggatttttgatacgatttgggagcaattggaccggcatgcacttccgttatagtggttgtagtttggtgattgatctggattcttcttttgcagtgaaaaccccaacagaattgtgcatctatgtttgcgttttggagttgagtataagtaaaaatttcctccatccctaaatataagggattttggttggatgtacatcctaatacaacgaatacttcctagcaaatacttcctccatctctaaatgtttcatgtccaaatttattgtattagaatatgtcatattcaactaaaaatctttatatttagggacgaagggagtacgaagtaaactattggtttacttactgacttactgatagtgttgcaaaattgacagtggtaagtgtacgtgaatgcacgtgtttgtactatatttaaaaaaaagaatttgaaattagtaattacgactatatttgtccatatataaatagcttctaaattgcatatgatccatgaaaatatttttgttattttttattattatcattttaatgtttttaaattcagaattaatataataaatttgcaattgtcatggaatcttaatttatttttcttcattaaatagttccaaaactataacatgataaataggaagtaatcgtaggctcggaattagataatttattaatcctaaattcaatataataaacaccttaatgtagtctttgagtctcaatttcagcatttatttaatttaatttgaattgttgaatacaaagctgcaactcaacttagattctcaattacgacaatttatgatttcataattctggaacacaaattaattaatataagtcgtactctttcttgaatataggtcttacggttggggaatatttgggttcaatattcgcttaattagaactatatgtcgtaacacacccaatatgttatataccttaccgaatgcaccaatactacgctaagtaaaaaaatggggtcaatgttggagtcgtgactatagtacttcgcacgatatgaggatcgttggtaccagtgtatatgcgagattgaagtaaaaagatggaggcaaggatttttatacaggttctggcccttgtttgacaggtaatagccctacttctgttggtcgaagccggtgttgctctttattcatccgaattacacaaatacaatgatttggataacctatctaattgtcatcgacttggcggcatggataaccaactcgtagtcgacgacagagtagtcttcctccccgaatatgaactcgttgagatcagagatggcgctagatccctcttgccggctttcgtaggcaccggattgggtttgtctaggctaatctctgatgtcgatatctggcggtgtatcttggcttgtgtatatgttgtggcttgtggcttgtttatttgtctcctctcctcctagggggcttgtatttatatccatagatgttctcttgtccaagtaaaattaggaagatcaatatgtatacaatctaagtagtacttgttgttttcatgtagaattattcttgtcatttcttattcggaactcctt

SEQ ID NO: 71259 - DNA, 578 bp, Oryza sativa
ctcgtggccgttttttgtcgggtctttctttctctcgcgcacgcgcggcgggtttgagaaaaaagaaaaaaatgagcccgggggataaggatgactaacacagcattcactgaaagaaaaacgtaagaatcgagtgaaagtaaaacattcggcgatgaacctgggcagccgtgtccgtgttggaacggtgtaaggtcggcgacttgacgttgctggctctctttgtggtagtcgaagccggcaggctgcgaaggtgaggaaactgagctgaggatacggccggtggccaacggctggtgtcatctggagcctggaggaagattgagatcgatcagtggcgaaattgatcatctggctagctaggatatgtaggcctgggcgtagaattcgtcccgaggccgacgccgaccaaggcccagtccagttaggatactaggattcactgggctgcgaccgtgctctctcattctcatggggaataagttcactttgggtccctcaatttgtcgcccagtccgattttcgtccctttaccgcaaaaccgggtatgacccatcccccaacttacgaaaaccggg

SEQ ID NO: 71260 - DNA, 3297 bp, Oryza sativa
aaggtttgtcagttcttacatagtcctacaatgcaacattggatggcagtaaagagaattttgagatatgtaaagtcttctgtagatttgggtctgaagcttaatagttcatcttctactattataagcgctttttcagatgctgattgggctggatcagttgatgacagaagatcaactggtggtttcgctatctttcttgggtccaatttggtttcttggagtgcacgaagcagagtacgaagcagagtataagctacagtatcctgttctatacagaagcagagtacaaagcagtagctaatgctacagctgaggttatatggattcaaactttattgaaggaaatagatgttcaaacaccgcaagaagcatgtttgtggtgtgataatttggaagccatgtatctttcagttaatccggtttttcatgcaaggacaaagcacattgaagttgattatcattttgttagagaaagagtggctcaaaagcaattggttattaagtttattgcttctggagatcagattgcagatggatttactaagtctctttcagctcaacaattcaagaattttgtatacaatcttaacttagataagttatgattgaggggggctgttagagataaagtatggtttagatttgcataggcttagagataagtctagagtttgtttctcacatgaaacaatgttttatctcttgtaatcggatccaaactgattcaatcttgtaagccacgttgagggttcttctcaacaacatataaatattcatacgcggcctcgagacgaggtgagaacgcttacgcacttttacagtgttcgtgcgtgccggtcgacctcgcactgttggatatggagctcgaggagaagatggctgctagggcattgggcaagggcatcagcagcagcaacaatggctgcgaaggcggcggcgacgagcccaaggcggcgtgggagatcgacctctcgaggctgcgtatccgccagggcgctcccgtcaagcacggcttccgcggctcgctgttccgcgcggactacgatggccgcgacgtcgccgtgaagctcctcgactgggggaaggaggggttctcgacgcccgagcagatcgcccacctgcgcgcgtcgctcaggggcgtggccgaagcctggcacaagatcgaccaccccaacatcaccaagttcgtcggcgcatccatggccaccgccgacctcaacatcccacaaggccagagcaccgcgccgccgctgccgccgccgccaccggacacaccatgctgcgtcgtggtcgagtacctcaccggagggactctgaagagctatctcatcaagcacatggagcgcaagctcgcctacaaggacgcgtccgcttcgcgctgtcaatggcgagagggctgagctacctgcactcgaggaagatcgtgcaccgcgacgtcaagaccgacaacatgctcctcgacggcgagctcaacctcaagatagccgacttcggggtggcgcgcatcgaggcgtcggacccgagggagatgaccggggtgatgtggacgctgggctacatggccccgaggtgctcgtcggggagccgtacaaccgcaagtgcgacgtgtacagcttcgggatctgcctgtgggagatctactgctgcgagatgccgttcatggacctcagcctggccgacgtctcgtcggcggtcgtccacaaggacctgcggccggagatcccgcggtgctgcccgcgcgacatggcgctcatcatgcggcgttgctggcacgccaacccggcggcgcggccggagatggaggaggtggtggggatgctggaggcgctggacatgaagaaaggccgtggcatggtgccattaggggagaccgccggttgcttctgcatctccctcaggcgccgtggatcatatatcactggtggagaaaccctttgtagtcccggttcgtaacccccctttagtcccggtttccaaaccgggagtaccaatcagggactaaagatcgagctgaccttttttttttttgcatggccctgttgctgcatggtttatatatatatatatatatataaaccatgcatatatatgtttcaatacatatatatgcatacatatatatatgtatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccccgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtattcacaggaaatttgaacttccgcctaagtctttctctccatttgccgcggaccaaatgacggaaccgataccaagccctacatagagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacaatatgaacgtcttgtaatgctgcgccttcaggagatggacgagattgtcctctgtttcttgtggatattggtcgagcattgcgacgtttactttccgagggtcgatgaatccagtatcgaaaaccctcc

SEQ ID NO: 71261 - DNA, 632 bp, Oryza sativa
ccgaatccgatcgagacgaatcgagagagagagaggcgccgcggatccgggtaagcatgctcgagcttccaccgcgcatggctggtcgcatccgccgcttctcctagtagatttctttttctctctcttgatgtggatgctggtgcatttttcctctgccatttcttttgattttttttttttttggggggggggggggagttttggcggtgaggcggaggtgctccactcatgattatctccatgtgtgctccagatttggtcgtctttgccttctcctacgttgcgatcatgcgatgcttcgtgtgctttgattaaaccctaggtagaattcagagaaggggtaaaaccctaaccaattctatttcctcgcctatctgcgttgtaaacttcttctttctttctttctttctttctttttttttttgcggggaaagcgttgtagaattgtggcgtggtccatgtgctcaacctttttttttttttgaaaaaaatagggtggttttgttggatagaaccctagcttttgcatatccgctgatccattccgtgtgacctccttgccgtttctgctcggcccctgataagttgatgcatattttagtggttttttttaacaaccaagtcttaag

SEQ ID NO: 71262 - DNA, 9842 bp, Oryza sativa
cggctcgatctcctggtttggttgctctccaagctgagggactggtttggactttccagaagatgctttcttcagcgttcgctcatagtccgatagcttgatggcctccttgacagatgcagacatacccctgaagaagttcgtgacactagggtctatacgaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctgggggggcccttgactttgaaggtgccggaagaggagcttgcgggggagtaggtgtaggagcacgaggaggagtcggtgcaggatcctgaggaggagttgatgctggagcctgaggtggagacggtgctggcggagcatgaggaggaaacggtgcaggatcctgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtatgcgccttcgaccaactcaacttcgaccttcgagtatcctgctggaatcggcctgcagtggtaagtacctgaagggtccgttgggatggccatgcccgacaccaccttcatgttgtgagagattatttattagtaatcaacatatataagcagcaactagcggaatggctaaatcttacctttattgataagttcttgaaaggaatatgcagctcacatggtatccgctaagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgcccctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttcttttcatcatcgcctgcccttgttcacctgtcttatatgcaacgaactcgtcccagtgatcccttagctttgggaatgtgtcgaagttcggtgtctgccccttcagtatatacttctggtacagatctcccttgaagctctaaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccctactgacaggcacgttatcccgcacaacccaaccgctgtgacgtacatagttcttggcggcttcggccggggcactaggacgtccatcttcttgcacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatctgtcacgaccggaaatcacccaacgggcgttccttacgtgcgtgcattaatccttgtcccaggaggcaaggtacaccaaaagttgatacaattcagagtttaacaagcggaagcgtaaatagttaatttattacatgggcagcgaaggccgagcacacacagagacaaacgagaaacagcggaagactagggcgacgaccacaggcacttgacggcaggcacgagctagacaccaaagccttcatcctccaggaactcctcttctgggtttgggaaaaattgagcaagactgagtacaaccaccgtactcaacaagacacacccacaagtgcaggataaatgcaagggagtacaaaggagttacactataaagggttagggttgcagtaaacagcatttaaagacattagttgctcaaagctattttgtaaacgcgattctagaactaaacaatattatttatcaaggccggtgaacccacacgaacctgccttaacccaaggcgtacgatgattcagaccgaactggcaacccgaccgtgggtcccagctcgtcccaagccaactcaggccaaccattccacattttagttgttaagcaggttttaagaattaaaacactacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccaacccaatcccacctacggccggaacacccgggacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagagggggcggtgtgaatccaattccacaataaccaaaccattccatggtgtccaggtgatatgaatattcccaaagtctagagttgtaaaaccgcctaatgttacctaattaaaagcgaagcatctacctaaaatcatactagtgggaccatgagtagagtgtccactagttggggttttgtttatgctagggtgaacaaggaaataataacaataacaataataaggtcataacaaaggtaaatgggcatggctaaataaaacagtgataacgcgggaatttaaataaagcgataatgcaataatttgaatcaacataattttataaactgggattcaatatgttcaaagatgatgtgacttgccttgctcgctttcccaaacgccggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaatttaaaatcggatttattgtgtcagccgggagagaggagcgcgcggaccgggtccacgggagtggggcccactcggcagcctctcggtccacggtggaccgggtgcacgcggcttacgccggccggcgccgtgggtcccacgcgtcaaccgtaccgagggcgcggccggctgacggccgggccccacatggcagccgcggggcgcgcccgaaggcggcctcgccggcacggccgacggggaggcggcgcgcccgcgccccgatggtcgccggcggcgaccaccagcgcggcggagcggcgcccgagagaggggagggaagggggaagtgaaacggcggtccacggctcaccccgggtcgacggcgacgacggaaacggcgaccggagtggaggaaggcggcggcgcggctcgggtagacgaggacggcggcgttccggcggtcggtgagcgaaacggaggggtggacgaggtcggcgaggtcgcggcgaacccgaagaaggcgatgccgaagcgggagaaggtccggggcgacgacggcggcgaaccggagctcggcggcgacggcggagagggaggacgacggcgcgagctcgattccgacggggagagagagcggcgagtggcggaaaaggaggagggaggcacggggagtgtttaaatagcgttgggagggggagagagcggccggatgagggggaatcggccgcggaagatccggccgccattgatgcgccggcgaagtttgcgggagtgtttccaaacgaatccgagggagagtgtcacgcccgaaaattcacaagtaatttccgaacttatttgtgcataaaatcctcgtccaggaatcagccgaggtacacaaactgacaatttaatatacagattcatcaaattaactaaaacgataaatacttacttatgaggcacttagtcctcatcaagaagaaaactgcagcggaaaataaaatctagcgaagctccagctccactcccacaggcagctcaactggggtataagccaaacgtcttctccttctggatcatttttcttcaactgaggttgattgattattgcaaggtgagcatatgacatactcagcaagccacacagcaaatatgcaagtgcacaaggataccaaaggatggcataatataggctcatttgcaaaagcagcatttagcaaaacatttaagagaagtaaaacagtggagtaattaatcaggaattttaatcaacactgaacagcacacccatgctgcacaggcccgaccatcctgaacaaccatacccggctgtacagatctaatctccaaaccaggaattatccattccaaaccaggagctaagcaaattattaccagttataacatccataattattgtgagaggtgtgggactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataatacaactcaccacagtgcaccattcctggatcataatcacccccttataaaacaaggcatggactccccagcgacccccgtgggcttatctccgccacttctcagtctggtgccccgcaatgaaccatgctatacaaaagataaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctaccattaaatataaccttaagtgatagtgaaacattagttatcccaattgtgtgctaatgtttctaagcatagctaagcaataatatctaatatctagttgaaccaatatatataaagctcaactagtcaaattataatatcccaaggtatcaaggaatagagtaatcaatgcaaacaggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttctgaatacttccggcgcactcgcgaaccttcgcaacgacggaaacgacaagctaacacgcaaaacgaggaaaaagactaataaaaaccaaataaacaatacataaaaagtaaacaaacatgtagatcataattttagatgaattatgagacttgaacggcctcattctgatttcatatgaatttattatgaattttacaagatttaattccaattaaacctattaaacgaagactattcccaattaattaaatcatttacaaatgatttataacggagagaaaagattaaagcaacctccggaaaagattagattatattggtagatgacatatgataaaaagaaaaaggactaatatgccattgaaaagatagaacgaatttatattgattttggacggctgagattaaccttgaccgagtcgactaagatcggatggcttggattgatctggcaagcaagcctcacgagataccgactcaacgagtcaactccacgtgacatgagatcacctaaatgatcaaccgaaaccggcgaacagaaccggcggctctgtacggctctaaactaaaggacgactcaacacggacgaatgaacgaagcacggggaacacctcgttcgaacgaacgagcgaacgactcaacaacggttgtggttaaaccggtcggctagacacgattcacggtaaagccctggtacgacaaacgataggccggtaggaacctagggatgcacctacggctagacaacttggctaccgagcaacggctaaagcggcggctaggtttaaacggcacacagctgcgacacggcggcactaagacaacttgactcggctaggtggcggctaggcggaaacacgcagctagggttagggtgacggcacagccagtagcgaccatgcacggctagagcagcagggctgcgagcaaaaacgcaaccggcacggctgcggctgtggcaaagcggcaagcagctgcagctaagcggctcagccggcacacgcgcagcagcggcacggcaagcagctacgacacaacgacgacgacacacacggagacgatgatgacgctagggccaaacaagattagattagatcggattaaggccctagggaaaacctcacaggtgaacggcaaaggagcggcggttgccggcgaaccacggcacaaacgcaaacggagggcaccgggagcgagaggggatcaaagtgacccttaccaccacttatgcgacgacagacggcgagggagatggcaggcgacgagctccaaaggcggcgaccttgggttgacgatggcgacggctttccggcgacgagaggcaacaaccgaggggcggacggtcttcacctcgctcctgcgatcccgagggtggtgacggtgaatgaaggcggcgatggacggcgacgaacggcgcggctgaagatggaacggatcggcttcacggtgacgacgggcttcccggggtcttcgacgacggggaagtggaggccggtcttcttctcctcctcgcgaacccaacggcggcagcggcgaccgaaggcgacgaccacagcgacggcgcggggctgctggagcggcggccggaggtggagagaaagggagagcgtggggagagggtttcgggcggcggcagaagaaggaggaggtggcggccgaaagaggagaggctgggggctctatatatagccatgggaggccgggatcgagcccacatcgacgggaaaaactcggaaagtttatcttcgccggaaaaaggaaaggatttgatccgcgaaattggaaaggatttccatagaaacttttggggatttcttggggaaaaggaagaggagattgagaggattccattcccgcaaccaatttggaaagaggagcaacggggaggtcggattttggaagggaatcggcggcactgtgcacgagcacggctggctcggctctgactggaggaggaagatggagtactgtagcaccagggaggttaaacagactttggctgggctgacaggaagggagagaggagaggagggaatgggctggattcggcccaagactaggaaggaggatttttattacttttccaaataaattaaccaatgagatgatctttcaattgttaaaaatacttcaatgctcaaataattccaagaaaaatcttgaacatacttggacactcaaagtatttaatataataatatccagatcatttaatgattaatttattttttaaataattgctaaactgttctttgtatcatttaggaattgagctctgaaaaatccgagaaaatttcagagagttgacttaatcatggagaatttaataaaaaattaaatccatccatgctttatatttaggacattttatttcccacatttaacttcacttgtagattaaagatcatgtaatatccattctattaatgattgactaaatagatttatacatcctgaagcgaaaatcaggatgtgacagagagagagagaaaagtggggggaaagggagagggaatcacggggagtgatttccccctctttattgcgtgcgggggcggcgggatgcggcggaatccgcggcggcggcggcgctagggcacgggcgaggcggcgggtgcggcgcgaggtaggggatgacgggtgggccccacccgtcagcgagggtggcgggcgggcccgcccgtcagcggcgcgcgcgcggggaggaggccgatgggccgcgggggagaggagagagagggagggaggtgggccgagccggcccaagagggaaagggggggaaaggacttttttgaaacctttttaactttgtttatttcttcttaattattatttgtgctctgaaaattccactaaaatttatttacgcattttaggcttttaggaaatatacaaaaatcctccaagccttatttgacttttaaatttgcacattttaattgttggaggctttcacatggattttaattattctatgcataattttgaggatgtattttagagtcgttttgggacgcgacagcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactacaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatatgctaagtctaattaagactacaatagtcaattgctacttgtcgcaccaattccgtagtcaataattacatactaag

SEQ ID NO: 71263 - DNA, 13895 bp, Oryza sativa
tatctctctcttttctatccacttagcttagataatatatatgagaatgagtagttaatgcttgtgggtcactctacccttggattaacttaaccaatgcttagaatatgattatcaaaagtaatatataaattattagtcaagttctctctacatgatcttcccacgggataaaataaatgcgatacccttggaatactctcgggtgaaatgctaaaatggtatatccgtgcgcttgcggatgaactctgtaaccataatataccaaaagtatttctgctccattgctaggaattatatttctagtaatggcgttaagaaataccaacaagcatttctggccccgttgccggggaagattcatactagagattacatgaactaatattttatatatacctatgtataatcattttcctttgcaggctaaccatggttgttttcacttttattatgaaacacagggtagtgaaatagtgcttgactggtttcaacttgccggaaaacttcaaagaaaatccagaagctttcttccggaacgtcagaccgcgagtcgctgctccacagagaactctaccgacagagaaatcagtcgtaccagcgccaccaaccttcaagaatatggctaacaagactctccgggagttcgctactccctttgctgacaatgtggccattgggccgcaggtcaacataggggacgtatatttgacttgaagttcagcctatcacgatggcgcaggctagtccgttctgtggcaagcctaatgaggatgccaatgctcatctgcaacaattcctggagatctgtagcacgtacaccatcaagggcgtaagtcccgacgccgtcaggctgcgactgcccttctcgtgagagcgaagtagtggttctatgccaaccgtcctgctgtcaatacctgggataaatgctctacgacattcctctcgaaattcttctcgatgggcaaaaccaatgcccttcgtggaaggatttcaagttttcagcagacaagggacgaatctattccggaagcatgggaacgtctgcaggagtacgtggcctcctgtcctcatcatgggatggacgactggctgatcctgcagaacttttataatggactcaccctgatgtcccgcgatcacctagacgcggcagctgggggagctttcttctctaaaatggttcaaggagccgttgatttaatagagaagatggtctccaatatgggttggagcaaggaacgactctagacccgtcagcgaggcatgcacaccgtcaaggagacggaactgcttgctgccaagttagaccttctcatgaaacgattggacgaccatgagaaatggccacaaggcactgtcaaggccttggactctcacgtcatgtgtgaggtcttcggcggcacgggtcattctgggatgactgcccgaaaacccgagaggaggtgacgtacatgggcaacaacaacgggtaccgtccacaaggaggtcaggggtggacccaaccatgcccatattatcaaggaggtaacaacaacggtaacttttctatccagccctccttgaaggatctcgtttttgcacaagctaaaaccactgatgcgttaagcaaaaagcttgtggccaatgataagatcctagaaaacattaatgtcaagttagatggctttgcctccacttttcaaaactagctgagctttaataaaatgatagaaacacagctagctcagttggcatccttagtccctgcaaatgaaactgggaggattccgggggaacccgactcctccattgaaaatgtcaaggcgatcacgacgaggggtggtaagtccacacgtgatccgccgtatcctaaccctgcaggaactaatgggatatcaaaagaagcgctatctaatgactcggttgacaaggaagttcagccagaaaagacagtgccgcaggagtactgcgacacacggttgctgccgttccctcaacggagtaggaaaccgtcagtggatgagcaattcgctcgttttgttgaagtaatccagaagatccacatcaacgtgccgttgttggacgccatgtaagtgccaacatacgccagttatctcaaggacatactcaacaacaagagaccgctcccaacaacggaggtggtcaagctgatggaacaatgcaacaacctgatactccacaagctcccggagaagaagaaagatccagggtgtcctacgatcacttgctcgattggggcacaacagttcgaccaggccttgtgcaacctttgagccggtgtcagcgtcatgccaaaagacgtcttcgacaagctcaacttcacggtattggcaccaacaccaatgcgccttcaactgccttcaacgccgctcatcctggggcgcccttttcttagcaccgcaagagccaacattgacgtgggaacggggagtatccgtttccacatcaatgggaaggaagagaagtttgagtttcaaccgaggacgaaacaatgttccatggtcaggataaagtacgggctgaacccacagaatattcaagaggtcgaagtggagccacccaaaacggacagcctggtgaaattcatgcagaatttcctggagctggaaacaacgatgcccaggaactgttattggaagacaccggtaaaaccacccacaccggcaagaagctagagcagccggctcagaagaagctgccgtccgcaccaaaaccaaagaaggtgtgtagggagaagccaaagacgcccgctccatcacctccggagacgggtagaaaatccgcaaactgaactggaaggaggtacagtcttgcacgtcggactttaaatgacgcgacctttgccaacaggtaaattggtatgcatccgcatatttgctttcaacaatttggatttttacatgtttgaatttcaaagttgcatttaggatttttgaattttgaggaaattcttcaaattaatttttcagagcaaaccaaaagaaaatttccaacgaaaattcaccatgccacgaccacactgactgttggaatccaacggccgaaagtggggccggttgggcccaccgtaggttcggtcgaaccggccaggaaacggttacctgccacttttggcagggtaacggctagtgggacccacatgtcatttctgaccgttgtgggtaccctataaaagccagccagccgagagagggaattctaccccatttcaacacattttctttccctctccaaagtttgctctcaagttcattaaagctttgatagtttccctcaaattcaaatacttagttgcatatatacaagttgctttggtgaaactaaccggcgggtgaaattcttctcatttctaacccctgccgagctagttcgttcttgctccaatgtgcaaaatgagaaggcgattgtcacgtctgttcaaggggtccggctcttcatcaagtcatcatgacgagtctagcactcgttcatcagctgatgtctcgatggaagacgccgaagctctgcgacgactcctaaacgaaactgacctcgaccttgtcaatgatcgggagagacaagcctactacatgctgagcgaccgggagtatgctcacacgcgagaatactctccggagctgctgaaaaatataggtatggatgttgaatgtcgttctatttggaaagcggttagttggcagagatttgctgtggtagatgagcctggttctcgtttgcttactttgcaatttctgtgcagtttgaaagaaatagaagatggaatttcctttcgctttttccgtaagaagtacacagttacatggaaaggcttaagtactgtcacgaccggaattaacccaacaggcattccattcgtgcgtgtattattccttgtcctaggaggcaaggtacaccaaaagttgatacaatttagagtttaacaagcggaagcctaaatagttaatttattacatgggcgacggaggcccagcacacacgaagataaacagaaaacagcggaagactagggttacgaccagaggcacttgacggcaggcacaagctagacaccaaagccttcatcttccaggaactcctcttctgggttggggaaaaattgagcaagattgagtacaaccacagtactcagcaagacacacccacggatgcagaataaatgcaaaggagtacaagggagttataataaaggggttagggtttgcagtaaacagcatttaaaagacttttagttgctcagggccatttggtaaaaacgatcctagagctactcaatgttattaatcaaggccgtgaacccgcacgaacctgccttaacccaaggcctacgataattcagaccgaactggcaacccgtcctaggttccagctcgtcccaagccaacccaggccaccatttccatattttagttgttaagcaagttttaagaattaaaccactaacttgggtacattgctaggcttgcccataaccgagggcgcggctatttgaatatgttatactctgatcagaggtgtacagctttacccacaaagacacatctttctcacgtgtaaccacgtgccacataccaccacggcatacgggcgaaaaacgtgacatagttcccaacccatcctagccataaacaagagtaccgacccaaccctaactacggccgggattcccgagacaggtaaccaaggttgagcctctagcagcaggacactggcccggtgccatgacatctcgactaccgggacgcagctcgtgtagccttcatttgccctagagatgtccatcgggccccgacttcgtccatctccatccgtgtacctttgtttatgaccagactgagccacaaactaaaccttacccactagatatgtggaagtacggtagagctttgcaacagaggcccgaagaccggtccttatggtggccgaggtgctactatcaaaaccatgcacctcgagtccagcctaaaaccattttgagggttttgaatagagggggaggtgtgtgtccatttcaaaataatccaaccattccataatgtccaaatgatatgagtattcccaaagtctaaggttataaaaccacctattgttgcctaattaatcagcgaagcatctacctaaattcatactagtggaatcatgaatagaaaacccactagttgggtttttattttcctagggtgaacaaggtaataataacaatagcaataataataaggtcataacaaaggtaaaaaggcatggctaaataaaacagtgataacgcgggaatttaaataaagcgataatgcagtaatttaaaccaaaataattttataaactgggattcaatatgttcaaggatgatgtgacttgccttgctcgctttcccaaacgtcgtcttcaacctccacgtagagcggatcttccgaagctgcagcgtctacacgaccaacaggaagaaaaaggcttttactctaataaactccatataacaagctggaacaaagcataaaaatgggttcttgacttcttaaggaaaaattagagacttgaacggtccaattccgagttcaaacgaccaagttatggccatttgaagtttatatgctctttaagtgaatatttacgaatttcttcatttaaattttaattaaaaatatggtttattgcgtcagccgaggggagggggcacgcaggccgggtccacaggagtggtgggcccaacgcggcagcctctcggtccacggtggaccgggtgcacccgcgggctcaccagccaatgccgtgggtcccatgcgtcagccgcacccgaaggaacgggtggctgatggccaggccccacgcggcggccacacggcgcgcccggaggcggccacgttggcgcggtcggcgggaggctgcgcccgcacccctatggtcgccgacggcggccataggcgcggcggagcggcggccaagagaggggaagggaagggggaaagaggcggcggtccacggctcaccccgggtcaagggagcgacggaggaggtggccggcgaggagggaggcggtggcgcagctcaggttgatggggacggcggtgtttcggcggtcggcgagctcggcgaggcggtggacggggtcgccgccggtgcgaaaaacccggaggggacgacgccgaggcgggggacggtcccggcgagcggataagcccggccggaggtcgacggcgacggcggagagagaggacgacggggcgagctcgattccgatggggagaaagggcggcgagtggcggaaacagacgagggaggtgcggggagggtttatatagggttgggagtgagagagcgcggccaacggggaaggaaacagccgcgggagacccgccgccattaattgtgccggcgggattagggggtgcttccatccgaaataaagagagaaagagagaggggaaaatggggggaaagggagagggaatcggggggaatatttccccccattcaattttgaacgggaacggcggagcgcggcgcatttggcggcagcgcggcctaggcgcgggcggagggagcggcgcatgcggagggaggaaggggatgacgggtgggccccacctgtcagcgagggtggtgggtgggcccgcctgtcggcgtctgcgcgcgaggggaaagggagagggctgagtgggccgcggggagagaagagagaggagggagatgggctggattcggcccaagagagggtaggaggatttttagtgtttttctttttataaaaccttttcaactttgtttatttcttgaaaattattatttgtgctctgaaaattccactaaaatttatttacaccttttaggcttttaggaaatatacaaaaatcctccaagcctaatttgacttttaactttgcacattttaatttttggaggctttcactaggattttaattattctaggcataatttaaaggatatattttagggtcgttttgggacgtgacaaacctatcccccttaaatggaatctcgatcccgagattcggaagaactggcgaagaggtcgggatgggctgccttcagctagtcttcacgctcccaagtagcttcttcctcggcgtggttgctccactagagcttgcaaaaacggattacccgattcctggtcatgcgctctattgtgtccagaatcttcaccggcttctccacgtaggtcaagtcttcgcgaacttcaatctgttctgaatcggcctgctcggacggcactcgaagacatttcttgagctgcgacacgtggaacacatcgtgcacattgcctaaggatgcgggcagctccaactggtaagcaacttctccgcgtcgagcgatgatgcggaaaggccccacatacctaggtgcgagctttccttttgtctgaaacctgtgcactccccgtaatggcgtgacccgaagatacacaaaatcgtccactgcgaattccagattacggcgtcggttatctgcataactcttctgccgagactgtgccacctttaggttatcccgaatggttctgactttagcttcagcctctctcagaatatcagtcccgaacacttggctttccccaacttggtcccataacagtggagtccggcatttgcgtccatacaacgcttcataaggtgccatttgtacgctggcttggtagctgttattgtaggagaactcggcataggggagactcttatcccaggacttcccaaaatctagaacacaggcgcggagcatgtcttctaggacctgattcagatgcttggtctgtccatctgtctacgggtgataagcggtgctgaaattcaatcgggtacccaactcatcttggagcttcttccagaagtgagaggtgaattggcttcccctatcagatacaattttcttaggaacaccatggagactcacgatcctagcgaagtaaagttcagctaatttgttccctccataggtggtcttcacagaaatgaaccgagccaccttggttaatcgatccacgactacccatatataatcatatccgccttggtttttggaaatccggtgatgaaatccatcccaatttcatcccatttccattctggtacttgtagaggttggaggagtccggctggtcgttcgtgctctgcattgacacgctgacacacatcacaaagggccacgaactcggcaatttccctcttcatactaacccaccaatattgctctttcaagtctaagtacatcttcgtactgccagggtggatggaataaggactttcatgagcttcctgaagtatcaactgtttaagttccttgttgtccggaacgcatacacgatttccgttccataaggttccgtgttcatcttctgtgaagccagcggctttaccttgtttcatattcttgaggatcccatgcatatccggatcattcttctgagcctcgcgtatttgatcaagcaaggtaggctttgcttccagtgcagccaagaatccatggctaacgatacttaggtttagggcttccaactgttggttcagttccggtggaatgccacggacgcaaagagtactgcaatggccttgtcgactcagtgcgtcggcgaccacgttggccttaccagggtgataatggattcccacatcatagtctttgatgagctgtaaccatcttctctgccgaagattcagatccgacggggtgaagatgtatttcaaactcttatgatcggtgtatatttcgcaacgatttccaatgagataatgccgctagattttcagagcatggaccacagtggacaactccaaatcatgggtaggatagttgccttcatggggtcgtagctggcgtgaagcataagctaccacatgaccttcttgtattaacacacaccccaatccttggcgcgaagcgtcacagtacaccaagaaatccttgcgagtatccggtaagattaacactggcgaggaaaccaacttttctttgagagtttgaaatgctctctcacactgcggactccacacaaattcttcttcattcttcagcaactgcgtcatgggcctggcaattttggagaaattctcgatgaacctccgatagtaccctgccaaacccaagaaactgcggacctgggtgaccgtcttgggttgcttccaatcggtgacggctatcactgtttcgggatccacagcaactcctttagcagatatcacatgccctaagaacttcatttcggacaaccagaattcacacttgctgagcttggcatacaactgatgttcccggagctttcccaataccagacggagatgctgctgatggtcttcctctgactgtgagtacaccagtatgttgtcaataatgaccacaacgaacttatccaggtattccatgaacaccttgttcattaaattcatgaagaaggcaggagcgttggtcagaccgaacgacatcactataaattcatacagcccgtaccgcgtggtgaatgcggtcttagggatatcttcttcacggatacgcaactggtgatatccggaacggagatcaatcttggaaaagacagtggcacctttaagctgatcgaacagatcatcgatccggggaagagggtacttgtttttgatagtgacttcattgagagctcggtagtcaacacacatcctctttgtcttgtctttcttttcgacaaaaatcacgggggcaccccagggggaagtgctcggccgtatataccccttctctttcaactcttccaactgcttcttgacttcggccaattcacttgctgccatacggtagggtcgcttgtacaggggagtggttcctggagcaagatctattctgaactcaatctcctgattgggcggcatactgggtagctcttccggaaacacatcaccgaactcactgacaacgggtatttctgtcagtcctagttgatgaagtactgaactgccggtgggagttgggggtgcaaagaaaacaaccggttgatcaggcttccggtacatagtgacagtacgccttgcgcaatccactactccttagaatcgggtcaaccaattcatcccgaggatcacatccaagtccttggtgtcaagaaggatcagatccgaggggaaaggaattccctggatctctataggtacggccgggctataatactttgctgtcatagcccctctaggggtggtgatgagcagagagttcctaagcctttctacccccagctgatttctccccacgaattgcacaaatataaatgagtgggaagctccagagtcaaacaaaatggtagcggggatggaatgaatgaggaacataccaatgatgacatctggagttgcctgcacatcctctgcagtaacgtggttcacacgaccccgtgtggcatccttaccaccgttgttgcggcgaggaggagcttggccttcctggcgcctcggcttcgggcatttatccgcaaagtgcacgggctcgaagcagttgaagcacagatgctgctaaccttgaacatccctgcgaccttgaccaggctgcacggccggtgcaggaggacggggtgcacggttcccttgctgattctgctactgctgcggctgtgggacgcgtaccacgaattgaggtcgtggcgcggggcgaggttgctgctgctgctgctgtgaggaggatccccctggatagggattgttgtagcggatcctttggttagccacctgttgattacgaaaattcgccaagcgacgtttgtgtaactccagttccttgtgcttggcttccaggcggatgctcttggccactaggcgctggaaatcaaggtaatccccgaagaccagacaaacagaaagttcagagtccattcctgccagaaacttctcctgcttttcttcatcttcacgaacatcctctggggcgtaccgagccaagttattgaactcatgcaaatactccataacagagcggttgccttgcttcaactcccgaaattccctcttcttaagggccacgactccagctggcacatgggtcctccggaaagcggcggtgaagcgggcccaggtgataggctgtccttctggctgcatagcctggaagtggtcccaccatagtgatgcgggcccctgcagctgatgggttgcgaagataactttctcctcatcattagactagacggtgtcgaacttttttccaatggcatgcaaccagtccaaggcatcaacggggttattggagctagagaaggtaggcgggcggatgcggaggaactcggcaagcttggagtgctgcgggggtggtggtggtggtggagcattgtgttgcggcggattctggatgtggtggaggaaagcagccatcatgttggcctgctgggcgaggatttgggtgaggatggggttggtgtcaggtggcggtggtggtggcaaagggggaggtggaggtgggctgccatggttgttgtggttgctgccttcggggtgactgccctcaccggtagcaacgcttgtcctggttgtcaccatctgaaaacactaggagctgatgattaaaaataaccacccacgactaccataattcttgagtttatttctgctattaaattggttcattaaggttcaagctgcttatgcaaataaaataaagacaggctccgacatagttataccacacaccggtataaccatgccccacacgactctgcaagaaaacaaacgaaaagaacacacgcgcgggcctactaactgctcgtctacttctgcgacgggccggggcggaaggtgagtaacagcacatcctccgtgctactaacgccagaggctccctcctcctgaggaaccaagggcgcgggcttggcgcaaggagtctccacgaagcaagtccacgccaaggactgacgaacaagctcaggcctggaggtactcttgcgggcggtgatcttctggctgcggcagacacggcggcgcttggggcggcaggcctgtccttgagcaatcttgagctgatacagctacgctccatggcgtccaagtccttcttcagctgcaaattctcctgacgcagctacaggatcttcatgttgttctcgaccagcccacggtgcaccatatgatggaagtcgatgcgggccgtgacgtacgcctccaccatgcgcaccaggtgcatgatggtagcgtcatcctccgagccagcatccctgaacatggcgtagtcgcgggctcctccacgacgagggtggtagcggtagggcgagtgctgcaactcgcccggatagcgttggtgaatagtgcatggcgaggagcgcggcgttctggcaagcggcggggaaagagtctccacccgcggtgactgccaacgaagtcctctcgggagagccggtgaggatcaccgcagtgacctcccaagcggcgcggggaagcttcttgccctggtagtccactccatgcggatatcccaggacaatgcacatgccccacagttacaaagcgaagccagtcagatccagaccacgacggttgaggttgtcggccatctataaacaaaggcaaaagaaaaattttaaagatcaactttttgatgataaatgaagcagcaagacagggagagactaaaggattttcggaaataagagaagatttttatttcagaatactgctaaggcttgggatctaaggctcgtcctagggtcaaggaggctctgataccaacttttctcgaccggaattaacccaacaggcattccatttgtgcgtgtattattccttgtcccaggaggcaaggtacaccaaaagttgatacaattcagagtttaacaagtggaagcgtaaatagttaatttattacatgggcgacgaaggcccagcacacacgaagataaacggaaaacaacggaagactagggcgacgaccacaggcacttgacggcaggcacaagctagacaccaaagccttcatcttccaggaactcctcttctgggttggggaaaaattgagcaagagtgagtacaaccacagtactcagcaagacacacccacggatgcagaataaatgcaaaggagtacaagggagttataataaaggggttagggtttgcagtaaatagcacttaaaagacttttagttgctcagggccatttggtaaagacgatcctagagctactcaatgttattaatcaaggccgtgaacctgcacgaacctgccttaacccaaggcctacgatgattcagaccgaactggcaacccgacctgggtctgtcacaccctaaagttctttcccaagcctaaattgaagttataaatggtctcaagagaataccagtgtaaggcaagagtaaaccttaataaattaatgcaaataataatcggatttggcatgtggaatttttcttgagttctacatgtcgaaatatgctaacaagatttttaagtggaattttcagagctctagaaataattttaaccttttaaaaatgagcacaagcaatatttaatcccaggaaaatcctttttccttctttttcctttttcttttctctttccttcatttgggccgccggcccattctcctttccccccttcttcccgctggaccggccgataggccgaggcccagccgagccggctgcctccctcctctcccccggggtcgctgacaggtggggcccccctgtcgggcccgtccccttcctccagccggcgccgcaggcgccaccgcaaccgccgccgcgcccacgctcccaccttctccgggccacgtcggccacgcccgcgcatgcgccgcatctcccgcacccactctccctctctctccacctccacctccccacgtcggccggcgaaatcgggccactcccggctgttcccgacctccccacccctataaaatccatccccgcatcctcctcccctcttttcctt

SEQ ID NO: 71264 - DNA, 4937 bp, Oryza sativa
  unsure (1)..(4937): unsure at all n locations
attcctgcagccctccaattaaactcaatgtttttcttgtgataaattcaaagcatgctatgtgcattgaaagagaaaggaaaagttcaaaatcatgttaatggaccgacaaaatgatgcgatctgaatttaaatttttttcagacaggtgaatttaaacattgcactgtacccatgtcacaattgattggcactgagatggtgacatcttctcaacaggcttcctccccataaggagctctagaagcactactccgaacgcgtatacatcgctcttttcagtcaacttccctgaaatcgacatggccgctaaatgtcacataatgaaagtagcatttcagtgtcaataatatagttttgtcaacaaataggagtatgatttgggacgaggaagacatagtaccatccaacaagtactcaggagctacataacccaaggtcccggagagcttcacactccctttgttgacactcccactagacacagcaagaccaaaatctgcaatctgcaaatttcagcaaagtacaacaactgaagcttcaccaaattttaactttgatcccagcactaggacctgctgtcaatatgaacaagatagtttggcctttctgaaaattaaaggagtgtaccttagcattgaagtctgaatccaaaagtatgttagacgatttcagatccctatggatcactggtggactgcagtgctcatgaaggtactctaatcccctgacanaattttaannttttaccagtgcatanttanntaaccagctaatcattcaccaaatcatttttttnctcttaaaaaagagcatcattcagtgtgaaggaaagtggagggataagattataagaacctggccgtgtcaagggcgatcttcatccggatgtgccagctcagagttgatccatgtgaagaccctgaagacaaccactacacatatcaaaagctcccaatctggaaggaagatctcatctcatggaagagctaagctgcagctagctgtgactgtgagtgagtgacaactgacaaggcagagcccaatcatacaggacaataaatactataccatgaagctgtgtttccagtgatcccttctccatcagctcataaacaatgtagtgattcccctcatggatacagaagcccaagagggacacaatgttggggtgcctgatcctgccaagcaaatccagctcattctgccaacaaccacaaccccaaagcaattcagctcaacaacactgaacaccatacttccccttatcaatgggaactgaacttttacggtacaatttactgatagtatatactgtcagtatataggttgcaagtttactgatgggctaatggcattgcgttgtttatactgacagtatatactactactagtaaattgtaccgtaaaagttctcaccaacaattgaccatgaccagcaacagagtcacctcgaattccttctcgcagtcgggcccgccgccgtcgagccgcttcaccgccgcggtaactccggcgtcgaacgccgccttgtagacgcggccaaacccgccgacaccgagcatgttgctctcgctgaacttctctgtcgctgcctccagcgacgggtactcgaacatcccaaccagcctcttcctgctcatcttcaccgagttgaacctgctcaagatcggcaccagcttgatccccttcgctgcgtctgaaccatgtggattaagccagaattgtaattacagatagctcaagaacccaaaattgggtgagcgattgaatgagcggggttaagatcgacctgagctcctggtgaccttgccgccggtgctccggcgagatcgccgccatagtgtccaagcgtagagcgtggaaaggaagatcgtgacggtggcgatgcaggcgaggacggcggcgatgaccagctcgcggtggaaatggtggtgcactacgatcactgcaagccagcacaggtagcttgagacccactaagtaggagtaaattaattggacatgaacagatgcgccatctttttttttttttggtttaatctttgaaacggccttgaatcctggaaagatttgatgacagtaaactctaacgaaagaacaggtacgattgcattaaaacacgcagcgagatttccgcaataacgttgatgccacgtttttccccctcaaatttgaacaaaacgtaacatcccaaaatgcagattttgagaactcaaaacaaagaagattttctttttgttcagctagaaataaagcagagttgttggttcgaatgcaggcaacacaatgtcgatccccccaaaaaaatatatttctttttgccatcaagaagaacagtgcatgcttaaccaaatctgcagagaggacaaactctgtaaagagaaacagttccaaactcgaaaccgacaaaacagtaagaacacacacacacaccaaaattctgaatttcagctttcagcaccagcaacgtacgtaccaacaggcggaggcgccggaactgccgaagacaaggcggccgtcccattggcggcggcggcggcggcggcggaaatgccggtggccacagtagacgtcgccggagaagaagaagaagaagaagaagaagaagaagaagaagaagaagaagaagaagaagaagaagaagaaggcgtatccctcccattggccaacgagcacgaagatagcaccaagaacaagacggacgaacacaggagcggcaatggagttagcgccatctccatactctctccctttctgctgccctctccaggagaccaggaactcgaaatttcgtactgcctttgtggcgatggaagggagacggcatgaaagtgagaagaatctcaaggagggaaaaagaaaaggaaaggagtagtgccactactagctagtatcactgccctatgctgaacctgccgccactatttgtctatggcaatggggttctctcttgtgtgtgtataggttgctgccattttattcggtgtgctgtacgtgtgcacggacggcagagcaaactggtcgcgtggggccagtttgacagtgagaccagccatgtgcaattacgagaaggtggcggggtcagtcatcagtgtgtgtgagagagaggctgcaaattgtgaatattgcatctgtggagaggacaaaaagaagaaaagaatcgccttgttttgttgtgttcttgtgcttggtttgttcagatccattgcctggatgttttcataatttggtcattttcgaaaacttattttacaaatagatccctaaaaaacttatcccagaaataatcatttttgagcgtcagagtcgctggcactgctatccaacgggacggcgtcggcctctctggcaccaccccttgccaccgtggcggtccgcgctgacgtggcagtggagcgcgccatgttggtgtcggctcccctcccacccacggcgccacccactagtgtagaggaaagagaggtccaagttttttaaaattttttgatatttttttcacacttaggagcacataggaacaaaccatagaaaaaattagttcaaacagacgaaatatgttacttgtagaatttttcaaagttgtatcgaaaagcttcttacctcgaaaacaaaatcttccaagtggaattttgagattctgatttcgctgaacccgacgaagcagagagaataggatgaactttttatatagatgtccgtagatatataatttgcctgattccgagttaatatgaaaaagttatatatgttttaaggaaggacactcgaatataacaagtaaaaatgaactcaacaaaccctaactttttttataggatgtaaaaaaaaggctcaagagtttataggattacggaaatcgaatctactaattttttccgactatagaaaaaacaaaaacaacaaagaacagaaagtctctcaccgataaatcttagtgcatttaaggagaggggagagagagagagagcaagagcaacactccgactcgcgctgggagggtgctgggggagggagcatcatttggcgtgctccccctgctacgtcagtatctggccgccgtattgtgccacggtggcaaggggcggcgccagccactcttgcgttcaaaaggaaccatttctgggataatttttttaagggtttatttataaaatatgattttcacaagtttccaacgcttaactcattttcaccggatatgttatctttgggatataatgagaaatggatatttaaccatgaattatttctataaagctatgaaataccaagaaattaactttgtgtaaaaaaattgggggcttcaagcccagttgaaaataaaaatcgctatgtgtttaatgtatcatgtacacctaagcttttcgtatacacataggacacaccaactaataagtttcaccgaagaatctagaaaaaaaatatacatgtgttttttaatatcattacactcatgggtaaagtcttaacatcaaattcatcatattttagctataacaaaaaaaaattgacagttttaaggttataaatcgatcagaattttatcttttttgtgctccatatatatagaatggatttgaagataagattttacatataaatgtgatgctactaaaagtacatatatatttttttctaaaatttaatttggtaaagtttgttatttgttgtacatgatgtgtacatgagaaaacttgtgtgtatatgatatgttcctgtttaaaagggaatggagcgaaaaagatagaaaacacaaataaaactattcaaatctcttaattgattgtccagtggccaaactggtccgggaatgtgatttattgtaaaaagaaaaaaaaaacagtgaggaatgcacatgtttaggaattaggactggctagggcgagtttagaaggaggatttggaaacccatcctctccggcatgtaaaatgga

SEQ ID NO: 71265 - DNA, 2212 bp, Oryza sativa
catactaattcattatgtatgtcattattagtatttctttgtggtatcgtttacacaaacagaacgaaagcagaagaaagctgctgtgagggggtcctgttacaaagacaagtggtaaatgtcatcttttgctcgagatttggacggagggtcaacatgaagcggctggagtagcagaagaggaagatctgatgcaatcatggcttaagttgcctcctttcaggtcttgtgcttctatgaggtgaaaggtgcttttgcctgtatgtttctgcctgttttgctgagaaaggtgcttttgcctgagtatgaaacttgtaggtctgtggtgatataaggccatgtacaacgttccaccctatcatgtggtctaagcctccacgtcggagccgagcacccatggtagtgggaaccgtggttccatgaacccttgccgtgcatacctgcagaggtcacagttacctcagcgtgcttcagctcaagaggtgtgaaaccacttctcgggggtcacgtgttggggagaaccagagcctcgtgacgcgcttggggaaaaggagaggtcgagaaggacttcccgtggtcgtcgtcgccgctcaccgccaccgttgtggtcgtgtcactgctcgccaaatccgccgctgccagatccagcgagctcgtggccggattcggtgagctcatggccggatccatcgccgccggtggcccctcaccgtcacgagaagggggtgggaggggagaggccagccgatgtggccagatccggcgccgggatcctccgccgccaccgctcgcagagaagggagggggagaggccggaggtggaagaggagcactgcagcggtaaatggagaggagggggagaggcgccactggcagaagaggagtcgccggcgttcggatgcggagaagaggaggtgacgcgaaaaagggaaggggtgcctatgatacgaatagagtgcggtaatggagagaagaaggtgggtgtgagaggttaacagtgggtccatatgtagattagaggtatccatgttttttttatatggaataaaattgttaatcttataataataaatattgtaagggctgacatataaataaccagggtcgaaacacaaaatatactcaacagtagtctccattgtagattgtgtggcttttatgtgatcttatcctatttggtatgttgagacctctattgtacatgccctaagttaacaaggcttggtcctgctcctcgggtgatttttgtctgtaagtcatggggtgtctagctcttgtgaagggtgggatggcacctgacacaatctatctagctgcggaattttttttaaagaaacacaatacaagtgtaggcgttcaaacgcacacatgcgcactctaccatcattaacattttctaaaaactgagtcgatattaccttaagatagacgaagtctttatatatgtctcgcaattgacaggtacgccacttaccactgaaaaaaataattatctttaaatctagatgggtcaattccaccataagaaatcaaaccaattaacctatgttcacttaacagtcagtcgtcaagttaaaaaaagaggaaaacggtgtttttttttctccttttttatataaggtttacatttctattaatgaaaatggggggctatgtccttgataagaaaattaatttatgttttgcatatttgcctaaaaattccaaacactcaacagcatcagggagtactacagtagctgttgtacaagcaagtgccaggataagctaagcaccaaaagaagccgacctaataacttcgctacagtaaccatgagaggactcccccatcccccgagcattatctccacacccgtctcgtctccttgtacgttaatccagcatcagctctgtgtgggtcccacctgtctgtcactcactggccaccgacaaggcaacaaccagtgacgtcgtcctttggtaaattgttgcaagaagaagcaggggaccgacggcactatttgcctttcttctgttatgatcataacctattcctatcctatatcctatcacaacaacaaactacggtactttgctcatcaagaacgaaataatgggatcgttagtacttagcacgtattagagtgctactttcttccgttcatcgaccatcgtatctagaaaaatggtcggcagcgcataattgatcaccatctgtgtgggctgcaggaat

SEQ ID NO: 71266 - DNA, 14247 bp, Oryza sativa
tcgagcgactaacaatatgacagagtacgagggactccttgccggactcagagtggcagctggactggggatccgccgcctcttggtattaggcgactcccagctagtcgttaaccaggtctgtaaggagtaccggtgctctgacccacagatggacgcctacgtacgccaagtgcggcgtatggagcgccatttcgatgggatagaacttcggcatgtacccagaagggataacatagttgccgatgaactctcaaggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcctggatctctgagatccaaacatacctcacagataagactctacctgaggaccgcgaagggagtgaacgtgtacaacgcatttccaaacgctacgtgctggtagaagggaccctctatcggcgcgcggctaacggaatcctcctgaaatgcattcctcaggaacaaggcgttgagcttcttgctgacatccatgagggcgagtgcggagcccattccgcctcgcgtaccctggttggcaaggcctttcgtcaaggattttattggccgacagctctcaatgacgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctctcaaattcattaagggcatcacggcccgttttggagtacctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgcagagatgacctctactacttagaagagcgaaggcggcgcgcggccctccgagccgcgcgctaccagcagagcttgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggtgtcccccggccgggctcggtacggctggccacgggcgacggcacggagctgccaaacccgtggaacatcgaacaccttcgtcgcttctacccctgaaagggggggggtcgggtgtcaggttttggctcgggccaaccccgcacccccctcgggtgtgcaggattggccgggggctaccacacatgcacatatatccctttttcctttatttcagcatttcaataaaagcagtttcaattttctaaaggttgtgtctgtgccgttttttccttttgaagaatcttgacttgaaataatgtcactcgtgctcaaccttgccctcgggggctcggttcggtcagctaaaatcgccaaacggggcccagaaccgagccgtgccccggggcgtggtgaactccgggggggaatcggcaaaaacccacaattgggtcacccataaccctcggtcaccacgttcccggcctggccagtctcgacatgcggatctccccaggcactagccccgacccgcgcttttcgaggactgggacttgggcatgggcccttatttcaagctaagacgcaaaaagaccacggcacagatcatcctcatctcacatatagcaaaataaaactaacacaaaaattttttcatcatttctcattgcagattaagttaaattgtacaaaaaagaggcatgaaggccttagaagaaagaacaagaaaaaagttaagattggcgggggcctgggggctcattcaaatgcgcccgggtcgccggcctcgtcgccaccgtcgtcctcgccgctggcgtcgccctcctcgtcggagctgggggcgaacgcgagccgaggggccgagccctcgaagccgttgacgatgtggtcagcagcatccccgacgcgcgcgcgcgcgtcgtcctcggtcccgggagggaactcctccagcgccatccagggagagaaattggggtcccgggcctggtaactcgctagcacgagttcaaccgccccccgggcgaggtccctcgaggatgacttgatggtcttctcgagctcctcggggagtcgttcgaggacccaggccatcctgttgaggtgcggagcgaggccttccagattggtggggggcaccgtcgtctggcctctccagaggcctgcttgacgaccggcgcgcttcatgcgggagaccgcatcccaaagcatgtcgggcccaatctcgcccgccaagcgaagggcctcggcctccccggtggaggagtccagcgctcgctgcatttccgcgacggtgtgttcggcagctgcgaggcgggcggctaagtcgctttcgcccgcggccgccccgccgataggcgcccttgcgtccagctccttttcccgcgcctcgaggtcagcagcccgctgctccagtgtggctctctcggcgcggacgcattcgagattgcggcgcgcctgctcctcctgcgccgcctcgcgaagggacaggctgtccgccagccgtttggtcgtggcctcagcctcctcgagagctcgctcccactcagcgagtgcgtcctcgcggaggcggagcgcgcactcctcctcggcgcaggcggcctcatgcgccgccagcgtcgcctctcggagaccagcggcggcctcgcggtccgtcaagcccctctccacggcgccggcgtgttcttccagcgccatggcacgggcctcaagggcctcctcgcgccgctgaaacgccgcttcagtctccgttacccgccgctctcgggcagcggcggagtcaaggaccccttgggcggcgtcgagctttttcttcagctccgcctcccagcttgcgtgctgaaggcggagagtgtcttgcgcctcgatcatcgcggtggtggagatgagggcggccgcccgctcctcctccacctcacgggcgatctccgccagcgccgctttccgggcttcaagctccgagacatgacggcggtgagccttacggcccacctccaccatggcgtccaccgagcgccgcccctcctcaacacgcgcccatgcggcctcgagctccgctcgttctgcacgcagggcctccacttgggtgttgaacccatccagcactgcggtgtttgcggcggccagggcctgcagaaggggctcggcgctcagcggggcgacagaagatgaggagaagagccgccttggagaaaaggcgacgcggcttggccccccggaggatgcgctgggctcggggatgtcccccgggcccgtttggtcctgggcgtcgcccggtgaggtaggcccaggcgatgcgcccgcggcctcgtcgcgagccgcctcggaggatgtcgcctgagggccgcccaagggagtaggcccaagtgacgcgccagcagcagctgtcgcctcagcctggcgagcccgggcggcctcctcccgggcagcttcttcggcttggcgagcccgggcggcctcctcccgagcagcttcctccgcttggcgaacccgggcggcctcttcagcttcccgaaggcgggctgcggcttcacgccggtcagactctcgcctccgctcctctgcggccgctggatcttcggcctcggactggccggatttggggtggcgggaggaatgcgacgggacatcgctgaagcagaagaaaaaaccaaaagacgaacaaaatgagtaagaaaaaacttctctttgggagaaaggtggttgcaatgagagtgagacgaacctgcgagggggtcggttgaatgaccaccttggaggagaaatcaggttcccccggcatggttccgtctcccccgtcttgcggagccgtttcttcttgcgctccccctcgggctgcgacgtcggcgcggccccctccgggcgccgactgctggcacgcgccgccccgccccctcggggaggagatgggggaggtgttcctcccagcttcctcttcccctgggcgtcggcagggcggctgctccccgagcccccggcgcggggcccagaagcacgaccccctcctggggcagattgttcccctcggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccgcggagctaagattcagcaccctttggaccacgatcttgaagtcctcgggagcccaatcccatctggctccctggtgggtccgcatgtagtcttcaggcccagtgtactcccaggcgttccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggtgcccgccagctggagacctgcgccgggggctggcttggaagtcggaggcgcgcttcgttggcgaggggggtgtagaaccagtcgctcttccagtcgtcccacttcttgcgaaggacgcaggggatgtagcggttcaacaccggcccccgcggctggaagtagcagccgccaaccaccgacggcggtgacaccgactgcacggtgaagaaccaccggaacagctgaagagaggggcgcaccccgatgaacatctcgcacagatgcgcgaagatggccaatgtcatcaccgcattaggggtgaggtgcgccatctggaggtcatagaactccaggacatccatgaagaaatgagaaaatggcgggaccagcccagccatcgcaaaggggaggaagaagatggaccgccccgggtagtctggtgccgggcgcccctcgcccagcatcactatctcccgaccggtggcggactccggcatgaagcggcgcggcagtccggcgtgcctctcattcacgatgcgggaaggcggtagtacactgccgtcgagcagagcagagccccgtgccatggcggcggaggaagagatgattgagaacgagcgcgtgtggcgaaagtagggcgtagcagagaaagagttagagctcaggtggcgaaggcaagaggaacaatggcgaaaggaaggaagcaaatccttttctcgatgcttttatacccttgccatcgctgggcctgactcctcgtttctcgcgcccactacctcgctccctcgtatctcgctatctcgctccctcgtttcccgtgcccacgcttccactaatcccattcgcccgcttgcggcgcattgagtggatatgcggttgtggcaatcgaaatggattgtatcgtgcgcgcgttaattacgctcgccgaccgaagcggcgttaccatatctccgggcgagacaaatctgctcacccagattcgcgcgctgctcaagtggcgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcctgatttcccccgaggggggggggtctggttgcgcttgccccggccccgagggccgaggcaccccgaccccttaaggaagtctgcgccacatacatgggataagtgatcacagctgtgctcacctaacagcatttattgcagtctggtcaagcgtgtcacgctgcatgcaacgcagtacagcgcgtttctttatccggtctgtgaccagtcacagaccggtcagatcacgggttaggtggcgactggcggtctgacgcacgccttgccccatcccgtcaagacgaaagcctctaggcactcgtctcaagctggagctagcgtgttatctcttagagatggcacgttagccctggtcagatttataccaggcttcatcctaaccattacaggcaaggtgttacacgaagaagggcaaacatgcacgttgttaagctgacgcgtggtggacaagaatgaccggtctggcactggtcgcgtcagcaacgggcagccacgatcccacgttgcgcctgtctccgccgggagtggaggtaggtgtgggctgtcccatcggagtgtcattcggacagcaaccataccaatctccgtccataaagagaagaaaagtccagtttggaaagggaagggtgcatgtggtatccccttgaagtataaaaggaggaccttgcccatagagagggggggattcttttcgagatttagagcttagaacgggggatttttggtcctttcggaaggctgagaggaaaggaagtcgatcctttgtaacttgtccatacacaaatccacaaaaacacaggagtagggtattacgcttcgcagcggcccgaacctgtatacatcgtcgtgtctcgtgtgtcttgcgggcagacgatctttccagatacagagggagagcgagagcttgagatttcaccctaagcccccggccgaaccggcaaaggggggcctgcgcggtctcccggtgaggagccacgagctccgtcaccatcacatcaaaattttcctacacacataaacttttaacttttccgtcacatcattccaatttcaatcaaacttctaattttagcgtgaactaatcacaaccaaacacctgttttcttggtctttttttgataggaaaccatgcagggaaatacactgaccgacacatgtaggaaaggaaatttgtcaaatctatacctaataaaaaaattcttaaggcttccgtcattatttttggtccgtcgccgatttcccacacgcgcacggcggtttttttctgtccgtttttttttcgcgcggttttttttgtccgtcagggtttttttcgcacgcggttttctgtgggcccatccaccttttttttgcgcacacgctctttttagtgagtccgcctttttttcaatgcacgcgtttttttagctgtccgtctccagttcccgcatgcggtatttttgggcccattgcccaggaattacaaattcagtccagcacataaattacatagaacccaaacataagaattacatgaccgattaggatacaaacaacttctcaacctatatatagaataaaactgaaagcacaaacaagactaatatatgcacccagaatttggtgtggaactaagcaatctctgctcggcgctactcatatacccagatatttttttgaaactgagcaattcatgttcggtgtgagactcaatctgcttttactgcatttataacgataaaaggtaattctttagaccttaatgatgtatacattatttatgacatataacgaacaattaacataaatcagtcaatcttaagagggaaaaaatacatggaaataaaactaccaagctcagcaaggtaacaccagattgatcggatctcataccttatttaagaggcaaccatcttttattagtaattctgaagaaaaaaccatccatcttctattagctaaaaaaaaggggagtagctatatttatggcgccatatttttcaccaaaaaatagtcggtgtgtatttacatcgtaagtttataaattacatatgcaattttattgtatttacaatgtaagtcacaaacttacatatgtaagtctcaaaattacatatgtaagtctcgaaattgcatatatgtaattaatatataatcatctctcatcatgatgtatgtgtggaaataatcttcaacctcacggaagcacagttgggaggcctcaggcctgtgcggttgtgtggcatagcgcataggcatgcaaaccgactgtaatcaatggaattttatggtgccagaaatttagcaaatccaaaaaaaaattatcacaccaaactattaaccaaaataataccactattacttcattatatttttatttgctacacttatttctgatttcggatgtatagtctgccaaacaatttcccttaactacgcgcgcacacaaaagaagacctacgtataaagtttaaatgtttggcctatagcttggtgttttgtgtacataactgttgcttgagttcccctattacttcctagggccataacgtgaaaggtatttcaaatagcataagtaaagcataaaaaaaaacttaacagtatttgcatatagagaacacataaaagaatattatggaacattagtaaaacaaaacaataacgaataacttgcctagaaaatcaagtggaacctctatcgcatatcagaacaaaagtttctttagatcaagcatcatggcatagcaaactaagacatgaaatttttggtactacattggtacatgtcagaattgagtgtttccaaacagatgaccaatgaagcatgcacatcgcaaccaaaacagagcaggaaacaaccatgtgatcagatattacattggaagagaaaaaaaaattggttgcagtagtatggctgtagtttgcacaaaattgataactgaccttgctcaggcaagctatctcaacattgagatagaataatccccaccaaaagaattggtgtattaattgattccatcgaagtccaacacatatataaacacatcctgcggctcatttaaatgaacaaaatcagctgaaaaaacataagtgaatgattaaattatttttgcttctcaccgttgttttcgagaagatacatcatgcttttgttgttgataatgtttatgtacagcttcatcttccaagctagatgcgccatctggatcatcgtccccattcttagatcccaatacacgaagacagagacacaaagctgtatgcgcaaaatgcctgacgaaaagaaggaatacttaagaaacgtcatgacgcctataagcgaaaaaaggattcaaatgtccttccaaatgttaaggacgcacattgcattaattatgaaggtgatcagcaaagctcatcgcatgctaaatctaataaagttaaacaatatatgcttcaagtttttttactaacagataatttgacccctctaccagaccagtttcaccatcatatgtagtcacaatgtactcatgacttcagagagaagcaaaaaatcacttctaatttttaattttgtgatgaaaatatactatggatttaacgaataaattatatctataacttctagctcattacaaagaataactcattatataagaatgctgaccaggttagatcatactgtacttgcatcaaatacccagattattttctaaaaggaagataactttgagttaggataaaactaaaacacattacattttggaacggtgggagtatcagagtgaaaatgtaatgctgagaatcacaaaaaataatacttgaaacaaataaatgacagtggattcaactctcaatttagtttaagcaaaggaaaatatgtaacatgggatgtaaatgatattataaacaacataaaagcatgatcacaaaactgttgtccagcaattccacatttcaaaacacaagctcagataagaaccgtattctaatttctaagcaaccggattactactatacaagatgatcccaaaatttcacatcaacaacatgatatattgtcttaaaaaataaagcacctgggaggcagtggctggaactgacggcgagtcaaggacgtcggtcgttggcaagcacggcgcgggccaactctcctcgaactcagccggccgcagcctggcctcgaaagaaattcagtataatgcggacattgtttctcccgtaaggcttgcctatcagcatagctccagtgagccggatgatgtttctgaagatctgaagaaatgtagattaatacacaactagattatctgcagtgtatgtagcttggacactatgactacataaggagtgttgtcaaacacggttctccaccagaagaagcagagacaaatctgatgagctaatggaatgtggtgaaccccataaggacttaaaaagaagttgcatcctcaaatgcgatgtgcttagcaaccaacaccgggtcccctgacttatcggtgaaagcacaaaccaaaagatagcaccaagtatcctggatagaagagaaaatcaaaagaggatgcagaggaaagtgtctggatgattgggttgaggactcacattggcgtcgttggactggtagatggtgacctcctcctacggcggcgctgtcagatcgagatggatgaggaacgcgccagcgccatcagtcgctaggataagggatgccggatccagatgctcgacggaggtcttggcgaccacctctcgccaccttcgcctccatctcatcgaccgcccacttcttcattcttcacccaccggaccatgcgcctccccttcatatcccttcctctagcgcctcccaccgccgccgccgccgccccttatcgcagccatcgaagacggcgtgggggagaaggaggcagcaggggcgggggcggcgtaggggccgcgcgtgcagaggcggcggcggtagggaggccacgaccacggtagaaccgccggatcttgaccctcccgttaacaccggcggcggatctgcgtgagcggggcacggagagacaacgggatctgagcgggagaggaacaggtcgccggatccaacccctcccgtcgcagctgatgacggatctgtgcgagaggggaccggaaagacgccgcatcgaattcgccgtcgccgtcccctagcatccgcgccgcccatacacccatcttaccgatctgcgttgccaggccagttagccgccaccagaattgccgtctccgaccccgatctacacctggacgccccccctccttgcccccgtcagccggcttgaagagtaacgagagagagagagtgggagagagagagaacgagagagtgagagtgagaggataaggatctctaaatttctctccaaggtaatgtacaacaaccatctttcttttcttttcttgaaaaaaattacggtcaaattgtgctaatccatggattcaaattgtacaacaaccatctttcttttcttttcttgaaaaaaattacggtcaaattacggtcaaaaagaaaaagggaagaacatgctcgcgaagctccggcccctcatggcgacggcggcggcggcggcggcggcggcggcgaagccagctccggctttgtcgttttccacggcggcggcggagggagacgaacacgcgcactacaaccacaccgacgcgtgccaccacctccggtggacagccaagtaacggctcccccccatcacttcctccatcgtctagggcttatctgcggcttggggcttgattggtagtaactgttttggttttggttgggcactgcggctgcggcagggagagctacgagtacatgtacgcgcggccgtggagcagggtggtcgacttctacgccgagctcgtgcgcaccggcgccggggcagcggggctcgccgatttgtttgggaaggatgaggtgagaaggaatgatattattattttttaaataattatccatgtgaaaccctgaggtagtggttcttcgcattcggtaaattggaaggggaaaatgtgttagtgttagttgcaattcctcttagtgtgccaaatgttggtactttccccatctaagtagtacacattgttttagagaaattgaaatcttttgggtgaagacatttttttcttggaggatagattaagattttggaatttgtcggtgcaggcctgtttctagaattatccatgtgaaaccctgaggtagtggttcttcgcattcagtaaatgggaaggggaaaatgtgttagtattagttgcaatttctcttagtgagccaaatgttggtattttccccatctaagtagtacacatcgttttagagaaattgaaatcttttgggtgaacacattttttcttggaggatagagtagattttggaatttgtcggtgcaggtccgtttctagtacttttagtttgtttcagtaagatttatcggatttttcttcaacagaatggttacagccttgatacgaatggagaagattacacagcaccatcagaaaatcaaacatcaactaaatcatccaaagatcgaggaggacgatgggaaagagtaaccttcaagattgtcctttcatatcatggggggtcatttgatggttggcagaagcagcctggcctcaacactgttcaagggtaaggataaataagaatggagttatgtcatttctatagacatatctggcacttttattcttcacttcctttgcatctcaagacagatgacaggataaaaccatttgttgcactctgtatttcttgcaggttagtagaaaaacatcttggccagtttgttgacgagaagaaagctaaacagcttgaagcaagatcattgccattagaaggctgtgctgttgttgctgggcgcacagacaaaggggtgactgcccttcagcaagtttgctcattttgttagttgcacctgagaacacactattgttttccagtggtccttcaactaattatccacttttatgaacatgtcatattacaaactattccctttgttccaaaatttagctacctttccacctctcaaccaatcgcaccaatccccatttagtttctccacctacttcctcatctcaaccaatcacaacatccatcatgtttacctttttctttaatatctgtggccaactctaaaataccttatattttgggatggagggtctacttctcaagaagagcttatgtgcagttattttgtagagtttttttttttttggttgaaaattttgctttgtttacagaagcatttgaacaagtaatttgcttctgattataaaatcattaacacaacaatttgtcaataccaaatacaccactgttttcctatcaaagaagtaatagcctggagatatagcagtgcagaactctggcctacgtgcaatgaactgctaaccttcttatttgactaactccaccaatgcatgccattcatttcatttgatatgacatgaagaactcatttgcacaaataaatagacaatccttgtgtacttatgtgagaaattaactctaatggaatgctgagatacaccatgggactagatacattacttctcctgatagctgacatgtgtatttacttctaatttccttagatacatggaggaaggatgtaaagtctagtgatataaaggatgcaataaacaaggctgcacctgataaactaagacctttgcatgtgtcacaggtatttttcttttgctttttcagaatatatgactgcacttgatatgtatgctgcattgctgctagtggtagaattgtccatttttcatgtaaagttcttagaatgtcaagacatccaccatgggtgatgctacgcttgttattaactgatggcataatttgcaggtctcacgtgaatttcaccctaattttgcagccaaatggaggagatacctgtatatatttcctcttgacgaggatgtaaaactaatctcaggggaagaacagtccgctaaaacagtagagggtcctgagtgcaacataaaacctc

SEQ ID NO: 71267 - DNA, 5140 bp, Oryza sativa
atccatcaactttcagccacgaaaaatatgaaaagattgatatcttttaagaatccagcgggtagtctacggttctagaatctagagcagggcagaacgagtgagcgacccagctggctcgtcgttgtctcggacctgctaggccgcgttgcgaagcagaggtccagaggcgcaagccggggtgaaaatggaaaggaaaaagttcacttaaggtcccttaacttatcaacgaatccgatttcatccttgaaccctcaactatcaaaattaatgcaatatagatcccatgatggtttggactcaaaaccaatacaatatagatcccatgacggtttggacggcggttttagttgatgtggtggctagtttgactcggtctttatctcacgtggcattgacgtggcgattatgttgcaatttgatctggaaaaatgaataaaaatcgtgggcctacatgtcagttaaaataaaaataattaaaaatattagggcccacatgtcattctcagtccctcctcttctgcttcctctctctcgggcgatcttcttcccccggctacaagtccggctattagtcgctgcacccaaaactgatcagagttgaatgtgatcaacagtacatatgaaatctcaagcaaaaattgaagcatcccatcaagctcatcgattcagcgcctgcacgacttccgtgctagtatccggagaaggggcgacggtgacacgctggaggacgcggcggtgctcggacatagatcttgctgtatggaggtttattaggtgagctcagattgtacaggtcgtaataccagagcttgcatccatattcacttgagtatgcaatgcagtagcatttgttcaggcaagcttctctgcaatcttcatcggtgtcacctggttcgtcctgagcgttgtaagggagcccttcgagattgtcaagaatagcgaaggagtcgccgtgctcgttctggccgttggcgtcgcaggctcgcagctcagtgggagagacctcgagcagccggtgacaaagtagccgagccgccccactccttcgtacgtgtccgacagcttgaaccctttgacgcaccggcattcgccaccggtcgacgtgcaggtactagaaaaatcatttttcccaatgtaggtgtcttattttcgcaggcggacataagcttgggagtcaaatgaccgcctacaaaaatataaatcgaggtgaagttcgttgtccgcctgcgaaaagatttccgcaggcggactacttaagcggcgcctgtgaaaatcattttcgcaggcggaccacctaagccacgcctgcgaggcgcatcttatgtggtccacctgcaaaaatcgtatctaccaaaaaaaaaacttcaatccttatccagtactccaacccctccctaccactcatttctatcttctcaactctctctctccctccaccaccggcttcttagctcccccatcccctcctctaccatcccctcccctcccctgcgaggcgcatcttatgtggtccaccggcggcggagcgcgctgcggcggcggcggcggctccccgacctcccctcccagatccggccagagggatgccgggggagggcagcggcggtgcgcgcggacaccgtggcggcggcggcgcgcggacgcggtggcagcggcagcgcacggacacggcagcgacccgttgcggcggcggcggcgacgtggttccccggcctcccctcccagatccgaccggagggaggccgggggagggcagcggcggcgcgcgcggacgcggaggcggcggcgcacggacgctgcggcgacccggtgcggcgacggcggctccccggcctcccctcccagatccggtcggagggaggccgggggaggacggcgggcgacgtggttccccggcctcccctccaagatccggccggagggaggccgggggagggcagcggcggcgcgcgcggacacggtggcggcggcggtgcgcggacgcggcggccgcggctaccccggcctcccctcccagattcggccggagagaggccgggggagggcagcggcagcggctcctgttgctgcggcagcggcggcggctaccccggcctcccctcctagattcggccggagggaggccgggggagggcggcggcggcggctcccggtgctgcggcagcggcggcgtggaggcgattttttttttgttttttattggattttcgcacgcgggccatttgcccgcttgcgaaaatggatgattttcaccgtcgttcgtctgcaggcggtcctcccctccgcctgcgaaaataggttttggccacttacaaaaatgcttttcctagtagtgggcgccgaagtcgccgcagaagaaaccgctggaggaagaaaaatgtccaggagtgagaatgacatgtgggggcccatgtgggccccaccatttttaatttttattattttactgtaactgatgtgtgggcccatggtttttatttttttctagataaaattgccacgtaagcgtcacgtcaattccacgtgggataaagaccgagttaaatcagccatgtaggtgccacgtcagctaaaactgttgtcttaccatgggatctatattgtaccggttttgacagccgtatctggttttccggttcaacgacggaattcggattcgtcgaaaatttaagagaccaaaagttaacttattccaaatggaaaatgaggcctgtgcttcggccctcctaggctgcgcggtgtgtgtgggtccatgatgtggtcagggccgatttggatatctatgcatctttcgaaagatttttataatcatatcacacagatttttaattcttggattaaaatccaatagacacagtaaaatacaaaaaacaactaagaaacaccataatggatactatattaccatatcttcagaaaaaaaagaccaaatccaatataaatttcaaaacttatatgcgaagattcaaaaattacactgtaacttacaaaagttacagtgcaaatttcataaattatattgtaacttacaagaaaacacactgtaaatttgagtgagaaaatcgagtaagagataagaaaaaatctttcgagtgagatatagcaaaatcgttctttgatcagtaaatgtttccgaatttccaagacaagatagctactcccttcgttccagaatatattaacctaaaaccggattggatgtactatgaatctggacatacctctgtctagattcgtagtactaggatatatcacatccggtggttttaggttgctatattctaagatgtagggagtagactatttggattgacctatcatttttagagtgggctcatggataggtagcctttggtgcctggtgtaagattttcacattttgatcataattgattggattgaccatattatttgtgacataaaacaagctttgaaagagactttcttggtcctgtaaacaagtatcgaggaccttttttttttaaaaaaaaaagaaacacagtggttcatacacgcaagtacactcatcctataaacacagcatacccttccccaacaaaaacttcgagagagtgagacggtatatcaagattgataaaatcatcaaaggtgctatgctatagacaggtacctcgcttatcactggaataataattaatcgtacgtacgagtgctgccatgtcaagtttttgagttgaatttgtgttggttaaaaaaaaatataaccagctgatttaccctcaatttacttgaaatatagtaggtctcaaaaattttacatttgttatccatgtacacaaatttcatgatcgtgttttcattttgaaggcgttgttgaatttcacacactttatagaaaaaaagtaaaaacttgtgttcaatccttataattagcctggtattaaatttgattaaaaatgattccgtagttggttatttcaatttaacgtggatgccttagcaatgtttgaatttggaaaattctaatttctattgttttttatgtactatgtgggatttttatttgcatcccaaactccacgaaagaataaaaactctagagaaaactaacatagtactccctttttcacagctgaacatgtgttttactttaaatatttaaatttgaggtatatcattgcaacgaacctataaaaaacagcctttccaatgcattctccaaactaaaattaggtaagttcgatgaaaaaatatcctccaatagacctgccaacaaaccctccaagccatctggctcacaaaattaactctctagctagctaaacatgggcatcctacctagcgggccaagccatgttgccaaccaggggatccagtcgtcagatacccttctccccttctctctcttttcccgcacccatgcagaggagcgctgccggccaccatcgtcatcaaggtcgccatcatcatccgttgttgctaccgaggtcactgtcgccagggttaatcctatcggttatgctgatttgatcgggcctcaccaaaatgccgaaatttcggtccgaaattttgaacaaaatttagttgaatttgaacaaatattaccaaaattcatgaaaaaatgaaaaatttcggccgaagtaatatcgtatcggaggggaccgaaatgatcgaaatttcggaaatttcagtccgaaatttccaaccatgactatcgccagccaccgccactgtcgtttgtgccatcactagccgttgccatccacctcgaggttactatccgttgtcgctgttgtattcgccatagtctggaagcctccgccacctgtgcccctactggattcgactggcgtggcgcggattcgcgagggcttgtgtcggattcgggcaacacggtgtggattcgagggctacacgacacccgctctagcgcaaattcgactagcgggttggatttgcagcttcgtggccttcaccgcctccgtctccccaagctgagttctgggttgcggctgacgttgtcatcgccgccgttaaaaggccgggagaggaggaagaggggagaaagaggagtaggaagaaggggtagtactagaggctggtgtatgggtcctaatgtcatatgctcggaaagaagagagtacatgaaaagactattgaagtgagtaataataag

SEQ ID NO: 71268 - DNA, 5083 bp, Oryza sativa
ttgtttgcaaagtgacgtggttttatattagggtttgttcagttgatccttacatggaaggggttgaagggattaggagagattaattttgttcttaacaatgcattgtctggttaatcttcaggagggagggattgaaaggaattaattccacttctcaatatgtgtgaaattatctctccaaattcattcaggctgcgtttgggaggagagtttggtaacccctcctccccggcatgcaaaacgaagtatgtgttagtgcatattaattaagtattattttttttaaaaaaatggattaatatgatttttaaaacaactttcgtatataatttatttttgcaaaaaaatcacaccatttagcagtttgaaaaacgtgcgcgcgtaaaacgagagatatgggttgggaaaactggggaagaacacggcctcaacccactatggagaggattaaccaaacaagaccttaatgtgaaataaaatcctcttcaattgccctttaatcccttttaaagaggtattaaccgaacaggaccttagcgggaatgctagaaatggaatccatgcccatcaccttcccaatgtggtactcccattgggcgatgcacctcttcacctcgtcttacacctgcctccttcccttcctccaccaagcggctaacatgggccacttcgaagttggcgctacgctccacgcctcgctggcctccgtcagtcctccttggactcttgtcgctatggtagccgcatgctcaaggctgcagatctagtgcctactggctcattgtcgacgaatttgggtgatccaaaacagaaggaggagagttggtagcggctggcaaaaggaaggatgaggaatatgcatggtagcagcgatggtgatggtgccctttccacgcctagatccagtgtccttcctcaagctcattgttcctccagtgtgtgcatcgagctgtgctgcagttctttgccatggtggatggtgatagcggcatgtgcatcgatgtcatcgcaactacaacggttttctccgcatgtgcgcggattgaggacctcacactaggtagggagacacatcgacgcgtcgtggaaaggggtggaggggctcagccatagcgataacgggaggcaaggtggagcgaacggcgattgtgatgacagagatggggattcgtcggtatctacggggcaccagccctagtaccacctgtatcacttgatacctacctggtattacctgatagctagcaggtaatagatgtgatacttacctaatatcatcccgtccgaacaaaatgacgtaatataatcgccctcagtattaaaaccggcatatctctttgtaattgattatttctttcatttcaaaatttagcaatttctagtatttaaaatttagcctagaatatagcagtttatccacttacattcctttcttaacaaatcacactattttcctttaatatcttacctatctcatcttctcaacccatcacagctatcatttgtttaattttaccaattttcttaatacataaacatgttcaattctagaaaaaatcttttattttgaaccaaaaaacttattttttgtgcaaatgttctttaactagctactagctggaatctgctgcgtgtatacgtgccaatttggccgcggtttctggctcgaacgaacgttcagtacgggcatgtattgggctgagctactgcatgctggagcctggaaaagaataaaaaaataggataatgctgcgtaatttgacatgcttcccgttattcatggaaaataattaatgttacaaccaactggcaatatcagcctggaggtagcgcggcgcagtcgacgtgctcacgaagtcaacgggaaggaggcgccgctgtacgtggcagtatccgagagcacacgcgtgagtcgcatcgacgacgtacgtagcaacggactcggcgcggatcgagctcgtcgcatgggctgctgcttgcgactttgccgacctcattaccttgcgagccggccgggccccagtactgggcctgtggaccagcccaagctgggccggctctagcatctccatgattttaggagattattaggggcaaggaataagttcatccgaggtcccttaaattgtcaacgaatccgattttcgtccttcaaccagaaaaccagatacaatgtgtccctcaactatcaaaaccagtgcaggtgaggtccctcggcggttttgatggcggttttggctgacgtggtgcctacgtggctaatttgtctgggtctttatctgatgtggcaatgacgtggcattgacgtgacgcttacgtggcaattcgatacagaaaaataataaattttgtgggacccgcatgccagtttcacacatgaattaaatataaaatagtggggcccgcgtgggcccacatgtcagctaaaaaaataaagatggtggggcccacatgtccctctcggctctccctcgtccccgcggaggagcggcggcaggagcggaggggcggagcggcagcggcggcaagccacaggcggcggaggtggtcggaggaggaggtcgccgccacatgtgagcagacacagaacgaggagagaatgagagaacagtgggactgggggagtcgggtcgacgagaaatgccgatggagggcaccggtgctggcgcaacaagacggacggcgagaggcggcgtagggagctcgtccccttgcatcctggtgagggcgccgggccggcggaggtggagacgggttcagtacccatcggcggcatggtgtggggaggtcggcggcgtcgtggcgggcggcggagtcgaggaggtggtgggcggcgagcgcaggtcgacgggcggccggtggagggtgccgaggccagtgccccgttagccaggtggcagcgctgtggcggagaagtcgaggacaccgtggctggcggcagagccgcgaggcagtggcgtaggtgggccggcggcttgctccaggtgccgtcggaggcggcgcggcagtcggggctccgtgagcaggaccgtcggcgcaaagacgacgaacaggagctcgtcccccggccgccgcgcaccgccccttctcacccgacggagaggacagaggagaggggagagagatgaacacagggagctagcggatcatatctgtcacgccatgaagtttcccctttttcttgctttaaaaatttgttaaataaatcgtccaaagaaattatcttaattaacctagagctaattctctatttaataaatgaatttaataatcgaattcggcgtggtggaatttttcttgagttccccatgctccaatacattaacgagatttttagtggaattttcagagccttggaaataactttaaccaattaaaaatgagcaaatgcaatatttaatcccaggaaaaatcctatcccctttttccctttttcccatttcttttcctcattttcccacttcttgggccgtcggcccagtccactcccccttctcccgcctgcgctcggcctccctcttgctgggccggcccgcccctcccttctctctctggacgccgacaggtgggccccacctgtcggtcgtctcctacctccagccgttggagctggagctccaaccgccgccgccgaaaccgtcccgcgccgccgccttctccgttccacgtcgtgccccactccgcgtccacgtgcacccgcgcccacgtcgtcacccacgccccgctttcctgccccacgcgcgctcgcaaggggcggattcaattttgaatctcctctctctctctactctcccacgtctctggccaaataggggccatccccggccacgtccgtccctcccatgcctataaaatccttcccccgagccccctctctcgtttcccttgcttgccgccccctcccgtgcttcctaccgcgctcgcgccgctcgccgcacgcaccgccgcttgccgccgcctccggccgcacgccgccatcgctagatctgtcgcctcgccgcacaatcaccgccgctagcttcgccgccgcgagagctacctcgaccgccgctcgctttccgtgcgccgccgccgtaccgctctcctcacacgccgccgcctactaccgccgccataccgctctctccacgcgccgccgcctactggccgcgcgccaccgccgctaaagctgccgccgcgtcgtgaaaccgccgctgtcgcgctcgccagtgtcgcccgcacctcggccgccacttggttgccatccgccgccgccggaacccgattccctcgcatcgccggtgaggaccacctctctctcctccttcctttcctctctcccgtgcacaccgctgccctccgcacgtgcgtcgtcgccttcggccgacgccgccacctttcgcgccatccgccgccgccgcttgtcgtcgccggcagacgtgcgccgtcgccgcctcgccatggccggccgacttgagccgtgccgagccagcaaccaccccccctttagccactgccagtggggcccgcgtgccgtcaccccctccctctccccttgtgccgctgacatgcggggcccgcctgtcggcgctgcccccctcccttgatgacgtcggctcgggtgatattgcgcaataaataattaaggactttttctttattaataaaaacacatattatcttctaaaattcataactaattcatccgagctctgtttaagtccattcaagtctcagtaaattcataaaaatccctaaaatccattaaaatggtttgttttctgtttcagtagtcttatagcatgttttgcttgtgtgctttgtttgtcgcgtagatttcggtcgtttcgtcgatccgcggtttctcgaagacgttgctgtggtctcattagtgcgagagcaaggcaagtcatgcattacaattgatcatattgtacccaatttacaaatatcctgcatttctattaaatattgcattcttttacaatgtcatgtgggatgggtcctattactcagccatttattgtttaccttatgccattgataacttgggtatcaaaatgattagatgttggtttaggaaatgcttagccatgcctag

SEQ ID NO: 71269 - DNA, 1425 bp, Oryza sativa
gataagctaaaatcacacctacccagtacatccttgaaggcaggccagacaacttacggttaaaagactaattggagtactttttttatttttgaatagtctaactggagtacttcacccggaaacaaaaccccattgtggcattgtgcattcaacatacccttatccacttagtttcaagaaaatttaacagcatgagatttatcctctctatacccgtggaccaagccggcagcacgttcgccgtggaccaagcaaggccggcgccgaccgatcaccgatcgataacagatgcatgcacgcacgcacgcacgcacgcacgcacgaacggcgctaactaacgataatatattcgtaccctacggttttttgccgacacgtatgcgtacgcaagcagccatcgacacgtagcccccgcgcgccgacgcggcgctcgtccgctcgctacctactatgtactactatagctgccacatccttcgacctccacgtatgcaaagttgcaaattaaactcactgtacgcatccacgtatacgccatgtgcgtgcggcggccggccgggcaaacggccgatcggcaaatcataaggcagccgcgcgcgcgtaatatataaccgtagctccaaggtaactgtgtctccatacacggtatatgcgtatgcattattatgccgtgtttatataaattgcgtatattagacaaagcggcagatacacgggcgcgcgcttagtatagagatatcggtagattgcaaggcctacgaaaacgatagctatacgctacgaaaccgatcgaatctccaacgtgggtgtgtcgacttgcgcctttggcacgacgcacacttgtccgccgttcgacgttatgcccaatcgcccatcgaccaaatacttctttttttaatcagttccggctagctagtttgtatacatgcatgcatgaatcatgtacatacctgataaataatatgctccgaacatctattatggccaatgatgtatacatgatatgctccgaacatctattgctagctgcaacataactgatcgaccaacatttgtcatgtcgctaactaagcaatcatcgtgcaagctaagctaggtgtatgaaatctgcaataggatatacagtgtatgtatgtgctagttcttacgagcttccgttattgttgatagctaacgattggttgctgctcgtatatttgtctggatatataacgatctatgcagctaatagcaaatgggtttgtctcggataagacaaatcactatttggtcgaacggaccaactgacctgatttttcggatctcttctgcacgtggtaagatcctgttatttcggcatctatttttcgttgtagatctcattttctcgccgctactacttgcaccaattaattaactataatatatatccgcactgtattt

SEQ ID NO: 71270 - DNA, 4597 bp, Oryza sativa
gaggaccttgcccatagagaggggggggattcttttcgagatttagagcttagaacgggggatttttggtcctttcggaaggctgagaggaaaggaagtcgatcctttgtaacttgtccatacacaaatccacaaaaacacaggagtagggtattacgcttcgcagcggcccgaacctgtatacatcgtcgtgtctcgtgtgtcttgcgggcagacgatctttccagatacagagggagagcgagagcttgagatttcaccctaagcccccggccgaaccggcaaaggggggcctgcgcggtctcccggtgaggagccacgagctccgtcatctggcgcgccaggtagggggctcagcgtgtgttttctgagctctcagactcttccgtgtgcgccaagtttttcttgttcagcctaatggccgagcagggaaaagcgcacgacctctctccgagtgtgagcggcgacgacggggagccgaatccacgccgtcgagctcgtactcccccacctcctccgcgccaaagccctaagcagggggaggcgcttgagagggtcgacaaatccgtggcatcaccagtcgcaggtgatgcaggagaacggcgagatggggagcgtcgcctcctcgtctacggcgacggcagcacgcctcagggtgcgcttcaggctgctggcgcgctcctacgacacccgcctgtcgtccatgacccggagtctccagcccaacgatggctggaagacgtggccaacttggtcatgacggcacagcagcgcctgggtgctggtggacggtccgccaccaccaagacctccggcgccgctaccaccggctccgtgtcatcaaggcggagggcgcggcgagcggcggcggctgcacgtcattcggctgccactccctcgtcgacaccgtcgactcgggaggatcagcatggggagccggatgcccgcctcaacatcgagcgcaggcgtaatagccggcgtactccccgtgcaacggagggcgcctcctcgtccagaatgtcacctcgacacggacgtgaagatcagccctccgtgcccccggccggtggtgttggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggcccattccggcgacgaggggcacgtcctcgccgtcgagggcgctccgcgggccacccgaaaggggaggcctgcgagcgacaaaaagaaagaggctggtactcccaaccgggagcgcccagccagcaagtggtgctccgtccacaacacctccctccacgatctcgcggactgtcgtgcagtcaaaaatttggctgagcgaacgaggaagtgggaggaggacaggaggcaggaacgccgtgagggcaagtccgcggcagttccctccggtagacggcgaagtgaggccagacagaaggcccccgccgttgaccccgatgacggtgatgatgacctaggtttccaagaacctggggccaccattgccactgtcgacgggggagcgtgtgctcacgtttctcgccggagcttcaaggctatgaagcgagagcttctagccgcggcccctactcatgaggcgacgcgtcgggcgcggtggtcggaggtggccctcacctttgatcagaccgaccacccaccgtgcgttgcccggggagggcagattgcgatggtggtttcccccactatctgcaacgtgaagttggggcgtgtcctcatagatggaggagcggctctcaacatcctttcccccacggcctttgatgctatcaaggccccggggatggtgctccagccgtctcaaccgatcatcggtgtgacgccggggcacacatggccgttaggtcacatcgacctaccggtcacctttggtggatcagccaacttccgcacggagcgggtgaacttcgatgtggcggacctcagtctgccctacaacgcggtcctggggagacccgcgttggtgaagttcatggcggcggtccactacgcctacctccagatgaagatgccgggccccgggggccccatctctgtccgtggcgaccttaaagtcgcgctcgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggattggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggagaaaactgcgttcattacccccgtaggaacctattgttatacatcaatgcccttcgggttaaagaatgcaggtcctacttttcaacgtactactcgaatttctttgggtagccaaataggacgtaatgttgaggcttatgttgatgacttggttgtaaaaacgcgcaaccaagaaactttactttcagatctagcggaaacttttgagaacctccgctccgcccgcataaagctgaaccctgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctccgggccgttcacttggacggaggaagctgaacatgcccttactcagttaaaggcgtatcttagctctcccccggttctagtcgccccggagccaaatgagtccctgttactttacttagcagcgaccccccaagtagttagtgcagcgttggttgtggagcgcgatgaggacaatcctcattctgcgcacccccactctgtgccgacttggcccgggagcaggcagggaggagaggcccccgagtcgaacggtggcctaaggcccccgacgaccggagtcggccctctgcccgcttgtcagacggtgctgggtgcccccgaccctcaggaaggccccgaggccactgagggaaggccgcacttatcgccctttggccccgaggctaaccctgtgctgactcgacccgggagagagcagggagaagaggcccccgagccgaaaggaggcctgaggcccctgacgaccggagctggccccttgcccgcttgtccgatgacgccaggagcccccgacccccaggacggccccgaggccactgtgggaaggccgctcctgtcgtcctccgaccccgaggtcatcggcacagaagacgagtgcaccccgagaggccacttggatgaagaacgccccggggatacggcccctagcgaaggggatcggccccgccgaaaggtgcagcggcccgtctactttgttagtgaggccctccgggacgccaagacccgataccctcaggcccagaagatgctttacgctattctgatggcctcgaggaaactgcgccattatttccaggcgcatcgggtcactgtggttacgtcttaccccctcgggcaaatct

SEQ ID NO: 71271 - DNA, 1119 bp, Oryza sativa
ctcctgtttttacataaagagaaacaaatcaaggttaacctatttggaccaatgttttattaaacatagtatgattatagatgtatataacattatctttaaccagtgccttccctgacagtggtgctagaaatgcttgttggtatttcttacgctcacaaataaatccgcaagcgcacggataccgttgtagcacttcaccaatgagtattcccgaaagtgccgcatttatatttcagcagcaaaaacagaggtgtaaagacatagtttatatcaatctataattaactcactatagtctagacctggttagtattatgattaaggggtattatgacacacataagattcatctctaattaattaatatagtggaaaagacataagagaactatgatccaaccgttattccatattaatcatgttatatatatatacttaacacaatattggtatttattaccagggttaaacctttcggtttggccgatttgatcggacctcaccgaaatgctgaaatttcgaatagaatttagttgaatttgaacaaatattaccaaaattcatgaaaaaatttaaaaatttaaaacttttggccgaagtaatatcgtttcggtcagcgcaaggaggagcaaaggcagcagcggtcggcgagcttctcgccggcgctggcagtgaacggcggggtttcatgaggtgcagccaaaagtggatttgtagagtggaggattgtgaagctaatggtggtggtcttgtgcatagtggtgccaaaatcagtgtcagcggcggcggtgagcttcggcatgctagtcagcttcgcactaagtcactgccatgtggaccccacatatacaagagataggatagctgacatgtgagcccaagggtatttttggcatttcacgtgatttctctctcctcttcaactgtaaattattgttttagtcggcgcggtgtccattggcaaaataccacgattatggatgtttccctcaaaagttagttttggcagtgtcctaaggctaaaactacacaatagcagtgtcctgtaacaaaatttcctaaaaaaaaaagcaccatcgctcaaaaaccaatagtggcagcttggaaaaaggccct

SEQ ID NO: 71272 - DNA, 2375 bp, Oryza sativa
actggcttttgaggggtgggggtgaaacattagcgtggtgtggatggttaggggagggttatgcggagggtcttgtcacgatttccccctttgcagtatcatggtgatacttcggggcatggcgacatgtgtggaatcgtgtcttgtgggtacagttgtacacctctggccatagtaaaactattcgaatagccgtgcccgcggttatgggcgatcaactagattcaccgtgattagtctcacccctagtttagcttaatgaactggtgtagttcaggtgttggttgggcctgttgcaacgtggtgtagcgttggacagtgattggttaatattgattaattactacaattgttttaatgttttcaactactatttttaaatggctgctttatgcaaatgaacccctagcctcctttggttatatcctgcatcatatctcctcttccggtatgacttgctgagtacagtgggtagtactcagtcttgctctcttttcccccacaccagagctgaagatcttcctagttggagctgtcttgttgaagttggtttcgtcgttgccgtcaagggttgcctgtggagtggagtcgccccgctgcagaattcaagcgtccaagtctagctcgttttaccttttccgctgcatttgtaatcttttatatttttggtaagacgtggatctgtatgtcaacaattatcgtttgtgtaccctggctggtcctggacagggatttaatgtacattcagcttagaaattctggttagtaaatttctgggcgtgacaagttggtatcagagccgaccttgaccgtaggacaagccaactggaaacctaagagccctctcaaccccttttcatctgcatatgccttttgcacctggatttgttttgggaaaatttggggttttgcctctttggtttgtgggaaaaatcttggtcgttcattcagatcggatctttaaaattagctcagtctagggttttagtaagattttatttggagtttattcgacagtcactcgggaatctattgggtggtatgcactaagtcgtgtctaggttcgatggggcaattttacgcgtatcattatgactatgcatctattttatgcattaatttagtgtttagttagttacattagtatcctctgtttgggttcatcaaaagtgttatatgcataaaaatcagccatgctcagttatttgtttgagtaatttgttgctttgtttatttggatttgagcatgcgttgattccttatctctagcccgctgctacagatctatagcccgctgctcttctctctctttatttatctctttaaaatatgtttatagctggtttatagcctgctattgtacctgctcttaagctttattgtaattctaagggggggtgtttagatataggggtgtaaagttctatcgtctcacatcgggtattatatagagtgtcatatggagtgttcgggcactaataaaaaaactaattatagaatctgtcagtaaacagcgagaggaatttattaagcctaattaattcattattagcaaatgtttactgtagcaccacattgttaaattatggagtaattagacttgaaaattgttttagcttgtatttaatattttatgtaggtattcaaacatttgatgtgacaaaggtataaattttttttgttaggaactaaaaagggccatagcatggagaccgctttgcttccattccaccaatttcacttatggcaagtggtaactactcccatgatggaacggcctgcatttaccgggaatagcgtgcaatagcctttctgggtccgtaggcctggcctggaaggggcaagggcatagggatcgaggcgtagcgtagagtccactagggatgaaaacggagcggatacggacgtttaatgctcatactatattcgttttcatattttttaccggatacgaaaacgaatacggatagcttgaatacggaaacaaatacggattatctcgaatacgaataagaatcgaatatgatcggacacgaatacggaaacaaatttttctcggaacacgaaaaccaactcaacttctaatagaaataaatatcaatatatataattagctcattttatataaaatgaggtataatttataaatattttttaaaatttaaataatattaatagtatggactagtgttaagagataaactattattaaaatctataaaggtatattgaaggttatagaattagaaagaaatagggtatgtctcatgggtcctgcggatatccgaatagcactgttcaccggatatctgaattattatccgtattcgacggaaaccctgatatcatattcgtattcatatccgggagaaaat

SEQ ID NO: 71273 - DNA, 32601 bp, Oryza sativa
  unsure (1)..(32601): unsure at all n locations
aggggtgaggatatcaaagagaggagagagagatggggagaggagaagagatgaaaatttttgaaagggtgaggagggaaagaattgttaatgtgaaaaactttgaatcaaattttatgatattaaatgaatttttatgaaaaagttgtcaaaataaagttgtagaactcgttaagatctaccaattttattttggtcatttctcgataactcatcaatatctataacttttgttttggtcattttgctatgactttatttcaataatttgaatttgaatttcaaattgtgacatcttcaaacaacattttcaaatattgaaacaaagtcatatagcaaaatgaccaaaacaaaagttatagatcttgataagttatacaactttgttattggtaatttttttatttgaaatcatttactactcgaaaaattatttgaattgagaggagagaggcaaaatagacttctcggtaagggaggaacaaaagggctgggccggcagcccgaagagggctgggccggcagcccgaagagggaggaggagggagagagaggttataggctgagagagggagaaagtaatacttgggccgaaaaaggcccaaggacagagagaggaattttaatttgctttctatttattttaacaggttaaatgaactttgtggtattaaaattagttattgagcttcgaaaatttacgaaaaattttagagaattatttagaccacgtagaatattacaaaaatatttccggccatgatttttaaaggaatattttagtttccccattaattcacttgattaaattgctttaacttttaatatatttttttagaaatgcattatataaatttatgacgtttgctttgtgccccttatgacaaattaatattcgtcacgatgtcccattgaaatactttatgacgatttctagttggtattaacgacgaacacctttttttcatcactaagccaccccatctcatacttatcatcataaaatggaatgtgctagtgacgaatagctccgtcgtcacgaggaattcgtcacagaaggtcatatttcttgtagtggttaattcttttttatttaatcaaccgatatataactttgtttgataacttagttgatcactaatggatttgaatatatgtggtctagtagagaagcacttgacagaagagataatatcattgaatcgactattcatagtattattattcaacgaccttattatataacctccatagcacatagtgatcagacccatctgatctcaaagctggcatccccagtgttgatagtaggcccaatgggcacattggaagcagagtgagccgagtattcatggagagtcttctgagttcgggtgccgagagcctgattttcggaggaatgacacgaggtcggactcttctggcaagtttctctagattatcaacgaagtttatccacagatcaaaaccggtcatacactacctgtttttacataaagagaaaacaaatcaaggttaacctatttggaccaatgttttattaaacatagtatgattatagatgtatataacattatctttaaccagtgccttccctgacagtggtgctagaaatgcttgttggtatttcttacgctcacaaataaatccgcaagcgcacggataccgttgtagcacttcaccaatgagtattcccgaaagtgccgcatttatatttcagcagcaaaaacagagagtgtaaagacatagtttatatcaatctataattaactcactatagtctagacctggttagtattatgattaaggggtattatagacacacataaagatttcatcctctaacttaattaaatatagttggaaaagacaataagagaactatgaacccaacccgttattctcatattaatcactgtcatatattatataccttaacaacaatagttggtatttattaaccagaggttaaaacctttcgggcttggaccaatttgatcgcgaccctcaccgaaaatgcttaaaaattttcgaaataaaaaaaaatcctacttgaatttgaacaaatattaccaaaaatcatgaaaaaaattaaaaatttaaactttttggccaaagtaatatcgtttgggtcagcgcaaggaggagcaaaagcagcaacggtcggcgagcttctcgcagacgctgacagtgaacggcggggtttcatgaggtgcagccaaaagtgnatttgtagagtgaagnattgtnaagctaatggtggtggtcttgtgcatagtggtgccaaaatcagtgtcagcgtcgcaggtgagcttcggcatgctagtcagcttggggggggcccccccaaaatttcttttttaaaaaaaggggtttcccaacacttgggccccccatttggtttggggggagacacccccccaccataatcccaagagataggatagctgacatgtgagcccaagggtattttgggcatttcacgtgatttctctctcctcttcaactgtaaattattgttttagtcggcgcggtgtccatggccaaaataccacgattatggatgttcccccaaaagttagttttggcagtgtcctaaggctaaaactacacaatagcagtgtcctgtaacaaaatttcctaaaaaaaaaagcaccatcgctcaaaaaccaatagtggcagcttgaaaagggccctgcagttcttcacactaacatatgtgaaacgactggcgcaattattggtccattctaagcatttaagcaaggaagaacttaaaggttactagtaatcgtgcacgtgcaatgcacgtttttcacaatatatattccatcaatctaatattttgcagactcaatatatagccaaaaccgattcatttcgatccatagaagaatgaagaatcaaagcttcctgaaatttacattcaggctgaaaaggggggaaacaaaactgtactgtatgcaaacagagtacattgcacaaggatccatgtaaggaagaaataaatcattggaaaaatggaagaaacctatcgtcatttgaatatctatacaaatgacaatgaaagaaattagaaattctcatagcacaaccaaagcacagggaattttgaaatatcgaagaaatacaaaaactgatagtactgagttttgaactaatgagaatgtattataaatctgcatgcattccatatatcttgaaaatgaagttggatccttcatcaagaccaacttaaatttattatacaatttggggccttcagtttaaactttgcattgaattctattgaattcttcctgcaactgaacacaattcatggatcaaacataagaaataaatatatttttttagggataaacggcaggagctctgccaatttcattataggagaagaagataaaaagagtttttacaggctatggatacaagaggaaaccatagaaccccccacaaaacaagaagaaacggatgggaggattttcaggaaatgcatagcaaccaagaagaggaactgggtactactcatctagattatgagctccctcataggctttgcatatggcgatgatggagtcaacgacttgcggtactgtgctgtaggcaccgttgaagatccttgcgtttcgttgaagccaaattccccaggctgtgtagatgaagaggccatcaaaacttctcccttgatccctgatcatttctcttctgcacgctgtccaccagctaagcatatccccattgaaggaggaagccataggcatgtgaagcccggctttctgctagatggatctctagacctgctttgtaaaggtgcaatccatgagtagatgagtggccgtctctggctccactccacagagtgggcaaatgcggctgttatcccagccgcggagaaggagcttgtccgctgtaagaatcttcctatggatcatgagccaaccgaagaatttacatttattttcagtcttagctttccagaaaaaatccgacctattatcttgaatacttccaacgaattgtatcttgtaggcggagtttgccgagtatgtcccgttagaagaccatctccaagtgaccgtgtcatctgttccctcctgtagttccacccgtaagaaataaatatataatttcagtaggctatccaatccgtttacatgtaacagatatgtcatagatattatgttatagttcaatatgatgctatcaagccctgaagagtctgactctacatgccccattgttaatggaacatactactaagaaaagttgcttttggtccataaaatcttgtattgtctatgggaccttggatttatttctatccataaatttaagtgaagcaagcatctttttatggctcctttttacctggtgaggctctcaacaatcaagaatcaatttaatttaacaacaatgatataaaaatggatggttcagctgtaaaaaaaactcagtttatcatttaataaggaaaatctactgcaaaaaatattacaataacaatgtaaataaatatgcaaatataaaagatacaatgccaccaatgttcatttcttttaatcagggattttctacttaaatcagctaataatcactttaaatgatcacatttgctgaaaagggaagctaactactggaaaataaatcaatgatatatctcaaaataaataggagcaaattttctctccacactaagttcgatgactcatgttgcgtgtgatagttgaaactgatcatataaaactatgcatacttttttttacctctataactactcatgtgtgcatatgtaaaagggaatagatccattaagtagccccaagggttattacatgcacctagcttaaatgcgcatgccttatgttaaacaaatgaatggcagtgaaatgtatcaaacagtgagcatcaatgttcataggaatcaaataggatagtcaatgtaccatactattagcaatcaataagtgaagccagaaggggatttctcaggggacaagcatctaagttcagaacaaatggttgcgatggatgggaaccaagagcaattgtgacctcgagattgcgatggtggcagaaacgtagaaaagtgaggcggtcaatgcaactcctcatgaatttgcataggtgtacgttaatagatcccttgatatcctattcaaatagagtgttagtatatagtatattagctttaaactgatccacccaatgggttttgcgaatgtcaagcatggctgcaagcaatggaagcaagagatgtagaatcagttgtagcatgtccaacatgcaggaataaagcttatgaaagtcttcatgactcagagaggcaactaagcagaacaaacattttgtaccttatctttgagttcaactgatccatcatgtttatgcgggaatcaagcaggtgcaaatgtatgtttagctgcttgcagcataattatcgaccaaaatgcaaatcaatggtgcaccaacacggcaatgaacaaagttccctactcacctcagtacctcacagtgtccaagagcctcttttaaagccattatatcaagcatcaaaagcacatccacaatttctaattgcaatgatacaaatttgtgtgtcacgataaattaacgaattccaacagcaaacaacagtacatactgcagggaaactggatattactgaccttaagtgcatccaaatcagatcccactttcgaggctttgatatttactcatggagaagcaagatcatcactgcacgcaacaaaacaaaacaatcccagttgaatcaggcaaaactggctgtaattagggagacagttcaccaaatgctatcgagtatcaagagaaagagacagagacagagacagagtggatggatggacgcaccgacaagggcagcatgcgccactgaattactactccgtgtcctccaacacgcgcttcatggcaccgagctccgccgcgcacggaggtcatgagtcttatgaccactcacaagcctatcgagcctgaaaccgcccccattgcctctccgcggcgccacaagcttcctcctcaccgtcgtcactgagtaggcctgatccagtggccccacggtgcctcagaggttggatatatacatggatctgatggagaagaaggccaaacgggtctggtggtggaggagactggtggattcgatgggagcttgggggaggtgccagccattactgatttggggaggtggtctcccaacggagcgatggtgaccaaggcgcagcggcatctcatcaacatcgtttccagaagagaagcgataggatgcacgccatttgctgcctgtgaccctagctccacctccgtgcctgcgtgatgatctcgagggcaccctacactgacgctagcttcttgttgcccacctcgtcggtcgccgctgcatctgtgggcggctcacaccgcgcctcgagaagcagcgctaggctattagcaggagcgagggggctcacgtcatctggggaagatggagaaacgacagtgttattgcgagcggcggcggtgttaacgcgaggaggatggcacatcgagcgaaaatagcggtggagatagaatggggcctgcgatgtgggtggacggcagggattagggctcagggcaatgtagatgcagatgaacggtagggatttcataagttgatttggcctgtaggattggaagaggtgaactcctcatttttatattagtatagatatagattggtaataataaaaccatgagcattaatctttccaaggcaatggactccatcaaaacctacatttatcaatggaacagtactccgaatattagcttaagttaaagttcattgagcaatgagcttatacaaaatacgattgcaagaaagtcactgaaatgcattagtaccaagacatggatcgtgctgctattgcttacaaataataacaacatattgaatatgcttcttataagcaccagattgttgaggtagtgaagtgtatccttaaaactatgtaggcatcagttcaaaaatggcaggtaactggtaacgctgcctcgttgtttgatagtgcagagatcaagtgagcattcttgttttttctagttgttttgccttcttgttgtctaaaggagcattcgattctttccttcgatgatctattttagagattgtgtaaagcaaacaattccaaactgtcataacgtttgagtggcgagagagagagagagattcaactacatatgaggcatgtaaatatttggataaccttaaacaatgtggagaagacattgataagtaggataaatcagatatcaatgatgacatatacaacatctgagatttaattatgagtatcggtcaggattcaggtcatgatataatcttgggctcctagaagaaaaaaaatataatgaatgcctcacaaaatggtagctagcaaaagcatgcttgtacaaactcctaaatgaatcatgtggcaactttatcaatagcttaggcattgtatggtctaattttgttccattcattacacaaatattggcatgctactttctaactgcacacacaaattctaaggcctacagtactgccaaataaacgttccagtttattaagttagggctttacaacacgaatggcgagcactatgagttactaacaaacatatatttatgtaatgcataaagacatcacttactatttctggttggtgtggtgattgattttgtttaattgctcatgtagcaaaacgaaattgacggctccaacaggtgcaagtttgcaacgtatacacaattgtggagacaaatagcgatgagtggctcactcttgtcataccttgtattgttgccccaaagaaaaccttaatacttcctccatttcacaatgtaagtcattgtagcattttccatatttatattgatgttaatgaatctagatagatatatatgtctagatttattaacatcaatatgaatgtgggaaatgctagaatgacttacattgtgaaacagagggagtatcagattgtagatcttgcattttttttacccttgcataaggtaaatgtggacagtcctgctttagaaaccatgctaaagtaacttcatcattctacagttaaggtatttacataatcaggcaacaacaacaagaagtcaagaaggtaataagactgatgagtgtatgacatgaatatgatcgataggagtctaaccagtgtctcgtgaaagctctcaaccaaggagcgagaaaaatctccccaccgctctggcccctcttcctcctcggctccggtggctcgccccggtgatgggagaaagagaggtcgggtcctccttgtagttagtggggcgggttttcccgtagtccaagttaatcttgttttttaaggttcagtggaaaagcttaagaggtggttaagttccctccgtggcccagttttcagggggaaaacccgggggcccctttggggggcctttccggggtttgggcccaccctttttccaatcacaagggggtccccaattaacttgggttgcccgggcaacattttttttccgggaagcaagttcaaaagcagaacctttttcattgccataagttgggactcttcatcaagcagttgggttttgcatgttgtaccaaagaagctttaacctctacacaacagaggccctgtttgggtatgtgttcttggtttgttctactgcaactgcttgtggtttctttgtttccgccgtcagagtgatcgatttggctgcttcacatggaggatttgcaacaacgttgactttccttgttattttttacagtgttattttgcggtggagctgaacttttctttgattgccaaggccctaacctcctatgtgaggcccttgttggatcatgctaaggctagatctgctgcagctctctgtggacaccccgagtattataccatccagtgtccaacgcgaccaccacatactattggagaagtgggatccatacacgcataaatagccactcgtcctcaatgtgtccatgatcgtggttgacaaccttctgttataataatcgaaatgtcgagtagtgagcgcaagacataaccgtaagatagcttgccagtccaccacgtcatatgcttgtcaaccactcgaaggtggcgaccaaaagcataccccagtgactcgatccaaagtgctatccccaattatctcaagcgatcaaaacccgttactcatgcttagctagtccccaggaatgcgactagcctcacactttcatcgcaagcaattaataaacatagcaagtaccataatagggttaaagtgcagcgaggtacatgacacataaaagggtccgaggtcccaacatacaacacataaatatagcagcggaagtctcaattagagttcataagcaaaagataaaaccggtggtgccacaactccactagggcaaaccaaccgagcaagagccaagctgcaagagatcactcattgccctcgccgccctcggcagagcaatgaccacacaagaaacataactcataaccagaatcctctcctgaaattgcaaacatcgggttaagtacaagattgtactcgcaagtcttacccaaaattatatatacataagggagagagaagtatgcaagctttctagcctatagtgggtctctaggttcaacatttgcataaagctaattttattgagcaattaatgagtaaaataagcaaggacaagtaaatctagcatcattttaatttatggacagcaagtatataattctgaaatgtataagcaaatgagcccaaaacggcgctctcatcatcaaccatggactaccaaagtccataccaacatggcacaacatgccaacaccaccatcaaacataatcccatccataataatccacatttgatgctaacataactgactaacacatcaagcattgtccataactaaggacgcggctattcgaatagattatactctgaccagaggtgtacaactggacccacacgaaatgaacaaagatcaaatgctacacaccccgtcgagtgcggtacacaagtgattcaagctcattacatgccctttcttagccccaccccaaccacctataccacgctggggttctcgatgactcagtcacgtgcgtgcgtgatgtgaccaaggcgggcgcgccacgcgggaggcacccccgaccaaacctaggcacccgaggccctccaaaggctacctgcctcacgactctccaacgtggtataaatgatcacagtagaactagtaagaacaagctggtcccaaataaggcatgtggtaagtacgaagggtgcttaaatagatgtcaaaatgttcggtccttaatgacctagacggggctacttgcatcaggggaaaccaacctcccatcatcgccctatcacccgtccaagtccaacatatttcatcaaccattatttagtgtaagtgctcaagttttatgcccaataatgcaagttgtttatataccacaattaatagcactgtccatccctatagttctattagcactaagcatggctaagcattaatgaataagaaatcccaagtaatcccaaccagtggtaataggatataaggacagcaataacacaagaactaaatgcataaataggttctacacatacaccataaaccaacaatattcatatctaggcaatgcaagcatatatatacgtatagattgcaaccaaatcatttctagagaaagtataggttctatatgcttaggtgcttgccttgctgctgagggtagtcactatcctccttgggatatggctcgttactctccggaatctccgaatctatcgaaaagaagcaatatgcgaataagagccaaataaacatgcatatgcaaaatgatcgataaattatgaaataaatacagtgggtagataatcaccagattatcacttatggtttgggagatatgaaaatgacaagctctcaggtgctgaaaatggcaattctgtaaatattaacgtttcctttagtacattacaagtaaaattcatttcaaaccaaaatttcataataatgattatttttagagtaaagtacatcactcacagctcctaagaaaaattatttcacagctatatgtgttgtcattatttatttatggatcttacaagttagaaacataggaatgctaaataaactcctaaacatgatttaagaggtagtttttccaaaaacaacaccataacagcaaagagtactaaaatataagctcaacaaaattggtttcacaattttagcttttaccaataatttcttacgaatttcataagagctagaccacacaagggatacatatagctatttatatttttactgggaaaaccagtacaaaagttggtcatttttattttacaacattgaagatcacgtttttcttaatccacagaaatttggttcagctcaaacagagttcagatgaattttctacgaaaaatttggttagggcagcagtaaatattgctagcttttccaacatttgagatggcttttcgtggtggcattcttttacaggacctgtaggttgaactattacatgtggatatgaaattagcaacatgctagatggttcagcaaaagcttgtttgtagctaaaaaaaaaggttctagttagtgtgggaaccacaatacccaaagacgagctcggttcacttcacaatctaatagaggtccaatgggtgcagtggatagacatgcatgagagcactctaaacctacaagatatgagttaacacattcctacagaatgtgacacacacaaaagaaaaggccgtaccaagagagtaaaccgaagaatctcagggttgtcctgcaatggagagggacgagttgcagctaccacttgcctccaaatcttgaatcgatgacctatggaatgcactagagatgaccaacacaatggagaacctcataggggagccatggatggagagggaaactcataaatcaatggaaataagttctccctgctgctgtaacctcataggctgcaagtggcttgttcttccttcttctcgatctctctcacgaatccatgcatgtgggagattttcggatggatgaggagcttagagtgatgggggtttagtggtgtgacatgcagggatggatccaaagtgtttggaggagatttgatgggaagaagtgagctgggagctcagcttgcaagaaagaaaagatcagacaagggagaaagaaaggggaagaagatgaaagagtttccatagctgcttgtcatatggagctgagttgggtgcacgacctggaggtgggatggggcttgttggagagccgaagtcagtgacaagtggggccaagtcgagctggacccatggggcagataaaggaaagttagaaacataggtacacattaaaaatagtgaattttcaggaattttcactctctcattcatgggtaattagtttgacctagctacacgagtgtcaaaaatgtgtgttcaggtgtggagatagattgagttacctagtttccatttttcaaagttacactcaaaaattcaagatattttaattctagcaaaaaggtaaaaagtggtatgctgagaactaaattgaattttaaagaggtcaaaacggagagctaaaattccacaaaatttatatttgttggtgataaataacctagtatttgaataaattattaaacatgtatacttctgttcaagttattgttcaaatagaagtggtttcaattttaccgattagagttaattttgttatcgcgtatgattaatttgcaatatagtaaatatgcaatctaaaggacaacaaatgcacttctaaatacctggttatgagcctagggctgttacatctccatgcttgtattcctcaccgtcgtcttgaacatcatcgaggctatcgttgtggccacagcttgaagacagacttgaatacttgatcgcttttttgatcttttattttgtccttccatgcttaaatctggacctctatgtaattcacccttgcttaaggagctgttatgcaacactagttgtacatccagttctcaaataaataaatatggagtctgttgcctctttgtcttaaaaacaaagaaggtaataagactaaaactatggaggcagtaaactaaccttgcaaaagaggttcagtaaatctatacctatactaatcgggcacttttttggagctctcacgttaatcaggaagatcaagccattgattaaacaaaccataatatgtcaaccgttgattacaatctaatccaagttccacgcggtgggtcttttaaagcccatgtaacctatattgtcaagcccatcgatatgatccattcacgcacgcattctttttcctttttctttcgaacgtgggtatttgtttctttttctaaaccgatgagtccatccatatttactgagatcgatctgatcagatgcagtggaagatacgggagggcacggcatgggcatcgcgccggccggcagcggcaaacgacggagaaaggcaggaggaaacagtacatacaagcacatcgtacgccagttatgttctgctcgctcggccccggcaaaggcgaatatatcaacgttatcggatctagcagcacacaatcactaaggcgaggttgacgtgcggccggtgagcgccggaaaagcacacaacgtcagccgaatgctaattggtggtttctccattggtaagggttgattctaacttctaatttccagttcaattctctttacatgcatacttctcatctgggacagcgtccaataggaattaatctacatcatcaccatactgtatatatttttgatgttcagatgttgattcagcatcaacaagttcgctagcacctgacaagccaatccatggtcatcgtaccataataattcatagaagtcttccatctatttgctttgacaaatccgctggcatttaggaagatccatagtggtcgccgcatgtactattcatgtaagtattccatcaatttgcatagtctaactttttatctgtatttgatctacttttaccattcttcatatattcactctctccttaaatataagcgatttcaagagattaggaatgaaggaaaaatgaagataaagtttaaaaaggggtgaaggggcagtagaacgatggttagggataagattgatcgaaaaatattaaatgagaggtggctttacaaagttctactcttaaatccttatatttgtggatagaatttgaagtctaggatcaaaaatatttgtggatgaagggagtatatttgttttaaaatgtatttttttcctatgtgatatgaatttgctacccttattattatattgttaaaaacttttttcatatttatgttcaaaaatatgttcggactttcctaaactatccccgcaaaaaaaaactctccgtatattatttagttgattttttttataatggaatgtaacattccggcctttactcaaagagctacagccaattattacagaactcacacagaaagtttacgatagcaaaaacaaagctaagcaaacacaaactaattgacaccaacagaagaaaaagatcccctaactactgaaatctattagagaacctccacccgatattggcaaatagatgcataattatattatttagttgattcatcagaaattttgtgttatacaggtggtcatgcaaaggcaaagggcatggaaaaaaacaatagttatgcatgtgcagtttttttcgataataatgcatgggtggaaaatagtaatagatatgcatgcgttgcttcagtaatatacatgcatgcatgaaaaagacaaatggtgtgcagtgaaacatggtttattttcgtccctattttccaaaaccatggaaaaaagaataattccatgcattttgctgatcctactttatcctaacatggcacacaatgaaaaattattggacacggaaccaatccatattaacattatggtaggacagtacagcagagttcttgatttggctcctagaactaatccattaatatttatacgtagtacatggtttcctcttactatatgttaatactatatgttatttgattttgatcctttattatgccatgttctcacgataaataagtatatatatgtgtatcatcctatatcactataatctgttgcatgcttcatccagttgaacaatttatgttttcattgatattcattacttcagaaaaatacatcattcctccaacaaattcagatgaagtacttttcttttaatcaatgttgagggataaacatgactaaaattgttttatgtattattaatctaataatagtatattgggacattgtattaagaaaatatgccattggaagtcatactcaaaatgaattaaaaaatatgaattttatcgttttaagtattctattgattaggaatcaatatttaacaatgtatatttcataaaaactcttattttaatataatctaagagccattgtaattagaaaagcccatatatttatacataactaaaattttaatatttatgatgatataaataaagagcccgtgcaacgcatgggttgatggctagttagtaataatctgtaacagacaaacaacaagactacaattggtgtccattgttggtgcttctatgttgcctgcttgccctgggctttgtagtgcccatccccatggcaggcacactgcacacaccacacgcgaggctaataacaatcgagcgggcgaggaaattaggaaaacacaaggcccctagtcctaacggcatgcatcgcacgcgaggccaactgcagcggatctgtcgatgaaggccataagggtattgactctgagcggatgagctgcacatgaaccaaccgctacattgtcttcggcaccggtgataggggtgaatgaagcggcggcggcgggtgggtggaggaaggggtgctagggattaagaggagcaaagcaaatgctaggtccgaggaggccggcgggacacgcaggtgggagggagaaggggcgacggggagctccgtactcctcggagtcggaggaggagggagccatgggtgggaggggaaggagagatgcggaggggtctgcgtccaccgatcccacaacttggtaaggccgtgcaaagctgagacacggacggatagatgggttccagatgtgggatcgaacgacccaaaaaaaagatcctggtaactaccgtcgtacaaaatcttgcttagtgatgcgccgcaaactaattggtcagccggagctaaaatctgctctagctggctggctgcggcaaagctaggactaggctgccttcggaaccctgtgttccagactgtgcgtacgaaaaacggagtggtctattagcgtatcattaattaagtatttgtaatttttttttcaaaaatggatcaatatgattttttaaacaactttcgtataaagactttcttttttgcaaaaaacacaccgtttaggagtttaaaaagtgtgcgcgcaagaaacgagaaggagaagttgggaacacatggttccgagcgcaagcctaagggtgattagatgacctactgcttatttattttcattcatacaaccgtttcatgaaatttggcatatgttgtctaggattcttcaagtcattacaatatgtagaagtgtaaagtgaacattattaattttgccctactaattatgtctttcatagttcaatagttcatggttgtgacactattctgctgtatcctttctttgttggattgtttcttcatattgccagaaatggcaacaaagaaatgagaagcaatgatgcttgaaggagcaatacattttaaggcttatgcatccataatgttatatttttagtcaggacatcattctaaaaatatttttctgagtaattgactagagtacgaggagtcaagagaatatcacggaatgaatctctactacttaaaattccgtagtgcttgtggtgagtttggtatcctcccatagtgcttgtggtgagtttgggatcctcccaccaaatcaacgctcagatgccccatccgcgctcgcatcgcgctgcatccgcgctccgtcgcacgcgcggcccctcccctttctccgccctccgtcgcggccgccttccaacccacgcttcccgctcccttcgccgccggccccactgatcgcgcgcctccgcccctcgcgccgatctcctccgcgggcccctccgcccatcgcaacgatctactctgcgccgcccccatccctcccctaaccatcgtcgaccccctccccttccaacctcgccggccatccgcccgtcgctcaatgcccgtcggagatcgccggccgccggttcccctaaccgccgcaatcgaccccataccggcgccgctgcacatcctgatcaccgggcaggcgcctttcatccctcggccggtctgcgtcgcctcgccatcaggtattgcttggttacatcagatgatccttctttagtattgataggtgcagacttgcagcgtttggttggactgaacattttgtacctttcaggagcaagaggttgaggtgtcgagcgcggagagagaggcacccaggctgacctcgctggtggcgacctggtggtctgtgtgacctgcaagtgtggtgtccacaaggagttcggcttcgaccattcccactgatcaaattagccagtccccttattccatcctcactgtcaatgtcaatttgttcttgcaaccggacatcaggcataggtatgttctatgctttgtacaaatctgctaaaaaattacttcacaattaatacaaattcagttgtcggggtttttcccccccccaaagggaagacaccaatccccccaaaaaatcttggggcccttaaacccccaaaaaaaaaactttgtgaaatgattattttggattcatggacaagcagtctttgtaatatatatttttgctgacatggcacaacgaaatgttgttgcaaatcacagaggtagttttacaaatccaaaaaaaagtaagtttggacacattgcatcccatgactgaatttctttgaaaaatgactaggcaatgaagatttaatcacagtgctgcctatatatgataccgttccctttgtgagatattctcaattcgcagactgtaaagaacagttgaagaactaatcttaaaatgaacttcgataactattattcatatgatttatagcgtaattctacttatttcaaatgcaattattacattcagttgataattgtttataatggtcgatttgctcggatacattatttaatttctgttcatttcagaatgttccaactattgaggaaggtcaacgacaggttgagttttgatctaagcattacaagatccttgcgtgtaagtatcatatgctcacaacccttttaatttagtaggatattgtggatgctcagacctttgtgttcaatttaaagattcttggactgtttcctggaatataatggataagatgtaggctcatatcttattctgtttgagaattcaaaattttgattgctcagatgtatgccaatgcatgtacatcttttttttaggggaaagcactgtaggggaaactcccacagttaaaggatattattaaggtataaaaataataaagtattacacctggtttaacaggaggttaatgtacatctttgtattatgaaagaatctattatcctactttgatcgcattttaacgctataatcactaaggaaattggacacactacatgactgagcatctgagacacacatgaatctgtagattaatagatcaatcctttatattcacaaaaaaagtgttctactacccttagatatgcataatagcattttttttccagtatgcctggcattttctgttttacgcatgtgacaaataaataattatttatactaaaaatcaatgggtattggtaattaatgttgtctctttaagtgatttactgacgtgcctatctatctccttaacgatacttttgctacgtgattttacttcctttatttactgaatgtttactacttggtggtggagagtttatttcctttaggtcagagattttattttcatgaaacaaaggtcactagggcttcggtggctagagaacttgtcaaacatgcccgacttacatgtttccagatatagagtttagtacctaattggatagagagctgaatggaatgctataaatggtcaagtccaatgatatgttttgatgaacatatgttacccttaaattcaaaagccgtgttacggaaaaaataaactatgtacaatgcagatattgtggtctacttactcgaaatatttcgttggatgatagttgggattgaaaagtagtattttcactcaatatttgttgcatgtgatctgaatctttactacttaaaaaacttgtagtggtggtggtgagtcctgaaagattgaagggctgatatccatccgaggatcctcccgcacaatcaacgatccagactccttcggatagcgctccaccgtattattccgtgtgtattcgttgttgttcctccgcctactctctctcaaacaaccactctctcctcaatgctaccccctgccgctccaagctgccacaggcctgtcgctcacctgtcgttccccatccacaccgccgctgtcgcatccccgttgctcacctgccgttccccatccacgacgccacccgggcctcccagctgcaccctccacacccccccgccccccccccccccaaaaaaaaaaataaaaaaccatttggacgaaggccagtgcacccaaattaccaacatcgcagattgaaaaatctgaccaatcaagctagcgctaccagtttgcagtagtgtttcagatgatatttcactaccatgataaatgcagtttctgtactattaaaactattttgttttcaatatagtaagctcaattcacataaaatgtcttgaatttatatggatgtttgattgttctgcttttgtaacatggtttctcatcaaatggcttcagcagctcacgaagtagcagaattacctttgctgatcttgctggttcaatgaacttgatcacgggttgggacttgggagttggcgactgaggcgcatgcagggcagcggcaatgaccaagtgttgggcgctctattaaggactgcaggttgtggcagtactgcagcagccagtgctttggtggggaggtcataattgttttgtagtatggctcttacggctgtccatttcatgtttatccaatttcagctcaaaatatttatttttatgcctatttcgtgctacatttgtccctcttttaatttttagattttactaatcatcttagctgttcgcttgatctgggaacaaggggatctgtgtaatatagggaacgagcaaggggacctgtgtaactgtgttggaggtcgtgggcttcgatacaaaattaattgggttgcagttggattcatcattggataaatgatctgattaattagttgtatcagtaattgttccaaagtacctgcacatttctatgttttctttactatttcatctctgcagagtgggaattgaaagattgcaatttaagatatttcatttgtgtttcaggtcctaatctttgcttacatctaagaaatttctaatgagaggaagattctcatttcaggtcctcatcctgttattcacccttcatgccaattcatgccaagctggtttacaatgcttacctgatcaaatttgcccatgttcagtaagggaacaatatgaatgcatcatgttggtcaaatatacttaggtaactgaatttttgtggttttctttcaggtggaaaatttttgacatagtagtgcctgcaatcaaatttgatgatcaaagtgcatgcaggcaggcagggttcctgacctgggcaatcaattgagggaaattaaaacttgcgagagttccattttgagttaatagaaaaaaaaggatattttttctatttaaattgacattttccatgagctaaacgtgaagtagcttgattgaatgcaagatctgattggcagtatcacgcacgtaatgcttatcgagattgttgatcttgcttgatgagagcttttgataacaaagctttgctgggcatattaatcaccagaccagtttgattgtttcacgttggtgcttgcgtcctaccagtattatgtactgaataatgtttctttgctatgtccttcactgatttactgattttggtaaattgaggcttctactgcgctcgatcttatcaaataattaagcatgtagcgtatgtggaatgaaattggtgggtaattaatgcccaaaccttacatgggtgctgctgccctgatgtgccagggagaagaaattgaggcagttatatatggtcaagatcagctaattaattagcaaatgcgattagcacccttgtggaattattatttttgttcttccctatacgtgaacgtctcgacgcatgttacaagttcgttttgctaactcaagtattggcattagcactaaagcggcattattttatttcctaccatgattgatgttttatacaataattttcgtttttctcgttacttaatactatttggaaactataaaatgtgatacaagtattatgtatgtattaaaattttcatatagtaagcatagcatatgcttgatatttatttaacatcattttactttcctcccgttgcaacgcacgggtaaccaactagtggtagaaagtaattgtagtagtgtgaagatatctatataaattttaaattttgactttgttcacgtataaatgtgtcaactaaaaagaaatttgcggggtcacattaaaaattaattaatgactgtcgcattcatatcatgccccaaaaatcttattgctttcatttatactttgtagatttttttttctatggttgtatcatataataataattcggtatgtgaataggtatgtgttatttatagaaaattctgggatatgttcactgcatacttcggctaacttaactactattaacaatcctccctactaaaatgtatatgcacgtttctttctttttataaggttataatgtatattatacgtggtctgtcactctgtcatacaaaaactactaccttcgtctcaaattaattgttttttaaggttgtttggcatattttaaggtttagaacaaaaagactacaatacccttataaaatattttatggttaaggatataagggtggttgaggggtagaataggaagaaatttgaatgggatatgattgatgggacaagtagtatttaggagtgacgagtattgtgaatttatagaaaattctggaatatgttcgctgcatacttcgaccaacttaactattattatcaatcctccctgctaaaatgtatatacacatttctttatttttataaggttataatgtgcattgtacgtggactgtcactttgtcatactaaaaactactacttttgtctcaaattaattgttttttaaggttgtttggcatattttaaggtttagaaaaagactacaatacccttataaaatattttatggttaaggatagaagggtggttgagggatagaatatgaagaaatttgaatgagatataattgatggaacaagtagtatttaggagtgacgagtattgtgggataaaatttgaatggtagaaagacaactaatttaggatggtgcatttgtgaaagccagtttccggagcagaaaaaaggaaagcccaatcacgcagagccgcttgttgctccgtgctattttttcgtttctggattccctattcttgtcccgtcccattcctttttcccttttccttgctgtcttcctcctgacgtgtcatcgtcggccttgctgcccatgacgcgatcaagaaacgccaccgcccctccgttcttccagagatcgaatcttgggggatcgagctagttggggttagcggtgtggaagggtcgaaaatccttggagacattggattggattgcagtggggcggacggcggtgggcggggcttcttgtaggctgggctgtaccagagaggagccaagacggcggcgataacggcggcaccggtggcgacggcgccgtcgccgtcggagggtgggggaggcgggtgcctggattgtctgcaggatgtggttcgggcgctgtcgatggggacatgccttacgacggcggagcagcgggccatggaggtgccggctgcgtcggtgaagggaggagggggcaggaggagtgacgaggaggcgcccggcaggatcgcgggtaacggcgcggggaatgtggcctgcctgttcactcggcaggggaagaagggcaccaaccaggatgccatggtcgcgtgggaggtatctggaccccaagatctcgaatccctttcttcttttgttcactgctcgtccacttttcagttgtaaacgtgagcttttttctttgtttaattggcaaacggatctaacttgcatggattacttgtaagttcagcagatttcttctttccttatctttttttttgcggggaaaggttcagcagatttcgtagtattacctatgtgtagtggcaattgagttgattctttctaacgaaaaagaaaatttctgatgcctcaataatttacaagaaaatttaaactgttgtttgcctttgtaatttttcaaatgaacattttttatgttaccaagcgatgaaggtaaatctacattatctttgtttgctgtagtttatcgatttgtttctgttattttacgttgttcactaatacaaatagcttgtttataatatttttggccctcaacttatatttctgatgtaatggtctatgcctgataaaatgctcgcagaaagggcagcaacaaaatgttacttatctggtaccattggtgagctgtatatataaatcaaatgaatggcgttattttgaattctaccttttctttctaacaactccaagtcccaacttttgctctctaacctttaaatggattaattacatgttctctaagtatcatgaatgagtgtctccttcaacacttctgttacatctttcttatgtcttctcattatgtgtactattaacaccctgtgaacactatggaacaatggacagaactataacggaagatcagacacggtattttgtggagtttttgatggccacggtccacatggccatctcattgctaggaaagtaagagatattctcccttcgagactctgtgatttgatatatgaagactgtggggatagtccaaccagcaattcagatgtctcaactctggaagagaatttatctccgtatgcagatgcagagtgcagatctcccacattggctggacaaaaagaacatcaagaattcttcaacgcaatgaaagaatctttcagaaaggcttttaaaaatgtggataaggagctcaaattacaacggaacattgatagcatttgcagtggaactactgcagttactttaatcaagcaagtaagcagtttcctctttttgatgtaacaaaatatatttactattacttaagaatttcatatgcagactatctaaaatcgtgtctatgccatcagggtcatgatcttattgttgggaatctaggtgactctagagctgtattaggcaccagagatcagaacgataagttggttgctcatcagttgactgttgacctgaaacctgatcatccaagtaatctctttcactcctaactttaagttactttaatcttctgtattttctcttctaagacatgatgcattgagcaagttcaacttggatgtttttatggtgatattaggctaaagtgttcccttgcatttcctttttccaagataaatattgagcaaaaagtatacactgtctttgatttatttgagtgttcaacctgccacgctgccaatgaaaagaatctcaacccaccttggtagactcactgcagactttttcttatagcagcaacactaagaccattagccccgttgatagatctcaacaactcatatgttgtttagcacatgcaaatcagcttaatattatgcaatgtgtgaacacttggcttaattttatgctccctcctgtctagtgtttacccctcagatgctagataggtcgccgggtggtagtcgtgctgcgccttgtacaatgcttagtagtgaaaacttggcttttctagatgctgcccttgttccatttctatacattccagataggtccttctcaaatactagacaccacaaagtacaacagtagcatttgcacaatgaaagcaaaatagttgacaccatcaatggagaatagaggcagcatgttcagtgactcagaagcctccagcagggtctgataggactatggtacacattgacatcccttacagtggccttactgtgatcctagtggaaaaaaccagatcatacctgcggtttaaccaaaaagaaccggaaccagctcattgattcaattgtgtccaaagatcattcgtgcatttgtaccagtttacaccgcctggtttcgaggtatgcaaagcattaaactgggactagttggactggctggagagagaagagtgtaaggctgaacaaaggtctatttataccttaaggcccaagggtgtgatttgacccttggtctagaggtttaagtcagtcaccctttaccatgacttaatcaggaaccggtgaactgacagcttggccggttcatcttctccagatggcatggatgtcaagaaagatgaccgctgtcttgttattgccatttctattagttatctaaaaataccatattaactttttttatgaaatgttgtattggcatacccatattgctgaaggaaacattctgttgctagggatctaccaagagtaaaagtttacattttgtaccgatattttaatagcgaatcttgtgttacaagattaaatcactgtaactgctatttgccattaaagtcatctgtaagagcatctccaagagttccctaatgccagctccaaaagataaattttaggaatctagtctaaaaccatgtctccaagagatgcccaaagaaggtcccaatatttaccgacaccctaaaccagaaccgatctgaaccaattttggacacctccacgcactcccaattgatgaaatcgggaggtttttgctgctcgcgccttttcttcccctgtcgtgccctgacgcgagatggccaagccctggccttgccccccacaacgtgccttgcagacttgtcaatgacctcgccgtctgctgccgcagctgctaggtacgcgcaagatcaccctcctgcacagcatagctgagcagctagcgtgccattggttggcagcacccagctccgatctccctcttactggaaaaatggaaagacaaaaggttgaagcaggatctacttaagatgatgtggcatattattattgcaaaccaaatttaggcgcactcttggagtcggaggtgatttttgggcccaatttcttttcggatggtcccaatccaagatttttaggagttaaattttaggatgctctaactaccaattaatggtgtgtatgtatggtcagttactaataatttaaaacaaaaaagataaaatgatctcttccataggtattttgctacctacagtactttgttttgtacctgcttgtgctaaactgataatgtgtaaatatgatattgagtaaatcgcatactagaccaccattttttgccatggttgcagtttggactaggggctaaccactcttttcactttgagctaggaatacttgcaaggtgttgtttttttttctcctcctagacctgttcttcctctcccctgctctctctctctctctctcatgttcttcctcccactcctctctctcctgttttggtttgagcctcaacgtgatggtgagcatctcctgtttgcgtcagctcatgggatgaaacttctgccccaccatgatggtggacagaaaggggaaggagaactcaaggaagaagaacacaggtccagagtgcaacttcttacaagaattcctagcccaaagtgagaagagtgggtagcccctatttcaagctgaaattattatggtaaaagaagatgctaaaatgcaatttactctatgatatttgtacctttagatagtcgttggcagtaagcacaattatcgtgaatcatcatattatgttcataatatcatattgataacgttaagcctgtgaaatagaatgtaaccagtgcagcatctttaacatgctgacttgtcatgggccttgggccaggagactgaggcccatgaccaagcccaagaggaaggcgtggtcaaccagggtacacgtgttgtgagcatgaaggacaataggcacacactattaccatgtcagaggaggtttccagagctaggggattatattagattggattattaggtgccagtctgtataagggtactcggcaaatgtataagatcgagcaatgaagaacaatctataaattgcccagttcatcacctcagcttatattcctcctcaaatccctagcagctgaatgcactactatcctcccagtagagtttattgccaatgaaaccttgcccggccgtaacatggttttattagaatgaaagacaccaaaatacgatatgaagactgaataagttgatgaagtgaatcaatgcttaagaagatgcaagcatagaataagaatataaggtggtaacaactgtaattgatgttgttcatcgcacataaggatggaatgatatatggtagaaaaacagagtatgttcaacttaaatcacatattttaattaattttacagtgagtgattactgcttatgttttgcccatcctcattagtcgtttttctctgtatgatctgtaaactgtagtagtagatttaccatcttcaggagatgcaatcttcagcactcattcttcaagaaagaaattcaagaattcaaacaccgattataaattcaaagctatctactgtgactcgtattcttgttaccctatgtttataaacttttgttctcttggacagatgatttaaaattaaattatcatgcacaaagattgtgcagtagttagcttgtttctttccatgttatgtatcaattcctttcacagcaagttctgtgttgtatggttatttgatgtattatatcttgttgactcatcatccatcagaacagctattctgatgagactatggttctgtgcttctactttagctatatgttttgcatgtacttttacatcttagttatcaaaaataaactctaggacatcttgctaggccagcacatttttcttgtgaatttttttcagccgttagtctgttgggaattgtcaccttgctccagtctaaataaatacaattttgagcataatcttgaaaataataacataatgatattctttccaggggaggctaggaggatcagacggtgtaatgggagggtctttgctcatcaggatgaaccagatgtggctcgcctttggcttcctaattgcaactctcctggactggcaatggcccgagcttttggtgacttttgtctaaaggattttgggttgatctcagtacctgatgtcacctataggcaaattactgaaaaagacgagtttattgtcctggcgacagatggggtaggtaacaaaaaatgattaacaattattttctaagtggcttcttcaaagagaagaaatagttcttaatcaaaatatgtacttcccaatttaaaatcgttggactgttttgtcttggctggctctgatacactattattttacattgcctacaggtgtgggatgttctctccaaccaggaagtggtggatgttgttgcctcatgctctggtcgtttcgctgcagctcgttctgttgttgatttagcaaatgagacttggaggttcaaatacccaacctcaaaaactgatgattgtgcagtggtctgtcttttcctgaacaagtatgaagttaccggtggtttatcagggcaacctggatatagtccaaggatgcctgccctatcaggtattacccggcccaatagtaaaagggttactcctgacgacgtcgatgatggtagtgactcaaacgtaagcggagatgagaggtccttggatggtttcactcgattgaacacattgttggcactaccaaagtttggtgacacaagtccaactaagaaatgagttggtaagcagatgagttttgcaggtgctttggacaagagagcatatcggctatattagcatgtccggtgagctcccgttctgatccagcttacgatagctaagaatgagtagggttgttttttttttttcatcctaactcccatttggttacgagttgacaattacgcagcaagcatttggagtcttaactcttatttagtcgagagtagacttaacctttttgtatagctgctcatcgattttctgtcttattgtatgtacttggcgattatatgtggacaaatcctactcattcttatggtaatttcgtttgtcggattatgacagttggaaccttttgctcaaaaggttcgtatgcgtttctaaaaaaagggggttcgtatgctctagtcgcatgcaactatgcaagccggagaaggtctaaaaggccaacgataggggtaaaggataaattccttatatatgaaacggatgtaattacacagctagttctagctggtttgtctaatacaagagacaccttccacctatacttcaaatataattttctcttaaactactcatccgatctacgatccgattacactgttgtatttgtaacaactaaatctttataagaagatctcacatgattatattttgatgaaaaataataaattacttttataatatatctaaattatttttagatttcactaaattacttcttagacatattaaagtaaattcaataaaacctaaaagtaatttacatatatatatatatatatatatatatatatatatatatatattatataagtaagtgttaaaaaagaagttataaagaaagtaactttaattaatgcctttctttattgaacaaattgtcatatatataagttacttttagatttgattcaaatacttcctatacattcataatgctttgaggtgattacttttattattgtttttagttaattccataatttgtgctgattaatttaatttcagatagagttatgtttttatctctacaatggatttacttcaaataacatgccaaagttgcctccgttttgttctaagttacttctataatatatgtaaattacttttagattttactgaatttatttttatatgtttaagaagtaacttagtgaaatctaaaagtaatttagacatatcataaaagtaatttgtgatttttcatcaaaatataatcatctgagatcttattgtaaagattaattgttacgaacataacggtgtaatcggattgtaaatcggatgagtaatttataagaaaattttatttgaagcatagatgataggaatattttccctacttacttaatagattagattcttcaagttaacacatatctgaattgctgctgataggggtcgctcgttatgactaaatcgagagtgctatcaatttaaattttgcgatatgaaacttggaaattacgttgaattcagaaatgttagtaggatatttgtccatgtacaaattatttttactcaaggtggtgtggacaaatctcaagcgtctttttttaatctaatattagtttttaggtgtccattatttttatttgtcgtttatcctcagtccatccaaaatagatatgcaagtggacaacagtttcattagaagcataacaaaccaccacttgctagtttatttcctatgtaaaaaaaaaagaagaggaaactaccaatctagcgcctggttccctaaaaaaattgacagccacggtggaatggatttcaaaaatggagatcacgatcgttgtctttttcctcttgagcagcaggccagcgctggcagagccagaactggttcggccaaaccatggtttcagtcgaaccgttctggtcgccaggctagccaggctcaggcaaggtgctgggctggactaagtccaagtatagctcagtagacacataggatacatattaaaattgaccaactctataaagtctgcatcctgccccaacccctttactggttctaggaaaactttaaaacgatggccatttaccttaaaaatactaccttcgtatccgccagcttgaccgctccgtgtggcaaaatatgtagccataggatacattttacggttgcaatcctctgatagaaggccctcccccaccctgatccagggggggccgccctccctcgccccgatcttcctctgtctcctgaagcggtgcctcccgctggcttcagtcgtcaagctcggtggcggccatatccgaccgccatgagctcgtcggtaggccgatccagctgccatcagcagcaccagtataccctgggacgatccggccaccatcaacaacaccaacatcatcttagctttctttgatggatgtggtaactttctgaaccaaaaactaacccaggactacctaccattattgataatcattctttttggagctttagtgatctttaaatgaaataatccaaatttagccgaaccataattttctatgcaggatcttagatagaaagaataaaaaaaatatttgcttcattgtcctaccatggaaattaatttagatagaaggtaacgattacaatatgcattttgtactaagcttaagaattgatttttcatacaatattggtgattgaataattgcttttacaaagagatggcatgaggcatgtcattttttcttttgtggttacctaatgtttttctgcatgaacatatacaattggttgagcatcttgaaaatatggatctcaatcgtatcctttttacttttaaaattttaaaatcaattcaggtgcaccttgctagcagctagcttcaaattggcaagttcaacatgtgtttttagttagtttgttaatggagtttttgttattttcatatttaatccagtatacctatactcatcaaactaggatatatatggtctttgttcccattatgctgcatcctttctcccatggattaatttgatggtaacttagctttactgcatggtttgcttatgcattttctattttgtttgatagcttttagaaatagatatgaactgataacttgacaagtgataaatcaaagctattttggtcttttcctactttatctaacttgcacttctagattcacaccttttggagtagtatagaattcaactgaatttttggatgctattcatgtacttgcatatttttagatttgttttgagtatatcgatggttctcctaccatggcaagctgctatatctgactttggattcagacttatgggcccaggtattggttatttacgttttgctataatcacattatactaacaagctgtatgtccagta

SEQ ID NO: 71274 - DNA, 11867 bp, Oryza sativa
  unsure (1)..(11867): unsure at all n locations
ctaatattttgagaggggctaattcactttagccccaaattagcccatctgtttggattcttaggggctaattcagggctaaaaggtgagggctaataattagcgtatagaaccaaacagggcccagctctttctccacaatacaagctatgggacccacagtaatattatattttctttctttttttgagaaagtaatattctattttcagtcctgcttatttgcgtttcagtcatccaattagtacaaacaccatcataaaaaagaagaatcatatcttactataaaataaagttacaacccactaaatcctaaaacttaatatgcaaaataccacatcatcattcactaataattattacatcttaaacatcatgtgagcatgctatattatctataattttatgatttattaaattttagagctttaaaatacaaacatgttaaattatcatcccatataattcacataatattttaatatatatctccatcattttttataatattctatatacctatatagtttatcctcatttgcttaatattatttctcttctcgcattaagtcatatcacattaattgtttttagccctcagatgattaatatatggtccaaattatctccatcattttcttgtcttattaaaccatatcacctcaattttattttatgccttagatgattaatttatggttcaaattattttcctccttttcttctcttataatgccacatcaccttacttttatatttaaatcatcattttatatactatttaaattaccgtaaaccatatcaacttatgtaagattatatcgtctagcaattttacacattatttctacttattgttatcattctaaactcccgcagcaatgcacggagttttaccttgttgtatagaaaccagaaacattttcctcaacctatttccccaccattgctcacctcaagcattcgagctccgattctcgcccgcctagcgcgtcaccataggtgccagctggtacctccaacctatccttccccaccactgagatgctgctttgccactgctgtggcctctctcctcttcccaccttggcaacgagcaccgccacctccacaggcctctcccctcccctttctccagtcatcacggtccccaacacaacttaaaaatgattttacggatgcatcccctattttatcgtaggcaagctaaaacaacatccgcatgtcaaaagatttgggtggtttttggttaagatgacccgcatacaaaaatatgctattttcgtaggcggtcctcttaagagtcccaactgcaaaaatatattttcagatgtggaggttcctctccgccctacctccccctcacctccactcttttatttcgttcgtcccactcccaattccctcacccactgctccgttccccctcacttaccctctctttcccaatcagccggccggcctcctcgcctctccgagcggcagtggcgggattcgagcttggagcagcaacggcctcggacagccacaggagcagtagtgttggcttcgtgcagcggtggtgaccacgtcaccatgagcggtaaccacgatcacagtggcagcgtgcggtggatccactgttggcaggctcaggaaggatggatatgctgccagcgggctcgggaaggacaaatctgctgctagcagactcgggaaggacgaatccgctgcctggctcgggagcggctgatccgtcctcgcatgtggcggaaaggaggccgaaggacagcatgtgaccacggcaccaggagcagcgaccatgatcacgatggctgcgcgtgtgggctcgggagtgacagatctgtcgccggcgggctcaaaaagggtggggccngggccccttggctcgaaaatggcggatccacgctcacgttccatataaacaacggtcgcgtggtgacatttgacgccgataaacctctgcaacatttgcctcattgccacctagctatggctttggttttttttttaataagaccttcaacttggccacttgcaaaaattcgatctttgcaagcgcgccttattaagatgtctatatgcaaattatggtatcgcatgcggttttggcagtgcacatgcccctgaaaataccgattttcgcagactccttgcgcccgacaagtggagcactcaattgtgaagatcctttatgtagtaatgcaacctcgtcgttggaggctgtaggtggagcatgagagcatgatatgttccttttgccttgattgataccaggcttgttccttaagtatcatgctgacatcaatatggtacataggtaatagaatatctggtatctacggtatcatatcttatacatgtatcatgctaacgtcaacacataaagtgttctattggctgaacggtataccgttctctactcacactcgaacaataaacccaattgtaagtacaaatccggcacctatggtaatctacgtgtttccatatatatatatatatatatgtgtgtgtgtgtgtgtgtgtgtgtgtgtgtgtgtgtgacatgataattcatgttttccattttcggaaataaattaatttagccatatataccgcggatgcaccaaccgagcacgcattcccgcacatttaattcccggtttaattcatacacatgtctactatgtactggcacctgcctatatatatactgggatggcagcaaagggcacacacgtacgcacacctgtcttgcgttgcattccgttgctttctcttacgagcactgcgcaagaagcgagagcccaagagcagctagctagcaatgggtgtcaagctgttggctgacggctgcgccggcgcctcgtcgtcgcctgcgctgtcgcgggtggcgacctccgcggcgcacggcgagggctccccctacttcgccgggtggaaggcctacgacgaagacccctacgacgccgccgcgaacccggacggcgtcatccagatgggcctcgccgagaaccaggtctccatcgacctcctcgagggctacctccgggagcacccggaggccgccgcctggggcgtcgccggcgacggcggcggcgacagcttcagggacaatgcgctgttccaggactaccatggcctcgccaacttcaggaaggtacgtgacaacctgacaattgacaaactgctctgttttctaagcagcttgcttgtccacaactagcttgcatgcatggctcccgagtttgacttttacatctggatgattgcatttgtttctcactcgtcaactatcaatctgatggtcgttgactcgttgtgaataatttttgaaatatttgaccaaattcttatttattgtgtacatcctgtaaaaatgctctgtatttggcatgccgagttggacttctacaatttgattgcattttgtttcagcctcctcaactataatcagccaaatagttataaatatttttttgaagaaaaaatgacaacatttatacaataagtcttctaccaccttgtaaaattgtaagtccaaattttatctacaaagagaaataaaataaaatagactaatttggttatgaatgatactaacattgcatttagtcattttttgatgcgtagtgcagataaaatttagtaatgcatatttgcgaaatgatacataatattgtactatatgttacagattttttttttctaaaacaatacaacatgcataagatgggtgaaaatacacaaaaaaaaaaaacaaatctccatgcatgcaggcgatggcaagattcatggagaagataatgggtggcaaggcgacgttcgaccccgaccgcatcgtcctcactgccggagcgacggcggccaacgagctcctcaccttcatcctcgccgaccccagagacgccctgctgatccctaccccttactatccagggtagtcgttcaacctattacttttcgttccataatataataaattatactactccatctaaaaaaacgaattcctacatgtatctaagttcgtaggtaggatttgtctttttttttggacggagagggtagctatgaatctgaataaggttatatctatgatcatagctagaaaattatatttggaacaaaggtagcagcaatgcatacgactagccagtttgtactccatctgtgccataatataaggaatttcgggtgaatgtgacacatcctaatacaataaatctaaacagatagtctgtccagattcattctatatttgtactagaatatatcatgggacgaagggagttatgttgtgccaataatcctgtgcaccagctcagtgctcagcttcagacccatcagagtggctgacatgacatccatggcggctgtgcgcgcgggtgcctgtgcatgcaggttcgacagggacctgaggtggaggacgggcgtcaacgtcgtgccggtgcactgcgacagcgcgaacgggttccaggtcacggccgccgcgctccaggcggcgcacgacgaggccgccgcggcgggcatgcgcgtccgcggcgtcctgatcacgaacccgtccaacccgctcggcaccacggcgaggcgcgaggcgctcgagggcatcctcggcttcgtggcgcgcaacgacatccacctcgtctccgacgagatctactccggctccgtcttcgccgcgccggacctcgtcagcgtggcggagctcgtcgagtcgtcgtcctcgcgcgcacggcaccgcggcgaggacgacgacggcgacgtcggcgtcgccgaccgcgtgcacgtcgtgtacagcctgtccaaggacctgggcctcccggggttccgcgtcggcgtggtgtactcgcgcaacgacgccgtggtcgccgcggcgcggcgcatgtcgagcttcaccctcgtgtcgtcgcagacgcagaggacgctggccgccgtgctgtccgacgaggcgttcgtcgacgcctacgtcgccgccaaccgggcgcgcctccgggagcggcacgaccacgtcgtggcggggctggcccgcgccggcgtgccgtgcctgcgcggcaacgccgggctgttcgtgtggatggacatgcggcggctcctgctcggcgacggcggcgacgccgcgaccttcgccggcgagctgaggctgtgggacaggctgctgcgcgaggtgaagctcaacgtctcgccgggctcgtcgtgccattgctcggagcccggctggttcagggtgtgcttcgcgaacatgagcctggccaccctggatgttgcgctggagaggataagccgcttcatggacgcgtggtgcaaagcaacaattgggaaatttaaccatttgcaacccaacagatgtgaggtgaattattttgcacttgagaggtaccaagggcatgtgcaacagtaatcgattgctgccttagcctgctaattaggtaacttaatttgttgatgtggagtgaagagtgaggagagaaacattaactcgatcttggcctaagatataaggattgatgggcattttgaggccagggaaattgtacgagattgggagaagagagggaggggaataaaaatttaatttagtggattaagtttttttttactgtgaactgtttgctgctaccttggaggctgtgtgtgtaggctcaactgttctttttttccagaatgcagatgttttttttttcgaaatgattgaatccactaaaatactagtttaactattttcttattattttacccctatttgtgaggaccggtttagttcaatcaattttgccactctgatgttaatatagttttcacaaaaggagatgaacatctccctcttccacgaactgagtctctagatactcgtatttacaattaattatttatatttatacaggtaacagcggctatgtatctgtaagcgactgagtgcaagtactctgttttaagaacatcttgatctcccacgcaagctaaagtagcacgcatatgcatgtggcatggtaatatagtttttggccatgccatgtgtgagctagtacgatcaaaaagttcagttttgaaaaaaagttttggggatttgtttttaaaattatttaacaaaatggtttatgtaacaaatataactagcatggtggcccgcgtagattgcgtggctagtatcattatattttctctcatataatagcatatatgttttctcattatattattaaaatatattacaatgacaacatgattttaaattttgcaataactttacgaaactattaatgtgtaatattcatattgtattttatatacgtgttagttattaattatttttaatataaaattttagttatttgtaaaatatatatatttctatatggactctagacttgtcttttaatatttcttttttttaattctgaatttttattatttctaattgtatttctatgtggactctaaactcatctttcaatattctttaatttttaatttcaaattttagttacttctaaattgtattcctatattggctttaaactcttcttaccatgtttttcttaattttgaattttagttatttgtaaattgtatttttatacgaactctaaacactacttttcattttattatgtttattctgaattttagttagttttaaattcctatatggactctttactctacttctaatattccttattttttaattccaaatttcttttttttcttaattgtatttctatatggactctatactctacttctaatattcattattttaattccgaatttatattatttcctaattgtatttttatatggactctatactctatttctactctacttctaatattccttatttttaattgcaaattacagttatttcctaattttatttctatatcctcttctaatattctttttttattccgaatttcaactatttataaattgtatttctatatgaactctagtctactcttctaatattccttattttttaattctgaatttcagctatttctaaattgtatttgtatataaactcatctttcaatattctttaatttttaatttcaaatttcaattacttctaaattttattcatatattgactttaaactcttcttcccatgtttttcttaatttcgaattttagttatttgaaaattgtatttttatacggactctaaactctacttttaattttattatgtttattccgaattttagttagttttaaattcctatatgaactttattctccacttctaacattccttatttttttaattccgaatttctattttttttttcttaattgtatttctgtatggactctatactctacttctaatattccttatttttaattccgaatttctattattttctaattgtattcctgtatggattctatactctacttctaatattccttatttttaattccgaatttctattatttcctaattgtatttctatatggactctatactctacttctaatattccttattttttaattccgaatttcagttatttataaattatatttctatatggactctagtttcctctcctaatattccttattttttaattccgaattttacctatttctaaattgtatttctatatggactctgtttttctttttctccgattaatatgagaatttctagaccgtgagagcgaacgtggaggcttatttttctattcctttaataagttaatacatagatagatagatagattaccttgcatgccatacggttggggattatatgtagattatcgattttgctatatctcactcgaaagattttttcttatctctcactcgattttctcactcaaatttacagtgcattttcttgtaagttacagtgtaatttatgaaacaaacactgtaacttttgtaagttacactgtaatttttgaatcttcacatgtaaattttaaattttgtattggatttggtctttttcttgaggatatggtaatttaatgttcattatggtgtttcttaattgctttttgctttttattatatctatcggattttaatataaagattaaaaatctgtgtgatacgattataaaaatttttcgaaagatgtataggtactcccgtagattatatatagaaattcagaatccgttctctgtcactccgtttgtgccttgtgcggttgtgccgctgaatctgcagctgtcctgacccctacccctagacagtagagtctccattttcctaagcactgcactgcacgtgttattttttatcaccatgcatgtttgtatttgttattttaatttaaattgaaaataattatggtacattcacaattatatttgttattatttttgttaaaatttatagaagttgaattttaacttacatatttatgaaatgatatattttatattaatttatcttattaactttttttttaaaaaaatataactacttagatgacatacacgaaacgagaagatatattctcagagagattaaacactttccgctttggatgcacgatacggcaaccgatttatagttttataccatgataatttccgtctatatacagtagtaataaataactagtctccctacgaatttcaacgtacatctcggcgtatcgttacagttcgtggtggaaggacacgtcgacgtcagcctccgccgtcgtcgtctcagccgtgtcgttgtccctcttgttgcagccccagcggcagctccacgcgcaccgggagttgaacgactgcagccgcctggagtgcgccgccacgatcccggcggtggccgccgcccggggcagcacgacggcgtagccgtcgtccatgtaatccgtgccctccgggaacacctgccacagcagcgcccccgcgccgccgccgccgcgccgcgtcgaccgcagcatcgcgccatacaccgcctcgatgaacgcgtccctcgacgtcgcgttgaacgccgcccgggcgcccctcgtggacaccccgaactccgcgaacagcaccggcatgccgccgagcgcgccctcggcgtccgcgatgtgcgcctccacccacgacgtcgcgaacctcagctgcgcctccttcgtcgcgcccgccggcagcctgtcaagaatgtcgttagagctgcgacatctctgcgtctccggccgccgcggcggctggctgttagcctgttgccgcttaccaagtgtccgggtagacgtggacggaggcgaagtcgacgccgaggacgcggtggttgcggacgaagtcggcgccggcgagggcgacgtcggcgttggggttcacccggaggcgcgccggcggcgaggacgggccgtagaacccctcggcgccgacgccgagcaggtgcgccgggtcgacggacttgacgtggaacgccatctccgcgatccacgcctggagcgtgtcgccggtggggtcggaggcgcagcgcggctcgttcatgagctcccacgccatgatggtcgggtcgtccctgtacgccacgcccgtgtacgcgttcaccctcgtcagcaccgccgtgacgtggctcttgaagtagcccctcacggtctcgtcggagaagaaggcgtcggcgccggcgccggcggcggcggcctgcgcccaccgcacgtactgcgccttgccgccgtagtcgtcccagttgttgatcagcggaagaatcagcctgatcttgtgcttccgcgcctcgctcaccacgaaatccagggcctgcatgcgcgtacgcaggtggggaattattattatttttgaacggaaatacctggagaattaattaatcaattgaatatgaaatgcaagcaatcgatcgatcacttcgatagatcctttcaaaacgaaaatgacacgtatgtattatgtatatgtttttacgcgatcgatgctaattattgggtgaattgcgtctcagtttagaggagagatgcctgtcgtccaacccaactatgatggaatcgaatggaaattgatgcttgtggagatgtttgaagccagcaggtgtcttatctgcaagcacaatgattgtttattctgcatggtaaaatagcacaatgcatgctacatggcattcttaacggtttctgaatttgtggacaccaaagagttgtcccaggatactcatagtgtggtcagttcaacgataggattgtaaagctcaatccagtgtggtcaggagtacttttgtattgatcaccattagttagtaaatgtacaaatcatgtaatctagctatctatcatgtgaatatatatctcaatcaaggatttaaataaacgcatcattaggtataggcacagctaattgatcaatcgacgttgacttccacgtgttaaataatatttggtttacggtaaatgaaatacaggtattcaaatgtgtgatctaaacaatatacagttcaatcaaaaagaaaacgaaatatttgcgagcttgggtggcagctggctagctacgtcatcgtcgagctcgctcaccttgaagacctcctcgtcgtagactccgggtgacttctggagcgcccgccacccgccgtcgttgaacgcccacgtccggcaaaccgtgagcccgaccgccgccgcctgccggaacacctcggtgaccttccccctcgtcgacgggtcgacggcgaggaccatcagccagtacgtgttgaacccgttcacgtagaacggccggccgccgccgacgacgaactgcgcgcccctcgtcctcaccatcccccactcgccgccgccgtcgaccacctcgctgctgctcggaccatcgccgtcgtcgccgtcaacgacgatgtcggtgaggcgattacagcgccactcccagtatgatgactcgtgtagaacggcgatcgctgcggccatggcgagagctccgaggaggaagaagaagatgcagtggagcagggatgccttcctcctcgcttcttcctccctgtacgacgtctccatggccgccgccgccgccggtggtgaagctccacatggctgcaatttataccggagggaggcatgggagctgagcttgatgagatccatgtacgtacagtcagtgagcaagacagggtcgtcttggcttggaagcaacagagagagagagagagagagagagatcatggatgcagatagatggtggtggctattactatcatggacattgctgagactgatacacttgttttaggttaaggttttaagcaaaaggaatcgttaagatgtcgatttgggagggaagagattgagatgatggatcatggattagatttggcggtgctggggaagcggcaacgcaaagcgtacgtggctgcacgggagaaaatcgacgcgttcttgttgggaatgtgggcctttgtgcttctgtcttttgtgcgttagttgggccacgcccttttcgtaaacaggccttgctgggctggattttgatgtgcagttcgggttttgcttgcacgtaaccccctcataatggctcactctcttcccctcaaaatgattcactgaactggtgtaaaaaaaatgatacactgaacttattctgaaaaaataaattattttagtcatctgaactatttcattaaaacacttaaccctgtaaactatttcttttacttattttgtacagggccagtcctaaggcagtgcggtcaggacaactgccatgagctcctaaggccctgcaggctggtagtagtagtataggtcagtgcagcttccattcagttttagatctcgatgttattgattccaacttatacagatactctctccatctatttttgatagacatatttctaaatctgaaaatttatttttgataggcatatttcaatctaaccacctatcatcttaatgactttctcggatttaatgcgtaactctcca

SEQ ID NO: 71275 - DNA, 1284 bp, Oryza sativa
acgaatgcacgcacgtaataaaggtacatgggctccctaaaaacagacacaatttatgaaagtatagaagaagtatggaaattaaaataaaggaaaattcacggcatgaactttgctatagtttggatattctcaaagatagatacaacaagaattcaaaaaaaaaagaattcacaattcatgacaataaacaacagtgtcaagttatacataaagagtaaattaggatttattatgtaaaagtactaatattaatagatttatcatgaaaaatgctttcatatatagttatatgttagtaactttttatacaacataaagttagaaaaagtaataagggaacatgtgtttttggagactgtgtttgtgtctaaaatgtaagtaaaagagaatggagataataacattcagttccatctactttgtaaatttcggcggtgccagccagcattaattaatgaacccatagcattgaattggcacaacaagaaaaaggagaagtctttcaatggtcaagatgcttttgggcggagataccacacatctaataatgattaaagattgaagggctaacctcatgtagcactggtacatgcttaatttaccgctaaatatacccacgtgtgcatgttctacactactatagatcctgctattgttggtggcctatttattattggtggcctatttgttatggatcaatacaacacatcacagaaacctttatctctaacatgtagaacattagcccgcttaagattatattgtccggaacaacctgccacaaatcgaggttatatgtgatatagtaattgtagcccgtcacggatcatttatgataggtcataacgacaacccgttatggatgatcccacacctttaacagtctattaacccatcactgataagagtgacgggtacccgatagaaataacaaatcatccctaacgagtttgttttttaacccatcaccaatgtggaaaaaccgattgagcggtcaattgcatgtcatccacacataaaagatcttcaagatatctctcttgctagctagtcagcctctcccttcttgttgctatctcccaccttcaccgtcagcaccaactccaactccaccagccatgccggcaccagctcgatctcgaccggccactgcagcctctagatctgagagttcaggccgctagcctcctcctagggtcaaatatgaagaacaccgtttaagcgtaatagcagatcaaccaacaaaactaatgttggactataataatggattaaatgtta

SEQ ID NO: 71276 - DNA, 3285 bp, Oryza sativa
tcatgggatctaaacaaaccctaattttagccagacgtgtcacgtatatgatatttccttggctaattaaatttaagcatttgaaacaatctgtcaaaaacataaacatgcgcatatttgaatcaatcacataaagaaaaaaatgagtaaaattaagtgaaaaatatgatgctatatttttaccaaataaactcatatggccatatatcacttaataaccaattaaccatgatgccatcagtcaaaaaaagaaaaaaaaaccatcctaactaaaacccaaactaaaccactgtcacggccaaatcctcttttcaaccatgcagcacattaatcaaacccccataaactccaagcctctccaatccaaccataaagcaacaagagagaaaagaaaaagaaaggaaaaaaaaaaccaagcctcagctcagctccccagttgcttcccctgctgcatttattaatccaaagcagcttccttttactctcgcttccctctggcacagctaatccaaatcctcctctttttcttgttttttttttctttcttcgtcttctccaacgcccaaagtaaaacaaaggaaaaaagaaaagccgcatccaagaacgcaccagaaatttcggcgacggttgcgcgcgaatccatccatccaccggcggtcggagggcggcggcggcggagcaattccgcccaaccaagcggcggagtcggtgcgggcgaaatttccgggttggtgcgcggggcttgggttggtggtggtggactggtggtggtgtgtgttcttgggagtggatctggcaggaggctggcgatggggaggcgggagtagggggagcggcggattggagtgggaggcgcggtgttgggggctcccatgggcggatgcttctcgctggaggagcaccggctccagggcaagacaggttcgtccgtgttctttcttgcctcgagctatatatatcttacttagtctctgatgtgtgtttttgcttgtagtagtagtagtagctgtgtgcatgttgcatggaagtgaagtttttgttgtaatttggttgtgaatttagtcgtgcggttgggtttttgggcgtattgggggctatggattttcagcgtatattcagcttcagaagatttggtttttgagcgagaattgctgtctcgtttatgtcagagttccgacaggatcaattttgtctctggggctatatcatgtagtaactcgtgttgcaaattcgggttttttaggcatcgcgtggttgatgtttgattcttctgtgactgagtgtcgagtgtgaggaatgccattctctaagtgctaaaagttttatcttattggacatcgttacattcaggcctctatctgtagcttagtttctcttttttctttgacaaagacgaaacttgcatggtacaaactttgctctttgatggctggtagaggacacgatattatgatgtactggtatgttgtctatgaaatttgcagtcacggttcctgaaaagtcaaactgcagcaagtcaaatttagctcataacttggtttgaactacattggcaaagctgctagaagattttaagttggttggatggaagtatcgagtaaccctataacttagatgcaaatggtctgttctgcatagaagattcttgttcagagactggaagagatgacaaatgttgtcctgcatataggaccatgagcagcaaatgcgtgtttggagctattctagaattttattgagataccaaattaaattgggaccttcctttgtcatgtcatggcctttagctgcacattaacctgccacttgaacgtggaggatgatcaatgaatacttttgttgctgtagagctattgcaaaatgacattgtagcttgacacaatggaacacatgtttcttaagttagaagatgaacaccattttgggtaggttagtggtatttacaaactaagatgttatgcttatcagattatcattttgacataatgcacaacaacattacagagactgcacagcaggagctgtatggggggtgttatatgaattaaaaaactaaagtactaaggcaaaataatcacgccacattgtagctcttaatgttcgtatgtaattgattattccctgatgttttttcttttctattaattctataagcagaagctggtgggccagatgggttaaggaaatgcaaatctgattctaaagctacagcaagtgtccttgcccctccaaaagatgtggaggacctgcaaatcgaaggatacggaaatgttaatattttcacatataatgaactaagagcagccacaaaaaacttccggcctgaccaaattcttggagagggtgggtttggtgttgtttacaaaggtgtaattgatgaaaatgttagagcgggctttccatccacacaagttgctgtgaaagaattaaacccagagggatttcagggtgacaaggaatggttggtaagtatccttgctttatttcattttttttgaaaccatgatgaactatacacaagtctatcagccttcatcagctaattagattttacgattcaatttaatgatcataatagttgtttgttattgtagtttctatattacctgacttatttacattttatgattttaagcaaggacattgaaagagtacttttatactgattagtgtttgattaaacagcatatatcagatacttatagttttattatttgtttccaggcagaagtcaactaccttgggcaacttagccatccaaatctagtcgaactgattgggtattgctgtgaaggctctcatagactgcttgtttacgagtacatggcttgcggcagccttgaaaagcatctttttcgccgtaagctgaccctttccttcttgacagttatcactcccacctactgaatggccgttgtccatggcagcagaacctgcaacatgtttattgtttttgcattttcaaaagtaaaaaggaaaatggtcagtttggtgcacgctgcatgaacaaaaacactaatttattttcaacaagatgagcagatctatcagtagaattaatataaatgcattcacacttatatttctttcagtgctcgatttactggtgcaatttaatctaatgagtagtgaccactatatacaatttagttgtatctgtgtacccgttccctccatgtaattttcaaaaataaaggattttcttttgaaacgataatggttagcatatgttttgaagttctcccaagtcccaactagctactccctccgtttcacaatgtaagt

SEQ ID NO: 71277 - DNA, 3123 bp, Oryza sativa
ctgttctttcgtctctgcgtttttacccaaaagaaaatcaaatttgactaaaacttgtaataattgagcaaatcacaattgcatgcaagaacatggtgtaccgtacccggacaatccggccggacgaacgtgctcccatgtgcttgtaaatgtatgattatttaattttgatttaattactgtattaatcaattttgattatgtgtgatgcagggcttggacccgaagtcgacggccgacctgttctcgagcgcggcgtgggtgggcgagaggtgcgtcgacggcgacgactgcttcgtgctccgcgtcgacgccgaccacgccgcgctgcgcgcccggagcagcggcgacgtcgaggtggtccggcacgccgtgctcggctacttcagccagaggacggggctgctcgtccgcctcgaggacagccacctgctgcgcatcggcctcgcccacgccgccgccgagagcgcctactgggagaccaccatggagtcctccatcggcgactaccgcgccgtcgacggcatcaacatcgcgcacgccggccgcaccgccgtgtcgctgtcccggttcgagagcgccgacgacgccgccgccgccgcgcgcggtagtaataagcggtcgtggggcaccaccaccatggaggagacgtggagcatcgaggaggtggacttcaacgtcgtggggctctccatggattgcttcctgcctccccgggacctagtgctcaacgactgcagcaagcagcagcagaaagaggacgccgccgccgccgtcgtcgtcaaggacgccgccgccgccgtcgacgtcaaggacgccgccggtgccgccgcgaacgccaagggcggtagtgacgacggcaagaccaacggcggtgacgtcggccgcggcgtggtggtgaagaaggcgcttgttccggcggtgaccggactgggttggttcggtccggccaaggtggttgccgtcgacgacacggtggacgacggcgtcgccgccgcagccgacgacgacaagtaaatgtagatatctctcggctactcgctagatcaggtggtgctcgcttctgcgcccctcaagagtaaatattaattcgtatagtttaagttaatttctactacttaggaacatgcaagcttgatcatgttatatgttagatctagcaactgcattccattgtagatgttgggggaggagactaagtttatgttcttctccattcgagtttgaggacattttgcgtagtgtccggccggtgcttcattcatgatgtaatttaatactttggaaacaaacatccaaaggaaactttgtgtatccattttgttaagaacgacatgggggcttcagttccaggtccattcatcagaaactaaagttattaccgccaacgacgaaaagctccaaaattttgacaaattgacttgtttataaaaaattattttaaaaataaaacgtaaaaaaataatttcagaaatagatcatgacctcaacgacaattttgtgctgagctaaatgtctcaactccaccactattgatgttgagatctcatgatcttgtccgacgtgacataaatctgcaaggacacgggagctcagcataagtgtgctggcggcatcgatcgatgtatggttcagcatcctccactatcctccgaatgcatatttacattttttgagttgatattaagatgcaagaaataatttgaaccacgtcaaaatgtgatcaccatcatggatctcaaaaggtacaatctggaacacatacacatacgcacacatccccctccaaacaaaaatatttacgtaccagattaaatcttagcctctacatctaaattagatgaatacaacaccaacccaaaaaatataaactatttcttagcttccaatgttccaatacaaacaacaagatatattacttcgctcaaccatgcgcaatcataagagtggagtgcattttccgtacaataaaataaattgagtgcctaaacttcaggcaccatttttcttgttctagctaggtgacaatccaataattctcaacacttctctattgctaatttaaaaaagtctattcgatttaaataaaaggtcaaaacaataaattattatgacataaaatgcaaagttatatgaaatgaacttacaattaataaaaataaaaaatacattaaaataggcttagataaagaaaaaattaaaccatatatttcaaaaaatgctaaaaaattatacattttaggtgcattaagtgtgaatcttttttggatgggtcaactagggtgtgtttggttgcctgtatgaggcctggcccacatctgtagatgcaattttcggtttttggttacctgcgtggccttcccagcctgccccgctcatgcaaaaaggcctccgtagccaggctgagtggaaacagtcaattcgagcttcacaactcagcttggcccgatggatgtaactggctgtatccgcgcgtgcaacggtaaagatggggtcagtttgcccctcctcatttctccccccaaatccaaaagctagggtttggtgccagcgtgccaccctcctccttgacactactcgtggacacatggcctagaaaagagagacgtacatgggctgatacaagtgcatatagatgtattttgtcgttctccatcatccgcacgatatataaaagttagagtaaaatgcttggagagggtcatctaacttatttagacgtgtcacataggtcactcttctaattttaaattgcacatctgaatcacgttagtgagtcaactgagtcatttagtcaactaactatcacatgaggacgccttgtatatatgacatgtcacctagaattgacaaaaatacatcatccgcagccgctgcctcttaggaattcgactccatttctgtttacatccatagtttatcattgccgtcgggtttgatggcaagtgagagaggactgagaactagcagaaaaactcatcaaaacagacacaagtgaaatgatttggttcctttcatttcttgttagtgttgtgacaaaaggggaaaagaacacacatgtggtttcctgcatgtccaaaagcaatttttccaataagggcacccacaatggttatctatagg

SEQ ID NO: 71278 - DNA, 8852 bp, Oryza sativa
ggatccccctattttcatgtctggtccatatcctccataaacggaacatcacaaatttttattatttgtaatttaaaaaaaaagtacagaaaacatggaaatgcataactactttttgagaggtctgcatgtcctgcaccagcgaaacaatcggaactaccaagtttgcatctatttataggaattgtattagacttgctcgacgaaaaagccggccaacgatctctatgctgcatcatgcgtccatgcctggttttctttgccccctgccaccataaatacgcacccaactacaacatggatcaccaaacacctcgatccatccctctacccttcaagaaacaagaaagataacaccaacaaactagctagctcgccaatggcctcgttgtcctccttccggctctctgtggcagtggcggcattgttggtcgtcggctcgtgcgccactgaggtcaccttcaaggtcggtgagggttctagcggaaaaagtctagagctcgtcaccaacgtcgccatctctgaggtggagatcaaggagaagggcggcaaggactgggtggcactcaaggagtcatcgactaacacctggtcgctcaagagtgaggcggcgctcaagggccccttctccgttcgcttccttgtcaagaacggcggctaccgtgtcgtcgacgacgtcatccccgaaagctttacggccggctctgaatacaagagtggtatcaacgtctaattaatagacatgagtattcttgcattgggttgcatgataattattaacctctaaataattttgtcttgaaagagatcatgctatgcgtgagcaagcaaacaattaatttcttgtggttattttgttgtaataagccagtggcaaaataaggcatacatgtgtccttccaaaacattgttgtggagctatatgtgaacacgatttcaaatatatgctgtttatagtggatgtatggaaaaatgttatatttggttagctttcattaagacgattgtgtgtatttgatttctcaaaattttagtacatatatatgtccaaatcaatgtagcccatttctcccttttagcttgtcataaatattgtttacagttgtttttttaaaaattttgtggaacaaattgttgaatcgatcacaccgtgacatgaaactataagtataaagaatcagtacatcgtttagcttattcagatgctaaaacaaaatgtaagtcacattaactaatcatatcttctggacccccgtttttataacaggaatcattcgtgtaaacagtaccatttccctggatcaagtagtctggtacacacgagttcatagctgaaataccaaaagcacatacacgagagtctagtgctaattattacatcataagcccgcaggcattgtcttaaatcatcggaccgagcagttcggaatacatccaaaatgcagaaatagataaggcagcggaattcaggcgcagcggcatgccattgccacaggcaacgaccgtactaagacctactgagcgccatcgtcttcatctccctcctggtagtaggcatagggatcctccaaagctttatctcctgcttctgattaattttatatttgcaagggtgagtaccaaccgtactcagcaagccaccacaacaacaatgcatatgaaaaggggtatttcaaaggatggctatggctcttttgcgctaagccagttttgtaattcttttcacaaacctaagacctagcatagactgatcaagttttaataccagtgttcacattaaacaacgacggttctgtccaccatccattgtgatcccaaggatagcttcccgccattgagtcgtcatggttttctgaggacgtccaccttccctcctctcaggaagtggctccatcagcataaaaaatcatcatgcaatatcccatcccacacaggttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagtagtgagaggagttctggcgctcccaggaaagagaagtctcacacacatattaaattatggttcaagttaagttctctctctcacatactcatggcagtcctaccaatggcgacaccgatgtagggcacgcttctcggccctacctcaacggctgtcccatcgtagcgcacctgcctcactcaggggtgaaccatctatgcagggatactgcctccgctcggctatctaatccgctaggtctatacccattcgagaagtacagttgtacgggggtcgtttcatgcttaacttcatggctcggtccttaattgactggggacggtactagccttttccagataccacccaaatcatccgtccgccccagtcgaaaacagttgttttcgctttattttcctttcacaaatcatgttatcaatttcatggcaatgtggcgctcatgtctccacataccgcatctcaattaccttcccaaaggtaattgcccaagcatttagcatttgataaatatgagtatgcatgatcctagaatagcatttctaagcaattgtcataattgactagggactcatacgtaaacatggttacgaaggaataagggataaacaataatcaaggcatggcataatcacaagtaggatgttcatcattgcatgcaattttatttataaacaaaataatttcgcaattgggatcaacatgttcaaggaatagtgatgacttgccttgctcaaggtcttgggggtcttggccttcacttggatccgcaactccctcgggctctatagttacgtgcgaaaactgatttggattcgattagaattcaaataaaaaatccaaataaatccaaatggaagtcgaacgcgaaagtcgattcctttattttaactttattattcgcgaactaaggcaaacccaatttcgattcaaactattttgcgggtataaatgttttgttgtcataagtttttaatttaatctacccgagcattatatccatataataggttagagatttctatcgcgagctaaatatcggacgaaatcctagaaatattatatgatttaatttagtctatgactaaatgattaaatataatatacggctaaaatccctagtaaataaatccgaatttctaccgtgaatcgattacttatagagattacccaaaataatctataatagtctataagaattcatctaatcgtttagttcctaattacagttaaactactaccgcgaattgatttcttgtagaaattaccaagaataatctataatttatattaaattttgcaattctatgaccataattaatctataattaaattctaattattttagattttcttaaactattaacctccttaatttcttcctaattttctatttatttttccttttctttttctccattctctcttctctttttctttctttttctttcttttctctctctctctttttctttcttttctctctttctctctttttctctctgccggcctctcttttcctctccctctctctcttggctctctcccaccagagcggcggcggcggtggacacgagggggaaggagggcggctcaccggcggcagcagcggtgacgacggcggcagcgacggtggcgcacggcggcgcgggagcggcggcacggcggcacgggaacggcgccgcggcggcacgggaacggcggcgtggcagcacacgggaacggcggcgcgacggcacgagagcggcggcgcggcggcacgagagcggcggcgcggcggcacgagagtggcggcgcagtggagagggaagaggggaggaagggtgagatggggtgggggaaaatggagagagggggggtatttgtagagaggggagaaggagagggggaggggcggcggcgtaatggcgacgcgacggcggcgctcggggcgggacgacggtgacgcgcgggcggcgacgcgatggcggcgcggggctcggagcggcgatgcgacgggcgacggtgcggggctcgagacgggcgacgcgacgggtggcgtggggctcgatgcggcgatggtgacggcgcgcggcgatgggacggcgacgcggcgggtggcgagcgagcggcgtgacaggcagggcgacgcgacgcgcgcggcggcacggggctcagcgcgatggaatgggcggcgcggcagcgacgcagggtgacggcgaggggacggccgcgcggcggggcgcaggcgcgaggggacgggcgcgcggcggcacaaggcgcgaggccgacggcgacgcgacggtgacggcgcggcagcggcggcggcgcgcgcgacgggcgggcgacgcggcacacgcggcagggaagggggcggggccagggggaccacgatcgaacacctatgccgcaatgaacagtaacttttcctatttatcccgattttagcccattttctatttaaatatagtcctataaattctaacttttgcataaatgaagtttactccatatttgtgttatactaactaaaaattcaccctaatttaatatcactcatatttattttatataatttatttgaatttttattagggttaattctcattccatcgtactaaaatttaattattgctaatatggtcgcgataatattttatatatttccaatcccacctaatatttattttaatttatattttaattatttatttagccaacttgatttttagggtttattcctagttagttattcattatccgcgattaataaattccgagatcaaaatccaatgaaataggcgaataaaatcggcatgatgcaatttattacttaaaaagtttttgaaaatctgtatttttggtgttttgatttcgttggtcgaattttcagggtgttacatatctccaacatgaataagtggtaatggatagaatggaagcgaagccagctttgagaggtgctaagttaagcttcatttcatatagttggccaaggccccaagctatagtcatcaacaaagtttatataatactacgagaataccaacctattgcaaaggatataaaataaatacgcaattagttccaaactttaaatagaaaaaagaagcttacactgtcagtgtgttacaaaggatctagaaaatataccattagttccaaactataaatgtaagaaataataaatccttaaggcctagaagtatagcggtggtttacagtccctcgtccatcttaagctcaacctgactcccatgccctctcgagcgattctcgcacgcatgatgtccccttccctgcgcgaatggaagcacacccctgacccccaccacccgatcaaaatcaatccaccatccttcaccgacgctttctgcggagattatgagtaccgcatacccacacggctgggctatccgactggttacaggggatagatcatgtatatagaatatgtaataaagtaggactcggtcgctatgttgccttgtattccaaggcagggtataaagccccaatcgggtactaccatgtactccctctatcccaaaatataagcatttttagcatagtgacaagtcaaacatttttaactttgaccattaataacaaaacaataaaaacgatcaatcatgtaaagttgatgttattagatttatcattaaacaaactatcataatatacaactctttttatttaaaacatcttacttctatagatattgttagtcaaagtagcatctcgaagaccgtgtcagggtccaaaaatgcttatattttgggatggagggagtaatagattaggatactgataacgtgtccggctaggtttttcctttgtaaccctgccccccaacctatataaggcgggcaaggagccccctccaaggggcatgggcagagattcacaatccgatcgtcagatcaatactacaacccgacgaattcaaatccctaaataggagtagggtattacctctcattgagagggcctgaacctttttaaattcttgtctccgcatccatccacttttaggtctcgtgcgctaccccctttataatgccgaattctagttcttcccgtggaccttctttcatgtgtagctctcacgctgcatggacataacaatatatgcacttgctaattaaaaatcaattgaatttaaactatagtcttgttttagaaaaaaaaaagttagaaaaaaagtatgttatctctcatttttcgtcggtgagatactggtacataaaagactagtagcctacgcagacagcagcaacaccagccctacaaagtacgaattgaatctttcggttcccgtgaataagaattgttaagtagcatctacactaaaacctgtatcattgtaggattattctcattatgtccacgtgctcctccccacctatgcctcatcgagtcgtcatcttgtatctctgtcaaatgtattacatcgactgacgcaccgctcgatattcagctaggtgtgctctaccatattaattagcaccaaccccatttcactatagacgctaacctatgtcccatgtcacatagccgcaacaggccatcacgtgagcccctccatcactgccacggtggcgttaacatcgagtcgttgatggcccctctaccacatatactatgtgtgccacagtgtgcccctctgtgccatacgattactcctgattgttagctttaccacccctttgtcttccactagcatctttgatcctaatttgttcatgcgttggttcacatcctccataaacagaacatgagaaggtgattaatttgttggttgtaagtttttaaaaaatagagaagagatagaactacataggtgctttttgagaggtctacatgcccttcgtcagcgaaacaatcagaactatccagtttgcatttatttatagcaattgtataagagttcctcgataaataaactgttagttccaaagtttaaaagtaaaacaactaataaatctttaaatttaaatgtagtagtacgttttttttttacaaggcagacgtgaaatgctcgatcaaggtctccgatgtaaaatcggcggcgccggttcggcgctgggttggcgctttggcaggtggcgtacgtcgtcgtgcgaggcagaacgagcgcgcgtggcgagacgaggcgaggaggaggggtcggcacgcgggggaccgggagaagaagggcgagagacaaaccgcgtgcgcgcgcgcgtggtggtggagtggatggcgacctcttttttgggcgttttccgccccgaaaatcctccgttcccgcgtcctcaccaaagtacaactccagattggtttcgtatctatctactctaccaccgcaattaccagtattttctaagatttcgagttattgcaatgatgatgatgaagctgtcacacttgtaataacaagttgtgtactcctgctggagttagtgggcagaggatgtgattggaaggcgtacagaaatggattccgctaagcacaaacaaaaccgagtggagaaacgggggtggtggcgagcactttgacacggtggttgattgattcatgccatgctgccgcccactcaaaagcatcccctctcctcgctaatgccatttcttaaatcattccatggaaccttccaaacctggatctcgcaactttgggcaaccacaaaacaactcgttcccaaagcatagcaaatgcaatgctactccctccgttccatttgaagtgcatctacaaatttccgtgtctaacgtttaaccatccatcttatttattttttttataattaatatttttgttgctatttgatgataaaacatgaataatattttatgcataacttattatctttatttttttaataattttttaaaataagatatacggtcactgcatttaaaatggttcggggagtactagtagtactacaatacagatggctctgctcccatgtggacgtacgcctcgcgcccccatgtggtgtcttggatttggttcggatttaggcgtaccgagtccatgccaatcacattgtttttccacgccaaattgcgtctcccagaacaccaaacatatggtggccaagaaaatgattgatacgcacggtggatggatggatggattggtggcgatcgatcgattggtttgatgatgaaaagaaaaacaaatccgaggagcacctggaatcggggacatgcgctgaaccgggacaaggaaacagccccttgttttgcgaacttgtagttgtagagttcgtgtggagttgctgtttgctgttgccgtgttggggtatttttctgccgtttcttggagtctttgggcagtaggttcaacagctaaaggagacaaacctctctccggccgtgttgcgaattcgcaatgcaaaatgcaaccgacggtctggtctggtggtgttgctagtcttccatttcaggtgccattgtcaaaaaactcaaaagggcatcacaggcacagcacagggatttctgtccctcggaaactcattgataaatttattacaaagacctagctttgttttgttcttgtgtcttttaatcgtgtcaaatgaggtgtttaaatctatgggtgtaaagttttgacgtgtcacatcgaatatacatacacacatttgaagtattaaatatagattaataagaaaacaaattaagattccgtctgtaa

SEQ ID NO: 71279 - DNA, 3842 bp, Oryza sativa
acatacaaaacaaaactagtccacatcgaacatcacataatccacataatgcataagtccatcacatagtccaattcataggaaacatacaaaacaaaactaatccacatcaaacatcacatagtccataagtccatcacataatccacaactccatcacataatccataagttcacaagtccatcacataatccacaagtccatcgcatagtccataagttcacaagtccacatgtgcattaaacaagttaacacatatcagaaaaagttaaacttcctagaaatcacttcttgcgttgacgccaaagagcttgcgagcctggagtgtacctatatttgaaaaaccaatgttcacaacatttacaaatcgaagcgagggaaatcaaataacatatgagaatggtaagcccagtgtaactctttttccttgaccgagtggatcgtaagttgtaggtggtgggctgcgacgcctgagacacatcgggcagctgcaacatgcctatctcgtctgcgtctggtgtgatgtagtcgtcgtacaaaaataaaccaaacaacttttaaaattgttacggtataccccattcaccattcaccatacaggactgactttaccgggggcatcgtcaaaatatgtctacgtacagaccattcggggtcgctttgacttttctttttattagaaacgtttgaccatttgtattatttcaaaaattagtgcaaatataaaaaagattcatacttaaattgataataaagcaactcaaaaaagagtaaataataattccataattttttgaataagacgaatgataaaaccttacaaacaaaaactcaaagcgacaagtattttaggatggaggtagtactctcttcatccagaatataaatatctagataacttgccatgccgcatcctccttaaactcgatctcttctggataaatttccttaaatagattaatttctttaaccgaatcctccatgaatccgactgctggcgacttgataactcccatcggttgattccagaactctaaagctgatattgattttaggctgatgacatctttggggcttaccaaatttcactatcaacattggtggacagcatggtggcgacggcgaagcgggacggtgcggctgctgggtgacgacgattgagtgggggctcctcactctcacctccctcccgttgcccctgcctccattcatgacgagatgcggcgtcggaagcaggcagcgtgggtgatcctagctagctggggcggcacgatggagagggcggtgggtagcagcgaggtgtcgacagcggagtcctttcggacggcggcggcctgagtgtcgatgtcctgtccgtggcaggatgaagatggttcgggcggtggtcccgtaggcagtggcggcggcccgggacagtggtggtctgagcaccggcgcaaggatcttgtcgaggagcaggtggaggtcgaccttggcgacagcggcggcccaggacagcagcgaccttagctctggcgcaaggctcttagcgaggaacaggcggaggtcaacccaggcggcagcggcggtgggcctaggggcagcgggacaccgggacccgggacggcaatggcttgagcaccggcacgacgctcccagcgaggagcaaggctgaggttgactctagcggcggcaatggccctatgggcaacggtggcgccctgagaacgggcacaggactctcaatgaggagcaggtggaggtcggccccagcggcggcgggctgggagtacaaaaggcggacaaacatcctctgacgacaacgatggccctatgggcggcagaggccaaggaattttggcgaagtggaagtcgatcccgtcggctcgcggctagttctgactaaacaccgaacgatgatggatgaaagtcagatgaagatggcaccaacgaaggttgacaacgacggcacactaggggccgcggcgactagacgacttccactcgctagtatgtcgggaagaagagaaggaggggtgtgccgaggtcatttgtttttcttttcttttttgattgagtgttctcctccttgttgaggtgtgagtctaagtgttcttatatccttttggctctgtatatcctatccttcatgtatatagaggccggactaatgaaaatctattatctaaaaaaaatcttccactcacaccaaagccaaatataatccacacaaacaaaacgagctcctgccaaacttggtaaaggtgataggcaccgaaagccacctcacttccaatggacggcagaatcccagctatagctagctagcttaggttcttcgttccgggatcagttgacagtgtcccccatcacatctgcttcccctctgcatcgtctgtcaatacgatccgcggttcggctggtttccactttctccaggcagactggcgtttttccaagctgtcatttgctagtggttgctattagtgatttgattggaacctgtagtaccggctagtggatgtcgttcacatctgatgttccaagaagcaagagcagcgaattaaccaggtttgttcatacagcaacgagcagcaggaagcaattgcacattgtttgaacattcactgaaccgggaggtgagatagccgttccttgactcatgtcatcactcatcacatctgatcagggtcaatgaggaggaatatccaatattacctttgtttattaccaacctcttgaaattaagatacttgaacaatgctgaaaaattctggaaatacttcaagagtagggcactggtattatatacataccaataccatcctgaaaatgttagaggacggtcagggcaccaaggttcagtgttgtgcaatatgatctatgatgctgatctacttgtagtttaatacaggatgggatcaaacagctgaaagtacagaacttctcgtagttgtaaaagggagtatgtagtcaaaactcagaaagggataagtgggtgatatcttccatgctcttttattacaagattacaactgcattaggaggtaagaatctcaacccccttcaatttagaggtacctatacaattactgcgattttgaaagaaacatagatctgctaaagaactaaaacatacatatatttagcccaaaatgatgcatagcaaggctagtagagcaagtaagataactatacaattagctattcctgacaagaattctgttgaggcacaccacaaatctagggagcaatattagagcttgcaatttgattttcatcttccatctggtgtcatgagctgggagaagatgttgcttggggtcagcccatcagactccacgctcgcaatgctacggtcagtgatgctcaaagaagttgtcgttgtagtggtagtagtcacgtcggtcgacggctcatctgaatgcagcctggccacaaccagcggcgacgtgctcgctgacgtcccctcggtcaggctgctactgtcctccgtgctctcctgcagctggagcgcaaactcgaggttccagagcacatcacccatggacggcctgtcgacgctgcgatcggccacacatttctccgcggtctcggcgaacttcaagaagcactggggagcgatcttccctttgaggagtgggtcaatgatctcgccaagaacacctttcttctggcaacgcagagcccagtctgcaaggctcacttgctccttcggaagtgatgggctcagggcgttgcgggcgcacaggacctcgaacagcacaactccgaaggagtagacatcagatttctcggtaagctgctgccgtcggaagtactcaggatcaaggtatccgaagctgcccttcaccactgtgct

SEQ ID NO: 71280 - DNA, 12026 bp, Oryza sativa
gcggtggcggcggaggcgccgcggtgccaggtggagggctgcgggctggagctgggaggctacaaggagtactaccgcaagcaccgcgtctgcgagccccacaccaagtgcctccgcgtcgtcgtcgccggccaggaccgccgcttctgccagcagtgcagcaggtcagccactcagccctcctccccttcccctctcgctctcctctcctccaataccgcgcttaagattctgagaagcatagttggtgagaatctggagaagctgacttctcttaggagactggagaaactgcggccgtcaggaagctctctaaacaagccctaaagttctactagtaattgattcaatcgccccgttagtgattcgattgggcgaattcgcgccctgtttgaattgcttcgatatgcctaagtgcatagtagtaatcattagtacgactattactatactacctgtgcagtaaaagatagggtataaatatgtatgtggccattttgtgctggtacagtgtgaaactctgtgcatgactgattggtcacaaggttctctgccccttgcctgatttggggaggtaagatcctgtttccccgtcgatagtactgtgctagaatttgcctgtacgccctgcatctggaaagctgccaagacagtgaattgtctgtgcaaggcaaggcttcctgaatttctggtaggacggcctgtggcttgcgtgtctatgtgaatgtgtattttcagcaaagaggtgtgtgttagtacaatgagtgattgctatgtgtagatagtagtattttgcatagttgcattcttgcatctgcttttgccagaaactccctgtgaccaaattctgcttttaattgtggttataaacaataattcattacgttttgcggcatgtttatgtcgttttgatgattttttttgttctatcttgggattatcaaggttccacgcgccttcggagtttgatcaggagaaacggagctgccggagacgactttctgatcataatgcccgtcgacggaaaccacagacagatgtgtttgcttttggctctggaacactaccgcgatcactgtttggtaataccctcgtgacctatataaactacaaaagtcaatcacagtgttgtttgtagtttctgtctagtaatatattggagaaaattgttggtggttggctgatgtgatgcatatttaatatctgaaaaaaaatcaagattatatctcacgatgtcatacactgtatttccctgaaataatgcttagctggatccttcactattttctatgaaaataatagcatgtatggccatatgggatagtagccttagccactactgtattatattaatgccactttagtttgggattttgtcaatgcaaaatctattggacggtatatcaaaacaaagagcatgcatttattcgttctcctgacatgttttctttgaggaatcaaaaaatcatttaccattgaccttaataatgcttgggtagtttccctccttgtctttgtaattttctaaaagtttctctttcttaatttcaaatgttattgcagatgataggcagcaaataagtttcgcatgggataataacgctccacttaaccatgcaaacaccacttcaagttcctcgtggacatctgacttacagctctcccaagtgatggacataagcaaaaggtcacgaaaagctggggcagacagtgcaaatatccgtttgtcaaatgctttgccaactctttgtcatgacacaaatgagctcttgccaataaaaggtatggctccatgatctttttatatcatgaatggaaaattaatctactcgaataattttacttatgctgacaaagttagtttacttcacttagcattcatgccatgtgcagtgacaggcttaaaagataggctacaatgctaaatttgacagcataatatgtatctctactaccttaaaagcgcaaccattctccttctgtcctcttcccactgtgcgcagtcgcctgctccttcatgtgtgcgtaaccaccgtagcatccagtattttatccttaatccatccacccagccaatcgcccaatcctcaattgtatgagcttggtacgttgcaaagcactggcatattactagtaaaaagaagaaataaaacagtaaaatccatatggccactacccaaaatgggttgatacatcaagtttgttgatactggcatctatcccgaaacgaactttaaacatgtgtaggtacattgatatttgaattttgaggtttatagttcagcattctttctgtaaaccaaactcccaatttgttgtttcacaacattgcaagtttcttatgcagtgccaaaatcttggctgcagattttttccccccatctttgaagttaggaacatttgaaatgaaaattttcctagttactatgtatatttgaatattcacaacccatgtaggactagcaatccagcattccagttacacttgtggcatcatggcagatacctatagcctaggtatcacaccattgaccactatgcacgagtgaacttatgagatccatcctattgctaaatgctttccatcctccgagccccttgatatgctcaatacaatcagataccgtgtcttgagagtagtattttctctagttttatttactggcgctgtatgcttgatttttcatttcatacgtttctgttatcacttaccactattttattttctttcgactgtcgctctaatgctttgatggtccaattttgcaggtgcagatgcatctgaaactgcttcaaaactagatggagcactagatgttcagcgtgctctctctcttctgtcagctagttcaaggggtttgactgaccccggacaccaaacatcttctatcatccaatttacgaattcgaaccaaaacagcacattgcccagtgtaccaagcgaaggaaactctaatgtacccttttgggttgatggacaacatcaagcagtagagcctcaggtgtttcagttcacaatggacaccggtaacactgtgtttccggatctagagcggatcaaaccttcctacgagtcttcaatgtttggtctgaaccagatacattgaagcctgcaatgatcaccagcacggtcgctgctagtatggatgaataagcacacgtcctggactatccaagatcgtccaagacttgccccaatctgccgagtgtcaatgctatatccgtgtgtttatttaccttcccataattcagataaaccttgtgaacgccaacatctaagtatcaagcgttcacaaagtgtgctagtttcaaccttatttctgtcaaaatgtaattgctgttgtgcaattctttgttcttcgtgttgtacaaattattcattgttcttggcgttgtacaatctactgcctaaccatttgtcagaatattagctctttcgggaaacaagacatgatttttccctgtgcatactgtttttcagtgtctaatagtataatttgaaatcttaacatgtttaaagtaattttatccctctttaaaaaagggagagagattttaccccgatatgccgttgcgcttgacttctggtcgcctggacagcatatggtttctttctgactggtgcggtgtactatgtgcatcttaccagctttttacacggtggttaacgttatattttttttatcattaatttctgtcataatgcattatcaattactacaaaattaacatcatatataaatattttaaaatacgaataatgatactacacacatgccaccaaaaacatttttaattcatattagttaaaaaaaatattaatgtagattttatggaaaataaaggtttcttatttttagcacaaaatcttgtcccaaatgaatcaaaataaagctatttcttcacccatcatcttctctcaaccaatcataataattcttcatctacattctttttgtgaatcaatcataatattcctccaatattttcacctacttttttaatatctgttcctacaaaaaaaaatgccaacattttggaacagagaaagtattttagaacggagtactccaataagtggaagttcaacagactataggtgtttagaatttggtgacacaaaaccacttggaaaatctgcataatttacctggataatcaaaaaccggagtggaaccggcagatacattttagatttgacttcgacatagatgataggcatagataagtatcatggatccatatggaaaacaacacaaggagaataatatgaaatggatttggaggcgcaaagaatggcagcatatacaaccgactcaaatcaacaagaccaggagatgatgaccacaagtaggtcgacgcttcagacaaagaacacacaacagctgctgatcaaccagcaaatacagctgctattatttcacaagatagctcatttcggagaattacataacacggctctttgctaagatatacaatcatacaaggtaccatccatatttgataaagtagaaatcagcaattttaaaccttgaaggccagggatgagacttccatatcggcacgcaaacgcgaccgatatcatggtgtcctctctcttttcttttttcttttctgtactctatcctgcattagtttcagtctgtggtcattggccccgcaatacaacagcggaaacgtgccctgcggacatttctcataacctctatctcggcattctcaagcatgacaacgatctcggcaaatgatgggcgaacttcagggtttgcgtcccaacagcaagtcatgatcttgctcagagaatccacacaatcctgcgggattgcaggacgagagcccctgtttacgacagcaaatgcagcctgaacggctgtcatgtttgtgaaggggagcatgccggttataagctcccacaagacaatcccaaagctgtaaacatctactttatgatcataaggcctgtgctggatcatctccctgcatgatggcaagataagcatatttgacagagatttaaaaaggtaaacagtaggcaatgagcgtgaatgcgtgattatgacttacggtgccatccaacggtaggttcctgtctctggggtcattccctcagtttgtacctcaattcgagcaactccaaagtcagctatcttgatggatttgtctgctgaaattagaaggttatctgattttagatccctatggataaatcgcaaggcatgcacataagccatcccccgagcaacatcaagtgcctgcttcacagccagccccagaggcacagacttgttctgccttcgtgcaaggaattgccgaacagatccaccttttgcatattcagtaatgatacaccaaacaattgatttccggcacgccccaatgaaccttacaatatttgggtgcctcaacgtagacaacatcataacttcctgcacaaactgctgttccatcaattgagctctctctgggtcattctcaggcttttccagcagcttaatagcaacgtcttctccattgtatgttccccgataaagcttcccaaatgccccttgagcaaaaggagctcccatgtcgagcttacccagatcaatggtccactcctcgtaattactaagtatctccgtcggatggcttggatccatcaatacccgagccaatgcatcctcattcagagtaggcgccatagcccggttcggatggatgacgctattgtgaaccgaataactcggcgccggcatatcacggaggccagggtgtttgagcatgaccgtgcgggactcgtttgatcccacgctgctgttatccaccgacatggcaaccgaaccaccaacaaagttcatcatgttcaggttgtcggcgttatccacggacatgtgggagctctccccgaccttgtggtagtagggcatattgtggaagccattcatctcgttttcttgccttcctctgcaacctataccacctccaattccagcaccgcccaacatattctgaaaccttgacccctcaatcatcttcaaacaaccaacactaacagtagggttgctttacgaaacagtagaatcgctgaaaaacatccatttctcagttttcttcagtgctcccacggtatctagaatcaaaacaaaaaactgattagcgcctaaatacgcatatagtaaagtataccatcaaaattatgctaaaacaggggcggatctaataaactgaacccccaaactatttggggaacaaccaaactactattcgtatcaagtttcaaggcaaattaagagaaaagcttcctccgaggtctagaagagaaacaacaagggttcaacgcaaaatttggggaacaagcaaactactattcgtgtcaagttttcaaggcaaattaagagaaaagcttcctccgaggtctagaagaggaacaaccaaagggttcaacgcaaaattggagggaaaaaaaaagtgagtgggtacacagcgatgaggaagaggatgaatggatgctcaccgggatgcggcggaagcagcaggacgaacggcggcggcgcgcctcgcgggatcggcggcgcaggcggcggggcgagctcacgaggagtcggagtcggagtcggaggcgacgacgaggggaaggggaaatatcgtcgtctcgtcgaggcaccgcacaacgatctcctttttgttttccctttttttttcacaactacgctaggaaggatgctgattatgaaacattggtactactatcttttacggggaatgcaattaaaacgtagaagctcatggcacctgcaaactcactcccacaatataagttattttaacgtgtgtacgcttcgtacacacgtacatccatgtctacgagtaccttcggaagattgagctgatatatcttgagattaatgaatcattaaaatttcataattttaatataaatttgttcttctctatactgggggtaaatatctcagtattctttcgctattttattttgttttgttctcatttttctctattttcgacgatgatattgtttaaccttacgtgttaaacacggttagcaaactcgagtgtccacaatatgtactacatatttgtatttagtaaaacataataatttattctagatgcctaacttggtatttgttcaaatacatcacggatacgtatactaacacaacaacattcatatgagaatttgtattaaaattccgcttggaatcgacttaatctgagaatttgtattgtttttgaacttttaaatatctaattttaaagtagactattttttaatatgaacttttagtcataccaccctatctaacgtaactgaaaaataaccaatgctaatgttatcctaccaaactcttaaatagaagacgatccaagtatttttttactattgtagaaaatcttttatatattttgtgatgaagatagtaaaatattccatcatctcgcatcatggctgcattagcactttatcagtcaacccaaagtctcgaacctactgaccagagcacacacattagattcatcaaaccatgtggtccaattcatcccaattgatgagtagattaactagggaaatcaagcaaatttcgccgaatttcttctgccaccaccgtcgtcgtcgtaccgtatcatcatccataattgtttacgcgtgtttggatccggacgcgcacgtcgtcgatcgtttgccggccagcgattttcccccgggtttgaagtcaacaaaagcgatcggctggcggcttccgtttcgtcaggtcctaatcgcaaatctctttctccatgacgccgattaataaagtatatacaacttcagatgcaaattggaatctttgttcttgtttagtactctttccgtttcacaatataagtcattctaacatttcccacattcatattgatgttaatgaatctagatagatatatatgtcttagattcattaacatctatatctatctagattcattaacatctatatctatctagattcattaacatcaatatgaatatgggaaatactaaaataacttatattgtgaaatagagggagtatttttttagtgtgactttaattaaagtgagcgtgggacgattctgattcgcatcggcgaataatctgcgtgattttatgcaattatttgaaacgatttgagttcaaaaagaaaatcaaatgattatagcccaaaagaaacaaaggaatacaggctgatgatgagactgcgagagatcatcaaatcccacctatctaaagactaatgggccggaattctggcctgttaaatgggcctacatgggccgcatgattaataagcccaaatcttagggccgaaacataataggccgtacgtataacgggccgtaagttaaaacggcccgcagattaacaggccggatttttccacgttgacttgtcgcacgaaaaggtcatgtcaatgggcagcttaatgagctggcacttcgaagccccacaaatacttagcaggccgaaattttgtttgaaggttaacaggccgaaatttgacactcaaattttcaggtttttggaggaaaacacaaaataataatccctccgtttgttaataattgataattttgactttctcattaattatttttacattgttagataaatgttaatagatttcattgtgtatcatttcattaaaagaagagaacacgaaaggaaaagtgtccaccaacctaatccaaaacaggccaaagcctttacaacacaagcaaaaacctcaccttcaaagggctatccacttatcaacaaataaaacaagtgatcaaatttctaaagcgaatattacctagtgctagttattaagaaacgaagggagcagtcttcgacgatgcttatatgggtagagttggtgtgcgtacgttcatagagataagtgcacgtgcgctgtgagtggctgcgttgtactatgtaactctaaaaaaaaaaagaaacgaagggagcagtattaactaatccaaaattacgcccttttttggcacggctctaagctgtgagttctagagaaaatagtttgtagattaaactaaagtaccacagtttagtactttttatgtaaattctaaaacatgaaaaaaaatgcctcactctaataagcagttctaactcaaaaaatcattttggcaggtgaggctgcgactacctataaattgcgacattgtttgtattggttgcagcgcaccaccaagcatccaaacagacctagcaacaaaatccaaacacaggattttcaagtcacatgatttttttaaaaaacagtggaattgcgtaggaatgtatatgcaatactaaggatcaagacatattttttttcttttagtgagctgaacaaagaagatggagtagatgtttttattcctatggaaccaatacattttgaagatctagcacatgattcctatagaaaaaaaaatcatttaaatcgtataaccgaaccgaacaaggcatatataataagaaaaaggagcccgtatggttgaaccatttggattctctctgaagtactatggcagttggggcatgtctgctatccagtgctacgttttgacaaacacgacgttggaactacacgagaattacacggtactggcatttgcaggctgcagccggcgttgacatgaatagcctcctaaagtcgccggtaaactaattacgtactgtaccagcaagcacgacaagttgccaaccgaccacaaaaccgatgagcaggaacaaaacagtgggactagtccactctctagctggctagcactgtgtatatatactccgtatttgtgtgaaattgttgacttgcatcgtccatggcaggctaaacatggtcctccacacacactccagtacgcgtagttcggtgtacacaggtcacgcgtttacaatgtcatccacccggacagtccacgacgagctctacccgtacagttccatacaccaaccaacagacgcctctactaatctgtccaataaaaaagcgagcctcactttggtgctatttagttgtagaaaataatctgaaccgttgatctcatttgatcgaagggttcatgttgctttctactgtcatcctagttagcggtagtagaaatttagaggggaaaaaataggggtatagttgttatttagcagtgagccattgactaaaggcatgttcagattgtattcaaaataaaccttttttttttcaaaaatcgagcgttgtttcaccaagtagatcgagaatgtttcactaagtagttcgaaaatgttttagtcttttaaaaagctgaaatacaaccaaatcacctcgtggaacattttgctacaacgtatgatacaaacggtttccaaaaaatcagacgttgtttcactctatataaaaacaatatttcaacaaatagcaaaatactatttcaattcactgcaacatttgatccgtacatagtgaaacatcacgagtacactagctgaaacatttttggtggaacaaaaaatgaaacggattcctttactatagcgtttccgtaatatgcagttgatttgttgcaacaacgtctgtgatggtgcacttggtggaggcggcgcgcaagcgtgggaggtgcgggtgcctgatgcatgcacgcaattttcgaaataaaccttaacaaattttggcaatgccaaaattttaggaatttggtaatattgccacatctgttagcagcgaaatttgataagccccgaagacatcatcggactagagtcagaattggcttcagaatcctataatcggccaatcaaaattatcacatcgccaatagtcggattcctgctatattcggttaaggaaattaatcgaattaaaggaagcttatccagaagtgaccgagttcaagaaggatacaacatggcaagttatctattaattaggaatagtttgttagttttcttttatctttaggaaagtgtgtttagtgtccaataaggactttatgtttccgttttaactttagaaaagtttctttcttgtcctacaaggactagtatctatccatgggtgtaaatatgtacacccgaggccattgtaatgaatctctagatcaatactactctcggtgcatcatcaccctctttcccgaggtttttacttatcaaccagcggaatttggcacctaacaatataaaataacaatataatcaccatcttgcatctatttatagcaattgtacaagagctccgaacgaaaaagccggccaacgatatccatgcagcaccgtgcatccatgcatggttttcttacccccccacccacccccaaccaccataaatacacacccagctgcaacatggatcacaaaacacatcgatccatctaaagtttatatagtactacgagaatatcaatctattgcaaagtatctaaagtaaatacacaattggttccaaactttaaatagaaaaaaaatctttacactaccaacgtgttaaaaggaactagaaaatatatcattagttccaaactatgtatgtaaagaactaataaatccttaaggcctaaaaaatgtagtggtggtttatgatccctcgtccatcgtaagcccatcctcactcccatgccctctcgagcgagtcctgcacgcatgatgtcccttccactgcatgaatggaatgcccccgacccccaccaccgatcaaaatcaatcaaccatcattccccggtgcttggccatggacctcctttcacgtctagctctcaacctgcaggatgtaacgacatgtgcacttgccaataaaaaattcaactgaatttatagtgtactcctttttaatgtacaatctacacccagacctagaattgttggattattttcataaggtcacgtgctcctccccacatacgcctcatcgagttgtcatcttgtattcctatcaaatgtattgtatcaactgccaccaccgctcgatatccagctagctgactaggtgtgctctaccaatttacttagcaccagccccatctcaccataaatgctaacctatgtcccctatcg

SEQ ID NO: 71281 - DNA, 2202 bp, Oryza sativa
tgcacccgtgtgcaggtaatacagcccacgggcggcgccgatgcagatctccagcctctgcttccacgacaatggtgggttcttggtgttgtacaagtgttctcgaagtgtcccatgagccatgtagtcatataccaaaatcatctcattcctatcctcgcagtacccgattagagacacaaggtgacggtgtcggagcttggacagcatctcaatctcattctggaactcatggacaccctgctcagacagcgggttcccacgcttgattgcaactctagtgccactgtctatctctccaaggtaaacgttgccaaatccacctttgccgaggaggaaggatttgtcgaaattgttggtggcagcctggatttctgcaaacgaaaagtgccggcaaagattggctggcagcatcgagtggctccctgtgttggttgtctttcctgaggtggctgactgtgacttggtgaaatcagtgagaggagtccagcgtccttcatcagatttgccagtatcctttgctaccttcttctttcgtctacagatgatgcacaatccaacacaagcaatcaacaacacggcaaggccacccactgctccacctatggctgctggggcaacactctttgatttacctctactagatcccccattgggattcacaccaggctttggtggaagtggagggttgagcccagcaaggttatttcttccaaggtcctgtagcttgaagacctcaaggccatttagtattgcatcaaaatactctggtttgcttgaaagatcagggtgaagcgcgacccacaggtccgtctggccagaaccaaccgttgtgacaacatagttggtatatgttgttctgccaattcctccactccaaacaatgacgtccatttgattctgcgccgtctggttgttgatgtaaatgaaaaatgatctctgattcaccttggttattggatactggatctcacagaaatggaacctcaagaggtaggtgaaccccgcatcaaccggtaagatccatgtaagattgtagttcaggttgatctgtgcagttggccccattgaccttgctgttgcgtagactgcaactggtgcagtgtaatttggctcagtatttggatatttgatggtgacattaccatctttggagaaggtcaccccataggcagcaccatatatgtaaggagaatcattatcccaagaacgatagaatccagaatcaccttgcggagagatgggctgtcccccaacattgagccggtacatcgtttggagacccatcacaggatctatgccatattgcacattgtccccgccattggcagatgtaggtgtcggtgttgtgaagatgtcaggcgtgggcacaatctcaatcccattcacaaatgcataagacccgtttcgtgtggacggggcaaaggtgagttttaggctgcttgaagtgacattaaccgagaattctcgaaagaagtaggcagagcttgttgccagagcagtttgtgatgcgttgaagttgtctaaaaggatcagattgttggttgtgacaccaaagtaggcatttgcagaatcaaggttcccattataattagttggatagaagtgtaggcgcacgaacatgcggcctgggctgacagggaaggaataggtgtaatttgaagtgaagaatcgagcagtcatgtaaggcacgggtgatgggagcgaagggtcttggtatgaagccctggctacattgcctttcaccgatggcgcaaacttggagctagcatccccatcccagctccgattgtagctatcaggttgcacaccagaggctccacaattcagaaagattggagcagaggccgtggaattgttatcagccgccatggcaatcgataggagggctgacagtgtgagccattggatggtagctagtaggcttgggtgcatcattgaagtggtggttggtgtatcaggatcaaaagtttgaggattcgttcacatcaatttgctataagagttgggaacacttgcataatgccttttctctgggtgggatttgaggcaaggaaaatgtagagtttggaggattgtactcttgtttactgaagaaagcacatccagatagctgtaatcctgtagattcacctgcaatcagagcaaacgaagggttcggaaattctgcaaattgtagattggaaagatgaataacaagaa

SEQ ID NO: 71282 - DNA, 768 bp, Oryza sativa
gaacgagagcgagaacgaacacgtcaacgggcgttgccgcgagaacgtgaacgagaacgagaacgatcgaacgaacgagagcgagaacgaacacgtcaatgtacgttgccgcgagaacgtgaacgagaacgagaacgatcgaacgaacgagagcgagaacgaacacggcaacgtacgttgccgcgagaacgtgaacgagaacgagaacgatcgaacgaacgagagcgataacgagaacgatcgaaccaagacaagtgagaacgagggaacgaacgtgaatgagaacaagcgaacgagaacgagcgaacgagaacgaggacgaacgttaacgtgaaatgcaatatatatatatatatatatatatatatatatatatatatatatatatgtatatgtatatgtatatgttacttcgcatttatcctaatacatctttttgtatcttgcagaaaaaacgtgttgtgggagtcgtccgtcaagcctgagtggaagagctagccctagaaggaattggcgcaggcaagtgacgtaataatataaatgattgttatatttgtaatgcaattaattaagattattagacctgtaattagacttatcatataagattgtgtaggtgttctaatattatttgagttttaatataagattactttatttgtaattagacttagtatgtaattattgactaccgaagtggtgcgacaagtagcaattgactattgtagtcttaattagacttagcatatacgcccgaaacacttagca

SEQ ID NO: 71283 - DNA, 943 bp, Oryza sativa
acataggatacatattaaaattgaccaactctataaagtctgcatcctgccccaacccctttactggttctaggaaaactttaaaacgatggccatttaccttaaaaatactaccttcgttatcctgcagcttgaccgctccgtgtggcaaaatatgtagacataggatacatattaaaattgaccaactctataaaatctgcatcctgccccaacccctttactggttctaggaaaacttttaaacgatggccatttaccttaaaaatgctaccttcgttatcctgcagcttgaccgctccgtgtggcaaatatcgatgacggtgtacggttctagccatttgctccgaaatttcccgtgaccgaagagctttgccctagagctgaactacaacaccttgtttcctggttcaaactcgttgactttgattcacctgtcatgccatccactggtggagaaaccatctttggtcggtctggcaaattccacaatagtcccggtttcaaaaagaaccgggactaaagattatttttagtctcggttataaagattttaatctttagtcaccaactgggactacatggcctgtcaaaggcatgttagggggctgaggatcttaccactttagccctggttggtaacaccaaacgggagtaaagatcatttagatctttattcccggttggtgttattacaatgactaaagatatatctttagtcccggttaaaaactccaaccgggagtaaatatttctctcccacatctaatcggttaagtcgcagaccaacttcctcctcatcagattctcctcctatctatgagatatagctccttgctgtgctctcctgcccttcctcctcctcccctctcctcctcacatccgacgccggcgtcggcgggcgccggggccacgaccagcgtggtgggcgccggggccgcgc

SEQ ID NO: 71284 - DNA, 642 bp, Oryza sativa
ctttctcataaagagtaacagaacgaccgtgtagtgcgactgaagctcgcaataccataagtcgtttttgctcacgaatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatcaggacagaacatactctgttctctagcagaattcttttgtcccacgtgccctccactcattcgatatatgattatgcatgaatcaatgcaaatataagataaaccggcgtagtcgttaaatttccatatccagcacgagcgaaggggtcccctttgtc

SEQ ID NO: 71285 - DNA, 35248 bp, Oryza sativa
  unsure (1)..(35248): unsure at all n locations
ggaaaggctgcaggaatacgtcaccacccgtcctcatcatgagatggccgagtggctcatcctgcagagtttcttcaacggattaaccccctcgtcctgggatcacctggatgctgctgctggagggacattcttctcaagaacagttatatgccaaccgattgagaagatgctctcaaataaggggtggagcaaggaacgactccaaacccgtcaatgcgacatgtacaccgtcaagtggacggaaatgctagccgctcagttggatctccttatgaggagactggacaacaatgagaaggacgccgagcagggtaccgttaaggccatggactctcacaagacatgtgaggtcgatggcaatactggtcactctggcacggattgtcggaaaacctgtgagaacgtcaagctcatgaacaacaacgggaatcgtccacaaggggaccaaggatggagcattgctccatggggtagatcaagaacatatcgacacacaaggaggtcaaagtaaaaccccgaaggacggataacttcaacactttcatgatgaacttcctggagcgggaagaaacgaggaaccgtcagtaccttaagccggcatccaagaaactggaaatacaggccggtcaacctgcattcccagtttcgaagaggccgctgcccgcacctatgatcaggaaggtgtggcgggttaaggagaacacacccgttcctgtacctccggaactgggtgcctcatccagcaaaattcgttggaggtatggtcgtgctcatcggacctgaaacgacgtcgcccttgccaacaggtaaattggtagtaatctcatatttattttccattgcatcaaagcatgtttgaattttcaaatgcacatttagatttgaatttgaggcaatttcttcaaatgattttttgtgagcaaaataaaatgcaatttttggcaaaattttgcacagccaccttcacactagtcgttggagcccaatggctaaatgtggggccgattgggtccaccagtggttcggccgaaccccttggttcggtcgaattggcctggtaccggctggttgcaaatttctgcagggtagtggctagtggggcccacatgccattactagccgttatccatgcactatatatgcagctcaactgggagagggaggtcacaccactttaactcattttcactccctctcaaaaccttgctgcaaaattcattcaaagttttgcaggcttacctcaaattcacacaattcactgcatttagtttagacaccttgcatatacaagtttgctttagttcggtgcaaggataatcggcgggtacttgcttaacccccgtccgagtagtcttgtattcttgctctttgctgtagctatgaagaaacgactttcgggcatattcaagagacgatcaagctcacggacaagccgacacgataagccgagtgcaccttcttccgcggatgcatccatggaggaggcgtacgttccaccaaggctgtacgacaactctgatctcgaccttgtgggccaccgggaaatgcaagcctatcatatgttgaaagaccaaacgtgtgctcagacctgaccatacgactcgaccttctgaaaaggataggtatggatgctgagtttcatactatttggcgtgctgtaggatgggataaatttgcatgtgtagaagagccgggttcccgtttgcttaccatgcagtttttatgtgccttgctagaggtaggcgatggcgttactttccggttattccgcaaggaatatcacctttcttggaaagaacttagcttgcttctagtctttgacaaaacatgcaaagttaatttcaggaacgcatttcctgattttaacaagcgtatgttttgacaaagtatttcgggtctctcatcctgtagaaagcctagaactaatgacatccataatcctaccttaaggctgttgcataagtttcttgtttcacgttgtttcctagagctaatatccggatagtgcgaactagtcctcttgtatgccatggttaaaaaaaaaatcaaagtttcacccgttcaacccaggatcaagcaatggttagaaaatgtgaagttgtctagtcctgttgagtgtatttctttggtgactcatttagcatgaagagttgggactctgctttatatgcaaatattcctattacccgctcttatgttgatgaggcctatttggttcaatgccacatactcaaacatggtccaaatgattatcttatatttttgtttcccggctatgcaaatgagattacgttacctaacccggagtttcatttgtataactgccgagaactaaccatttctttccaagcggagttgcctcgagaagtcccacgcagggtaacatgacgaatggcgagagaagtacctctggaggcgtcttcctcataaccaccagtgcagatgtatggaaacagttggggcccgaccgtgcatgcccgtggttggacccaattcctgcaacatgacaccggaggttcgtcctggcagagtgccagcgacagcaggaggcatgagccacaggagctgcactagggatactcgggctccttcagttcaagtggtctacctccatcctcttgatgcattgctcagtctcctctcgaggggatctgggagaactcatccggaggatggatacacttagaactgcaggcagggaatgagcaacacaccttggaggatcatgtggtacagtcacgggaacggcagcagtctgttggtgcacagctcgcaaacttcaacaccatgatgcaacaacagcaagctgactggcaagcgtttcactgctaccagggatttgatccccaccttgagccatagcaagaagcaagcttgggggagatgtctctccccccactgagctaacttgtatcacattgcatatttccctttcaaattgcatgtttaaatttttgcattgcatttataaacctgaaaacaatataaaaatttgcaaaatcaaaaataccaaaaagataggttatatttaataagataggttagatctaatatgctaggtaagacatgcttagttcttcatgttgaaatgatgaatagttgctctgttatatatctctcatacatgggttcatggttaagtactctctcaaaaattgaataggagtagccaataattatccggggacctgaggtaagtgatctgagtctaggttgttgcgagatatgagatactaaataagagttgctatgaacctgctctaagtttgacttgcattccggatgttttatgttccaaaatgataaaattgaaagttcctcatttgatatgagttcctaccagagccaaaaatatccatattaattaagtcatatacattttggttacttgtaattccattgaattttgtcaaatctttgtgacttatgtagatacttctcatgttctatgatcaagatcatacacccacttttgcacacatatgctaagcatctacactggaagatagcatccatatcatccaccatatccatgttatcattatccacaaataagctctccatccatgcttcctttccaaagaaaaatcctttgcaaaagtaaaagaaaaaaaaagaaagagggaaaggtatggctatgagaaataaataaaaaaagaaaaaaagagaaaaagtagccataccccctctatgaaaattaaaggatattttggaggaaaagcataagcacaaaggagaagcattttctttatccatattttgttttccatcatattttcccaccatatcatgcacacacactttgcgcgatcttgatcttgagtatgattagtcatctagtttagtccaagtttttgacatagtaataaatgtgaatacaagtatgtcatgtttgatccatttcaagctccacatatgaaccttagagtaggaatcaaaaaggcaaatttggtgaggaatccatattcatgcactttgagtgatctagagaatcatttgaggaacttggatttcttttgcaaaaatcatttgaaaacctccggaataaaagttgaataaagattgggtaactagcactctaattgttgttctgtctcacaaccgctcaagacaaggaaaggcagtgtctcgtgggaatcagggataagggtaagccgccgtgccaaacttatttgatttgagagagagtacccataccttgcatctgtatctttgagatatacaacattgcagcaactcctgatcaacaactaagtctttgttcctttcgttctttacttgggacgagcaaaggttcaagcttggggggttttgttgacggttgttatcgaccagtttcgaccgtcaatattacccaattaatgaagactaactatgcttgcaatgcattattccataaataaaatattctactccaccatatgcttggaaaactaaccatgcaggagaagctatcaaaatggagtagaatcgacaataaaacaatcgatcaatcaaacagacactgtcgagaatcaaacttgtggatagatgggctgagaactcagatatgacatgatcaaataagcccaaaattccctgttctgagttaaggggcaaacgaggaatccacctaccgaattgtgggctgattgggcctggccagggttcggcccaactccctagtttggttgaaccaccagctggcctaatctagcccattttccaccggcagttatctacatgtatcctatgacggttaggagcaattctaccggtagaaaccgtcataagcatcgacacatggcacaatgaggtgtaagatgctctttggatacttcatcttgccacttgtcatgaggagagcaaacatgctcctaggatgcttggagcatctccacactcccaaggcacctcatgggctataaatacccctcctctcattcattccctcacacacctcaagaagaagatcaagagctctctcaagtattgtttagtagttctagtgctattggagtaggaaatagaatagtcttcatagtcctcgagtcttcaggagattccgggtatggctttaatagcttttctctcttcttttgtaagatttattgaattaataaaatatttttctttatacaagttcggtattttattccattcatattacttgagtgccgactttactttatacttgaatcaatatagtcatgtaactagctttccagataggtgtattggtgtgggtttagtgtccgattactcggttgctctatgtcggttgcaaggatgtagagtagtattcagtaatgtaatcgtggtgcttagattattagataccattaattgttgttatatattgcggatgagaggtgggccgctgatggtaacagctcagtacgggtattcctccgcgccggtatataatcctaagttaattcccttgggaggttattcctccttatttagccccggttgtatggtcatgacaggctatcgtaaggaactcggcagtcagaggtggcttctcgaaacaccaggaggacactgggtatgtggtattggttgcatgactgtataatagcaagtatagactaaagatgtatgtatactagaagtacaggaatgatacttttcttattctttctccacttagcttagactatattttagtgagagtagttcttagttctttcttctgtgtgtcaccctacccttttaactgaattaacccctgcgtagactttgacgatgtatataagtaatatataaactattagcatggtactctctaatcatatcttcccttgggataaaataaatacgataccttggaatactcccgggtgaaatgctacaatggtatatccgtgcgcttgcggatcatgtctgtaaccataatataccaggattatttctagtgccattgctgggaattatatttccagtagtgttggtaagaaataccaacaacttcctcatcacttcctatgaagcaaataacattctgcaacagtttaggatagctcaaacttttttgtatgattcaaatgaaaaatctttctcaatgatttctcctctactacttctactaacaagagtagacatgtaaaatttatgtttgttcttgaagggaaaaccgttcgagttgttccttaactcaacaatcatatgtctgagaatctggtttaactaagcggattggaggcgggcattttcatttcaacgtagcagtagggaaagtgatttcggggggttagtacctattgatgaataatcatagtagaatcaaaggtacatagtcaaaaagggttctgacctaaggctatggatgaatcagttcaaagaatttactcttaacaaattcttagagtatttctggtagaattggggagcattaagtataaatatgatacatagccctttcttattaataaaagaataaggaaaaacttttgaattctaccttcatatttcctgctgagatcccaagtctccaagtgggccctcttggccacccatgaccttggctttttagagaatcccgctcctatgtcgtcagacagatccgggcttatcaagtggtactgaaatagggtaaaattcagtttagtagaaaggaaggaagcaagtgaagaaagatgggatcaaataataataatggtacgaatatttgatgattgatttatacccatgtatgacatgcttgtgcatatggtgcatgttgaatgctacggtaggtgatgatatgcttctttttaagacatgcaccaaatgaatgtgggatcctaaaatatgccccccttgtatatcgatgtatgacatgtatgacatgcttgtgcatatgatgcatgttgaatgctatcataggtcatgatatgcttcttttcaagacatgcaccaaatgaatgtgggatccaaaaatattttccccttgtatatcgataatcatatcaaatgtgggatcctcaaatattctcccacttttggcactaatctcacaaaaaaacatttgcaaggaactaaaaaagaaacaattttgctcgagcaaaacaagaacaaacattcacaagaccaaatattttttttgaaatcgaggctcaaagcaaaaattttacaaatggtccatttaacaattactcccccttactctcgtagtctcaacacttagacaaaaagaattagaatggatttcatttgttggagggagtgattatgagcattagaactttctctcaaaatgcactcatcaagtatttttctctaagagaggagtttggtcaaagatacttgacagattcttggtcatgtgagtaatctcggcaatggaatgacaatgattgacaaataccgagttcaagatgatcaagggttagtaccattttatatagacaccacttgtgtatgcaagtgcgaatttggatcaaggaatggtagttggcaatggcaacaagaatcaacttgtatttcaaaagcaaaggaaatggaatatgtaggttgttaatgaaaattccatttgagtttaggttggctcaaataatggggtttaagagcaagaggaattcatgcaaggaacaaatccaatagagctcaaaattgatttaacattcacgtaacatagaactcactacacgaaacaatttttattaagctatcgactcagattttcaacaaaatgaaacgcacttttaaaatttgaattttaaccaaaaaaaaaagatacaaccaagcaagctcttgtagcaacacaaaacttgtggaaatgatctccaaaaacatgcaataaatcctggagataattcatggaatcatgcacaagtttcattttggagtcttgctcatatctcaaccatatagacaaaacaaaaatcataagatttcagcaagctgaaattccagatttttacacaacttaagatgggctttgaaaaagcattcaaacagagtccaaatgagctgcaaaaattaaaacaaaaattaccaataattttcaaatataggggatcaaaagtcataccgaaagctccttccagtttgcaataaattgagagatataaaactcacaaatcagtgtaaaaccatgtcatttccaaattttttttagcaagttcatcaaagtgagaaaaactcgaaactcttccaaatcatgtccaaataagatgaaatcttacagaaatgatctttagacatgagagaatcttgtccaaatgaagtttttggaaaaacatttttctatcaatataaaaaccaaaaatagcattgtaggcctttcaatttagtaaattcgaatgaaagtcacaaatcacacacaaatgtgtttttcatggagtttgacatttgtatagcgttatatgggttagagatactaatttaagccaatattcacattgtactttagctccattagcataacccttgaaatccatgttttggtcattgtggtcattacattacacaattttggatgaattttaaatagctataccctttgaatggttggtattttgagaaaactttgaactagagatttgtttttaatgaccaacccataaactttcgtattagaaatgttttcaaaaacacaaaatattttgaattaggagatagaacattttgaataagaaataggatcatgcaagatccttttacgcccattttctatattattttagaaataagatcttttacttcaaataccttgcaaaaatttgaaatacatattgaagcacttttgggaggattttcacaaaatttggcctcttaaatgagatttttcttaattttgaccaaagaggatatttgaaatagctataaatccaacttttgaaatctttcatattttgaaagcatgggatataaaaatatgattaagaccactccgaattgatttatttcacactttaacatcatgaagtcaaggtttcgaagaaaagaccaagtttgagcaaaaagctacataagcttctattctaaacacttttatccaaaaatgcaaacacaaacaaataagatggttttggtgagaaataaatatgaatgaatgttatgtacttatttgagctagtatgatgcatttatgcaaccccaacaatgagaactcatctaagtgatagtaggtggccatgtatggtctaaataatattttggataagattggaatgtaaatttcttttagttggttggctttttagagaagttttgaaaaccaaaaatgtttgaattagccaaccctatctttttcattttgaaaccattttcaaattccttttgaaaattagctaaaacaagatacttagagctacatttttttttgttgaaattctttttcattgaaaattagctcttctttgaaatataaaagtattgagagatatttgaaacacacgttgagatcatttccaattagatttctcatagaaaagctttttctatagttttcaaaattttcacttttggctaaaaggtttgttttgaaattacgaactagcacttaaccaacttgagaacatatattggtgtgatatgcatgaatatgattgagtattaaatactcatatgacacaacttatcatgctcaagaatgcataaatgatgaatttcacatatgcaaggaaggtaaattcttaaatgctatgagaatgcaatgcaacctatacaagattaaatacaagataattcaatgtagatacatgttaccgagatgagattggttcttgacgtgaattttgcaatggttggctctaaactccgaacttggtgagatccacctttgcttgcataagccatacctccaatgtctctccatgtacacatattctcattttagcacatttttgtccacaagaaaattgggtccatataggttagtcataagagatttcggcacccaagtgagctttgtgctagcatgtggtgaactaatcatttaagtaatactagtgacattttttgccttcctaagcaatttaagattcaaataaaaagttcgggttaagaatgttaccattgggacaatttttttaccaatttgtccctttcaccggcaattgtaacaaagtcgattcttgtctttacatggtgctttcttcaccgcatctttcatcttacttgttgccttgatattaagtttcttccttgatgacataaagtcttcatccttcatatgggggcatgatgcaacttcatgatccttcacattgcatccataacacttcatattgcttcttcttgttctcctcttggtcatcaatcttgttggaacatatcaacgcatagtgtcccactttcttgcacatgatgcaagtactgagagttttgatactactttgaatttgccctttactcttgttgttgaacttagtatttgcttgatagaacttggtgcaagctacggttgatcccttctcaggcttcttcaccatgttcccacggttatcttgagaaggttaagcattgcccacaagtccttgtccttttttcctacataatccaagtcacatgtagtgctcagggaaatgtttgcttcggagcagcaagtgttagcacaagtaagatcaacctgagcatgaggcccatatgattttaccgttgcaattatcacctcatgagctatctctactatggtcatgagaatctgcaaagttcatgatgcatttcttgtaaatccatatacttgctagtgatctcaaattcagatttgagctcttgattttccttctctaaaaatgctacacaagcaattgaattagtggcacaagaaaattcattttccaatttttcgtacttcataattaatgaagaatgagatccattgagtttcttgtgttcatcagatagacccttgatttcttcattcttcttaatgagtcattcatgttgcttctcaataacccccatgagcatgatcaccattgttgtatccttcttgttcaattgatcaaccacaaagtcatcatcatcgcccataaagcatgcatgatcttcggcaatggaagataaacaagttgatgatgtggattcttcacttaaccatttatgttcattcacttcttccttcaaaaggttagttccacaagtactatggaaagtagagcatccatccatatcatcctcatgcacacatttagcgctagatggtttgtatgagtcaacaacacaatcaaatatagcaatttcattatcggtgttgttggagtacaatgggagagttggacaatcatcaaccttattcaccatttcattaccttgcttgtagttgtatgttggtgagatggatgatgagataagaccttcttgatcagaggagataatcatttcagacttgtcaagatgaggcgatgaagtagagcaatccccaaatgatgcttccactttccgctgcatatttaagacattatttatttgtaagacgtggatctgagtttcgactttgttgtttgtgtaccctggcttgtcctggataggggatttaatacacattcttcttgaaattctggttcatgaatttctaggcgtgacattccctttcacattgcatttataacctgaaaagaacattaaaatttgtaaaacataaaaagtcaaaaatatataggttagatttttatatgctatgtaagactactaaattttctatgttgaaatgatgaatacttgctatcttttatatctcctatgtattggttcatagttaagtactactctcttaagttttaagccggaaggccaaatattatctgggaacctgggagttgttaatagaacattgcatgatctaagtctaggttgttatgagatctgatttggtaaactatagttactatggtcttattctaagtttgactagaatttcagatgttttttttctcaaaatgataactttagaaagttcctcatttgatatgaagtcctaccagagacatatactcatttaaattacaaaaacctaatgttatggttgcttgtaattccattaaactttagtcaaatttccgtgacctttgttagatgcttctcatactttatgatcagacacacacttacacgcacatatgctaaacatctatactagaagctagcattcattttatccattttatccattttcttccacttcatccacaaaataaatactccatgttatttatggctctctttccaaaagtatcattcaaaatgaaagagaggtatggctatgcaaaaggaaaaaaagaaaaaaaaggagagaaaaataaaatcttgttcatacaaagtatggggcatgatgaaaaaacagaagaaaaaaacctagccagacaccctctcaatttttgaaaaaaaagagaaaggtgtatgcagaaggggtaatgtcattccatatccactatcataccagacacttgcacgatcttcatcaaaagtatgttttgttatcttatttggcccgactttttgacttagtaataaatatgaaagcaaatatgctgtcacacccagagtttccccttctctgtagtttctaattcaccaataaattgtctatagaaattactttggttaaccaagagaaagcccaaattaacaagacattttaataatcggaaatgtcagggagaattctttttcgaattctctttgctctaaaatcattaacagcacttaaagcggaatattcagaacatcggagttaatgttggtagattgaattgtcaagatttgaattaataataatctttctctcccgcatttggtcgtgaatcgtgcccgattcactgccctcttcgtccgtggttttgttttgcataacgagccaagtccgtttccgtttgtgagtccgtttccgttcttttcctaaaacggcacagcatttctttttcaatttgggaaagttcctttccaaatcctattcctatttttcctcccctccccatcccactaggccgccactccccctctcccctttcgcgagcatgcctcctctctccccatgtcgaactaggccccctctcccctccctctttgttgcctccccaccagtcccacctccctcttttttccccactcctgtataagttagaacaccccctattatttttcctattcaatttttgttttagccctagtcctagccctagctgccgcctcccgccgtcgccggcgtcgccctagcgtcaccgataatctgttttccctctccgtgtcatggctaccacgattatctatctctattctaatttatctccgtcctagattttgatctagcatcaccgctgtctcggcatgttgccgccgaactgtagtcgtcgtctcctcctcgctgattgtctcggtttggtgaggaacctatccgtaatctcccggtttaggtgttaattctttttagtgtcgttgttgtaaccctaaaagtgtaaccccgacaaaaccctagtagcctagccgtgccgccgccgcctagctgccgtgtcaccgctgccttgtgtcaccgcctagctgtcgtggtttgccgctgcccgtagctcagtagccgagtcgcaaagccataggtgcatccctaaacccctaccggcctatcgcttgctgtaccgagtctctgtcgtaaaccgtgtctgagccgtcggttccgttcgccggttcggttgaccgtttggatggtcccatgtcacgaagtattgggtcgttgagtcgttaattcatgaggcttgcttaccagaggtttatttccattgatctatttatctatcggcaataatatgtaataaatgattaaggtttttcagttattagtaataacgcaactcatattataaaattcgtaactaaataatctgagctccattttaacccattcaaattgtagtgaatccgttaaaatgtatagaatccattaaaattggtttcttttgctgtttcagtagcctcattgctggtatttcttgtgtgctttgtttgtcgtttagactctgtcaggtctggtgatctagtttatttcgaagtggtcgccgaggtttagtcagctcaagagcaaggcaggtcatacatgcatcattgatcatgtggagcctattttataaaatccccttctttctattaaattgcattgttttagaatgtcatgtgggatggatgcctatcatactcagcatgttgaatatcttatgccattgataacttgggttataactgactagatgattgctctaggagtgattagccatgcttagatcaattagttcacaatgggattcattataatttagtccttaatctaccctataattcaccaaatcattttactcatctttcactcctacactcttacattcatcactcaacggttaagatcgaccagtgtaaaatcaaatgatcgagatcaatcccacctcccacctctatgaatcgctcccaccaccttgaatcgcgcacgcggcacgcccctttctctctttctcgctctcccagtcacagatccacgtctcctctctgtcctcatcccgcaaggtcgcaacccgcaaccttgctcatcccctaaccgcgcctctaccctaatcgctgcgtgttgccgcggccttcgatcctccgttttcaagggcgtgtcagctcgtgccgctcgccgcggtctccatcaccgccctcatctctcccctgccaccgccaccttcaatcctccgtggtcaagggcgccggctcaccatggtcttcgtcacatctctcccctgtcgccactactatgagccctcgacggtggtgaagcggtggcgcggtggatcttcggtgaaaccgaggtggcgcgatggctggagcgacaggcgcctcgccagcatgacgcggactgcagtggttcttcagcaacatcacagcaccactgcttcatcttccatcagcaagtgcgcagcgattcatgcccgttccccttacctatcaccgccgcgattcttgcccctgcccctctcaaatcttcaaaccctacctagccgccggtaggcccctgccgctcgcctatcgccaccgcgccgccgctcacaatccccaaaccgtacccttctaccggtactgcgaatccccgatctccgcctcgcgttacggatgccactgcacctcctccatggagacgaaccaccatggaggccgctgtctttgctccccaccaggtcgccatcctggcactgccagcggtggaggcggaggtggctaccgctgctgcaccggggaggatggccgcgaacagcgtgacctcgatatccaagggcggggctgtaatgaggaggtacacccgtggaccatgatggatcggtgtgtgcggcggatgcgggcgagaagggaatcgcgcagctggtcaaggcaacatcccatctctctctgttaatctcgatctctgagattgctactaaactaaaggtgatatttttctaaaggctactaaactaaaggtgatatttttctaaattttgtgccaattccaggagaattcggaacctatgaggctccttgaggggagggagtacgtccctgaaaccacctgattccttgcatcagttcatcccttctattgaggctttgagtggctggggcttttgatgctatgtgctcttggtttgatgcgatttttgctttgttttggtgcatacagcaagatcatagacttgagcaggaatgggccagaagctgtggctcgctaactggcagctcgctcacacaggaaaattcccatatgctggcagtaagtttccccctaaattttatcccagaaacttcactgttagttgccaagtgaaatctgtgcaatgtttagtttaattctgatcgatcaagagaagcatatacactgcatttgaaagtgtgaaaacacatattttgctttattgagtttgcaagccaacgtgttaattgtagtttcatagtaactgatgtgtgtagtaccgaattctaggaaaatgcattctctttatataagcctttcctgatatgagttaacggatcagttaacggaaaatgcatactggatcacttctcttttttttttctcttactggtgtcagagttctctcttacaaatattcttatacaccattcataatactattatacctgcccactgtagttgtattgtgcatatataacttcagatttttattagccttcagttttttttttctactctgtcggattttcctgccgattaattgttggactcgatgtccagaaaaaaaaatgcaaggtctgctccccttgtcacattatttgcttatatttcccttgaaaaaaatagtgggttctagccttctaggcataatttatagtaaattgaaatagatatttcctgcatgttgaactatttagttcattgaatattagctagaaaaggtacaaaaacagggagaaaaggaaatcccaatgttgctactgaggcaatatgaaaaaaaatggtatactgcaatctgctttgtgtaaaagcttttcaatctaactgttattgtgcattattatcaaccaaattaagagaggatgcaacttgaagttccttgaggtagatattttatgtggtgatcatgaagttgatgttcatgggctttcattggaaaatttgagtcactaatctgatacattgggtttcactgatttataatttatcatttaatattcaccatttgattgaatttcttgtttcttgtactgaatcatgtaggttttaatgtatgtagttttacaagaacgtctccaacaccttaaaggatgttctttggaaatcagacgatcttcaaagtccacattcctggagtaacttgggagagtaggattagtgaactattagcataccgtcctttggaatcaatattcatatttctagaggtgagaaaaggagaaagcatgtctattgcacttgtaattacatgtgaatgatcctgtaaattatgttaagtctccactaatgttgcatgtgctgctcttgtttttcagagaacccttctaatagctcaagtgaagttgatcatgcaatgagttttatgtgttagtaagttttgtgcgtaaatcaatatgctgtgagatgcaagtataattaattaattaattagcatcatttcatttacactgtaaagttgtatcattctcagcaggaatttccttttctgtgatatcacagtggtcttatgaaacatccccgtaacgttagtacgggcatattactagttatattatgacatttaccccattaaattcaagtcctataagaagcagtcgattaccgcaatcactcaaagactaagtctaaacctgcaaacaaaaggttaattcaatagcaagagtcagtacattataagaaataatgtactggtaagcaccaagacaagcctaacactctacttgcaaggcatataatcaaggaaggcatgatatggttctttttagcataaagcaagttttatttgcataaaacatttccaaatcagatttgctttcaaataaatttcagcaagcaagtacttgacatattgggcatcaaagtagtcattaatcatgtataaatatactactcattgccatccatggcaacaaggagatcattctcaaatctcatcacattttgaagttaaatttcagcatttagaagaataaacacaagtctatactcaacacatatcgacatgccgctcatgaccgcgagcacggctaatcgattaggttttagaactctgcagactttatacagctttacccacatgatgtgaatcgctctggtttgtccggtacccgtcggtaccaccatactctacacattgagtatggtctagaggtcacaacgaggcttttacattaagtattgtctaaccttgcatgagcacgatatgtgtttctccatcctaggccatacacgttatatgacctagaactgttaatggcaggcccacgctttaaacttaacgccgtgatagcggacacaacgaggcttttacattaagtattgtctaaccatgcatgagcacgatacgtgtttctccatcctaggccatacacgttatatgacctagaaccgttaagtggcgggcacacgctttaaacttaacgccgtggtagcggacacaatgggaacccaccacgtggcacaatatcgttgtattggacacacttagacgcccatgccgtgaggcggaacacgtgaggcggaacagtacactcgtcccctcacggaaatcacacacgtagggaatttatcatcctacgatcacacttaggaacagtacactcgtcctaaggttcaacacacacatgggtagttcctctaggtagcccacagtacactcgtggcccctacctatactataacggcctcccgaatgcaaggttagacaagtgcttaacttaataggccaagatcccccataaagacacatgtggatgtatggtaaacataatgaacagacattgagtgaagtccttaggttggtttgggcacactctccccctatcggtacacaactaatcaccatatgtgcaccacttgaggcccaaacctaaaatccatgttttccaccattttatttatcaaaatcacaagtattaaaattctttccagattatttaaaaattaattttcatgtttgtaatgagcccataatgacaaggaaaaccattctaaacatggctaagcattatagtaacctagtgtcaccaaaactcatatataaagtggtatagtcgtattgttcctaaggttaggaatgagggatatggatatatgtgggttaaggtgataattcaaataataggagcttgcctaacaagtttaacaaaattttaatttattagtgtacaatcgacatgcaagatttgccaacattttcaataacctccaaaacataggttcaaagtgatcaaagagagggaggtgggactttccttgtaaccggaaaaagtcagcacctaaatcacttcttcaccgtttaagcaatcatctatacaaagtacatgttatgcagttaaacaccgaaatatgcgaaaaatctaaaatgctctaaaatgcatgatttgtgcacagtggataggtactggtctaaaatgaatttacgtgaaagaatttctattttatctcatttcatttgagagttatgaattatagaagtttgctcggtataggatagtatttacttaggtagtgttataaaatatttttataaagtgatgtttattaagtttgactttacagaggtgtagaggtgtgttttctaagactaatacatttggtttcacaatttttagagttattatgtattctttatgtggttcacaaattacaagttataacgtgttctaggcatatagtctctatgtgtacatggctttggagatttaggctgccatcggttcgcttttgcggttgctgttttgcagcagaagcgcatcggttcgctgttacggcctaaatgcaaacagctattggtagtgggccctacacatgtcgggatctatctacggccacgcatttggactcagtgctgacgagcacacaacgcacacagaggcaggcaagcagaggcaatgcatcagttcatagaagatccagtaatcagccataaacaaaacaatggaattgctgatgcttataagcattaggctagtactgctgaaaagcagcagcaactgcaaaacgatggcgcccttaggtccagaacttgctttaacttgctagtgttgtataaaatgagtattttagttaactaatctaatcttagttcataatttcggagtttatattattttactacatattttataaatagggatgttctatgttagttacttaacttatcaatctaaagattgttgcatgagataagttcatctaagttttggtagatggggatggaactatggctccactggtcctaacaagttttatttggatttatttggagctaccatgcatatatatatacacttattcatatgtattgtttaaccactattatgtgtttagtacctattctaccaaattaaggtttagagctatggtctgtacagagggtgccataattcactctactaggttaaagtatattacttgctggttctacagaaatttggttcacttcatttagactaaagatgaattttctacaaattttacaatttaaggtatgctccatgttgcttattccttacataaatgcttaggggttcttattatactgtaagtatgtctttttattttataacattgaagtgcacaactctatgattctacagaacttgagtttactcgaaaaggatctaagatgaattttatataaacttctaaagttcagcttatgcagaactagttattttaaagataatagttttagaggcatttgatgtaaagtgtgtatacgttttattttacttttttttagagaacatgttggggaatctgtagaaactaagtttgctctaaaatgagttgaaatgaattttgtatgcattttataatcctgtgtatgttttatatgtgattttacgtagatgaattttagagacagaaattgtattgtgagtgcaagtttttatgcaataaaactaaagttcttgattagatgagttagcagtaatttgaattactctaagatgagttgttttcaatttgttatggattttacaagtttacatgtttttctgttgaaaacataaagctttaggtatttcatttagattttttcagaatttaaatagattgggtcgacaggttagtctcaagccagtatgcagaaaggcccctggtgtttcagcaaaatcaacccgcggtcccatgactgttctgtgtgtgaagtaggtttacaaactactacctagagttttgattcttctcaagtgaggtccttggttcgagctgatacagagctagccatggccgagctcgtcctggagctcgccggcgacaaacggtggcagatctcggcgtgcaacgtaaggataaatgtaaaggggttcaaggcgacgcttttggtggtattattgcaagcattagtcaccggaattaatggcgacgncggcgcgagctgcggtggttctcgggtgatggtgcatgtggagctagagcattgatctagatgtttagctacatgcatgtgccgctatgggatcctagggatgcttaccgagcgtccaatgaaacttggcagggtccagatagcggtgaccgcgagcagaacgactcggcgacggcggggagcttcggaatgacgtcgccggcttgatatggctgatgatctaccatgcatgcatacacacggtgtataataggtctctggaaagcttcatgcccgaggaattgagctgtgactcaccggagagggagaaatcgaaggtggagcttgacggctggaattggggaagacgatgccgatctccaagctcgatgcaccactggctggggttcatgagggatttaagagaggaccccgaggagatgttgatgatgcggtggctcggctcggcttgctccggttcgacagcaacgaagacgatttcccgatggcggcgtccagtgcgcgctccagagcattatcgtcgaggtttgagttcccaccaaaccactgcatgaaatgggatgaaacttagagggctggaatcggcgaggagaggtgataatggaacgcaagagaagaggaaacgacggcggcttaatgacgctggaggcggtcgtcgtcttcacgaccggcggcgaggttgagatggaaaagggagatggagctctccttcttggtttcttcagtttaggaatggataatggggtgtggcgatgcagctgggaggaggagaaggctagactaggtgtttgatggcgtcgacacgttgtggccacgtgtcgttcatagccggcgccgatctctctctcagtctcggttgtctctggtcggttggaggagatgcacagggtgtggagcaagccaaagaggctgccatgtgggcccagggcgaagggaacatggcccagggcgaaggaaacaaggctggattgtgagaggtgggtagaagatggggtgttaattgattttggactaattttcaggattattttctcctctaaatttgtagcttcgtaacttaatgtgtggaccagattaactagtgttgattttactggaggtagatgaagttacctagtttccattttctttggttgcacttaaaaagtatggatagattactcacagaaattagaagaagaggggctctttggaaaatagtttggatttttaagagacctaaacagagaagataaattctggaaaaattatatttattcattataattaacctagtatttgaataaattatttcgcctatacacttccatgcagttaaatgcacattttagttatgtatggttttagctgattaagaactatatttagtctattattcgactagtttgacttgtttatttaaggtatcaaatttagttaatgtttgaccaaaattacagtgaatagcttgtgctaataatattctacataaatttttccatgattttatcttgcacaaaatatcttagataatccgcaaggcttatctcttatatgtgtttcccttttctaaatgcatgcaaatatttatataagttatatttggactcttcttaacctgagatgatgttgatatgtttgagttacagtttaccttacacagatcataagcttcttacctatttatgtataagtttactttagtattagattaagaggatgcttatagagatgattaagatagaatataccctatatgacttaatttatttgttcacttccatgttcatgactcgtcttcatatggatgaccaaattatttttgtggggcttgacattggccttttgatatattttaaggtttctatgtattattttccattagttagcactaagctctaatggtttagttgtttgtctagattgtaattatattcataagacctatgatgaaatgcaaatcaaaaatccaaatgcatatgaaggactcaagtctaaacatgtcctatgagtatgcatgcttacacataggtttacatttttgtcctaggttagagatgcaaaggttttaatttgttctcaagttttacttaggttcaagttagactgaccacacctaggttaaaaatggaaatttttggctctcaaaaatggaaaagttagcttccaactattttgacacgaaacttttaaggtctaaaatttgggtatgttacagtataagaaatgagagaggactaccgacaattgtagaattcctccgacttcttgtactctactctatccctaattctagtatacaataaagtacaatagagcctcttataattcagctcacgctttggtgtatgtgagaatgaggaaggagaggggtatttataggtggaagtgcattgggaggatagagtttctgtaacacccccggtattctctgtcatgcctggaaatatacaccatttccaaacgctcagtgcattaatcctcgtcccaggagatgaggtacacatagacattgttgattattacaagccacacttgcggaagcgtaaaggaagtactttattacatgggcgacttaagccctcacactcaaagataaacaaataaaacagtggaagactacggaacagcagcagccacaggcactcaacggtggagcgaactagagatccaagccttcatcttccttaggtccatcctctggattatttttgtgagcaagagtgagtaccatcaccgtactaagcaagtcacaccggaaatgcaaccataatgcataggggaaacaaggaaatggcctaatagggtttattttgcataaagccatagttgaaacattttaatcaggttaaagctcattttaaaacacgatcctgttctaagccaatattttaatatcatcaaggtcgcatgagcctgcgaacctgccttaacccaggctaatctccacatgactacaccatcatgatttcaccctcccaaggttttataaaacaaaactaactttgggtacattgctcagcttgcccataaccgaggtcgcggctattcgaatagtttttaactctgatcagaggtgtacaactttacccataagacacaacctcaacacgcgttgccacgcgctgggtaccaccacggtacccggatagaggtcgtgacaagactatccatctaggtctacccaaaacaggagaacccgccgaggtttcgccgcccgccggtccacgacaaggtaaaggttgccggatcccccgggacgagacaggcccccccttgcgccgggtgaaaagacagccttaatcctggccccatacccttccaaacaatggtctgtcttttgagaagatctaaacttccagtcaggccttacccactagacttgtggttgcacgaatatgccttgcaacagaggcccgaagaccggtccttatattagccagggtgcgactaccaaagtaaccagcttgcaccccaagcccaacccaaaaatatattttagctgtacaaagcattttatcacctatctattgacaaaccagtcaatagtccataactaatccagttttagttgttaaccaccagtctagtttatccaaaagttctaggttggaactaagcatgattaagcatttacctaaagcaactagttagtccatcatgtagggtactagactagtcaagttataattttactagggttcacaatgatcatggatatcaaatcaacaacatggccataacaaagagcataggaataactaataaaacaatattaataatgaaaagtataatttataaagcaatgcactataagtaaaacaacataattttcacaatatgggattcaacatgttcaaggtagatatgacttgccttgattgctcacaaagtcttcgccatcaacgacgatgaacaactgatcttccggaacggcaggatctacacgaccaacacaaagaaatacaaaaaggctaataaaaaccacatgaacataagcaataaagcacataaatgggatctactcaattttaggagaaattagagatttgaacgggttgattcctagttcaaacggtcaagatatggccatttgaagtttaggtgttatttaaatggaaatttgcaattttgtgaattatttttctaaaggaaaacttgaattattgagagagagcgcacgcggaccgggtccacgagcgggtcccacttgacagccgctcggtcccccgtgagccgagcacaccgaggtggctcacggtgcaccgacgtgcacagacatggccgagtagagcagtacccgagcaggcggctcgccggcaacggccaacggcgcggcggcggtgcgacagagtatgggaaggggaaaaacagaaaggggaggagacgacggttctcaccgagcagacacggcggcgagaggtcggcggtgttgccggcggtgaggaagaaacggtgagaagcttcgggtcgtcggcgtcgtcgtcgttcctgcggtcctcgtgctcaacagaggggtggacggggaataggaggaatcgccgaagcggatggtggcgactctgagctccgacgagggatggccggagttgcgacggcagcggcacaagaagagagcggagcggaggccgcggagaaaggaggagagggcggcggtgtgtggggagagaggagggagtcaggggtccctttttatagttcggaggggagggagagagacgccggggaaggagatcgacgccggccatggtggagctgaccattaaagaacaccatcaaaatccaccacgaataatgcgggatagagtaggaaattatgagggaattggagaggatgaggtgggaattaattcccctcaattaatttgatgaaacggcgagtggaggaggcgaatcggaggttgccgtcggcaggaattcggccggaaagagagaggatggctgaaggttagggatgacgagtgggacccacatgccatcgagagggagcacacctgcccaggctggggcgcgcggagaaggaaagatggacttagtccgagggagagggaatgagctgggccggcccaaggagagggagggggaggagagagagggaaggagagggggcggctgggctgggccaagagagggagagatgggctggaaacagcccaacaggaggaagaggatttcttttagcttttccattttataaaatttctttaattgtttttgttgccttaaaattatttagaatgctctgaaaattcaagtaaaaattggttaaacatttttaagcatggggaatttattaaaaatacccacaagccaatttgaaataaatgttggtgagttttaattgttggaggcttttttttaaaatttctagaaatgcattaaagcacgatttaaatttagggcgatttacattctcttacctaggatgctacacactacggtacagaaaccactgagtcctaaattcattaaaaatttcgaaagagtatccctgtaaatacggacatccacgacatgcaattatagattaaactaataataacatcattcccatagcactatccatccatctaatccatggaaagaaactaaaaggtagtttaagtgtcattatagacctaggcaatatagtttgatattgtgcagataaatgtgtatataatggagctacttcctgcccatgcatgtcggtctcaatgcgtgcataaaaccaaataaaacacaagagtgagtataaaaatactcagcaagtacaatatggaactagaaaacacatatacacatcattggcaataaagcatgtacaaaaggctttctttctttgataggaaacacattttcaaacaccaagtcaaagaagatagtagttcccatcccgggtaaacatgaattgaaatagtagtttccatcccagacaatagtgaatacatcctagcatttgccagcaaagccgagtaagcgtgatcaacgcttacccacaggaacatgaataaaaccagatagcacatccatgactcacatggaacatgaataaatgaaaccagaaataaagaaccaaattgaaaaccatattgcacatccatgacaagcatggaactttaactatttaaccagaacctgaatccggaatattgaaacaagaataatgacgtaaacataagataaacttgacatcaaaatagcatgaacaacaatatgaaaatatgccatcacatatcacacataaatataatgaaaataaatagatagagcaaacactccaagaatcacacaattagttcgtcatgcacttgcctccaataaagggttggtatgatacactattggatgaccaccacctaattacaaacaaaacctgaggaaacacattcaaatatacatataaaacaatgaaagaggtgaacctactggcccatcctgtcgaaacgcaataacagggaacgccggttggactatacacaagactactgcttcaaacctttatatcgtgaaatatgaaaaggctatgactgagagatatgatttaacccaatgtgttttttaataaaaacaaaaacatactctacgaaccatacctactactgatatgttgaaagcatatggatatgctgacgtgttaaacggtttaaatcgctcttgaaagtaaggttttgaatctggccagaatctcagagagaacatacaaaaacaactatatatggaggtctactcattggatctaagtctattttaccaatatggaaagcttggagaaaactctataactttgcctataggcggcctgactgattccactgtttaatcctccaaaaacagttaaatctactactacataaaaacagtcatactaaaaaaattatatctcctaaaccacttgagataaaatcacgccctttggtcagaagatagatccaaacattatctacatcttcctagtatacacttttgcagaaaatagcatttagagccccgaaacatcgaaaaactgaagcactgtaaatttgcccaaatgtagaactgcaacaaaccgaaccgcaagaacccaaactctttctctagccttccctaaccacgaattaaagcaataaagtcatgctagaacaactaatacaacaaagagaaaagcctcacctagggtttctttagagaacttgtgaggagacaatagaggagactccgatctaacccctcctactcctctccttctcctcgttccgtttttccacttcgcttcttgatccaggttgttggggtggagatctatgagggcaatttgctgtagaggggagagatgtgaacacaggaggagggaaggaaggaggcgccgttggagcccggccagggaaaggggtgtcggcaccaagagggtaggtggattcggttcccctctctctaggttttaggggagaactagtgggctgggtttatgggccttctcatgttgggccacttctaaaggtattttcttttatttatttctgttaacatctttattttaacaagtcaacccaaactaaaaaaacctaaataccttttaatatacggggtattacagtttcttccaagcatccaatgagtatcttcatcctcctagtgccaagtgtcctttctgatgatggttagagcgccggaaacagtcacaaccattattgggatgtcgttatctaccgaactgaacttgggcctgggccaatggcctttgtcagggttcgaccgaaccttggccagctccgttggccccgcttttcagcctagacactcattctggggccctcaatccattgccatggtagtttaattgggcttttcggtccaaaacttcgtaagtttggatatgagtttgactctccttgttcttcatgtatattttctctcaactttggtagtttgtcatctacatccaaatatacaccaacactcgtggaaattgttacaaatataccctaccactatgttggatgttttatgctttccattttatgcaggtactgatggcatgaatttggtacttaagagccatcaacaactatgcacttagtacctttgagatggacaacatagtagcaactcctgatcaacaactaagtttagtttatgcaagtcctttactcgggacgagcaaaggtttatgcttggggggtttgttacgttcattatagaccaatttctaccatcaaaacttctgaaaataatggagaactagcaaagcctgcatgcatatttatttataaatagtctagttccacttgtacttgctaaagtatttgtatacaggagattacttcataaatggaggagaaacgatggaaattcaccgttcaatcaatcaaaacctgtgtcaaacatatggattgatgggcccacaaacccattgaaacatctacaaatgggcccaaccaccatgccactgggctgaggatccatcaaacgacgtccaggaggaagcactgggctagggaggcctgctaggggtcggccgaccctggcctggctccgctggcctaggcccaagccaatgacagttgtaatcgaccttccaatgacgcccacaaccgtcatcctcaagctataaaaggacctctcatccttcattccagcatacacaaagaaggattcgcgaataagaagctctcttagtttactcactttgctctagtgctagtagagttagaattagaatagtctccttagttcttcaagtcttttggagaatttgggtatggttctagtagctcttccctctcttgtaagacttaatccattaatgatatattcttctttatatagttgtggtcctttactatatttgcataatgtcatgcccggaaaatagaacactatattccatttgtgagtgcataattccttgtcccaggaggcaaggtacacattacaaagttggtaaataacggagtatataaacataagcgtaaatagagtggcaaccaaaggcccaacactgaaagataaacgataaaagccagatgctacgtcgggccactacaggtacttgacggcaggcacgagctagacatcaaagcctttatctccaaagtactcctctgctggaagggggaaaaaggagcaaggctgagtacaaccaccgtactcagcaagccatgctagtaaaatgcaaatataatgcaagggagtacaaagaattcatttataaggttattttgcagaaaactagaatttaaaagcatttcaatatttacaagcatttaaataaaacacaaacatatctctagtcaaattattaccaagccgtgcaccaacgcgatcttgccttaatccaaggccacaagtgataactctagttattcaaattttaatagaattaaactttaactcgggtacattgctcggtttgccataaccaagggcgcaactattcgaatatattatactctgatcagaagtgtacatcgttacccaccagacacatcttcctcacatgtttccatgtgccacatgccaccacggcaaattgaccgaagccatgacataacccatcgtttagtaccgccctaaacaaggaagactgacatagactttgatgaggacacgactagcttggatataaccatgactatcttatgtattaattaaccaaaggtgcatatgttctatattggatttacatgttatatatttgaacaaatgttgctacacaatgagtttcatgtgtttccatttgcagaggtacttggttgggcgaaagaaaagaaaccgagcgtaaggaatgcatggatgatcaaagaagttcattggggaccaaactaagaccttccctaagtccacttccatctcaccacgtcacttttggtccgtagcatagtaagaaaacctggaccggtccttgacccggtggagggctcggttcaccggtttaccgactcaaccgttgggtcaccagttgaaccgcggtttatatcatatgtacatttagtatttccccttagtcacaacagttagtttggcctagtggtttgaagagtttgcctcaatcctagcagtgaggggtcgaatcccactgcctgcactatttttatcatataaatgtcaagttgggccttagctcctacatggcccatacagaataatgccatcaagtggcccagcaagcttgagtcggccagttcaggttgttggtatttctagaaagggaaaatttgaaccatgccacacaaattttgtaaaatttatgatatgccaccctgacccacatgtcattgactcatgtgggtcctacatgtcattgagatacgggtggcatgtctcaaattttgtaaaatttcagttacaaagtttatccgcaagcgcacggatataccatagtagcatttcacccgagcgcacggatagaccatagtagtatttcacccgagagtattccaagggtatcgtatttattttatctcgtgggaagatcatgtagagagaacttgactaataatttatatattacttttgataatcatattctaagcatgggttaaaataatccaagggtagagtgacacacatgcattaactactcattctcataataaattatctaagctaagtgaaaagaaaagagagagataatctattcctatacttctaatatacatagtatgtatacattctagttaaccgatatactagctaatatcctctttccgatgccctcctggtacttcgagaagccacccctaactgccgagttcattacaacagcttgtcatgaccatacaactggggctaaaagcataggaataccctccccagggaattaacttaggattatataccggtgcggaggaatacccgtactcttctgaaggcttccggactcctgatttctactctattcctattccactagctagatactactaaattaaacttgagagaaatgagagagctattgcttgaggtgtgtgagtgaagtgagaagaggagctccttttataggcaggtaatgacggttgtgacggttggaatggtcggtaataccctccaaccgtcattggggatcaaccccggccgtccatccaaaccctgcattatcggcgccacgagaggttcggccaaacccatgggctggcctaacccaacccatcttcagctagcggcctcttttgttgtcctcctccgtagacttgtgaattttggcccaatgtgtcatgttatttctgagttcttggcccattcatacataagtctggttcttgacaccgttcgattggtttatcgtctgagttgatgtcgattctcctccactttattatcattctctgcaaacggttattatacctaatactagtggaatattattattctaacaggtatatgcattgcaagcatcactagttctcctctattttagtaatattgacggtcgaaactgatcgataatgaccgtcaacaaaaccccccaagcttgaacctttgctcgtcccgagtgaaggacgaaaggaaataaagacttggttgttgatcaggagttgctactatgctgcatatctcaaagatactggtgcaaggtatatgtactctttctcagattaaataatctttggcacgtggcttacccttacccctgattcccacgagactctgcttctccttgtcttgggcggttgaaagacagaacagtaattagagcaccaatcacccaatctttattcaactcttattccggaagttttcaaatgattttgcaaaagaaagccaagttcctcaattgattcacacagtctctccaagtatatcaaaatgaattcctcaccaatttgcctttttgattcctactctaaggtttgatatgtggaactcagcagggatcaaacatggcatacttgcattcacatttattactaagtcaaaaacttagattaaagcagatgactaaacatactcaagatcaagatcgtgcaaaatgtgtgtggtatatgaggaaaaataaaagaaaaatgcttctcctttgtgcttactttcttcttccaaaaatccttcttttattgattaggagagggcatggctacatttttttttcaacatcatgctcatgcttgatagagcataactttattttttttttcataaccatgcctttccctcctctttttttttcaaaagcacttttctcttttataagaagaaagcacatgaaagcatggagaatttattttggtggtaaaatgggaatggaacgaaatattgcttaggtcccagtgtaggagtttagcatgtgcatatatgtggatgtatgatcttgatcatagagcatgagaagtatctacacaagtctcaagagtttgacaaagttcaatggaatgacaagcaaccaaaatgtatatggtttaatcatgatggcacgtttttggctctggtaggaatttatatcaaatgaggaactctcaatttatcattttgaaaaacaaaacatctggaattcacgtcaaactagtatcaggatcatagcaactcatatttactatctcatatctcacaacaacttagacttagatcagcaagtgcagctcatttacctcaggttcttggataattgttggctactcatatttagcctttgagagagcacttacctatgaacccatatataagagatataaaacatagcaactattcatcatttcaacaaagagaactaaggcttttctacctacatgactcaaacctatcctatctttttggtattttctatttggcaaattttatgttgttttcaagttttataagatgcaattggaaagcaaatatgcaattggaaagggaaatatgcaatctgatacaagttaccttagtgaggggagagatgtctctccccaagcttggctttcgctcagggtccttgataagaattgaacccctgaaaacggaagtacgcttgaaggtcatcgtgctgttgctgcatcatgttgttgaagttggcgaactgagcatcagcggattgttgccattcttgcgtctgagctatgtattccgtgaggttgtactgaacctcccctgcctacacatcaagggtttctattctcctagtgatttcacccaagtcccaatgagaagaacttgagctccattcacttggagatggaggcttaccacttgatctggaaggttggttgtccccccattggatgtcatgaggcgcacgccaccggtcctcactggcactcacccaagttgagactccgatgctgtggcgtggagcttgggtccatccgggtgcatcccagttggtgcccaatctgcctcatacatctgtacgggtattgaggatgatgaattctctcgttcattccttgtcatgttgcgcgtctccctgtatgctccacctgtacgagattcttctatggtctgcaagggaatggttagtttatggcagttgtacagatgataccccgcatttggcaacgggatttcatttgtacaaccggggaaaatgtaaatcaaagatccatctactccatgttttagaatatgcccttgtactagataattctcatcaatacacggacgagtggctgaaataaaagcaatttggttgctaacgacccctagcccttttgcaatccgagtaatcagagaagtgcactcaacaggaatagggaactttatactttctaaccattgccttattatacatttcataggagcaattttgatctttctaaccatggcaaacatgataatcaattcatcccccctaatgggtctcagatcacttctaggaaacaaagtcatagcaatccatttgtgcatgagcctaagtgtaggattatggatatcattcgttctaggtttcttgcaaattggggcacaagaaatgtcttccccaaacctatttttctcgaaccaagaaattcctttctggagatcgattttacaggaatcgtgaaaaccaagaagtgtacttgtcacatcccaaaacgaccctaaaatatatcctttaaattatgcctagaataattaaaatcctagtgaaagcctccaaaaattaaaatgtgcaaagttaaaagtcaaataaggcttggaggatttttgtagtatattccctaaaagcctaaaaggtgtaaataaattttagtggaattttcagagcacaaataataattatcaagaaataaacaaagttgaaaaggttttataaaaagaaaaaccctaaaaatcctccttccctatcttgggccgaatacagcccattctcctcctctctcttgtctccccgcggaccactcagaccttttccttttccctcacgcgcagacgccgacagg

SEQ ID NO: 71286 - DNA, 2283 bp, Oryza sativa
tccccgtgttttatgatattcttgtcataattatcttcatttgcgcaacaatcttgaataatcacattgtccagcctgttttgatttcctccagatggtttattcttaagacgacaatttgacatatcaggcatgctgtgggctggattatcatcattgatcgtaccagatttacatatgcattcccgctacatcatagttcaaatcgtcagttagaaatgcatgatgataagatcccagggcataatgaatgaagtatattatctaaaacaataatgagataacgatgtatatgttatcacaattaatagatcgtgcaaataacatgattttgtaacatcataaatttactcttcaaggttctcatttgcacttgcagggaataaacaaagattgcttgcatcacagcatttaaaagtttacttgtcaatagtttgtgtatagcctgacattttattgaccacaacaaataaagaattaatacaggacaaccatatttcactcccctacatctagctcgtatgaacagtttgccatttgattctgagcttatggtagcaaaattatgtacaatgcacctaaggtaaaccagcttgctctctcttttcctccctggattaccccaaccacacatgcaacaagggagatcttgtttcttactacaactaccagtcatatctagggtgattgaaattgagataattgtttatgggacaatcataagaagatttataaatggtagaaagtcagttcaatgattggattaaggatcctgtgggatcatagcaacgtggcagttattctagcttttctaggataaagaagactggaatactttgtaaccaatatgctataacaagcacccaatatgctaaaataagcatttatgtgatcttaaggcatccacatttctttaactctgctctgctctccagtctctgctctcctcgttcactgctttgcatttgtttattctctgctctgactaacggtcctaagcagtgcctagacatcagccctgccaataatctagagtctagtgccttctttaacactgagctcatgccatgtcggagaaaggagcgggaggtggctcatgctgccagaatggaagctccctcaccaatggtttgacaagagaagggaagaggttgcagagggcatttcggtcttattcatgggtctgttaacaggacatggatggcactggcatatgaggaggaaaagttcaacctgagtggaatggaaggaacatgttttttctaatactaacaaataagggattctaggaactctcatatgcatggaattttctctgtacaaacctcaaatttgcacgacctatctatgtctcaaatatccagttcgacaattcacaaacagcgcgtacttattgactttccaggccaatgtaccacttttataatcattgacaccacaaggaacaagcaatccacaaattttctggtaggtcccaatcgaagtgtttatttcttttgcagtatcctagtacatgttctttcctcccccgtacaagtgacgaaacagcataaatttctaatctccatctaaacagagttgactgtctccactaagataataccggaaatccatgtactcattaaaatttcccattactaccaaaacatccagtccacaaatacatcaattaggaacgtataaatgctgcgagactgaaacatatggtctaggcagctacaattataaacttccaaacaccccacaccaaggcattatatatattccttcgcacgcgaaacatccgtaaatgcgtaaagcgcatacatctagcgcgcctacgaattatcccaaaatctatcacatccaaattgcaatggtacagtacacatggagagcatgatgatcatcaaaagctagtggagcaatcaaaccaagcaagcaagagggcgaatttacctccggcgaagacaggagcgacgccagcgcctgcagcttgctcatgctgaggttgaactgcgccgccacctcctccaccctgtccctcacaccctccccaccaccaccaccacaccccctcccacacccacccatcgcccacaccagcagcaagcaccccaggaacccggccaccgccccggcaccggcgtgcgccgccttccctcgccgtgccccgcagccgccgccgccgccgcactctccgaccctgctcatctcactgccgccgccgccgccccaaagcctccaagaaacgcgccacactagcagagaagaaatccggggcgagctagctctgacgggggc

SEQ ID NO: 71287 - DNA, 690 bp, Oryza sativa
  unsure (1)..(690): unsure at all n locations
gtgctcgccggcgcccatccatccccgcaacgtgccgccccagagctcgcgcggcggcgccctgagactcgtcggcttggagggaggaggagctggaaggtaggggatctcctgcaggggcggttgccgatggctanactccggttcccagcgggatgaggaccgtgccgcctattatctcttccggaagctccgggccaagcgacaacacgtcggcggtggcgtcgcactcgaagtccaggaagacagtgcgcttgcggttgctgaccccaacaatggtgttggaggcgacgacggcgaagttgaggtactcgagagcgagccgccgcaacgtgtccatctgcgccatggggcggggcaaggcgctcaacactgtccactcgtcgtcgtgggtgaacatgtccttgatgttaatgttgaacaagaggtaggtggtgatgcaatccatcctcttctcttcttccaccaccaaaactagagttttcctcctccccttccatcttgtgcttgtgcgctgctgctgctcatccgcctccatctttttttttctttccgaagaagatactccctgcccgcctagcctgtatcgaggaaatcttattatacacaagtggagtatgtagtccgattccgtttcgacctcgctggctgcatcacaagtcgtttcgatcctacaactgtgtcgctgtt

SEQ ID NO: 71288 - DNA, 684 bp, Oryza sativa
tcaaaacatatattttgaagctagattttgcaaaaaatagttggaacaaaccttgtcaaaatattaaaaaaactccactttccaccaacgaaatataacaaaaatggagccaaatgaagcaagatagagagttcttcacctttcgtatagagttcaagtaaaaatttcgagttgaaaacctcccccctaattggtgcttgctttaggagagagaaagcttcgttttcaaatggtcaagctcgggcctggaggagcatatatggccgatcatcgcatgcggctaatcaacccgccccgggggggcggtttttgcaggcgccgccacaagcggcccgcatggaacctaccgaccccctcgtacagaaaaacgatttttgtagtagtgtcgtgaatggatatattggaaatggtacacatttttaatctcaccaccatattactttgaattgtttttgaagaaccagaaagtttaagacccaaaccatgatccaaacttcgaaaatgttcaaaaatctcattcttagtaaccatgatgataaccgaagaatatctataaaatcgtcaaaaatcactactacacaaacggtcctgtacatggtcggagctcttttagattgcagatggaccgtaaccggtcacgtatgtaaaaatcatccttctatttttatgtgtagacctgaagag

SEQ ID NO: 71289 - DNA, 722 bp, Oryza sativa
ttcttaatttctcaccatacatactagtactatcagtgcaagcaccctaaaccggaacctagcctataaagttgacccgaagatactcatccctacagtgcaaatacctcttttgtgtgacttaattagatgagtgtagtgtgggaggaaaccgccctatagtgggcgtgatctcgggctgatatcgggctcgtggacacgggtagtggggcgaaataatttccccacctaccctggactcatcttctcctagccctcccccccatcgctttctcctcctcccggtcacccttcccgtcgctgcccgtcgcctcctccccgtccggcgccagtcccctttccgctcggtgggccgcactgctcctcctcgcctcaccgcgcctcttctggcgtcgtgtctcgcgcgccggcggctgctactgctccgacggtggcgagttgcggcaggcagcggcacaggcccctagattcgttggcggtcgtcaggaggcgaattgcctggagaccccggagcaagccaccgcggccgcgcctcctcgccaacagtgcacgcggcagctgcgaggaggagggggagtagatccgggttctttgcggcagcggcaggttctcggtggcgggaggcgtccccggttcccgccgcggcgtcggtcaccaccagtggcctcgccgccgcgcggatgattgtgcttcttgacttttcgtgatgatttttcttctct

SEQ ID NO: 71290 - DNA, 742 bp, Oryza sativa
ctcttaaagtagatgacgactttattacttctctatgtgtttacaaagtgccccaacagcactccttataaaaatctcgactaaactcgaaaccctaactcaaaactcaactcaattgctctcgaaagcgataccgctaagcctcacgctccccctctattttatacatgaggtaggcagcctaaagccacgaaccaaactcatactaagagtcctaaacaccttaggaaaccctctagtacaagaaagaaactttatataaccaatcgtaccaaatttggactccttccaaattcgactccgcatcccatacgtacacaatacctccatcgtataccatatagaatctccatcaaccacgtgcatcaactctagcctaagtatcccgcatgatctttgaccaccatggacgtcgtcttatccccaagccgacttccggtccatcaccgcaaatattctcccgaggtatcaagtcacctacacatgaaataaacaaagaaaccatattccgagaccaagttatctcaaacttgactcattagtagcgaacaacagtattacatacgtatagtatccatctagaagcccataatcatgacataatcacggaacaactcgaaaccgaaaccgacacagagtcggccggtcagaccgcgggctgcgccgatctgaccgcgcattacacgccggtctgaccggcaacacctgcccggtctgatcggtcacatgaaataatgaacct

SEQ ID NO: 71291 - DNA, 7919 bp, Oryza sativa
tttttttttgagattttatgatgtatttgatgtgtgatgtgaatctgtgaatttgtgatatatttgatccgtgatgtgaatctatgaatatatgatgttatcattgatctatgatgttatatgtgaatctgtgatttggggatgaagggagcaactcaattatgggaaatcaatatgcaagcagtaaaaacaaggaaaaaaagaaaataaaactttagtcccggttggtatatccatctttagtcttgaattgggcgtcccagtttacaatccaggactatagggggttacaaaccgggactaaagaccacttcaccaatagtgggaataggtccatctgtctatgttaccgtcctcaactatcatatttgtatgaaaaataatcctcaacatataaactatgtattattcatctcttaacataaaatattttttcactttatcccaaacctaatacgaactgagatgctttccaaaatcccttatattttaggacggagggagtagtacagtaaaataaaagatgggcatcacctgctaatcaaatactactcactttttcttccttccccttctctatcttttacatgaaccattatcatgatgcacaaggctcccacaattaatatattacataaataaacatatttatgtgtacatagcaaagaaaacataagcaacaaacttgaaagccaagcaattaaaagcactttctctttcagttcaatgagaaagaatctcaaacgggtgctcccccgactcccgtgtcgctctctggggacgacctgggggaggacaactgccagaccccattgctacctcccgagccgctcacctcgacgccgctgttgttgatggtgtcggtggcacccacacccaccccctttgaccttcttcatctctttgttccctttccttctttttttttcttcacaaatccagtttcaggttggctagttggccagatccgatggctaggacttaatggggaggtttgctcagtggatttagggcagacgtgatgcggatatcactcttttggatacacacaacaatcctccaatggtcattcgaggacagataacaagagctcgcgcgcgacaattgaatttagaagtgagctcgttcctatgttcttctttgtacgaatttgagaaaagattgctacctaggggcagatttaacgtataaccgatgggggcccaggaccccagtcaaatttacactcctaggtatattcatagtagtatgacctatgggcccccactccaattggaaaaaaggaccccactcctcctagttttcgttccctcaatcgcaagtgcgcgtgagtcgaggagtcaaacatccgctcctcttctttgattctctaaattccattattaagtggcaaatatgcaaattagggattaaggaagggaacgggaagctaatccacctcatctctcgccaagtcatcgcgtttcccacatgccatagttcatcttctcggcaatcgctgcttccttccttcctcgttcgctcgtcgtcgtcagcgcctcagcggtgctgcagctgctggcctactgctcactctgtcctctctgcctccatccctggtaagtactcctttccctccctgaccccttcctcctctcatattatagtagattgatctctaggtctccctcatgtgctctatctaatcaaccatcatgattttataggaaagataatggacaagtttttgatctaaacaaccgttgagaggtgtttctctgctatgaagattgtctaagaatgatttgcacaataagatgggtgacaagtttctgagccatagtctcatttgctttgtagagaaggatatgttagacacaataactaatgatgtgattgtcgatcgtttccatatggtgatacaccatcgtgaaaaggataaaaaggatgccatgttgttctaaaccatatttcttatttatatatcctactttcagtaatatttttatcggtttgtgttaactaataatttgtattgtttttacatgcaataacattatttggattttggaaggcatatctatacattactatttaagataatgtaatatctcagagtttttataagttgcaatgaggtgagttttacttggctttctaactgttctatgagttatagatgcgcccctagtcattttttgtcctgcgtccgcccctgttgctacctaatgattatattgtgattaggattaatggaggggacaaggagacacttggagaaggacttagagtcatggaggatcatcgaggacgtccaagtcaaggtggaggcccaaaccaagtcgacctctggtgcaactcggagtccaggaccagtctgcactaaaacgggcgcccaggtcgcatacgttcccggattggagcgttctttatatggatggaaatctaagaagataacctttccaatggttttggttccatgttcaaattctttccgagtcaatggtaatcgaccgaacaagttgatgttcagaatctgttccggtgctgcgtcaccatatttgggcctttgggccatgtatcgtgttggaggccattagggctgcgttaaggcttggttgcacgaccctaaactctatatatcagtacccgccgtcatctttagggtttgtgttttgcttagattattctgtcaagaacagtttcgctgctagatcggtttgtaagaccctaacttgtgagcttaatcattcatctgcaattttggttgtatcttctttgttcttggttgtgttcttcgattcgcaaacagggattagccttctcgacgaggtcatccacgtttcggcatgggtgataaccagaggagacgtggtgctgctattgcggggctcaagagcgtgctcgttcaagaagccagatcaatttgtgttgcgactcagcccaaatcattgattatcagaacctttcggaagatcgggaaccctagtgcacatcaagatggacggtggccgtccatcggcgccatcggctttatctcctctgctgacagctttgaatctaccccaatcgttctccgtacgatgtaggtacaagtagcggcatggctagcctagacgatgctctgtgttgggctaggtggtgtcacttgcgtccaagccacttccacataaggcttatcctcttctgaggttgattttcttccagatccaactgtggggagccatgtgctacagtggtggctacggtagctatgtggtgtttggtgttcgaggcacaaacattgggtgtgcaggtgattttcaggtgtgcaggtggcattctatggcttccctcatgaacttcgtggttggatgtaaccctagggtaaaagtgttgctcggttttccagtgctagcgacaacaatgccctcaagtgttgttcaacatcatggaggcattgctacgtagctttctccaccacctcaagaggtctctctaggtgaaaaccttatattcattttagataaggtgttgttgccgttctatcgacgtgtccttcttaggagtttcccttgttggattgctgattgtaggaccaatgtgtctagtctatgtggctaattcgcttaaaatgtaagggtttttactagtttcctgcaaataaccatgcttttgtaaggtttttttttggtgggaggggggtggtttccctcataagctagatcaagtcttttcttctataatgaaattgcaggagctccaacgcttttcggaggtttacctaaaacactttgtgtagaggtgaagatcatactttaaggcatctcaaattagcaactaaggttggcttactttcatttgcttcaatatataccaagatgagtataattattttcctataaaatgggaagaggtatagaagatcttgcatccaaaagcatattgccaaagctgagcgaggtgtttcattgtatttgcgtcaaactccaacactgcatattaaaaggactatgtaagaataggtgccacaaagtctccttaagcagtaggttgcaaacaacacacgtgagatcattatgttgtggtaaacaatgttttctatccaacatgcatatcccttttgttgagtcgatcaatcaaaaggagccatcccactttaattttcataattaacacaattgcttttccatatccaattcaagtagactgtaggccaaatagacataaagttgatggcataaagtttctaagagttataagaagaattgccccaagtatatacccattgaccatattgctaagtcaaagatatgtctaaatcaagcttttgcaaggttataaactcatgatatgctaactctgaaagaggtaggcggattaaaaatctctgcatgcatttttccaacaactttataaatagtccttcagattatgtgcaaatgaacaaattagaattctatagatcttactatctcattcctcttcctagtagagacatgtctttccatctgaaatgaagcatttggctatccccctcaagatgtcaacaaatcgcaatatatttttctacagaaagaaccttgcaccttagttgcataagaaatagaactactatataatacttatcctagattaatctaacctattggcagcgctatcgaatttactagagattctagtcttaaacagttaaccttctagtttgcctgttctatttaggctataagttgccgatcagaactctcggtacctagtttttggttcccatgagggggcaaactcagggtcatgtctcacaagaagtaggtgcaacaaatagagtaaatgagtaagaacatgcagtgaagcaaatacacaagcaaagcaaacaaggattttgcatcgaagtttggatctgaacaatccagctctgctaagacagtccaaggagacagacctagattgatcccaagcctcaccgagctaacaactaggaagaagttttagcctctaagcaaccaccaaaacgtagcatgtttccatgcaaccaccaaggtccaaagcttagacaacaagcacctatctccagtgaagcttgctctacaaggcaacctcctagacgatgcctagactgctagatagagaaccaccaaaaataacaaacacaatgatgaagcatgatgcccatccctaagtgtacttgctaagaaccctagacttgaagctcaagagatctaaatccctctcattgacaaattttttgctgaagtagtaaggtggagaagggtacaaaccccagggagcctatgggagtaggctgaaagatgtgacagccaacacctcaaaagaggggatactccctcatcctcgcaactagccattactcacaaaatttcgatcaggatggccaaaacttccggtcacacttagtctagctacgaaaaggggaagtggaacttagggtctaaaagacttgaacttcaggtccaaggtctatgtttcaacgaagagtgatgactagaactttcggtccattgaccataacttctgatccattgactagaagttccggttagcctctatggccaaacagaaactcttgacctaaagtttcggtggaaactactgaaacttcaggtctaacttgaacacttatcccattttgcccattggtcgtgtggtgctttatgtctctctacaagatcaaggttattctagagaacttagacgcaacaccagatgaacttttaatttccccctttttggtggtgatgataacaaaactcagagcttacaaaagatttataattaatggttttgaatgaatagggatacaagagaatccccctaaatatgtgcaaataaaaataattaagttaattaagtttcacatgcacatatttgtttgacgcatgggaacccgtatctcttctcattcgtgggatgcaacgtgtgatagatacacgacaaaaggaagtctaaatacatatggcatggcattttcacaaaaaaggataaaataatcaccaccatccaaaacatgcatacacaaggattgcatatataaacaattaaaagctaaactagcagtcattacaccgtagacaaattgaaaatagtaatcacatgtccaacagaaaatgtattgtctaaggtgacaagaggaatcaaaacttccagtggatagagttcaaagaaaatgagttacccctttagaagaccatattgctccctccttggcatcaagacaccaaaaaggcaagaaacacaagacaacaaagaataaaatcgatcactcggaagtggtagaagcaacatccccttctttctcttcttctacttcttcaatggctccttgaagtggagagctctcttcctccataaggatgctaccaaatgcttcatggaaagcacaaacccaggaaatcccaacaccctaggcaactccttgagaagcctcccccttaccaaaaggatgctcaaagtgaggagcttgaggctcatcaccagactcatcgaagaggcatccacatgcaacaatgcaggcaaagtttatgtctcttccccatcctttggaggcacatcttgttttcaatgattttgatggcgttagcggtgtacactaagaacaaggctttcagagccttgttgataggagagtcatgcttgagtggggatgaagcaccagaagtagaagcatgcgtagctttagaggtgcaagtgttgatcttggaagcattagaaggaggaactcggagggggggggtccgaaaggcttgctttatctcctcctcaaagacggtcttggttaccatcttgattatataagatatggtgcgtaagcacacgtccatctaggatcaatgtctataaagtagatctcatcccaaataaacttcatcacattgagatatgcttccttgggtctcgagtaggagaggggatcaacctccctggactagagagtagtaccatcacccaccttgagattgagactgaagtggaagaggttgttgaacacatactagtggggaggcaaaccatcagacgtaccaaggcaacctagtggtgcatttgctccataaatgaaagacaactcatgtttcaacttgtgtggcatggtttgaaggccctaatattggatatccatcatgtcatgttgaagagcgcaagcaaacttgacaagagtagtactttgtgccttgcatcctccatgccatcctctcttgattgcccacaaacctgacaagagtacaggagtacttggtgccacgcatcctctatgtcatcctctcttgattgcccggatatgggtctattggcaccacctgtcaataagcgtgttggcctggaacaaagtttatgcactttatagtttaattccattatataaaaaaatatctagaaatatatattatacatagaacttattggaaaaggaaagtaggctaaggccaagacgtgaagggaaaataagtcctttttactctctcaaactatttcaccggagcacatcacccctaaacattttttttactcattttacacgccaaactatttaaaacagttcaccttactgcttaacgatatttctcttttatttgttctctatataagtagtattttccactaaaatttggtaggaatgatagatgcattataacttacctctaaacattttttagaattttcaaatgcaaatgagccaagccccaaaatgaaaagatgggtcagttcgtgcaggcgtcacgctcttgtttccgccacaaccattttgtatggagaacattccttgcatgcaattgagttttcactcaatctcttttatgcctttaaattttgtgttaggcgttacatgcctcgagttttaattttaatcccctatataaccattttgttagttgaccattattttttttaaatgactatgttactctttttcatacctatctggcagctagcttacaaagataagtcca

SEQ ID NO: 71292 - DNA, 575 bp, Oryza sativa
aataagttgtttaagcaattacttgttgccttcagtatggaaggcttctctggattgggtgaaacattcttaaacatagaacactaaagagtggcagggtgaaagatatgtgcgctgttgttggacattaaaagcattttttttcagggttcattcattaaaatgagcatttttttttcagggttcggtctgcttgttctacaaaccagtaaaggcgcttttcactggagatcacgttgcaaaatcagaagaatctgatgatttatatctctttcttatgtacagcaggcaaccaggtagaatcctccctagattttggctaactggacataactgtgcaattgtacaattagcttacaaatcggattaataatctatctattgcataaatttgcagtgagcttgcaactggacagcatgagaaaattgttgaagttagacttcgagtgggttttacctggtatgcgctcattcaagcattgcggatagagtatacctttttaagaaatgagaaagtccctgccttagcatttagtttctgttggtttctttaaaacggcatgattgagtcactg

SEQ ID NO: 71293 - DNA, 1090 bp, Oryza sativa
cttttttataaccatgtttggtacacaacaaatttggtcatttatatacaataattaattaaatatttacattgtgatctccacaaggcaataggtatatactaaatcaagtctgaaaccaaatgaagttgctagattttttttagataatgaaatgaagttgctagatgtaatgcagcatctgtaatcaatagaacgcaataatttgtaaagaagtgcaggtagatttcattacatggcaacctccttatgctggtcggccttatggcttcatgcgcttcttgagcatttttcaccttcttgaagtattttctaatgccctctgaagcatattcctcaccataccttaaaaagaagaagaatgaagattgcaaatgacatgatggaacacataaagttgattaaaaaggtaaactatcaaaataatgattgcatgagactagcccgtttagcattcaccatccagtgatgtccagttcaaattaaagaacttttgttcgcttatgtactaccaaaagggcacaaaatttagaaagataccactctctcacatttagttgaaaacttaggctgtgttcggcagccaatgatcccaactctcctccctcgttttttgtgcgcacgcttcccaaactgctaacagtgtgttttttgcaaaaaaaaaagatctatagaacagttgttttaaaaaatcatattaatccatttaaaaaatagctaatacttaattaaccatgcgctaataagtcgcgccgttttgcatgtgcatgggattagttcccaacctaaacagcagaatacagccttaattgtgacccttaagcccctacctcacatgcatcaattctccattttgtaataataaccatcaattccacatggtgcatcccactgcttcctccatgcccatggtacattgatttctcactagctaacatcagctaatctcatcccccattctataattcctctagtaggcttatccatctcaggcatttctactcatcagtcatttcacttggttgagcgtggttgcagtggtaacagcatggaaatttcctatagaacgtgggagtggcatgagggttcc

SEQ ID NO: 71294 - DNA, 17286 bp, Oryza sativa
catgctactagtattcctcgtaacaagcgattcattaatatttacatttctcgatgcccatgtagccatccttgtgtggaagaatggagagtcacgcattaaatccgagaaagtcattaagaggataggtggttgtattgaaatatgcctatcaaaggtaaatttttcagatttggaaatatgcctatcaaaagtagatggagtatctagtttgagaattgttccttttaagcttcaattccctctccatatcccaatggtacaatcagctaatacatagtgatagatcggtgtttttctagagaatgtaacatttcaatgataaataactgaaacaaaaatatgccatggtatttttcctctgatggtatgaattatgcaaccaaaagttgtgaaactacaaatcagcaagcagagaacaataacttttctgactatataatcaaatgtatctttgcaacaaccaaataggtaaacattaatttatttgatttgaattgaaataaagtggttcgtaatatacccatcacataagtcctaaactacaatgttcccagcaaaaaaagaaacttgttgccattaaaacaacgatgaataaccacgagaaatgagcacattcccactcatgaattgagaagctaggaattcaaattattaagtactacaacaactaatatgttagaagtggaactgtagatattagcacacctaaacaacaaacaaaaaaaaaacacttgactagatgttccagtagagcatacctttgcttcactaatgaaagaatatcttctgcagctccatcagatatcttcaaaggaaaacatgaatcatacaagtaagacaacaattccagactatcggagtacagcatcatacaaaccagatcctcaagaaattattgaatcggtaattgactgaaatttctgaattctgatatgaagggatagtgaatagtgcatataatacattcatgaaccattgcatcagataattataattgaatagatatatttcatatgattgaattctagttagaattgctactgtacatactcacgcatccatgaatcaaaatggcgatgagtagcgctaatttgaaggcagtactaggatgaaatagtttgccccagagaggagttagaactcattagagctaccatttacagactgggaattagatgttgcggatatggtggatttttcattaaggaaattgcaaatgtatccccctgctagcatgctttgatcgtaggatcaaacttgatcctctacatgaaaaacaaaagtaaaaaagacaatttatctactcactgcctgaagtgcaaaaactaatgaagacctcattatacttcttctcaatggcatcacctttttttcatgagtgtaccacacttacaaatatagaatttgccacaatcctgttatcatgagcagcgattattgtagcctgtgcagcgctgagctgctcacatgccaggcaggctatgcattcatcatttcatgtcagacaataattccaacatcgacatgccattgatgcatatgttaggactttgatattttgcacccaacagaaattaacctacttttgaacaaggctgtcacaggatagctacataggcaacaaccctatctccacaaacctagagcctcctcaatgccacctctcactcttgagcacagaaatacgcactgccctctagcactttgataccactgacaatgaagacagaacaacgtccctacgctcttagagaataaacactgcctcctatctcctagactccctcagtctcattgtcaggattctttcaatggcattaactgttacaataacacaagtatttcggcatggcatgccaaaatgatctgctgcaccaatggaagagtcttttaggcactggaaaattagtttcgtggcagaaagtatttggtataagtatagaagagcagcatggcgtaatgctttatagtttataccttataatctcaaaaggtaatcacgcgtgcttttatatatagtgggaggaaattgatattttaatgtggatgaccattttaacccataaccatggatatgggaccagattaatatttatgctatcgatactagacaatgctgatttgatcgtaaaggaaaggtaggatgacacctacatgaaaaccatctgttcggatgtatgtaattaacccagttgcttcctcagaggaaaggttaatcccctcatagagcttttgggctacctgcaatcacattgaactatgtgagcgaacagatagctatatctaaattgcattactataataggtcagtaggaaatctcatatacgcatttaagatttaactaacaaccttcatggtatacccagcactaaaatgtagtttgtttgctgcgtcctgctgaaggctggatgttatatatggcataggaggattcttgttaattttacttctcttaattcctgttacttcaaattgggatgaataaatcctcttttctatattgtgtgcttcttcttgagagcgtatagaaagctgatccaacttttttgaattaagatgctttatccgggattgaaggttaaggccatttgaagggccagaatgttgggttttgaagtccgtatcaacagtccagtactcctgcggatcaaactgttctatttcagcctctcgatcacacacaagagccaatgccgcagattggactcgtccagctgactggcaaccaggtagcttcctccataacagtggtgatatgccaaacccaatcaaataatcaagggaacggcgtgctagataggcattcactaggtccatatcaatatatcttggagatattaaagcctttttaacagcatcctctgttatttcatgaaagacaactcttgcaacagtaacttttgaacccaatgcgtcttgctgttcgagcatttctttgatgtgccaagcaattgcttcaccttcacggtcaggatcagacgcaagaatcaaattttctgccctgaagaaggaaaaggacaaagcaattataacaacaaaaaaaaagagagagatgcacttaatagtgcagtggcaaggggggtgtggtttcaaccccgaggtcccgtgttcaatccccaatacactcacaagttattcttaaaataatgtttggagggacgtctctccctccaaatctttttttttacaacaaaaaaaaaccattagtttgctaatatcgcatagcaaaagaagtcaatcttgctctagacatattgaactaataagaaaatgtacattttatactgttatctatagtataagcataagacatatataaagagaaaaggtaaagttaagtatggtgatattggtatttggtatttcacgataaaagacattttggagccaaacttctaatataacttatgaagcatacatgcaactgatgttacccgaaaagtatgtgattgcgtgtttctttacctttataacaaggcttagtcaacatctaataattgtgtcccttaatgtgcttcgtgtttgtgaaaatgagtatgtatgaagacattttgagcatggtgactagaacctgaccaactgggtcaaggaacaggaaagcaggacaagggtggtggaaatgtggtgactgaaaatgtggattgtgggggtaagttttattcaggacaattgtttacccggcaagtactgcctgtgtaccaccaatattggcagctactattgattaatgatgtcaattcaagatttcaaggtcacagaacatgacaatgatagacaaccgtagcgacaatggtttggaagcaccttattattaaaagaggcaaacaagcatgtatttcatgttaaaaactgaaaatgctaaccatactgcattatcatacccttttaacgccgttcttatgctcttaagatgtgtccaggcagcagcaggaacctcccacaccatactgaagtcatcatcaggacgaacagattttgatcttccagctaaatctctcacatggccataactaggtaacacttcatacatgtccccgaggtatttttgaattacttttgcttttgttactgattcaacaacaagaactgatttagctgtgggagggtaaagaggaacaagtggcttctgctcactaacagaggtcatcgtacaaatctcagctttagctgtcgcgttagaagcagcagattccttcgcttttgaagatttcttcgacctgcttgatgtcttcttctctttagaactatcggcagccttttttgatttggaaatgtcagacttgctttcttcttggttgaccccaattttcctgctctttgttgctgctgtactagttttaacagatttcctctgtttcttagtagatgccttctcttctttcatatcttcactagcttccttttttctgcttgttggacttttcctccgggtagtagtctttttagtaccagtaccactcttactgcgtttgctagttgatgttgaagcctcatcagtgatggtgccacaagcagccaatgtgcttttccttttctcagatctatgaaacatactgtgtgcaacactcccatcttcctttcgcatatttggattaccaaataagcacttgtttctgatgggaaaagttacctttgtgttgcgcagggtcaaaaaggaccgtgaattacgaatattgttcgccctcaaagaaatcccatgcctatatgcagctctcagacttacaaaattaggattgcccatgagcccagtagtaaaaaaggcaccacttttgagctgcaggggaagacgggagccgattgaagacagctgccttgatgaattattacttaatgaataaggcataaagttgtaagaacatctctgagatacaccaaattgaagctgaaaaggtagcacgtagccaacatttagagaacaagcaaaactctgaatggcataggcataatcacaagtgcgacacagaagcagaattctttgatacgttccaaatagttttatgacaccgatataccgcaactttagtaatataccatggaggaagattccagtgtagctagatgctacctttgttttttaacatatgccgccattaacattttatttcatatttgaccactcgtcttattcaaaaaattcaactagatatatattttgttttgttttgttgtggcttgatttaagcaatacttacattcttaagatttctaaccaaaaaaatttgaataagatgaatggttaaagggtataacataagtcaacggcgtcatcatatatatattaaaaaaacaaaaaaaagggtgtaccattgaacgttgggaaggtctagatatttagcattacatcaattcctgtccttacagccaaaaaatcaaaggggtagaagaggatgggggcacttaccatggccgtaggcgcccccggcggcggcggcagggcgagggaggcggcgtggccggcgtagcggtgcgggatgaggcggcggagctggagcgccatcgggaggggaggagagagcgagaggcggaggcgcggccgcgggcgcacgcactcaggcgaggggggtggcttgggctaatcgactaatggctgtgatttagctagggttttggaggagggggatgaggccgcgcggcctcgcttgggatgggatgggatggacatgggagcccgtcttggggtacaaggtaggcatcagtgggccgggccgagaggatgggcttcggtcggaagccacaggcgtgttgggctgtgggggcaggaattgggctgagaattgggggtttggatttttatttttttcctgctgtttggatattcgtttggaattggagtattatgggctttgtctcccactgaattgagatagagatagggatttaagtgggcagacccgtaaacttaattatagtacaaataattaggttactcgataggctatccgcttgtttgtactattatatataggtttacgggttatccgtttgcacccttagatagacttgtttaactttcgagccaagcctgacatttttgtccacctatctattgtaggacaacccctgatgataactaaaaaaaatcatagttcaccagcttctttcatctatgcactctacctgaggtcctcccatcaaaaccaatcagctagctctctcaaccgccaccctctcacacaagaaacgtactgcatctgccatcaccctctttatctgagtattcttagttccaaaatttcatgatctgaagttgtgattacattaatactatttcagatggatcattttgttctttataggatataaaatgtaaaatttaaaaccactgtaatttaacttacaaacttcaaatccagcacagatttataatttggagtggtacatattactctcatatttcttatagaagccggcctcctccccacctgtcggccagcctgtctagacaagaggagtgagagacagaggaggaaggaagactccaacctcggcgtggcggcctcctttcccgcatcgcggccatcgtagctgccgccgattcctcctctcccgcctcggcatctgttgtccctgcaagtgagcccagcgccgctgctgcaggagaagctcatggcgacattgtacccgtcaatcactgacaggtcgtaaaagtcctggctgccaccgatggtgaactccgccggcgtcatcggtggccgccccggagaggctgcatgacagcgagccaccgtagtcaccggtggcgcaactgcccatgctggcaccgttgaagttgttgccgttgtcgtgtcgccgaccgccagacctcctctcccctctcgccccaatgacctcctccccacctgccggccgccttgcccagagaggagaaaagtgagagagagagagagagattgagagagagagaggaggaggaagagggaggagggggaagaatgagggtgctgacgtggcatcctaacatgtgggtcccacgctgactcagccaccacgtcggacaaaaccgaagtcaaaaccaccaaaggacctaaagtgaataattttgtaagttgagggatgtcatatatctggttttgcggttggggatgattttgtaattcgatgacaagttaagagaccttcagtgtactttttccttttggatattcgtggaatttggaattggagtattatgggctttgtttcccactgaattgggatagaagtgtaagcgggcagacccgcaaactcacttatagtacaaataatcgggttaaccaatgggctacccgcttatttatattataagtaggtttacgggcctaccagtttgcatccttagatctctactattataaaaattgaagatgttttcgtggtccgtcatctgtgtttgagtcggttataaaaattgaagatgtttccgtggtccgtcatccgtttttgagtcggttttaattttatgttttggttttaatctatatctcttctcttctctactattataaaaatgagtaaaatacatggtcggtccttaaagttgagcgcgggtgtcacttaggtctataatcttgtaaattgcacatctaggtccaccatcttgtttaataagtgactcattaaggtccaaacccggtttgaccaaagctgaccatctacattgcattccacgtagacagctcatttgcaaatagccccttcgcgcttcagtagagccctgggcaccaaaaaaatccccaaatccctcagctgcctccgtcgtcacatcgcccaccaccgccgcacgtcatcctcatcgtcagccccttcgccggtcacgtcataccaatggctgagctgatgcggcgcctagtcgcacaccatggttgcgccgcctcgcttgtcacgttctccggcctcgcctcgccaacatcagtgtcctccgtcgctgctatcatggacctcgatgaagcgacacatgattgccaacgacgcagtattagaggggacgaagcgagcggcggacgagctcgaagatcaggacgccgcgctgtcgtggacctcaaatccttcttgacgaatggccggcgggcagaacggtggagggcaagcgcggcggcgggatgcgagcggagcggcgacgagcgaatgcggcagcagttggcgggtggtgcagggaactagaggagagcttgcggagcgccgtcaccgtctttgtagctagcgtgccgatggcactcgtgcctcactgatggccagatcaaccggtctcccttcctgctgatcgttggtgctagaggcgtcggtgagcttggcgcgcgcgggggaggtgtcgccggccacgccctggggaggggtcgcctaccgcggccgcgcgtgcgggggaggcgtcggcgagctcggcgtgagctgggcgggtgcgagctccatggcggcagcggggcggcaaggcgagcttgacttgagcagctgccgcagccacttgccgcatgcacccacggctggctagagcaggggccttccccttcccctgctccttctccttcccatcgacgacggcgagcggctgccggaggggtatgaggcgcgtcaccaggcgcagcgtggttgagacaggtgggtgccgcaggtgtgcatgctggcgcacgtcgccgtcgacgcgttcctgcgtgcgccacgcaaagaagggattggatcagacacggggaatcaaaaaggggggcaaaatgcaaatatgttgtcacgctggaccgccacgtaagccaatcaacccggtcagagatcctttggacctcaatgagtcacttaaacaagatggtggatcgagatgtgcaatttacaaggttatggacctaagtgacacccgcgctcaactttaaggaccggccgtgtattttactctataaaaatggaagatgtttccgcggtccttcatccttgtttgaatcggttataaaaattgaagatgtttttgtggttcgtcatccgtgtttgagttggttttaattttatgttttggttttaatctatatctcttctctgctattataaaaattgaagatgtttttgccggtattttgatacgtcatccatgtataagtcggtttttaagttcgtttgcttttggaaatgcatgtccgtatttgagtcggtttttaagatcattcacttttgataatacagaaggaatcatataagaaatatgtttaaaaatactcgcatgctaacttgagacgatcggacacctaactagctcatgattttctaaaagagcatatatatacatatatatatatatatatatacatatacatacatacatatatatatatatatgtatatatatatatatattcaagcgaactcccacagtgaatttcatcttaactaaaccatataacaataataagattaaaatagacttctcccgttgcaatgcataggtattttttctagttgaattgttaagctttcgagccaggcctaacatttttgtccatccgtccgtctccatagtatggaaacccctgatgataataactaaaaataaataaaaaaagttgtcatcatagttcagcagcttccttcatctactgtccatgaggtcctcccatcaaaaccaatcagctagctctctcaaccgccaacctctcacacaagaaaggtacatcgaccagatcaccctatttgcaactggttcatattttttttcttcatctaagtattcttagaattgtagttccagaattccatgatctgaagctgtgattatattaatactatttcagataaaatataaaattttgaatcactatgatttaacctacaaatttcagatctagcacagatttataatttggagcggtacgtattactctcgtatttcttatagaagcatttacgcttttgtgtggctatcctacctaccatgtgtctccttttgactactccctctgtccaggattataagggagtattccctttttagcactaagtaaagaagataaagaagtacatgtgtggaaataggagtatggaagtagagtagtaggcatcgagctagttaggacagatgcgggtggatgggtggtggggaaacttttcaatgcataggacagagtcagacacatggataaaatggatggctactggtgtactttactcctcgaaaactcaaagtacactacattggaggagaaactgtactacatattcaccaaggctatctagatagaagttggatgtgagagaccaatggctgagagaactcatcaccaaatcaacctcacctcatccacacccaacccatcaatcaaaagatggttcccctttcatgatatatatatcctcaaaccttgcataacatagtatacaatagagtacatttttccttcatgtagaaacaagcaacatacatatatagagcaagtacaaggcagaacagaactatgaacagagcagtggaaggcatgcatagtactacgcaagcaccggtacgtacatatgtaccagctttatttaatacaaacacttgtgatgagtgcatgcttggtgcttcgcctctactcggcaattgagacttgttcatctccatgtgttatcacagcagctacaggtgcccagatcacgctgtccctgctaacgaagtggcacaccgacgcatctcccggcctgagattgtgctcgacgaacaatggagtcttggggtcaaatcgtgacgtgtccaggtggcacacggcgagcgcctccatcttctccggtgtgccgctgccgctgccgctgccatcctcctcgctctccagcaccactgcgtacactcgggtagggttgatcgcgtggcagtagaacacagcgaatgggaacctcatggtgtggcacgtcacggtgtccccccttaagcccgcgactgttcttaccgctaccaccttgtacatgtttcctggcatgatcccctctggggggacatcgggggagaaggcacggaggtcacgtgttccgagcacagacatagcgaactcaaccaccgactcgatagacgtggcacacgcacgttcttctcccttgatcgggcggtggtgctcacaagtgtccaacgccgattgtataccgtcggccatgacgagggatataggcgaaaacattgccagaatgtcggcaaagttctttgtactcactgggattgaatccgcaatgtcccggcgaagaaagggagcacgcgtggctatccccgtgatgtagggagtgattatggatcccggtttcaaggcatcctctaggaaatggaggtttgccttgtgaaaatagccattggaatagccattactgtaggaatgactatatccattaatgtagccgccgtcatatccgttgccataaacttgatcatagccattgccatgaacaccttgattaacatctgcaatgaataatataagcatgtgaatttacccgaaccattaatgtaaaatccactggtatggctggaaaaaaattcatgccattggattatattacagggtaaaatcccataattaatctggcatgagatgatggatttctattgaactccatagttttctctctcccataattaatcttgtactagttttttctctccctaaatcacaacttgtggctgtgaactttgcttgcgtccatactaaatggtctatggagttcaacaaatttatgcatacttattatccatcattaagcttgtttaggctcgatctagaaaatccggtttgtacgtaagtagcatcagggagagagagagagagagagagagagagagagagataccagtaggagggttcaaaagctcgagtatagctgttggcattggagagtggggaagcatcttctgccagtatgctgttaccatagatgcaggatttggcagctctacccgttccactcccaccaaatttctagcctctatcgcaacctgtgcaaatcatccattgctataacagattgtgatatggaacaccctatctgtggaatataatattgcgataattaattttcgcacctcaatgctgtttgtgtactcgcacacatgcacttcaatatattcaattaatgttaggtttaacgaaactaatttagtgttatgagagttactatatttgataagattaaagttacaaaagtttgagttagaaaaaaaagtcaaagcatataggggagggaatggtatgtacagtatatagctagctttgattgacatgatacactcaccagaaggatgaagatcaaaagtgacaaaaaggctgtcatgttgcttagcttcattgtgctatgagctaagctagcttagctaactcaactgaatgtgctggctagctagctgctccgttgcttgctttgctcttggctgccaaggctggtcctatttataagctcggaaacataccttcatttctcaatcttattaattaccatccgatgcaataattgcacttggcatcgatcaaattatcattttgtggcggcatatatatctgcttgtagattccaaattatcagttgtgtaggagaagaagtaactggtctggccattgataaattcaagtcattctatatatatgtcgcaaccttaagggtatgtttgaggagaagggccatcgagatgattgggaagatacgcaaaacgaggtgagctattagctcatgattaattgagtattaactattttaaatttcaaaaatggattaatatgattttttaaagcaactttcctataaaaaatttttacaaaaaacgaaccgtttagtagtttggtagtttaggaaacgtgtgcgcggaaaacgaaacaaacaaactcactctctcaccctctcgaacgctgcctaagtcatcactaagattgttatctattcattcgcgtgtataggttgccaaccgaataaacgccaaaacataaggcgctgtaactctgcatatatagctgaaaaatgtgctgcttcagtatatgcatatctgtagcttatttattttagttcaaatatttattttagcttttttattttaggacccagcaccgcccctccaacctccacttccttctgcccccccccctcccggccacctcccccacctcaccgtagaggagagggggggggggttcaggaggaagcgtcagatcttcctcggcgcggttcagcggtggccgcctcatcccttccccgacacggcggatgtatgatttttgatttttttttattcaatttctgtgactcaatttcttgatttgtggatttgtggtgctatgtgatttgtgtggcagatcgatgatggatgtgtgatctgtgattcaagctctttgatttattttttgtgatgtgggatggatgggtttgaatttctgtgatgtgggactcgtgagctactcaatttaagccgatgcatccaagcctcttttttttattcatggaatctcaaatgtgttggttcctaaaccggcaccggcacctgaaccggtacctatttctcctccacatcagtgttgcctgctggatgctggttgaaaaatctagcaaagaagagggtttcccaccggcaccaatacctttttctatactactgactagatttacttgagtttagctgaatacattgcttgctgctaattaactcaatccttacatgctttctccattgaagaaacgactcctcagggtgtgtttggttcacagtcatatatatatgggatatgttcattcatattttgttggatatggcaatccaattttttgtttggtttgtatgaccaaatttttttgtttggttggagggatatagcatgtatgagtaaagccaaaagttagtgggacccatttgtcatatatttttttctatcaaaatataatcatccaagatcttgttttaaagatttaattgtaacaaatataatggtgtaatcaaatcataaattagataaacggtttaagattatttggagcttgcttaacagaaaatcaaaccaaccacacccaatcagaataggacacattattcagaccaaaactggatggcttcttccagccaaatctgccggatacactcatccaacatattaagagaatattctatattccgggcggccccaaccaccctgccctccaaccaaacggcaccaaaaatcgggcggccatctcccatctaggctcatccacccagccaaacacaccctaaatccacaaagcatgcacacgtctccttgctctctctcccatggaatagagtagggccccgtttggggagcttaagattctgaagccctctttgtttaggcttaggtttattggcctagacttttaagtcagcttattggcttatatgatttataagccggtagatttaatgtcctaagtttagtggttgagtcatacatctacctcacataagccaaaaaagcttctccaacctagcttttggcttaatagtgttagagtggcttatggcttcaaaaaaagccaaacggaaaagctgattgtttgtttaggcttagacttttcgacttataagttggcttataagcctaaacaaagagggcatgagaatctgctggttggtagccagcttctaagaatctggagaagctgggttttccagcttctgggttttgattcatttcctggattctacaactacaaattgtgaactggttgggggagttggagattctgggagaaactgcagcagctaaaaactcctcaaacaggccctagatccttaacaatgtccgcaaggtacggtcattccggctcaccgcaagatgttggcaacccatttctcaaaacattaacactaacactttaattgtgcatgaacgccaaattatctagattgttttgccggccagccaattacacttcaaattagcagttgtgtaagtgaggaagaaactaactacgacattgataaataccagaagtcaaccatacatgacgctccagcagagtggaggaggaaatatatatattccattcccactgattccatatgattttgaaatatctgtatagaaagacctgtaatataaatagccatgaggttatttggaccgtttcatagtatagtggttagagggacccaatgtccaaggggtcaaacagtcttttcccggtaatttgtgagtgaaataaattaaataatgtgagcataataagcttaattggtagttgctctcccatggagttcattggagaactattgaatatttgaatgtatatagaactgacctgacaatgcacagtagagtagttagcattataggaaaatcatttttcttataacatgtagtacaattaaattccattgtccaagagaaccgttgacttctagactgaaccatcaaggagtactagctaaagagcacaataacatgtcaagttagccaagtctttctgaattgagcgtgagatcactctttttcttttcatttttatagtgctcctctggtgcgcgttattgtgttctaggacgtgtttggttgatctagctagatgtggtccaaaatacttaaaaaatgatctttatatacctctcatttattttttcaagtggtaaaaaaaatatgtttgtcaaaagtattagaggtgccttgtaaaggcttgcttgtaaaaattaattttcgtaggttagcctcttaagagagccgaagtgggcctcttaattgcctgcctgtcggtgcacacactacatggcccatgtgatgggagggatgggagggacggatctgcaacctccggtcataggagtggtgacttcgagcgtggcggcctccaaggcgtggatctgccgccaccaagcacgggagtgacaacaacgagtgcggtagcctgaggggtgtgaatctgtctcaatcgggcacatgagcagcgatgaggagcccgatggttccaagagcattgatctatcactgcctaccccgagagcgggtggatttctggccaccgggcacgggagtgggcaactgatgatcgcattggccttgggagtgacaacgaccgctgtggcatcggtggcgtggatttgccgttgcgggccatgggagtagtagacgacgagcaagcatcctcgatagcgccaatctactgccgctggccctgggaagggctaatctgtggccatcatcatgggagcggcgactgacgattgtcggggcctttggagcagcaatgacgatgatcaccgggcacgggagcggcacccacttcatgcggatggcataacgcacccgcttgcaaaaaaaaaaaaaccgtttttgcgtgcagtgggactgcctacctatgaaatttttaatttttacacacctgatagctggcgttgctacaccaccaacgaaaatatatttttgccgtttgtaataaacactgttatgtaacagtggcctagcgtgactttgtatcaccaaacttggcttttgtcctacttcctccgtttcacaatgtaaatcattctaacatttcccacattaatattgatgttaatgaatctagatagatatatatgtctagattcattaacatcaatataaatgtggaaaatactagaatgacctagaattacttacattgtgaaacggagggagcactttgcatgtgattagctattgtgtgtttgactacatgcgtttgcataagcctgctgaagatgatatatgtttgggagcacggtaaaatgtggtttgggagggaaaccacgcaaggaagggaagcaacatcatcgcgttttcgtcacccacgcgcgaggtagacctgcggggaacaaaaactatgaaagggggaacggacgatggagttgtttgtttattctcaattcaacatagttgtgtcctgttttaataggcctgattgacaagcttctaaatttaactccaaagagtagtctgaactctgaagcggagcggcccaaaaacctctctagttcatgttttcaaaatcattatagcatgtttaacttcccttttggataaatcggaaagtggagttaactagtgagatatcagcattttagctagaagaacgtgcaaatttttaagaaattaacgtactcctaggacgtcctagccaaggacaaattgcctgaataggatcttacaactgagtcgtgtggatggcaatataacacgcgcatttgtaaactgtagaagtagcttaaagtaaaaaaaaaaaaaaaactgtacaagtagcaggcctaaatttcattttggatggtgcacacgcgcaaattcatgaaatcgaagtttaatggccgaagctatgtcaagttaacgaactcacttcacttgcatatatagaataagttcactttaact

SEQ ID NO: 71295 - DNA, 597 bp, Oryza sativa
atgcatattttctttcattttcccccaacagcggttttattccccaatttaatggcgttttttctttaaaaccaggcggtttttctctaaaaccaggcagtctaaccggttcgaatgctacccatgcacattttctctcatttttcccccaacagcacccatgcgcgcgtacagcagccgccaagcctggttggaagcggttttattccccggtttaatggcgttttttctctaaaaccaggcggtctaaccggtttattgctgggccgattgcatgccggtctttttacctggaccggaccggttggggcattggttccggtttttccccggtccaaccgctggtccagtccggtcttaataactaagattttacgtatagttgaaactgtttgattgaactccagctctaggagacatggagctagagctagacctgtaccaaacagatcatatatctatctatctatctattatatactagagtccattaaacttcttacaaacgctttaagctgctacgtcgcattctaaaaacgcttctaagccgcacgtgacactcttataaatcaaaaggttcttaaaattctatgaaaa

SEQ ID NO: 71296 - DNA, 9604 bp, Oryza sativa
catgaagctcgtctcttggtacgacaacgagtggggctacaggtgagcatccacttaatggcataacgccttagccagcccttttcagaacctattcgctttcctgattactgcagaaactgaatgtcatacgcaactcgtgtgttccaaatggtgccttgcatgtattttttccatctatctttatctgacctgaagattttgtttctttgctccagcaaccgggtcttggatttgatcgggcacatggctctcgtcaacgctaagccctgatgccattgataacagcagatgccctagtaatgtaggaagagaaggctgcaaacttgatggccccttctgtatctcggaattatattaagcacaccgaacaaaaccattgccgacatgaagatacatgctgtgttgtgataatccgagcttatttttggcctgtttgaattttgttattttgttgtgcgacacatggactccatgagttggggtgaatgaagcaagtagtaacacactgcttgcacacaaaacaaacagacctgatttcctacacttggtatggtgcattaacgtacaccatggaatggatcgatatctccaaaaaggtgtcccgtattcctatcttgatgatgatattctccctctctgtccatggcaatttgggttccgattaagctttcgcggagcaatgacactgacaacaaccggcagtgtcgccctcggtcctcctcatcacatcccattcctgccctgccagccgtcaagtggtttctcttagtggaaggggcatcacgccctccagataaaccgtgggaatcacttcatttttccccctccttttttttgtgtcgtctctatacaatgacgagagtcgtgagacctgcctgttgtatttttcctaactgtacaatggccctgttctttgctggttaagataaagattttatcttagtttttgttaacacgctattcaaattgataaacggtatattttgtgtaaaagctttctatataaaagttattttaaaatatctgataaatttatttttcaagtttgtaacaattgacaatatgaaactcaattaatcacattctaatgactttatcatttatcgtgccctaacttcatttccatttttagtgaaacgaacatcgccagtctgttcatatctcccggtcctatgaggctagatcgattttcattatcgaaaaaaaaatcttgagttcccatagctcataaaaatatttatagtaagatgtttattcttttagggatggagtggtaatgccgtcgattgtgcttttttatggtattttggaaattttgattgatgaagtaagtgaacagtacatctcttagagttttaggttataagacgttttgacttcagtaaaagtcaaattacttcaagtttgactaactttatagacaaatataataatatttataataccaaattagtttcattaaatcaatcattgaatatatttttataataaatttgtcttgggttgaaaatgttaaaacttagtcaaacttaaagcagtttgactttgattaaagtcaaaatgtcttataacctaaaacagagggagtagttaactataaatactgttcctcgccaaaaaaaaactacaaatactgaggaccgagcttagctcggttggcaagttcgctgtggtgcgaacggctggtcgtgaattcgactcgcggggcctcacctcgacgggtttttccagtcttttctttgggactgtccttcagggcagtctcgactagaaaatagggagtggtagtgcagtcgattgtgtatttttttaggtcttttgaaaattttgaatactaaggatcgagcttagctcggttggcatgttcgctgtggtgcgaatagtcggtcgtgaattcgactcgcggggcctcacctcgacgggtttttcccgtattttcttcgggactgtccttcggggcagtctcaactagaaaatagggtacacacgcatgtgcgttcagtgggactgcacgtttcccgtgcattgaggcctagtgcctccattctcaatcctagcgtgtgttagggatacgcacacgtgtgtgttcgtgtgttgtgatgtgattgtggtgtgtgagtatgcgttctgagttgtttcctttaaaaaaaagggcaaatactgtagacccattgccagttttaatgattagctttgcattattatgcagtaacaactaacaagggatgctcatacataaaagcaactgtcattcaggatgattttcctggatagacgaaaataataactactcactcaagatggcgaagtaaaatcatcagccattatacaagttatttaccggataatgagcatatataggtcacgctcataatctatagtaaaaaaagtttagccgatcaattaagcagcagtcaaaacttgcaggcgatggtggtggtcttctccgacgacggcgccgtggccgtcggcctctggcgaggggcggcggcggcacgtcgggcaggagcagtgcgccaggagccacctgtcgatgcacacgacgtggaaccggtggccgcacgccgggagcagccggaccctctccccgtcggcgaagtccgacaggcagatggcgcagccggcgacggagggcgccggcgaggcgacgtacgtggcgacgggcagcgccacgacgtcctcgcgcttgagccccgcgccggcgcggcggtgctccacccagccgacggggtccgccacggcgcgccgggtgcaccgcaccacgcactggagcatcgagttgagccccagcgcgcacaccagcgcgcacagcatcgccgccaggatcaccaccacgtcgtagtcaagctgcggcggcgacggcgacgacgccgctgccgaagacggcggcatcggctgctgctccggtgaggagacgttgctgcagttggccatgtgggacacctccatgccgatacgacgacgacgacgacgacggcggcggtggcggcggcggtggcgaggcgatcgatcagacaggcaaggagaagaggagaagagagtggagcaaccacgacatcgcagagaaagacaaggagaaaacaaaaggtgacaactgaagagctagagctatagcagtaagcaaagtgatcgaaacaaattttagtgccaatatgctcatacatttgtaggcttttaaggctgtgtttgagagtaagggttggaaatcctcctttcaggtacacaaaacgaaacatgtatttacgcatattaattaaatattagaaaaaaaaccttaaaatagattaatataatttttaaaacaactttcctatagatttttttttaaaaaagcacacaccatttatcagttgggaaacatatgggcgtaaaaaaacgagaagtaggaaatgggaaacacacccctaagtacatatgcatcttattttcagattatccatctgattgttgaaacaaattattgctccataatttgaaaaacacattttctaaaaaatatattcctttaactatattatttagaccacatgttttaaattatttaatttattcttataattgagtagataattcatagcaacgatccgtccaatagtctgttttgaatggagctttagattcatgatggacaattggacacatcaaaaaaattctataacctgaatactgttctgatagagtgacaccggtgtttcatcagcaggacgtatcaagtacgaaaaggtatgaatactggtcatagctatacaagtattggaaccaaagcaacagcacaacttgcacgagaagaatctgttcttacctttcttgaaaaaggaggcgaattgactgataaggagatcacactagtattcacttgcccgagatcaacatataatcgacacaattgtgagaataattccttcaatttgaatctttaaaatctaagcatatgcaaaactggaatatatttggccgctgtaaacatcacttccaagataaatggtgtaactacataaacaatacatgctttaacaaaggaggaagagagggtcctgaaatctgaaaatgtttttgtacaggcacggaaaagagagttggtttttcaaccttcatttctgaaacaaatatattttcacatgatctcacatgatcacgtgatcagtaattcagactttcagagctttaaaactttttttagagagagaggtttaagctgttgactgaatttgcagtaaattcacagggtttccgttcactgaagtgtgctttgtcaatatgcttgatcaactctctggttgcacctctgcgtgaagattacactgcttgtttggtaaacaactgggagtattggcaactccaatatcgtatcgatctaaggcaggagtaactaacaattgacctatagcattgttaaaacttgtcaggccagccagcagacagaaactcattgaacactaatctgcccaagttttaaacgtatccagatttatgcatccaaaacatctgacaccaagatcttaatttcgcactgaattaccccggtagatgcctcacggcacacggccggctcaggcattctaaatttctgaatattaggggttggtttcctatctgctatatggctcttcaccaaactttgctggtagaacaagttggtgctggtcacaaacagtttatcagtttttgacagatgagtgatgaccgaaatgactccacaagttgtatgagaattaaattagcaccatagaagtagatcaacaagacaacaagaacttgggaattgcagaatcacaaattcacttcacaggcttcactagcagctcactaacaccagcccatatatgtttgtatattttcagcataatagctcacatgcagttttgaacttccaaccggtggctgtacaaatcatggttctgaatattttcctaagtagaaacacatagccgcatcaaggattccagttccaggtcatctttataaagccctgtcataattttattaaaacttaatacctagttagccgtgctcatcttgatgattagtaaaagcttcagcattttcaagagaacttttacagtaaaatacactcgtaatatatcctgctagtaataagtaacctgtaaattcttagcgtacagtggaacaactttaggtgctttcgccgctcgatcccattcctcgttatccttcatcacgacgaggcgcctccaaccactgtggatccacatgtgccgccgccaaccaccacaatgctatgagcctttgactcggtgatagttaggcactaaactacaaatttactaatccctccatcctaaaataagtacagttttacactgttcatctccaacgtttgaccgttcgtcttatttgaaaatattttgtgattagtatttttttgtcattagatgataaaatataaataatactttatacgtaactatttttttaactttttataaattttttaaataaaacggacagtcaaacgttggacacggatatccacgactgcgtttattttggggcggaggtagtaaaatattgtgtggaaattttttttgttatacttcctctgtttcatattataaaactttctagcattgtctatatttatatagatattaataaatctagacatatacagaagtatagaggaatggtacatggcggtataccatgggtgtctcactaatcgtccaaactacccgtgctcatcttgacgattagtagaagcttcagaaattagttttctgagcctcgctccccaaaagcagaacagtagctaaataaagcagcatgacaactctgactttgaccctgcctcgtcaccaccatgacttcacgcccacgtcacacgcacaccccgaaatgtcgtgggacccacccgtcagcccccgccgaccaatcaaatccgtcgacaaaaaaccccacgctagtacacgtcgcgccacaaacatcgcatttacactcgctattaatccagaagaaggagcagatgcgatgcaataataaacccgtgaaaacaacatgtggttagcgtgcgcccgccacagctttgcttctgaaacttggcaacccaaatcaaaagttgattcctcccccggcctaatcaaatcacgcagaatttttttttttactgcttgtcaaaatccacacatgggctatgagagtgaccaaagagcgaaatcgaattgaagaaaaaattaggagtatttacatcgctgcagcatggatagctgatcagctgattttagtgatcttctctcttaactgaacaaacatgtgaaagtaataagaagaaaagaaattgcacacgatcgaggagagggtaaaattaacttgtagggggttaaacacaactggtccatgaatcttctttgcttgtgatgtgtcttcgattaaccgttggttaattaggcgaagtaaccattagcgctgtggttagcggcggaagtaggcatctgagctgactggaggctctgcaggagcaacctgtcctcggccgagctcagcgcgtggctgaacatgtcgccggcgccggtgccggcgccgccggcttgctgcaggttgccgtaaccgaacggtgcgccggtgtactgctgctgcggtcggaggagctgttggtggtcctggaacgtcggccggcgcggttggaggtggtcggagaagggaaggacggcgccggtgaagccgtagtcggagccgaagttgatgaccggaacgccgccgggccccgcgaacgcgcccgcgggcggcgccgggatgccggtgaactgctgcaccatggcgcggaagttggtggtgtccgtgttgagcagcgtcacgggcgcgcgccgcgacgccctggaccgcctcctcgccggcttccccacgcgcggcccctccacccccggcgcccgcgtcgggctcccgcctgtcgatcccgccggcgacgccgggctcgtcgccgccgccgccgcaccgttcgccaccacgccgccgtgagcagccgacgcgtcgtggtacagctcggcccactgcgccaagctcgagccagtgtcactcatggccgccatggcgatcgagcgagagacggatcgcgtcgcgaattgcaaaatatcggagtaaaaacggtggaaacgaaacggtatttatagcgacgcggcgaccggtcaaacggccaaccgaaccgggagacgatctcagccgtccgatcatgacatcaacggctgaggatcgttgacaccgtcgccgtctcgaatacgtccccgatcccgtgacagcggccgccgcctcctcacccctcaccttcctcgaaacgtcgcggagaggaggtggtgggtgggccccgcgcggggtgccacgtggacagccaccgtgctccggtacggcggggcggcggcggcgttggcgttgggtcacggcgcgcacggcgcgggatgattaattccgcgaggaaatatcgggcgctcgccgtcgacttcgtggcgcgagcccgcacgtacgcaacgcgcgcgcatgtcgccatcgcgcggcatgtgaaggcggcggcggcgggggagctgaggccggtggtggtggtggtggtggtcgaggcgaagcttccggtgaagctgcggcggcgtgtgcatgcatgcggcggatggcgaccgcgacgccggcgatcgagtagtaatgcggttttgtgtgtgtggatagtgtggtggatagggcgtcgtcgtggcacgtgcccggtttgaagaaggcggacgtcgctgtcagtatccacctcggggatcgcgtttacattccggccacacggaaagtttccacctccatcgtggtttgttcgaggtaaaagcgaaacggaatacttccaccgtttcgaaatatttggcgccattgattattttttaatatgattgaccgttcgtcttattaaaaaaatttaagtaattgttacatcttttcctatcatttgattcatttgattcattgttaaatatatttttatgtaggcatataattttacatatttcataaaagttttcgaataagacgaacggtcaaacatgtgctaaaaagtcaatggtgccaaacatttcgaaatggagggagtatttgctaacgaaaaataatttgtaaataaaactctaacttttattgtattgtctatatatctattgatataaaatctcacatcttattttttaaattttggaccatcgaatatgctttaagattcgtgcagagatattaaccctagctctcctcctcatatatgtgttttaaattatctaaaagaaaagactgaaaaataactataatgaacaaaaatcttaaactcaactctaaatttaaggttgaaaattaaaattttgactgacaagtataaatataaggaaaaaaatgaggatgttcactctccgtttgattacactaatgaggatattaagcttggacacgtaaaacgagaatattattagctcatattactaattaattgggtttaaattattttaaatttagaaatgactttataagatatttaaaagaacttttatataaaaagttcccgtacaaagtaggacgtttaccactttaaaaaaatgctaacaaaaatgatataaaatcagtatctttagcaattccctcagtcgaatcaagttatgggggatgcctgttttggttatatcaagcatatattcgacgaccactattggatcgtagtacaatggagtacgcctcttcggactgcaactgttgagaaaaaccatcataaaattgggtggcacaaagattgtttatcatgtgctcagtttctatttttgaaatttatcatgtgcttaaaatgatctatgaaaaatggtttgctatagcatggtcaccagacttggagcatgcttgctgatgtcacttgagtttaaaagttgaatcttcctgtttctaatttactttcgaccgatcgatttgttgataagtcgtagaaaaaataatgaaccagacaaaacttttgaatctgtattattcgtaatttgaaagccaagattaaaataacatactataaatttatagtgaaaacaaatcaaaatcgcttatatataagtccacgtgtagatgattagagtgttaaggaccctttttgtcactctgtgttgcctggctttcttttcatgaagctttaacaagagcttcaaaattagcttaggttttaagctgaagctgtgacaaattaaagcacgatcttgtaaaggttgcacattatatgttacactttcaccttcatttgcgtgattgcttccacgagcacgtctcctagctcgtaagcatggccaacactacaagtcaagcactaatggacctgatgaattagtggtaactacaatgttatgtctagctcttagttaattttctgatcaagaccgtagagtgattcaacgtacggcatgcacagtagtcgatcagggcgcccattttttacttgcaccgcaagccaaacatcgattaatatacgcttaccaaattgggtatatatagcaaagttagattagctcgttcagttaactaaaatgttcaaatgtcgatcgttcgaggaaatactcagcgtgttcacatattatgcacatggtttctcacttaaccaagtgtccagacc

SEQ ID NO: 71297 - DNA, 14065 bp, Oryza sativa
agagcagttttcgctgacgtggttcattgacctagtctaaccagctgagttagtacggcccatatgttagtgactcctcttctctcctctatcctcttcaactctgaggaggagctcgcccccaattttgccaccgcctgggtctaaggacgccgacaacggaagctggaagccgagccattgctaggtcgtcgccaccttgctacataacacggccacaaacgcgtcttctgcatttgtgatcgtgcgatgtagcggggcggcggcgacctaccctcgccctagctcaaccaagggcggagctagaacgaaatggagggtggtgccacttgcttaatttactttactttagaacaagtttaagcagatagaggtgcctaagtttgtatcgagggaggtgcatacatggtgaagatagatgatgtataactaaaaaattttctttgaccaggttcctgggcgccctcctagtatactctacctctgcccctgagctcaacggcgcacatctctctatgggcaatggtggtgccctgccttgccgatgtctccaaccgttgtccctccgctcaagcatcattggcgttgacgtggtgtcccgtatgttgcaaaaagaaggttgggggcgaaactcccagttggcgattgatcgccaggattgatcggtttcccccctctcctccacgtggtttccttttcttggcaccgcattactttcctattttagtaaatttatacacctaaagtttatacacctcaagtttacacatctaaagtttacacacccaaggtttataaattaaaagtttatatatccgattcaaatttgaatttgaattcaaatatttttttatatatagtatttctatacatctaaagtttatacacctaaagtttatagacccaaagtttataagtcaaaagtttacatacccgattcaaatttgaatttgaattatatttgattcaaatttgaatttgaattcaaatattttttatatatagtatttctatacatctaaagtttatacacctaaagtttatagacccaaagtttataagtcaaaagtttacatacccgattcaaatttgaatttgaattatatccgattcaaatttgaatttgaattcaaatattttatttatatagtatttttatacatctaaagtttatacacctaaagtttatagacccaaagtttaaaagtcaaaagtttacattcacgattcaaatttgaatttgaattcaaatattagtttatagacccaaagtttaaaagtcaaaagtttacatacacgattcaaatttaaatttgaattcaaatatttttatatatagtatttctatacataaatttttccaacttttttttaaaaaatttatagtgtagtaggaagagaagaaggggacgagaggagaggtgtgtacagggggcatggggatcgatcgctcggagcgagcgatcgcccattagccacacccggttgggggtttgggggggggggggtggagaggtaagcaagagaggagaaagagaaggaggtgctgaaatgcaggtttcacatgctgactcagccaatagatcatatcaacgaaccatgtcagtaaaattcaccttcaaaaccactgagaaaaccattatgtatggttttaataattagagataaaaatatattgtattatggttaaatgatacgaatccaattggagactcaaagtagacttatttccatattgacctcaacataattcacttttgggcacatttcagcaagtatttttatcggtccattatttccaacaaaatttaagtccaaacccacgaaatttagttgcagaaaagaatggaaaagtccaagagaatccacgtcgcatcaaagccattgccacagacttctactatcccccgagctcgcgcagctcccgcgccagctcgtccacctcccgccacgagctcccgccttcccgcgtcgccgccgcagcctccccggcgagctccttcacccgcgcgcccacctcgctccactcgctagccgccgccgccgccgcagaggtcgcctcgaacacgcgcgccacctcgtcggcgctcggcggcaccgcgatgccgccccaggagaccggcacggcggcgcggtgctcgtcgacgagcagccgcgcgttcacgaactggtcggccgtcatcggccacgtcagcatggccaccccggcggccaccgcctccagcacggagttccacccgcagtgggtcacgaaccgtcccaccgcccggtgccgcagcacgggcacctgcggcgtccacccgcggatcaccttgcccctgccgcccgccgccgcgcgctcctcgaacccctccgggagcgccgccgccgcgtgcgacccggcggcccagacgaacgccgtacccgtccgctccagcgccgccgccagcgccgccgcgtgaggcggctgcaggaccgccatgctcccgaagctgacgtacacgacggcgccgtcggcgaactggttgagccaggcgcagaggtccgacgcggccacggcggtctcgccgccgcggttgccggacgcgtcgggctccggcgccagcggcccgacggcgcgcacgcgcatgaagcccaggtcggcgagaggcctctcgaggtaccgcccctcgagctgccggaaggtgttcgacacgatgcaggagctccccatgttcgagaggaagttgttcttgacaccctcggacacctcgtcgccggccttgtagaaccggtaaagcaaggacagctgcctccacggatacgacggagagcccgggatatcggggaagctaccgggcactcgtcgtcgtgctcgtcctcgcgcttgggcatcaggcggaacatagagtggagcacggcggtgccgtacacggcggacgaagagaacacgacgcgcggcacgccgagctcgtccgcgagcgcctgcgtccacccgcagaagaagtcggatagcacggcgacgacgcggtcgggggtgtcggccctggcgcgcgcccacgtccccagcgggccgcgcagccccgcgaacgcgacgatgagcttggcgaacagcgccggcccggaccccttggcgttctccacgccggcggggagagccgggtgcgacgggaacggcagggtgagcgcggacacggcgccctggtgcgtggcggcgaggagtggcacgagcagcggcgccgtggccggcgtgcagacgacggtgaggcggagccccctggaggcgaggaggccggcgaggtcgaggagcgggatgaggtggccctgcgccgggaacggcacgaccaggacgtgcgccgcggcggcaccgccgttggccgccggcgccatggcgggcgcggttggtggctactgctctctcgctctagtctgccgcgtggtagcaagtgacgctcgtttgcaagtagcatgtgcacagggatgtagaaaaccactgggcgagggctgcaagatgcaggtagtggactagtggtgcagatgacaagttgagctagaattttgctctataggctccaaaattgaccatccttattttcgtgtggcacccacaatataagtcgataacccaatatataccaaattaaggaagagtaaaaaatacatctgactcatctggtagtgtgaaaagacactcattaacagaagggactgaataaagtgtagaatatactcactccgtcacaaaatataatcacttttaaaatggttctaagtcaaacattttcgactttgaccattaatagtaaaaagttaaaaaagataaattatgtaaaactgatgttactagatttatcatcaaacaaactatcataatatgcaactctttttatttagatcatctcacctttatagatattgttggttaaagtagtatctcgaagactgtgttgaggtcaaaagatacttatattttcggacggagggagtacacatttagaaataaactacatatgtttggcagattgggagctatagagtagtaccactgtacttttctctatatatatataggcccccatcggttggcttttttttctaataagccaaaaaggcttattagggaataaaaataaatttgtaggtaaaacttttatatatgtgttctttgtaacttaaaagccaatgttgaaaaaaaactacgttgaaaatatctcaaaatcaacctcaaaattaactttgaaaattcaaaatttggcttattctttggcttattggatcatgcgatgggagccatattttttacgacagggatggatggtagtactcaatttctgactgctgctagacttcttgtcttgggataacaaatatcatttatattcttggacaaacttagagagcataatactctatattcatagatagagggagtataaaatcttgatagattatttgatagtagacaaaatatttttttaataatgattaatcaagcaaatgtggatactaatggaagatgacaagaaaccctttcaagactacaccaaccaaaaagaaagaaacattagaccaattaaaaaaaatcctttgatgtctacaccaaccaaaaagaaagaaacattagaccaattaaaagctagatttggttctgtgtctgtcacttcgcatggaaaactttggttcccatgggggaagagaacctgcaaactggcaacctgaaaaaaaaaagagagtaaaatacatcgatgatcctcgttatatatatcaactaggtctataactctaaaagtatgatagtatgattctagaatctctaaattgcagacctagttgatgtttaatatgctactatttgatggtaccatcttattcttcatcgaaatagagttgttcctttcttcaccggttgttagcaaactttccaattcactcgctagccctaaccaccaacacgtccagctagacttcctaccgcatttaatttgtttctcgactaatgcattctctttgtcctataaaaaccaagctagtactggatatgatacatcctagtactacgaatttggatatacatatgtccagattactagaatatgtcacatctaattttagattgtcttttttatgtcacattcagttttaggttatcttttttggacgaagggagtatgatggtgaggcgatgcacattgacaaggataggaaaggcaactaataccttcctatagctcactcttcccttcctatgttacatcatccattcatcctgcccagcaagtcagatttttaagctttaagggcgcgacgagcagatccagttaggtagaggagaaagagaaagcttaagtgacggcaagatccagttagatcaaggtttagttcgataaggtttgattaattaagtatgacggagctcgtggctcctcaccgggagaccgcacaggcccccctttgccagttcggccgggggcttagggtgaaatctcaagctctctcggtatgtggaaggatcgcgagccaggaagaaacgcgagacacgggcgatgtatacaggttcgggccgctgggaagcgtaataccctactcctgtgttttggtggatctgtgtatgaacaagtgacaaagtgtcaaccgccccccaatcgctctgggatcggatctggaaaaggcctcgagtcccaaaagtcctctccaaggaaaaagatcaaaaaatcctcctctccctcagtgggcaaggtcctccttttatatctcaaggggataccacatgcacctctccccttccaaactggactgttcttctcttcataaatggacggagaccggtacggttgctgtccgagtgcccttctgacgggacggctcatacctacccccacttccaccggaaacaagtgcgacgtgggattatggctgtctgttgatgatgcgaccagtgtcagaccggtcattcttgtcctccacgcgtcagttcaacaatctgcatgttcgcccttcttcatacaacatataggctgtaatggttgggatgaagcctggcatatatctgaccggggctaacgtgccatctctaagaggtaacacgctaactccggctagagacgagtgcctagaggctttcgtcttgacaggatggggcaaggcgtgcgtcagaccgccagtcgccacctaacccgtgatctgaccggtctgtgactggtcacagaccggataaaggaacgcgctgcactacgctgcatgcggcgtgacacgttcgaccagaccacaataaatgcggttaggtgaggcttaccgtgttcacctaaccccttcatgtggtgctaactccacgaggggtcggggcgcctcggccctcggggccggggcaggggtcaccccccctcggggaaatcaggaggagggcggacacctcaccctcgggcccgacgtcaacgaaggtgccaggccacgtgggcgattgtgtctgcctcaagcctctggtcatgatactcccggtcccatatcaccgacagtagcccccggcattatgccagggcgatcgccctcctcaagggaagcggtcgggcgtgacgccactcctaaagcctggtgacaggtgggaccggtctccatggttgggcagaaacccaacggtttcaaaccatgcacatcggtaatggtaacttggctgtccataatgggcggtctcttcaagactgccacatcacttgagcagcgcacgaatctgggtgagccgatttgcttcgcctggagatatggtaacgtcgcttcggtcggcgagcgtaattaacgcgcgcacgatacgatctatctcgactgccacaaccgcatatccacctcatgcgccgcaagcgggcgaatgggattagtagaagcgtgggcacgagaaacgagggagcgagatagtgggaaacgagggagcgagatagtgggcgcgagaaacgaggagccgggcacagcgatggcaagggtataaagatgccgaggaaaggatttgctcccttcctttcgccattattccccttgccttcgctgcttgagccctaactctttctctgctacgccttaccttcgccacacgcgctcgttctcaatcatcctttcctccggcgccatggcacggggctccgctctgctcgacggtagcgtactaccgccttctcgcatcgtgagcgagaggcatgccgggctgccgcgccgcttcatgccggaatctgccaccggccgggagatagtgatgctgggcgagggacgcccggcaccagactacccggggcggtccgtcttcttcctccccttcgcaatggcagggctggttccgccattttcttctttctttatggacgttctggagttctacgatctccagatggcgcacctcacccccaacgcggtgatgacattggccatcttcgcgcacctgtgcgagatgttcattggggtgcgcccaactcttcggttgttccggtggttcttcaccgtgcagtcggtgtcgccgccgtcggtggttggtggctgctatttccagccgcgggggccggtgttgaaccgctacatcccctgcgccctccgcaagaagtgggacgactggaaaagcgactggtgctacacccccctcgccaacgaagcgcgcctccgacttccaagccagcccccggcgcaagtctccagctggcgggcgccggtagatctgggggatggctatgacgccgtccttgatcgcctggcgggcctgcgatcccaggggctcactggggccatggtgtacggcgactacctccgtcgccggattgcgccgctccagcgacgagcccggggcgcctgggagtacttcgggtccgaagactacatgcggacccatcagggagccagatgggattgggctcctgaggacttcaagattgtagtccaacgggtgctgaatctcagctccgtggaggcgtctctcattcctcaaggaatcctccccctctgcagcgatcccgaccgcgcctccattctgaccattatgatgggggtcggggcctcagaggaggaaactcctaagggccacgacggcgcgggcgagagccgccggggggatcaatctaccccaggagggggtcgtgcttctgggccccgcgtcgggggctcggggagcagccgccctgccgacgcccaggggaagaggaagctgggaggaacacctcccccatctcctccccgagggggcggggcggtgcgtgccagcagtcggcgcccggagggggccgcgccgacatcgcagcccgagggggagcgcaagaagaagcggctccgcaagatgggggagacggaaccatcccggggaaacctgatttcccctcccaagtggtcatttaaccgaccccctcgcaggttcgtcccactcttattgcgaccgtctttcttctatcccaaaagcaagttttctcttacccatcttgtttgtcttctgttttttcttctgcttcagcgatgtcccgtcgcgttcctcccgccatcccaagtccggccagtccgaggccgaagatccagcggccgcagaggcgcggaggcgagaatctgaccggcgagaagccgcagatcgccttcgggaagctgaagaggccgcccgggaggccgcccgggctcgtcaagcggaggataccgctcgggaggaggccgcccgggctcgccaagccgaagaagctgctaaggaggaggccgcccgggttcgccaggctgaggcgatggcgtcttccgaggcagctcacgacaaagctgctggcgcgtcgcttgggcccactccctcgggcgacgctcaggcgacagcctccggggcggctcgcgacgaggccgcgggcgcatcgcctgggcccacttccccgggcgatgcccaggaccaaacgggtccgggggacatccccgagcccagcgcgtcctccggcgggccgagccgcgtcgcattctctccaaggcggctcttctcctcgtcttctgtcgccccgctgagcgccgagccccttctgcaggccttggccgccgcaaatactgcggtgctagatgggttcaacgcccaagtggaggccctgcgagcggagcgagcggagctcgaggccgcatgggcgcgtgtcgaggaggggcggcgctcggtggacgtcatggtggaggtgggccgtaaggctcatcgccgtcacgtctcggagcttgaagcccgcaaagcggcgctggcggagatcgcccgagaggtggaggaggagcggggggccgccctcatcgccaccaccgtgatgatcgaggcgcaggacaccctccgtcttcaacacgggagctgggaggcggagctgaagaaaaagctcgacgccgcccagggggtccttgacgccgccgccgcccgagagcggttggcaacggagatcgaagcggcgtcacggcggcgcgaggaggcccttgaggcccgagccatggcgctgaaagaacacgccggcgccgtggagaagggcttgacggtccgcgaggccgccgctgctatccgggaggcaacgctggcggtgcacgaggccgcctgcgccgaagaggagtccgcactccgcctccacgaggacgcactcgctgagcgggagcgagctctcgaggaggccgaggccgcggcgcaacggctggcggacagcctgtccctccgcgaggcggcgcaggaggagcaggcgcgccgcaatctggaatgcgtccgcgccgagagagccgcactggagcagcgggctgctgacctcgaggcgcgggaaaaagagttggacgcgagggcgcgcatcggtggggcggctgcgggcgaaagcgacttagccgcccgcctcgcagctgccgaacacaccgtcgccgacatgcagcgcgccctagactcatccgccggggaggccgaggccctccgtttggcgggcgagatagggcccggcatgctttgggatgcggtctcccgcctggatcgcgccggtcggcaagcgggcctctggaaaggccagacaatgacgcatcccaccaacctggaaggcctcgctccgcacctcacgaagatggcctgggctctccaacaactccccgaggagctcgagaagaccatcaagtcatcctcgagggacctcgcccaagaagcggtcgaactcgtactagcgagttaccaggccagggaccccaacttctctccatggatggcgctggatgagttccttcccgggaccgaggacgacgcgcgcgcgcgggtccgggatgccgccgaccacatcgtccacagcttcgagggctcggcccctcggctcgcgttcgcccccaactccgacgaggagggcgacgccagcggtgcagacgacggtgacgacgaggccggcgacccgggcgcatcggaatgagcccccaggcccccgccaatctccagtttttttctttttctttcttctaaggccttcatgcctcttttttgtatagatcaacttaatctgcaatcaaaaatgatgaaaaaattctttgtgttaattttattctgctatgcgtatgagatgaggatgatctgtgccgtagcccttttgcatcttagcttgatttaagggctcatgctcaagtcccagccctcaaatggttcgggtcggggctagtgcctggggagatccacatgtcgagactggccaggccgggaacgtggtgaccgagggttatgggtgacccgattgtgggtttttgccgattcccccccggagttcaccacgccccagggcacggctcggttctgggccccgtttggcgattttagctgaccgaaccgagcccccgagggcaaggttgagcgcaagtgaccttaattcaagtcaagattcttcaaaaggaaaaaacggcatagacacagcctttaggaaattgaaaccgcttttattgaaatgctgaaataagagaaataagaatgtgcatgtgtggtagcccccggccaaccctgcacacccgaggggggtgcggggttggcccgagccgaaacctgacacccgacccccccctctcaggggtagaagcgacgaaggtgttcgatattccacgggttaggcagctccgtgccgtcgcccgtggccagccgtatggagcccggccgggggacaccgatcactcgatacggaccctcccacattggtgagagtttgctcaatccagcacgcgtttggacgcggcgtaagacgagatcgtcgacgcagagtgatcgggcccggacgtggcgctgatggtagcgccgcaggctctgctggtagcgcgcggctcggagggccgcgcgccgccttcgctcttccaagtagtcgaggtcatctctgcgaagctgatcttgatcagcttcacagtacatggtggcccgaggagacctcagggtgagctcggatgggagaaccgcttctgcgccgtagacgaggaagaaaggcgtttccccggttgctcggcttggtgtggttcggtttgcccagagcaccgctggcaactcctcgatccatgaatcgccgtgcttcttgagaatattgaaggtcttggttttaaggcctttgaggatttctgcgttggcgcgctccacttggccattgcttctggggtgggcaggtgaggcgaagcagagcttgatgcccatgtcttcacagtagtcgccgaagagttcactagtgaattgggtgccattatccgtaataatacggttaggcactccaaaacgggccgtgatgcccttaatgaatttaagtgcagagtgcttatcgatcttgacgaccggataagcctcgggccacttagtgaacttgtcgatcgcgacatacagatactcaaacccgcccggggccctcttaaacggtcccaggatatcgagcccccagacagcaaatggccacgaaagtggtatgatctgcagggcctgggccggctgatggatttgcttggcgtgaaactgacacgctctgcatcgccggaccagatcgactgcatcattgagagctgtcggccaatagaatccttgacgataggccttgccaaccaaggtgcgcgaggcggaatgggctccgcactcgccctcatggatgtcggcaagaagctcaacgccttgttcctgaggaatgcacttcaggaggattccgttagccgcgcgccgatagagggtcccttctatcagcacgtagcgtttggaaatgcgttggacgcgttcactcccttcgcggtcctcaggtagagtcttatctgcgaggtatgcttggatctcagagatccaagcaatcaatctaagggggcttggagcgctcccttcgggtcccgaggcctggactccgacgggcctcgggggccggtcaggcgcatccgtctcccctaaggggtcgggtcgcgccgacggctgggtaagcctttcttcaaaggcgcccggcggggtctgggctcgcgaggacgcgagccgtgagagttcgtcggcaaccatgttatcccgtctgggtacatgccgaagctctatcccgtcaaaatggcgctccatacgccgcacctggcgtacgtaagcgtccatctgtgggtcagagcaccggtactccttacagacctggttaacgaccagctgggagtcgcctaacaccaagaggcggcggatccccagtccagctgccactctgagtccggcaaggagtccctcgtactctgccatattattggtcgctcgaaagtcgagacggaccaagtatctgaggacgtctccgttcggagaggtcaacgtgacccccgcgccggcgccctggagagacagagaaccatcgaactgcatcacccagtgggcggtgtgaggcagctgtgaggagtccgtgctggcctcggggattgagacggtctctggagccggggtccactctgccacaaaatcggcgagggcctggctcttgatagcgtggcgtggttcaaagtgcagatcgaactcagaaagctcgattgcccattttaccacccgtcctgtaccctctcgattacgcaagatttgaccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcactaacaaagtagacaggccgctgcacctttcggcggggccgatcctcttcgctaggggccgtatccccggggcgctcttcgtccaagtggcctctcggggcgcactcgtcttctgtgctgatgacctcggggtcggaggatgacaggagcggccttcccacagtggcctcggggccgtcttgggggtcaggagctcctggcgtcgtcggacaagcgggcaaagggccaattccggtcgtcaggggcctcaggcctccgttcggctcgggggcctcttctccctgctctctcccgggtcgagtcagcacagggttagcctcggggccaaagggcgacaggtgcggccttcccgcagtggcctcggggccttcctgagggtcgggggcacccagcaccgtctgacaagcgggcagagggccgactccggtcgtcaagggccttaggccaccgttcgactcgggggcctctcctccctgcttgctcccgggccaagtcagcacagggttagcctcggggccaaagggcgataggtgcggccttcccgcagtggcctcggggccttcctgagggtcggaggcacccagcaccgtctgacaagcgggcagagggccgacaccggtcgtcaggggccttaggccaccgttcgactcgggggcctctcctccctgcttgctcccgggccaagtcggcacagggtgggggtgcgcggaatgaggattgtcctcatcgcgctccacaaccaacgctgcactaaccacttggggggtcgccgctaagtaaagtagcaggggctcatttggctccggggtgactagaaccgaggagagctgagatatgccttcaactgagcgagggcacgttcagcttcctccgtccaagtaaacggcccagagcgtttgaggagcttaaataagggtagcgccttctctcccagcctcgatatgaaacgacttagggcggccatgcaaccg

SEQ ID NO: 71298 - DNA, 11809 bp, Oryza sativa
ggtttaactataaatacaacaatatttatattagaaatcaaatgtatagcttaaaattcatgtatgcttgaatatttttgattatttctcgctataaaaacaggaagggtagatggagagctcaagcgaagtagggaggtttcggtagtgccatgttgtgcatatgtgtgggggagggcgaagtgcaggggacatgagcggtttttttcttttttttctaaatgatttaagtgaaactgatgatccagtttttctcacaacttttgttattcattttttctaatttttaatatgtaacacatggtggcttaagatttttctaaaaatatatctattggctaaaaataaggatatacctatttaagtagaacttgatggatagatggttttcttccaatctgtaaggttttatttttatttaatgcataactcgtaacgccttcagtgcacttcagaggatatacaatgatttccattgatgtaatacttattttaattttattattaggttctctttcctttttgctatttggttacaattcgaaggatcagtgtctacattcaaatgatgtatttttaattttatagagtggaatgtgggtaacatgggtcttaaaatatttatttaattataaataaaacacaattcagataaagtaaaaattggatttaacttaagaactataatcatttagctttctaattattggactgtttttttacttagttaaaaattaggagatgaaggaattaaatgagataggagaggaagagagagttgaagagaagaagattacgccgcatataattataatatttctttttatgggttatattgttttagttggtattacttttttagctaaaaattgataaatgctttattgtatgattaaaatctatctttttttacttgtcttttcctatggtatattcgcagtagatattaaaaatataaacactatattctaataacgttattttgacttattgtaatgttagaatggacgagtaattttttaaaaacattactcagagttaggttcattttgcttttatccatatagatataatttaattattctgacatcatatacgatgataaaatctatatcactatttttctataattttgtattttttcgaatgatatacaaaaataaaatattgttgcccaaattgacagatttcttctcaaagatgaattaccgtggatatgggtctttaaatgtaaaatagtctgattaaatattagttgtgtgatacttgtcttttcctatagtatattcgcagtaggtattaaaaatataaacactacaatctaataacattattttgacttattgtaatgttagaatggaggagtattttttaaaaacattagtcagagatagctcttttgcttttatccatatagatataatttaattattctataattttgtatttgttcgaatggcatacaaaattaaaaaattgttgcccaaattgacatgtttcctctcaaagatgaattaccatggacatgggtctttaaatgtaaaataatctgatcaagtattagttgtgtgaattagatgttaatgttgcttacttttagcataagttttgcttttaaactcacagaatattcattttacttttatcattatggacatagtttaattattatgaagttatatacgatgataaaatctatattattattatttcatacttttcacaattgcttgaatggcacgtaaaagtcacaaaatataaaccaaaatttcatttcttttcaaaagctaaattgtgaaatatgatcttcaactgtaaattgagttataaataatttaaagatttaacgtgtaggatcgaatcacaataactaagccaaccagaggggggtgaatggttggtatacccaaaaccgaaaaattttagccgaaataaaagttgccctcgaaattgacggaagtcagtctgaccaagattgatctgccagtctgaccgagtggatgttgccagcctgaccggtatagattacccggtctgaccgccgatgtcgcctgctgcgcctgtcgccgccgctggtctgaccgccgccttgtcgccggtccaaccgccggtgagtcatcggttagaccgccgaaacccgatgaaacacaaatcgaagaactcttaaagtagatgacgactttattacttctctatgtgtttacaaagtgccccaacagcactccttataaaaatctcgactaaactcgaaaccctaactcaaaactcaactcaattgctctcgaaagcgataccgctaagcctcacgctccccctctattttatacatgaggtaggcagcctaaagccacgaaccaaactcatactaagagtcctaaacaccttaggaaaccctctagtacaagaaagaaactttatataaccaatcgtaccaaatttggactccttccaaattcgactccgcatcccatacgtacacaatacctccatcgtataccatatagaatctccatcaaccacgtgcatcaactctagcctaagtatcccgcatgatctttgaccaccatggacgtcgtcttatccccaagccgacttccggtccatcaccgcaaatattctcccgaggtatcaagtcacctacacatgaaataaacaaagaaaccatattccgagaccaagttatctcaaacttgactcattagtagcgaacaacagtattacatacgtatagtatccatctagaagcccataatcatgacataatcacggaacaactcgaaaccgaaaccgacacagagtcggccggtcagaccgcgggctgcgccgatctgaccgcgcattacacgccggtctgaccggcaacacctgcccggtctgatcggtcacatgaaataatgaacctgtaatcacctctgaaatccacttcgtgaataaattctaaataacaaaaccaataatcttcaatgccaatttttcatcacagaataataatcaaaaacacctttgattttacataacggatcaaaaattatttatatgatgtagatgctttattgttttacacataattgttgcttttctaactaataaagcatgcaaatagaagaaggaatgggtaaaaatgtagagaaaagaattgagggaagagggggcatacatacatatattcgtttgttttttccttaaaaaaaatgaaacttatacgtactggtttaggtaggcccgggttaaggagatgattttctaaaaaaaaataatccaatagttataaataatgggtccatcaaatttaatgaaaatttgctttgtttttttctagatttcttaagtatttcagtaatttattagactgacacgtgatgaacatagtatcatttgtagaacaacacatgacaacataggagcacttttaggaagtttaatggacttttagtatataatgtatacattatccaatgttctaaagaatcgatcgggcctatcaatttaaatgaaatcaacagtgatatttatggaaatttatagagtgatacgttttatctttaaataatagaaaatcatattttaaatatcgtcatttttctccaatggtactaagtacgtatgttttttttatgctttattgatctttatagtaagtctgtgcgtaagtttatttgtttctttagatgaacagtaggtaaagcttcattgtttttttcagtcgtacgtatgtatggatacttctccactattataaaaattaaagaagttttttgccgatattttggtacgtcattcttgtttgagtcggttattaatttcgttcgtttttgaaaatattgattcttgtttgagtcactttttatgttcgttcatttttggaagtacaaaaatagttatataaaaaatatctttaaacaaactcgcatgctaacttgagatgaaagtcagactcctaattgcagctaatgattttcaaaaaaaaaaaagcgaatttccagagtaaatttcatcctagttaaaccgtataataagaataagattaaaatagccttcatccgtagcaatggacaagtattttttttctagtacagttatataattctcccatatacatatatggattaaggaattagtttttaaaataaaatacatctaatataataatataatggtttaaaatatcggatccactgctaaagtgaaaatcatcggtgagatttgacagttccacgtggcagcttaggagcgttcgtataagtgtcacatggcgatttgagagctttcatagaaaatttaatggatgatatttacgtaaatttatacaatgacagtgtcacgtggtggtctagtagtgtttgtacaagtaacacatgatggtttgagatcatttataggacgtttcatgaatgatatttacgtaaatttatagaatcgtatgttttatctttaaataatagaaactcatatttaaagatcatcaatttttttcaatggtactaagtacgtgtttacacccaaatttggcacctaggatcaaaataagaaagattgccaaaatttagaagtctatcggtttccttcgagtcggccggtctgacagccgtgtgttgggcggtcagaccgccagttgagggcctgtcagactggcggtgtgtggcctgtctgaccggcaggtccgagtccgactgtgtttcgtcaggtctcgaggtttccttgctcgggaaggcatgtttcaggtttcctttagtttctatcccaagttggacatggaggagggcctgtagagggcaagaccaacccctatataaggtacatggccagttctattgtaagaaaccaatctacaatcaatcaattcaatcgtttttcatattgcttttagttttctcttagtttgtccatctttgtcggtttgcgccgtaaaccgtccgccgccgctgcgagagtgcaacatctctttgtaggtttgtcctgaaaaccttccgttttgcccacgagacgggtaattatcttaaattggctccgctagccggtttatttgtcaaaacccatctaggtttggctctttgctagatcgaggtggttcgtgactctaggatcaccgcaaggcataaggtgttgcaatcgttgttgtcaacttatcacaaaaagttgccaacacgattttggcgacttcgctggggagatccgttcaacgtcaactcaacttcgatttcgccatgacgaaaccgccgtcatccaaggtggaggtggagccggcctatgtgataccaatcacattggatgatttcgaaggagaagaccgcaagtccatggaggagtacatcaaggagctcacacaggaggcgttgatgagggcgtctactaggactcgtcaaggtgtgatcatcaagcccaggccacgtcctaggctcgctcccaatttggtaagcaatgaagaggtaacacaatctatccaacaccaagtagcatctacaatagattcatctatgactatttttaaagatagattagatgcaacttttgaggataaatttgatgagtttttaagatttaaagtcggccctctcttggccgattttgtgggtaaaaataaagcctctagcactgctagccaagcccctatagatcaaacaaatagagaaccgatggagtggcgcacacagctggtctgaccgggcctgatggccggtctgatcgcgacttcaccgtcggtctgaccggccaaatggccggtccgactaggtattaccccggcggtcagaccgggactcaggctggtctgactgcgcctctggatatcggttagaccgggccctggaccggttagaccggcgcaataataccgattcaggggatagatccaatgactaatgctagttatttgtatcatcttagaacatttgatcctcctgtatctactactgcaactaatccccgagttcccccacgtccatacctatactaattggacactttctaggagctctcacgttaatcagaaagatctagccgttaattaatttgttgaattatcataaccgtagatgaaaatacaatctacgtgtgatgtgggccacttttaaagtctatctattgacccaacagatcataacttgagagataaatgcatctactaaaaagaagatcaccgatcctatctccttaatgagatatacgaattcggctgcacaaagaaaaaaaaagagatatatggagcagctaaataagaggtccaactcgcggcacgacggatttcgctagtgacgggggacgccctccaggagtccaggttgcccttcgttctgatcatcggcaactatttcgacttcattggcgttgacgagagacatgcgtgcacatcagaggtcaggacacactgcactgtcatctgatgtttgcttgcatgcgcacaagttctggccgggtttcagtgaggaaggcgaaaggatatccatttagtgatggctgctacctgatcaattaatcatggccacgatgcttcatctcggattaagctttgctacaggatccgggatgatgaagatttcttattagattttctgataaaaggaaaagataacatatatattgatctatgcttttccgaataaaaactggcaactaaataatatgactatagatttcaggtgttgcgatgttgttcctctaaccgaaagttcactctttcctgcatgcacggaagatttatacaccgtcatcgcttcaaggaattcaagtaggttacttacatattgtatgtgacctatttgaagtattcttgatttctaattttcgtagaataattaatgatcatgttataataagtgttaggtaatcaggtccctgaatatataattatgtttatcaataagtgtgtttacgtagttaggtttatacagagcaaaactcccatagttcacaaacgaatttgatctattctataataattttagaactgagaactcacgttaatctctattttttcaatagcaactaataattagttttccatgtatgtcttatcatgtttcaaaaactgtatgaagccttattgttgacgttcatgcagttaaatatcgtgactaattccaatttttacaattattatatatcatgaaaactgtactcatgacctattaataacgaatttcaaaaatattaaatcagaaaaaagttataattcagtctgtcaaattggaaatattaattataccacgacgaatctacaaatgagactccaacatttttttttcttaacggaacatcacaatagttacttatcaattccaaatcaataaattaaattaaaaatactaaattgagattccaacatgagaagaaaatgagtagtgaatgattccgatttttataattatcaaaatagtggaaaggctattagtaatatcccgaatgtgtacatcttgatcaacatctattagttataaatctcagaattattaaatcttaaaaaaggctatactgagactcagaccagataaaactcaatattttaaatacaaaatttacaaatattaaattaagaaataatataatttggaattaacagctgagtttcctaaataagtataaaatgctacttgggatggatcttatgtttatactttttaattttggttttttgaacagtcaatacaaaatatattgttttttctttatagctataaaaatctacaaataattttcaaaacaatatatttaaaattttaatatttaataattctaccaatgatagccgtgcatcgcacgggttggcgactagtgttcctaatgcttataatgatgttgctagggagtatcctcctgatactaggcaaggccaatataaccatattgcgtcgcaaacacaacctattaggccaccaaatacaccaccaaatcaacataggcctgataatatggaggaaataattagtgggattattatggataaattcaggattgaaactaggaatcgtgctaaggtttaccaaaagtcgtatcctgactattatgataatgtgctgtttgctgtaattatagagttcccgaatttaccaagtttagtggtgaagattgtagaaccacatgtgagcatgtaggtcaatttttagcacaatgtggtgaggctaatagtgatacttttaaattgcgcttgttttctttatctttgtccggtaccgcttttacatggtttacttctttaccggcaaatttctattcatacttgggctcaattagaacaaagatttcatgattatttctatactggagaaactgagcttaggttatgtgaagaaaaaaatataatgagcctgtcattgattatattaagagatttagggatgttataaaccgatgttatagcttgaatataactgatagagatttggctagtctttaattgctcctcttagagaaagactagatggccaacaatttcttgatgttagtcaacttttgcaaagggctctggctcaggaaagctgggttaaggataataaaaaaattgttagaccatatgagaaaaggcctaatgttaatatgattgattaccttgaggcgagtgatagtgaagataagggtgatcatgatatgtatgttgctgaatggtcatggactaacaaaaacaagccttttgtttgttctaacctaatgccgactcctcgcaaagatcggcaaagtgaggttaaatatagttttgatgtggccaagtgtgataagatctttgattatcttttacaagaaaaacaaattagattatctaaaggccatatcataccatctcaagaagaattgaaacgtcgagcttattgtaaatggcatgattctcattctcatccactaatgattgcaatgtgttttgacgacaggttcaatcggccatagatgaaggacgattgaagttcaccgatggctccaagatgaagcttgatcatgatccttttccggtgaatataattaatttcaatgacaagaaggtgttgattcggcccgagcaagccgaatctactaaggaaaaaggaataatcattggtgaatcaaggccaaagatgatagtgccaaagaagccggaggttggtgttttgaaagagaataaaagcgaagcttcgacttctaaagctcctaggaagaccaaagtgacccttgatatgcttttggagaaatatgaaaagcaaggtggtgagagagcttgcaacaatgggaaaagaccaagatcacctcctagggagcgatttggtcactcgccaagatggttgcattcacctccatatcatcattcacaagacataccatggggtccctatccaatgccgccgctgggttatccttatccttattacatgccatggggggcaacgccgccaatgttcaatcatatgcctccaatacaattcaaccaaaggtggggaggaccaaggaggccaattcatgaacatttgtcttcaccaaacaacggctggttttatggtaagagccgggccagtgaggaaaggagagaaggaaagcgcattaaagtggaggcaaggacttcagaggtaattaccatcaaagtagggtctcatgatgtaccaataccttctggagatgaagttagagagtcctcgagaaaaaaatccgaagccggtaccagctcatcgtagtcggctggtctgaccgggccttctagccggtctgaccgcagccatacggccggtctgaccgggccatcaggccggtctgactgccgacccgacaatggtccgaccgacgcctcaggccggtctgaccgcccaccgaatgttggtctgaccggcgcatctggccggtctgaccggtggtctacgtccggtctgaccgggctccaccgccggtttgataagaggtttgcaaatggcgatgtgagggcttcatcgtcatcaattagacctaatagggggtattatttacctcctggaacagatccgaaacctagttgtcacgcccaaaaatttagcccaaatcttcagactattttgtgtattaaatccctatccaggaccagccagggtacacaaaacgacaagtgatatacagttccaaacgtaaataaagcgtaaaatacttacaaaagaggcacttagtcctcgcaccgaaacaaaagcagcagcagcggaaaaaggctatcctagcggggcttcaagctccactccacaggcaaaactcaactagggtctgagccttggtcctctaacttcgtcttcagctcagaagtactacacttctgaaaagggggaataaaagcaagactgagtccaaccaccgtactcagcaagccacaccaacgatacagatgtgcaaggggatacaaggatggtttgtggctatttgcataaaggcggttgtaaaacattttattgagcaaaacagtaaaactgttgagtaattaaagtaacattaaacctccactgatcaacgctacaccacgttgaacaggcccaaccaacccacctgaactacagtgtattgggtcgatttattaagatgggactaatcacggtgaatctggtcgaccgcccataaccgccggcacggctattcgaatagctttactctgatcagaggtgtacaactgtacccacaagacacagccccacgacacgtttccgtgtgccgacatgccaccacgacatactggaaagaggccgtgacaggacccttcgcataaccccctctagccaagcacaccacacctcaggtttcacccccgtccccagcgggcaacgggcagtcccctctcgtacctaggtgaatccggaagcgacagaggccgtcgcagggcccgccccgctccatcacgcccacccttgcctggatgcgtcagctagaggtaagctacactacaagcccagccgttgcccacgctggcttgtggtaagtacgataagttcttccagggcatcccgcgaaccggtccttaactaccatgggtgcgaccagcaaaaccatgcacccacagcccaccattcagtcgcattttagttggataattacgaccatgaagcatggccagatgtctcgagcacgcagcttactctgatactaaaaaggtctaatactgtaattatcccatcaactgagctagtggtaattaagcatggctaatcatatagttctaggtaggtcacataagtaacatgagcggcgaagcagataggtaatacctggatcccatgtaattagcaaaacatgcatatttatttgtaaacggtaaaacatttataaattgggatcaacatgctcaaggggaatgtgtgacttgcctttcttcttcacttggatcttctgaactcttatccttgcgaacgcgaacttccgaaacgacggattctacacgctggcacgcaaaacgaggaaaaactctaataaaaaccaaggaaatagtacataaaaagtaaacaaacatgtagagctcaattttagatgaattttgcaagttgaatggctcaattcggagttcgaatgaattagatatgaattttagaagttttgagccatttaaatgaatttctagaattattaacgaattatgatgtaattattatttatttttccaaagaaaaagagggttgctggcgtcatcaaaggggaggggcggcgccggcaagcgggccccaccggtcaacggcacaagggggagggcggttcaccgtggaccgggtccacgcgggtggtccactgccggtccacggaaccgacggcccagatcaccctcggggtcgatcggacgggcggcggcgacctggctcggctcaaggccggtcaagcggccacggcgacggcgacggcacgcgcgaacgcgttg

SEQ ID NO: 71299 - DNA, 667 bp, Oryza sativa
agaagatcagggagtgcaaattaagcattacaaaataaagtatattggcaaaacagtacatacatcctgatcagagggggaactctgtataagcaccatgcctccagctttaaaaccctgcttatttcagttatgaacagatcgcccaagttttccactttcttaatgacagcaagaacagaaccaactgatgcatcatcaaaaggtaacttcccacctgaaccatgccaacatggaatgttcaaaacgagcttatgacaaaccaaaatgtatactacaaggataaggtatactaaagcataacagaaatcgaaactgaacatatagcagagcaaaacagtgtgtcggttgtagggtccaaattttggaacatactccaattttggagtagtagtcatgggtgagaattgaatattgccactaatgaatctagataatcaatacaaaacatatagggagatgatctccaaaattttctcctcatgattgatgtgagaatatgaaactcttttctttccttcgtcaaccaatagcactgtctcataacctatttggtcccatatatggtgaaatgaatctatataggaattagcatatgaagcatcataaggggagtcgtcggaaactaaaggaatggtgagctccaaactgtttttcgaagaactct

SEQ ID NO: 71300 - DNA, 641 bp, Oryza sativa
cctttcattctttgaactgcatgcagagcccatcagcccatcattgaagagtgaagagttcatagaacctgttgcctacccagaccaaaacttgcttttgtttcttctcagggatcatgaggtgttcctccatatctctccacaggacacatgcactcgcgcaatgtggtactactagtctactacactgcgagctggtgagctgtgactgtatctgccttgaggtcccaagtatctgatctgaggcagcaaccaagcaaccaaatcttcccaattctcgcttgctcctagatactattaaactccattctctgcagcgccattgcctccatttctctctctctccctccctttctctttctctctcgagccatgaatgagctctgcgacctcaaggtgctcatcaatggccatcacacgcttcttcttcatcaggtacgtgcgacctgcgtaaatctttgagctcggttcacgtaatcaagcatcatctattcttacaagtgattggtggtgtttcatgtgcagagcgtcatgtgtgcgttctcggggaggttgaggccaatggtgacgcaggagaataaccagaggaagacgagccgggcggagagcctgtccgtcaagctcgccgacttccccggcgg

SEQ ID NO: 71301 - DNA, 629 bp, Oryza sativa
tatgtgacaatttgataaaaaaaataaaagactaaaaagttaaaacaaaatatgtgggacccacataccagtcaaacaaaaagataaaaataatgggacccatatgtcagtgggttcaatttcctccacctcaccctctctacctctatctcctctcttcaccggtgagccgaagccaggcggagagggaggaggtagggaggctggacgcaggtggcgaagagaagggcgacgacgagtgtcaactgatcgggacagagatatggctgggcatgaaaatggtagggcaccgacaacttcttggccctcttactccatcaccaacatcctcgtcacctccatcctcctcctcgccatcccctccacggtaaggtagtagtggcggtgggcagccagcgaggaggagggacgcagcgatccgtggcgaggaaatgggaggcaagggaactggagagatcgagatcgccattcccttcatgtaaggtggcaacaacgaggaggggcccaggagtggtgttggcgacggtgcggtggcagtgttggtgatagtgtgggagtcgaagatggaagagaattgtcgtcgggatggaggagaaccgccaccaccagcgctttgtgacgtcatgcgc

SEQ ID NO: 71302 - DNA, 1181 bp, Oryza sativa
ggtgccaattccggcgacgaaactcgacggggaaggggcggccggggtggagcttagcctcgcgaacccgacggcggcgacggcgcggtgcggcgcgaccctagcggcggctagcggcggccggagtaacggaaacggcggcggcgggtggttgcacggcgcgggagcgatggggagcacgagggagttcggcgagatggggaaaaagcgagagggggcgacggggaagcctaaataggggaggggagccccggatgtggccggtaggggcgggatttcgccggccaacgtggggagtgggggaggagagaggggcgggattcgaaaattgaatcccggccatctcgggcgcggggcgcgggtgcgggcgggagagagagaggagaagtgggtgcgggagatgcggcacacgcgcgggcgtggctgacgtggcctggagaaggcggagacgtggacgcggcggcggttgcgggcgcggcggcgccggctggaggaaggagacgggcccgacaggtggggcccacctgtcggcgtcccggggagagagggaggggcggcttgggctggcccacaaggaggagggtgcgcgcggcggggtggactgggccgacggcccaagaagaggaaaaggagatttttatttgttttctttttattttaattgatgcaatgatctttgtgctattaaaactatttcttgagctccgaaaatttgcggaaaaaatccgcagagtacattagggcacaaagaatattacaaaatattctcggccaatgatttttaaaggaaaatttaatttcctctataatttcacttgattaaattgatttaaattttaatataatttcttgaaatgcattattaattgatttttaattccgaactaaaatcggggcgttacactagtgtcatgaccagaaataacccaacgggcgttccttacgtgcgtgtattattccttgtcccaggaggcaaggtacaccaaaagttgatacaatacagagtttaacaagtggaagcgtaaatagttaatttattacatgggcggcgaaggaccagcacacatgaagacaaacaaaaaacagcggaagactagggcgacgaccacaggcgcttgacggcaggcacgagctagataccaaagcctacatcttataggaactcctcttctgggtttggg

SEQ ID NO: 71303 - DNA, 2618 bp, Oryza sativa
aacaagtggaagcgtaaatagttaatttattacatgggcggcgaaggaccagcacacatgaagacaaacaaaaaacagcggaagactagggcgacgaccacaggcgcttgacggcaggcacgagctagataccaaagcctacatcttataggaactcctcttctgggtttgggaaaaattgagcaagactgagtacaaccaccgtactcaacaagacacacccacgagtgcagaataaatgcaaaggagtacaatggagttataatataggggggttagggtttgcagtaaacagcattaaaagacacttagttgctcaaagctattttgttaatacgatcctagagctatacaatattattaatcaaggccgtggacccacacgaacctgccttaacccaaggcctgcgatgattcaaaccgaactagcaacccgacccagggtcccaactcgtcccaagtcaacccaggccatccattccatattttagttgttcaacaggtgttaagaatttaaaacactaacttaggtacattgctaggcttgcccataaccaaggacgcggctattcgaataggtgatactctgatcagaggtgtacatctttacccacaagacatgtcttcctcacatataaccacgtgccacataccaccacggcatacggacggaagacatgacatagtttccaacccatcctagccatagacaagagtaccgacccaaccccacctacggccggaacctccgggacaggcaggcaggattgagcccctagcagcaggacacccgccctgtgccatgacatctcgactaccgagccgcagctcgtgtagccttcatttgtcctagagatgtccatcgacccccgacttcgtccatctccatccgtgtacttttgtttataaccagactgagtcacaaactaagccttacccactagacatgtggaagtacggtattgctttgcaacagaggcccgaagaccggtccttatgtggccgaggtgctactatcaaaaccatgcaccccgagcccagcctaaaactattttgagggttttgaatagagggggaggtgtgaatccaattccacaatagtccaaccattccacaatgtccaagtgatatgagaattcccaaagtctaaggttataaaaccacctaatgttgcctaattaatcagcgaagcatctacctaagttcatactagtggaaccatgaatagagtacccactagttggggttttgtttatcctagggtgaataagctaataataacaataacaataataataaggtcataacaaaggtaaataggcatggctaaataaaacagtgataacgcgggaatttaaataaagcgataatgcattaacttaaatcaaaataattttataaactgggattcaatatgttcaaggatgatgtgacttgccttgctcgctttcccaaatgtcggcttcaacctccacgtagagcggatcttccgaagctgcagcgtctacacgaccaacggaaaggaaaaaggcttttactctaataaactccatataacaagcaggaacaaagcacaaaaatggttcttgacttcttaaggaaaaattagagacttgaacggtccaattccgagttcaaatgaccaagttatggccatttgaagtatatatgctctttaagtgaatatttgcgaatttctttatttaaattttaatttaaaaaagatttattgcgtcaacccaggggagggggcgcgcggcccgggtccacgggggggtggcgcccacgcggcagcctcacagtccacggtggaccgggcgcacccggctcgcaccggccggcgccgtgggccccacgcgtcagccacacacgaggacgcgaccgctgacggctgggccccatgcggcggccacacggcgcgcccgtaggtggccacgatggtgcagccggcgggaggcggcgcccgcgaccctatggtcgccggcggcggccataggcacggcgaagcggcggccgagagaggggaagggaagggggaaaagaggcggcggtccacggctcaccctaggtcgacggcgacgacgaaaaaggcggccggagcggaggaaggcggcggcgtggctcgggtcgatggggtcggcggcgttccagcggtcggcgagctcggtgagggggtggacggggtcgacggcggtgcggcgaagccggagaaggcgacgccgaggcgggagacagtcccggcaagcggagagggccggccggaggtcgtcggcgacggaggagagagagggcgacggcgcgagctcgtttccggcggggagacggcgcggcaaagggtggaaacgggcgaaggaggtgcggagagggtttaaatagggttggaagggggagagggcggccaggagaggaaggaaaccggccgggaggtccggccgccatcaatggcgccggcgagatttgcgggagcaaatccggccgtttgaatgcgagaaagagagggaaaaatgggggggaaagggggaggggatcacggggagtaattccccccacttaattgcacgcggggacagcgggatgcggcggattcggcggcggcggcggcgcttggtgcgagcggg

SEQ ID NO: 71304 - DNA, 665 bp, Oryza sativa
ttttcaacgcgacaggtgagaagtttcgacgctgagaatccgctcggatacgtggttgacgcaagcaagcgcacagatacggccttcctgcaaaagcacacggaattcgcagctcctgacgtgccgaatcggcggcaatggcatcaagccatgaacttttctgtcgtgaagaaaatattatccaaaaaggagagagggagggagcatgtgccccagctgatgggaccacgatacggggctaataatttcctgaaacttttgtcgtgtagaatatcaatggagatcttctagcaactggtcaatggagtcaagtgtacatataacacatcgcaattaataggcatgggcggagtcagaaaatctctaaaagtaggcacaacttgcttattctctactactatgcatttatatgggtaaataactttttttataaactatgcatttatgcgggtaaataacttcatgttcaaatagaacttggcagaaaagaccttaccttattcagatcggggtctgacatcttctattctcactaaacaagttagagaaattaaacgagtaatatgcaagtttaggtactgggatgacacagtcgaataagtttgaggatctaaacagtcgatttgcgagtttagggaccgggatgacacaacggtacaagttta

SEQ ID NO: 71305 - DNA, 3801 bp, Oryza sativa
atcttccttggtaataacaaactgtactaagcctaccatgaaaagttgttacatattgatatctcattcatatattttactaatacctcttagcccactaccgcctctccaaaagaatctgggacgctgtacgtgattggtcactccttcatatccaaccatcggaatgggccaatgttgaaacagtacaagattggtgaattcaaatcacctcagcacaaaacatgccaaagaaagctctcaagttgataattatacttgttgcatgggaattatggaagaaaaggaactcaaggatcttcagtaaccttgcaaacactccggcctccatcatggcaaaaataagagcggaagtgcacaggtggctaatggtgggggcaaagtgcctaacagagctctacccgttatgtgagcagtcctttttactcccttggtctgggatgaccctaactcccatttccttatatctatggattctacttctctatcaatatataaggcaaatttcttgccttccttttcaaaaaatatatatatatattactaatatttcttgattggcatatacatatgtcccgttcgaacagtacggccacgcaaaacgaaaaagtcaatagcgcatgattaaacgatttttaattatttcaaacttattggatttatctaatattttaaagcaacttctaaataaaaaagtattttttaatagtttaaaaaagtgctaatggaagcggaagtaaaatctgtatcttaatcagaaaagaaccaaaccataatgtacatgtttggttggatatttggttttggagatttttcaacatttatatcgctaacatatatatcattttcttttggttgtctgtttttaccaggttcacttcctgatgaccctacacagctactctctccgtcctaaaaaagaccaatcctagcatcccaatgtaaaattagtggggagaaaaaaaatgtccaaaatagctcattattggaaaaagtagtaattgtgataggtaggtgaatggtatttaagggataaaatttctcgttgtatgtgttgagggtaggtaggatggtagaagttggttttttgtgggacaaaattcaatctccaaaagttgggtttttttagacgaaggaagtactatgaataatatgaattatagttctttcattgatgtcttgataaatgtgaattacgactacaatatccaaggctctgcctatatataaaataccgaactctaggtctgatatcttgtatcctattagaccacgtggcaacatatattttcagctaaataccatctagaaatctgccatgtgtcctcatcatggtcacaactcacaaacagttcccaccgaatgtgctagagctattgtgcctaccggtcacatgctgctccctccgtcccaaaaaaagataaactatggattcttgtgctaatgtttgactatccgtcttatatgaaatttttttataattagtatttttatggttgttagatgataaaacatgattaatactttatacgtgacttatcttttttatttttttttataatttttttaaataagacgaacggtcaaacgttggacatgggaatcaggtttgtcttttttttttctttgggactgagggagtactacttgtcttaaagaataccagtgaacagatgatgtgtcttaataaaatgaatagttaaattacttggctcttgggaaatatgaaggggcaactcatttacagggataagctaataaggccatcggtttggaaggtatcaaccagattatgagtatttggaagatattaagatgtaaaattaattcccttcaatccttttccatcatgattaaatgaataaggtctaaagaatactccctccgtttcagtttaataattcccttagcaatgggcatcaagaccaatgatatcaaaacatccatcattctaaaattaatcctcatcgatcaaggtgcactttcgcttcatgtttaaaaaaaattaattcacactttaaatattgcatgagttgaaaaatagaaaataattatggttggctacatgcatacagagcattccacaatgcacatttactctttccacaaataaacaaagagacatttcgaggaaacatcaaaaaccttacatgatgattaaactgtgatagagagaaaacctcaaaaagctatatattagatataacatatcagctcacaccttttcccgcctattataaatctgattatccacattgcttacaaaatttttaataaatcccttttattttatgattgggaataacttctatattagccatttttctggtctcttccatgtaagacgacctttttttaaaaaaaatgcactaatctatactttcttttgctttattataattttttattggatgtagcgtaatttgttcttctcttgatgggcccatggtgggcctgtggccttttttttttccaaacttccatttacccatgcttttaaaaataaacacatttttcaatttgtcgaaaaatttgtatgtttttggtaagaattttgtaaaaccttaaataattcataacttcaaaataagcagtactgcatatagaaaacgagtatatgtggttgcataacttttttgcataaaaaatcatcattaatatatattaaacatatcacaccaatgcaatgggtatactttatttcaagcattaaatggataaatacattaggtgtacctacaagcccatatcatttatattatcatacttgctagcccattgcacggcttttgccgcgtctattttctagtgcttcctttttttttctaaattacacagaaggcttttgccgcgtctattttctagtgcttcctttttttttctaaattacacagaacaacgcagataagtacgtcgtctaccactgaaagcacaacgccgttaaattaaatcctgaaaaattcgttcctatgggaagttgaacccaaaaccacaagtgctactgaggctcttgtaaccactaggttacaggccctttcgtattttctagtgcttcctaatcgcaggatctgagcagaatacttgtatgtaaacttaagcgcagtgcaatattgttatttcaatgtaaacatgtggtctgaggatacacacgttcttaactgattttttttctttttcattttcaaacattgattaagtgaatttttgtttttttttcattcaaagtaaaatatttgctttttctcgcaaatcatctcggccattactgttgttcctattgttgcttgggacattcctaacagcagtattagtattggctgttgattttggtggtggtgcttaatcatgatataaatttatgtcagctaatagtttctagattcgttgtatttggatatgtcacatccaaccaaaatcccttatatttagtgacgggggagtaagtccaagtatatataatactaaatatagaccatactaattaacctattaaaaaacaaattagggtactgaatacgtgtaacatatttgatttaatttatatttcattggcgcgcgttgcacgcgtatgattactatataaaaaaaattcgtttcatagcgtcatctacaaaatctcatccgtcgccgtctccgcgctcgcctggtaatccgtcgtcctcgccgggtcccagccggacaacggcggcgccggtgccaacgccgacgctgacgcgcgcgcgcccctcgtcttcttcgccgactgccgccgtcggctggacccgcccgtcgacccggcctacttcggtaactgcgtcgcca

SEQ ID NO: 71306 - DNA, 7512 bp, Oryza sativa
tgtcttattctgcctaacttaacactaatatttgacacactatcaattgttagctattgatatggcagtttgacatcgaccctgctccatcattattactgcatgcccgcccattcgatgattgacttgaccaaacccacaagtgcaaattggaaaattaattaattaattaattagcaagataaatatatccatcagggattcaggatcaggtcatggatgtaatcactctcaaacatagctaatcattgtgcttatggtccaagtgatcattccccctaatcaacaactcgcttgctagcaagacgtcccttcgaatggattatttgatagctagagcatatcaccttgcacttcaccactccccttatgcagagtgtacgtatgtctaaccagaatctagtggtgagcgtaaaagatcaaagtgcccttatcaataacaaaatactccgtaatacatttggtggatatataggtatataagtattaaaggaataaaactttcaaatttgtggattctaataaaaactaatattaattttgataaacctgaattgtagatactctaacttagggtagtagttgaagcatgcaaagctctaaaaatatatatgaatttcggcgtgtttatatatatttctccgtggatataaaagcttaaaatttataatcattttatgatgatcaggtgacggagttcagttgcggagggttcgtggtgggcctgatctcggtgcacacgatggcggacgggctaggggccgggcagttcatcaacgcggtgggcgactacgcccgcgggctggacaggccgagggtgagcccggtctgggcccgcgaggccatcccgagcccgccgaagctgcccccgggcccgccgccggagctgaagatgttccagctccgccacgtcaccgccgacctgagcctggacagcatcaacaaggccaagtccgcctacttcgccgccaccggccaccgctgctccaccttcgacgtcgccatcgcaagacgtggcaggcgcgcacccgcgcgctccgcctcccggaacccacctcccgcgtaaacctctgcttcttcgccaacacccgccacctcatggccggcgccgccgcctggcccgcacccgccgccggcggcaatggcggcaatgggttctacggcaactgcttctacccggtgtcggtggtggcggaaagcggggcggtggaggcggcggacgtggccggggtggtggggatgatacgggaggcgaaggcgaggctgccggcggacttcgcgcggtgggcggtggccgacttcagggaggatccgtacgagctgagcttcacgtacgattccctgttcgtctccgactggacgcggctggggttcctggaggcggactacgggtgggggccgccgtcgcacgtcatacccttcgcgtactacccgttcatggccgtcgccatcatcggcgcgccgccggtgcccaagaccggcgcccggatcatgacgcagtgcgtcgaggacgaccacctgccggcgttcaaggaggagatcaaggccttcgacaagtaaaatgcttgtgaaatgtgaactttgttattgttactacttctatgggctcgttgctcaatgggcttttttttgcttttgttttgtgtgtgtgggccgacacgattggtcaaaagggatttggtggaggcccagttgtaataagatggtccacgcatcatggattaatcgttaattgtaaggtagtactacacggatttgttaacaaggaataagttcacttggtgacccagtgatcggaatctaattcatctaaaccgcaaaaccggatatctcgaccctcaaattattgaaaccggtgcaatttgactccctcggcggttttggagggcggtttcgctgacgtggcgctgatgtggcggtattgacctagtatgtgtgctgacgtggcgcttaggtggcatttcaattaaaaagatttacgtgggacccttttgtcatttacacacgcagttgaggggtccactgacatgtggcccccacatgccatctcatccttttcttcttcctcctctcctcccttctatctttctttctccctctcccctacggccgtccgcggggagcgagcggcggcgggcgagggctgaagcaatggcggccagcgggagtttaagcggcggcggcagcggtaggctagagtccatgtcgcgccgctcgccgttcctctcgcaccaccaccatccgcaccacccgacggccggcatcgagatgtcgtcggcggccgagctcccctcaaaacccgagagatgttccgggtgtcgcggcggctggcggagactgcggcgagcggcggcggctgcacggagtcccgagcggcggaggcgcaggtgtggagcggcagccggcgagcggcgcggcggagacgcggatgtggcgacggcgacctgcaggtcgagcagggcgcggccgagctcgccgtaccccgccgcgtgtacctcccaccgccaccgttgtggtctccttcgtcttcgcggcggtgaagctcagctcgggcgccgccgccgcccgcaggcgatcagctacgccgtccgctccggccgcctcgacgggcacgcgctgctcctccttctcgcagcggatattataccccacggtgaacgacactatggacacgcagtatggcgacgagctccaagccgtgtgcctgccggacgcggaggagacggcgtgggcgcacctggaccacggctcgccgggaaggtgctggctattcaacttggatcactgggcgctgatcagcgaagcggcgacgaggcagatggtcgaggacaacgcggtgaaccagtcagccctttgcttgttggcttgccgcttgacgttagtacacacatgcagatgcctcccaacacgcgtgtggtcacgtcgttgtcggccggctcggcacgccgaccgcgtccatcggcggcggcgccgcctcccccgcctgcgccactcctcccgccttcaacgccgccgccgccgcaggtgcagaagaagccaccaccagatgccgccatcttcgaggggatgccgacgcgagtcgcggtggcgagacgtaggcggcccttacacgttcgtgggcgcggcgggagaacagcggaggcgggtgcatcgtggccggcagagagggcgtggagcacagtggaggatagtgcggtcgcggggccgagggtggcgaggacgcgaccgttctgatggcccgttttcttccttccgacggccaaccttccacggcggtctcgatctccgccgccaccgctccggccctcgcccgcacgccaccgtcgccgctctcgggtctccgccgccactggcccccgtcccacactcgcggagagaaagagagagggatatgatttatgtgggccccacatgtcagtgggtcccacccatacttttggtgaatgaaaaatgggtcccacgtatattttttatttctaatgccacctaagcgccacgtcaacgccacatggacagaagaccaagtcaatactgccacgtaggtgccacgtcagcgaaaccgccctccaaaaccaccaagggagtcaaattgcaccggttttaagagttggggggtcgagatatccagttttgtggtttaggaacacggattagatttcgatcacttttgagggtcacgaagtgaacttattccaaacaagaatatcttatcatccttttgtggctcacggtgaaataatgggccgcctatgaggcccaaaaaagattaggcaggttaatggactggaataagttccccggctcccctcccctctccctctccactctcggatcttcctctacctctcaactctcccccgtcctcacggcggagcggcgacctcgccaaggacgccgcgcgcacctccgacgcgagaggagcggcagcgcgcgccggccaacgggagggagggagaggagcggcagtgcgtttgggtcggcgaccggcgggagggcgagagagaaacggcggtgcgcggctgccggcgggagagggttggcggcgcaagctggccgatgggtgggcgggagagaagcggcagcacacgccgcgccggcggagaggacggccgacgggagggcggaagagagggccgccgagcgccgcctccctcctcgcccggccgccgcgagcggcccctcctctcacccgggcaccacgcgccgctcatcccaccgccccccctttgcgccgccgcaagctgccccttgtcgcccggccgctgcacccaccgcccaccctctgcgccgccgctcgccattctataagggagggagagggggctgacatgtgggaccacatgggccccaccttttcttataattttttgtgtagctgacatgtgggtcccacgtttttttattatttttccgggattcatttgccacgtcaatgccacgttggacgaggacctagtcaaagaaagccacgtaggcgccatgtcatccaaaaccgcgcaaaatactgccgagggacccttttttttttgtacggttttgtaagttgggggacccgtcatacccggttttgcgaccgagggacgaaagtcggactgggcgacaaatagagggacctaatggactcgatgctatagcccagtattaaataagccttggctctggcccacgtggaaagggctagattgtaagctgggtaagatgaaccgtggcccgtgggcctggattgtgcatagctacggttacttaacttggcccggaacaaaagtggagattacaccacaaaattaatacataggactcttttggttttggaggggtgatgatgggtgagaggatgcatgattatttttcttataatattcttatacgaaatgttgtcattcttacaaagagggagatctttgcaaaaacaggagatgtacaagctgcaaagtatggtgtgataacaagacgtatattgatgcatgaatatgggaagccaagtggtaggctagagatttaccgttgtctcttagacagaatttatgcctggtcgtagtcgtgggcgtgtgagtgtgctgtgtacacatatgcgtcgctttctacgtaatcagaaaatatataagtatatacccaactgaagtcatgtagacatacgtgagcagcagcagcagcaacgctagcaatacaccattcagtataagccattgggcccaagcagagcaacaagattatcagttagcagcccaatcatagcagaagccagcagcgcgcaggagctgcatcagtagctagctagtagcccagcagcccagatgaactttgatgctttgggaacttattagaatatccgaatatattcttcccagattattatcgatcggctcaaaatatcagatagttagggcagatgtttggaggtatctatatctgtatccaacaagggatcccatccaacaactactccgcccgttatgcatattataggttattttgtgtttattctaagtaaatttctttaaattaaatcaagtttattgtatgaaaaacgtagccacatttataacatcaaattagtttcattaaagtcatcatgaatatatatttttataatatatttgttttgtgttgaagtggtgagctctctcgcttggcaacacgtacccatcgccgacaccaagccctctcctcctctcagccatgcctcatcgaaaggcccaccaaaccacaaagacgaaaacacaattttgtctggacggatgggcgggggcagtgtgcttgacattgtgctgtttttggtgatgtcgccattaacattctttcgtgtgtttgtttggctaccaactgactaattttagtcagattgatggatcgaacagtcacttcgggccttgtttagcaagggatggtcgcaagagtttgggctttttgaaggtcgtcttcggatgggttttttgcgcggcagggataaccaggtagtagaagaccgttctttagtattacatttcttgcaacaaagtttgtttctaacactaatacaaaatcacaaataggggacatactcaaacgtgacagttcatacagcacatacgaggctttttccatcattccgatcctcaagcaggcctaaaatagaaaaatggcactaacaataagtgtcgtcccccgcaaaaaaaaataagtgtcgtcgtttttttaataaacatgcatgtatactttgagatactaggtgaaactccgcgtgttgctgcgggagttcaatatgataacaataagtaaaaataatgtgtaatatagctaaacaacataaacttacataagcactaaaatcaattaatgtgatatggcttaattagaaaagagagaaatatcattaaccaagtgaggatgaacttacataggtacataagatatataaaaaataatgaagatatgtattgaaatattatgttaattatgtgggatgatgatttaacatgctttcattttaaaagctctaaaatgtaatatattttaaattatagataatatagcatgtttgcatgtgatattaaatgtattgattgttagtggatgataatgtgtcaacttgttagtggatgatgatgtggcatctttgtatgttaagctttaggagttagtgggttataactttatagtaagataggataagtgccctttttttttaaaaaaaaaatacttttagtgggagctaagccaagccgatgccaatgtcaagcgtgcgtgaagtaggcgtccttatcctcccatagcgtccttatcccctcggtcactccatctccttagctctgcatcttccgtctctgttcatcttctcggcatggcatggcgcgtcagcggctacctcttcctctcctcagccttgcgtggcggccactagattcagctagcacgaactcgaggacgatcatttccggccaccacaagctcgggacaacaaaatccatgtgcggctgcctcttcctctcccttgcgtcgcgtggtggcatccgcctcatcttctccccgacacggcggcgacaatggcctcttcctctcctcggaccagcacgatggtcatcagatccagctagcatgactccatggcggagatcaggtagacttctaattggagtgatggaactattcatttgtgccaaaatttgtaatcaatttatgtgaattgtgatgtatgattctttattttggtgggggtgttcttgttggatggattgatggtgatttgtgttgtgtgatttgtgcggggatattgttgttggatggatcaatgatgctatgtggataaatcatgaaggtgttcttcaatgtggcatggtctgtgggtgctaagtttttctttttattcatggaaccttaaatgtatcggtttcagaatcgacacctttaattttacctcatcagtaccacctaagaggtgttgatggaaaatttggtacttatgtggggttcccaactgacacctattattgttctgtagtagtgtaaataggcgagtgatatgcttgatgaact

SEQ ID NO: 71307 - DNA, 6680 bp, Oryza sativa
ttgccaattttgataattttgctattagacatattgctaggcatgataattctagagcaaatgacttggcacaacaagcatctggctataatgtgaagaaatgattatttctgatattagaagagcaggtgcttgattttaaatctttgtgtgaaattggcaaaactagagaccaggggtggtctgaccggccacatgccgtcggtctgaccggcgaccccgagtggtctgaccggttcaatcaatttagaggccgaattaattataaattcgaacatttgtgcctaggaaacagaggaagattggaggattcatttgattcgatatttgaaagatcccacacttaaggttgatcggaaaattcggcggcaagcattcaaatacacattgcttgatgaagatttatatcgccgaaatatagatggtgtcttgttgaagtgcttagatgaagatcaatctaaagtggctatgggagaggtacatgaggaatttgtagagctcatcaatcggcccacaagatgaattggttgcttaggagagctggattttattggccaaggatgattgatgattgcttcaaatattatagaggatgttaagcttgtcaacagttcagcaatgttcaattggcgcccgccgccatgttgaatcctataatcaaaccatggtcgttccaaggttgggctttggatttcattggtcaaatttatcattcgtcattaaaggggcataggttcgtgctagttgctacagattacttcaccaagtgggctgaagctgtgccgttgaagaatacgactcatacggaggtatttgactttattttgaagcatgttatccatagattcggtattccacaaacattaactacggatcaaggtgcttcttttatatctaaggaagtgaagaattttgccgaatcctatggtattaaattgttgagttcttctccttactacgcttaggctaatggacaagccgagtcgagtaataagacattgttgaaactagtgaaaaagaagattgaggaacacccaaagaggtggcatgaagtgctttccgaaccattttgggcgcataggatatctaaatatggtgccactaaagtcactccttttgagttggtttatggtcaagaagccattttaccggttaaggtaaatcttggttctcttcgttatatcaagcaagatgatttgtgaagtgaagattataagacgttgatgggagacaaccttgatgaagtcatcgacaagcgcttgaaggctttggaagagatagagaaagagaagagggtggccaaggcgtacaacaagagggtgaaagcaaagttgtttcaagttggagacttggtttggaagacaattttgcctttggttactcgatccagagagttcggtaagtggtctcctagttgggagggtccttatcgagtatgcagcattgttcgaggaaacgcatattttttggagacacttcaaggggagtgttttcagcgagcaatcaacgggaagtacttgaagaaatacttcccgagcgtttggcaaaacgcttaaggaggtactatggccagtacttggattatcgtcctaagaccaaaacatgttctacgcttttagattcacgttgttcatcaaaaaggcaggggggcatgtgtttacacccaaatttggcacctaggattaaaatagggaaaattgccaaaatttggaagtctatcggtttccttcgagtgggccggtctgaccgccggttgagggccggtcagacaggcggtgtgtggccggtctgaccggcaggtccgagtccgactgtgtttcatcgtgtctcgaggtttacttgctcgggaaggcatgtttcgggtttcctttagtttctaccccgagttggacgtggaggagggcttgtagagggcaagactaacctctatataagggacatggccggttctattgtaagaaaccaatctacaatcaatcaatcgaatcattttttcatattgcttttagttttctcttagtttgtccatctttatcggtttgcgccgtaaaccgtctgccgccgctgcgagagtgtgatatctctttgtaggtttgtcctgaaaaccttccgttttgcccacgagatgggtagttatcttaaatcggcttcgctagcctgtttatttgtcaaaacccatctagatttagctctttgctagatcgaggtggttggtgactctaggatcactgcaaggcataaggtgctgcaatcgttgttgtcaacttatctcaaaaagttgccaacagtacgtatgtgttttttttgctttattgatctttattcatagtacgtctgtgcgtaggtttatatatttttcttcagacgaacagcaggtacgtctttgcgtacgtctgtacttctttgtttttaagtcgtacgtacgtatgtagtacttgcagttatggcagttatagttctaccgtatacatatagagattaaggaattagtttcttaaaataaaatatatcatattaggtaatttaagtgaaaatcgacgttggatttgacagtgccacgtggtagttttggagcgtttgtagaagtgccatatggcagtttaagagtgtttataaaaagtttaatgaacttttagtatataatagatagatattttttatataacaaatagattttgccttcatagcgcaagaaagcagaggtatcaagcagaaacaagaaccagagtatagttaagcttgtcgatgaatgtcatttttttttaattgtatgcccttcatgacctgatctgcagagatgggataaactcaagattgtatatgttctattgaataagaattacatgatctattatgtatatttgtgattaaagtattcttatttctcatttgagcaatatctaatcaatgattttgtataaatgttgtaaaaaatcttagacatatcctttgtttgaaatttcaaactgtacatttgacctttaattgtcagtgtatacaaacagttagtcttgttttgatgcataactccttcaattgacatatataatttatttctataataaaaaggggtattgcatattaaataaagcatcttatcatataatttttggatttctatttttgacttcttgaatacataataacatggtatttggatcttcgaaacatttttttttctgtgtttatcaccactgtgttcatatgaaaagtcaccatagcgttagcacgggcattttactagtaatataaaaagtaccagttatttagttggattaacacagtgattgcgattagcactggattaacactgtgatcagcacacgaagcaaaatcaacattatcaatggtaaaatcaggtacatattcatgtgtccattgtgcatatagaagtgcaataagaattttattgcacatctcattcattttttcaagaatgttggactgattttcaaagtgaccaatacattttaactctataccattgtttctgtctatagtaccatgcttcttagtgctatgcctattttcatatatcgttctcatattatatacagcattccattgtataacggttcatttttcattttattagtggctgccaaactgatggacaaccttcttgtggtgagcaacccatatagtctgataagctcaatctgcctcacacttcttccatggccacagaaacagctagccaggtaggataccaacattttcgtgtttaccaacattttgttcagctttcactgatatagctaatatatttgttgtcacttcctgtagatgaaagaaactgtatctgctgatgctaaaaagaaaaggtatgcttctatatactgcagagctagctaagtcatgtgtgttctttacctttcacgcacatttcctttcctattatcattgctgaatatcctttttcccttttcttcagcgctgcttcggctcctgcaaccacccgcacccctaaaatccaggcacagaagcgaacctaaactctgaaatggtactgggtatgcacctagcacccataagttcttaactcattggatgacatattattgacaaggaaactttacactaatggcatgttctatttagcactttaaatatgcaaatgaaaaaactatcagagagtgatgatgacatgtatttacaaactgtttgcatttaatttcagaagcaaactaagtataaggatgctccacccactgcaattgatcttttcaaggagtgccattgcaaaagcaagatgggttttaatgagcctgtaaagaatgttattgtgagttacttttttcttttatcttttgcaattatattttaatgagaatgaaatgtgttttgtgatttcttatcttcctgttgctaggctgtgatagaagttatcattgataatcctgcacaagaagggcaagatatgattggactttgtagatatggtcagtgatgtagaactttgttttgctatctaggatatggtggtactgttgttttgctcaccgactgaacctagtttgctctcatactgtatttggaatgtgtctggttttggatgttaactaggttgtaagatttatgttgtattggatgttcgtcgggttgtgctatatgggttgttatcgtgtttgattgttgggcatatatgggcttagcccacttattatttgatattaatataaatgaatatattatgacgggctcaaaatggtgtggtacaatgtttgggcctttatgggcttttgcaatggacttgtcacattttgcaacgtgacgaaaaattcaatgtttgtgacgtaaatgaagcgtcatctatcataagatctctagtactgccacctttagcaacgatgccatcatcgtggcaatataggggatttcctatagcatccaatatgtttcggtggcaatagaagtacccacctatagcccctgttgatatttcttacccaaattactagaaatatattttccagcaatgacgcataaatattcctggtatattatggttatagagtttatccgcaagcgcacggatataccattgtagcatttcacccgagagtattccaagggtatcatatttattttatcccgtgggaagatcatatagagagaacttgactaataatttatatattacttgtaataatcatattctaagcaggggttaaaataatccaagggtagagtgacacacaagcagtagttactcattctcataatatattatctaagctaagtggaaagaaaagagaaagataatctattcctatacttctaatatacatagtatacatacattctagctaacctatatactagctaataccctctattcgatgccctcctggtactccgagaagccacccctaacagccgagttccttacgacagcccaccatgaccatacaaccggggctaaatacggaggaataccctccccaggaaattaacttaggattatatacacgcgcggaggaatacccgtactgagctgtcaccatcagcggcccacctctcatccgcagcatataaccccaaataatgatatcccgtaatctagacaccatgtctaaactaccagatactactctaatatcatcgtaatgacatagagtaattgcataagcaaacattatacccgcaccaaagcatctcccagataagctagccgtatatttagtataacatgaacataatgtaaagtaggcattcatatactcggaaagtatttcaataccataaatgtatatagaagagtattctaataaaattacaaagcttagaaaagaggaaaggaaagctactagagccatacccgaactcttccgaagacttccggactcctgatttctactctattcctattccactagctagatactactaaactaaacttgagagaatatgagagagctcttgcttgaggtgtgtgagtgaagttagaaggtcagggtttatatagccttccaatgacggttgtgatggttggaatggtcggaaataccctccaaccgtcattgggagctaatccacaccgtccagaagaaaccctgcatccagcggcccaaccagcccatggtttggctggcggcctcctctgttgttagacatgtgaattttggcctagtttgtcgtgtcaattctaagttcttggcccattcatatataagtctggttctcgacatcgtccgatcgatttatcgtttgagttgatgtcgattctcctccactttatggttattctctgtaaaaaggttagtaaacctaatactagtggaatattattattctaacatgtatatgtattgcaagtatcaatagttctcctttattttggtaatattgacggtcgaaactgatcgataatgaccgtcaacagccactaaaactttaatcgtggcaatagcagtgcccacttgcagcaataacaaaaaaaatatagtggcgatagaagtggccacctatagccaccaaaccaataagcgtagcaataccgatgcccacctatagcaaccgaaaaaattcaagtggcaatagaggtgcacacttgtagcaaccaaacaattctagtggcaatataggtacccacttgtagcaaccaaatattttgagtggcaatagagggtccaactatagcaagagacatgtgtagcgtggcaatagtgggatctatc

SEQ ID NO: 71308 - DNA, 1811 bp, Oryza sativa
attcctgcagcccggagagagagagcgacggcgcgagctcgattccggcgggaagagagggcggtgagtggcggaaacggtggtggggagctcggggagggtttatatagggttgggagtgagagagggcggtcggaggagggggaaacgggcgcgggagacccggccgccattaatggcgccggcgaggttaggggaggggtttccaaacgaatccgagggagagagagagagggaagaaatgggggaaagggggaggggatcccggggaataattccccccactttattgcgcgcggggacggcgggaggcggcggcgctagggcgtgggcggggcggcgggagcggcgggaggatagggttgacaggtgggccccacccgtcagcgagggtggcgggcgggcccgcccgtcagcggcgcgcgcgcggggagaggccgagtgggccgcggggagaggagggagaggggagggagatgggccgggccggccagagagagagagggaaggaaaaagagagggagggagacaggactttggccgcgggccgagagagagagagagggaggtctttgggccagacttggcccaaagggagaagggggattatttttagctttttctttttaataaactctgataattgtttttgttgcttaataattatttccggtgctctgaaaattcaagtaaaatttgagggctccttttagaccaaggagaatttaacaaaaattctccgggccacattcgaatttttctggcacgtattttagtgtttgtcaatttcttttcgaattttaattaattctattattccttttagaaaatgatttttatttcgggatgaatttatcaggacgtgacagaatcatcagctaatttcgtttggaaattcgaggattcgagttcgattcggatcgatctctctcctccgagccctagactttccttctcgtcgccggtcgccgtgggcctccgacgctgccttctagcccctataaaaggacccccggtgtcgccactacccgtcgccaccctcgccttcgtctctcgtcgtcggaagcgccctagcaccgtgtagccccgcgccaccatcgtcaccgtcgctccagccgtgcgccgccgccgttccggtcgtcgtcgtcgctcggggaggtcgccgtcgtggtcgccgtcgcgtcgccgtcctcgtccgccccttcgccgtcgttgaagaccgtcggagcaccgtcgccgtcgtcaagccgaagagtgccgccgcttcttcctcgacgccgtcgccgtccgttgatcttccgccgccgttttggtcaccggtgagttcgccgcgtcgccctctacgtgctggtgccctccgttcgcgtcgccgcgccgtcgttcgccggcgagtttgcaagcccgagtcgccgtaggtgatgacgtcatcgccgacgtcatcgttgccgttcgtcgtggtccggccgtggaccggtcgatctcggccgtccgttttggatggaaagatcttggccgttcgttcccgtgaaccgctgccgtgcgcccggtccaccgcaaaccctagccgctgacgcaataaacccctttttccttttcaagaataattcattattgcgtcataattcaattaaaatccatataagtgttttaatccgatttaaacttcaaaaattcataactaattcatcttagctcggatttagttggttcaagtctctaaatttttctaaaattgagatctacatgttaaaaatatccacatgtactgttcagcttgtttatgtgctgtttggtgattttgctctttcctg

SEQ ID NO: 71309 - DNA, 17726 bp, Oryza sativa
cctatttgaatacatgtcccagtcaagggagcagaacaataagaacggaggtacttgacacttgaaagcttggaaagttcattatttttcagggatttgttcctattttgacagaagcaaacgttttcaggaagcacttctcatctctctccaatacttccaagaccccattaggcgagctggatagcaaatgtgggaacagttgcaaacttaacaattagatgcaaaacgaaaggtgtgctagtgtggttcaattccctcggtggaatatgctcatggtcattatgttccagtgaaaaggcacttcatcttcagtgatctcaacacttattttcgaacacctgtgtttatttcactgaaagagagctttaggcggtcgtttacccatttcaactattgaaatctttttgctgggcaaaccttgggcaggtagattgtttcgtgcctaagagcagctatggacagttgttaaacgcttattgggtagccatgttttagtgaagattgttttctgaccatccaattgcatctatcccaaatcatgatatacatataaattaaatcttgaacagtaggtggtggccgtttttatttttccgcagatcattccttgattgtaccaccggtaatttcgttcttcatttcaagcgctgtccaccttttggcctcgcttaagatcggtgtactacatatgccggtaatcgagaacagtaaagtggtggccgtttttatttttccgcagatcattccttgattgtaccaccgcccaccggtaatttcgttcttcatttcaagcgctgtccatcttttggcctcacttgagatcggtgtacacatataaaaattaagaggactatagttaccatgaaggccgaatgtctttttacggactgtgccaattaggagctcaactctagattattcataccaacatacatatgtgacattctatgatttatcaatgacgaattgacgagcgctcgtttctataatttccattctcagggaaaaatatttgagtcaaaaaactttgtcatgggtgacttataaagcgggtaattttcatttctagcatggtttgatggaagtcaggaagaattcctgaaattttgttcaacttaggttggagatggcaaaaacaatctgttttgggaggataattggtatggtggcagacctctgaatttgcagctccttgctttatacaacattacccatactagacatatcacccttgcaaaactgaaggagaaaggatgggagattatcaaattcagaaggactttgcatggagataaacttagagactggattaaacagagatggatgcttctgaatttgcaagaaggaataaaagataaaatgtggtggaatctagaaaagcatggttgcttcactgtcaaatccttttattaaagctcttaaaagggagcaagtggcattcccatataaaaaaaatctggaagtttaaaatacctccgaaaatcaagattttcctatggctggtgttaaaaaacagaatccttactaaagataacctttttaagagaggttggagaaaatgtgataaattgtgccaattctgtgataaggaggagtccatacagcatttattttttgaatgctctgttgctaaattgatctggaatgtgatgttgtgtgccttgaatataacacctgctagagataaaaaccatatgtttggataatggttatctaattttgacaaacactctaagcaacttgtgatggtggggggtggcagctgtattatgggccatttggaagtccagaaacaaagtgtgttttgataaaaaatggcccaatgatccaattgagctgatatatcttacatgtcattttattgaaaattgggctaacttgcagaaatcggaggcaagacaaagaagcttaatgttgggagccaagctggcaagacaagtggcaagtgaagtcttcagttcccgatttgggtggagaatctatgcaagacgtttggaataaagaagttcaggagtttagtgttgctgagttctttgctttgctatggtactactcggttaggtctgccctttacatcttgttgtctgtgatctggtgatctctgtaaagcttgccctgcagaaactgttagtctctcttgtcagggtgctgctccagtaagggggttgtgtttagccttttcctttgtttttttacttctgaaccctgttgtacttgtcgtttcatttttagtaatggaaatgggggctttccagccctagttaaaaaaaaattgtaacgtgtttttctttcctttttgctattacagttagttaacctctgtgttagttttttttcatttgtgctaattttttgacaaattttgttacaggagatcatgactttatggttttagctgtaggacactgtccgaagtgacttttagcggaagacactcttaaaaaatggatcgtggatatttgctgatgaacacatcattagttaaaataataattttcggttgaagaggagagagaaatcacattaaatatcaaaaatgctcttggacccacatttcaactctcctatctctcttctctctctatcctctcctccagcgccgcatcttgggggattttatgggcggtgcacggttgagttcatggacatggtggcagcaatagcggcgatggcggaggtgtcgacaccgccgagcctggttaagatgacggagaaggctctcgatgagatgccgcagtggtcgtggcagagcgtggtggacatagtcaggtagtgccagcggctagctgcacccgatggtggacgctacagggatgttcgaccaggtcatcggcgcgctggtgtcccacgtggccatcaccccaggggacgccaccctgacgagcttcctcgccggagagctcggtgttccggttctcgtgcgacaccaagagcagctgcctcagcgtgcggtgcaccagccgcacctagtggttcgaggacctcgccgtcgtcctcagccccggcatgttggagcgcgtcgccagggcgcgctaggggcagccattgtaaacccgatttgcccgaccggtgacttgacgcgtcaggagctggctattgtcacgcccggaaattctgtagtaatttccgaactaatttgtgcataaaatcctcgtccaggaatcagccgaggtacacaaactgacaatttaatatacaaatccatcttaataataacgttacatacttacaaaagaaaagaaaacagcagcggaataacgatctagcgatgacttcagctccactcccacaggcagctcaactggggtataagccaaacgtcttctccttctggatcctttatcttcaactgaggtttgatgattattgcaagaatgagcatatgacatactcaacaaaccacacagcaaatatgcaagtgcacaaggataccaaatgatggcataatataggctcatttgcaaaagcagcatttagcaaaacatttaagagaagtaaaacagtggagtaattaatcagaaattttaatcaacactgagcaacacacccatgctgcacaggcccaaccatcctgaacaaccatacccggctgtacagttctaactccaaaccaggagctaagcaaattattaccagttataacatccataattattgtgaggggtgtgagactaatcacgaaaaacattgctcaactcgcccataaccgcgggcacggctattcgaatagttttactctggccagaggtgtaccactgtacccacaagacacgattccacacatgttgccatgccccgaaataccaccacggcattgcaatgggggaaatcgtgacagtaccctttgcacaacacaactcaaaacagtgcaccgttcctggatcataatctccccctcaaaaccagaggcaatggactccccagcgacccccacggacttcttgccgcttcacagtctggcacactatgatgaatcatgctatacaaaagataaagccgttgcccacgctggcttgtggttggcacgataaatgtttcacaacagtagctcgcgaaccagtccttaattgtcatgagcacaaccatcaaaaccatatgctcacaacccaccttaaccagattttatttatcaattaattaacatcacacgattaaccatcgtgatcgaccattaaatataaccataattaaaataatataatatagtttataattatcccctttagttagctaatgtttctaagcatagctaagcacacatacatatagcatttagctgaaccaatccaatatataaggttcatgctactcaaattataacccataggaaaataaagtcatcttaggccattaattaacggggaaaggttcaccacccaatgacattcgaaaataatgcatagttgaaataaaataatagctttaaacgggttcaacatgctcaaagggttatttgggatctgtgtgacttgccttgcaataatcggtcttcaattaatcttcttgaatacttccggcgcactcacgaaccttcgcaacgatggaaacgacaagctaacacgcaaaacgaagaaaaagactaataaaaaccaaataaacaatacaaaaacaagcataaacagtacatgtggatatttttaacatgtagatcttgattttagaaaaatttagcaacttgaaccacctgaaacggatctacggttatttagttatgattttccgaagatttaatctattaaaaaaaactggaaaaggggaagatgatgatgtcatgatgacgtcatcaatggcggccggctcggatggcgacctcgccggagctagggtgattggccgggattttggaggacatgtacacgtagaggacgacgagacgaacccaacgatactcaccctcgtgccaaacgacgaccgacgacggccggcgacgaggaggcgacggcggcggctcgggttggccggtggggacgggctacggcggccggcggcgaaggagaggtggcggccgagcttctccacctcttggcgaaaccaacggcggcgacggcaagcgacggcgacgacggaggcggcgtggcggcgcaaccggagttcggccagcggcggcggcggatggtttcacgcggcgacggctctacgggtcacgggagaggacgggagagggggcaaacgaaaaagaaggactagggggtcctatttatagccttggattgaagagatcggactcctcccgcaagaaaatcgactcgggaaatcaaaaactcggttttggagataaactcggaaacgagttcgattcgggcaagatactcaacgatttgctccgattttgggggtaaagatagaggaggatgagaggataaaaactcctcaaacaatcggaagaaaaagggccggattgggtgcggatttggaggggaaaaggggcggctcgagctagcaaggccggccggccggaggtaggagaagggcccgacatgtgggccccacatgtcggtgtcccatgagaggaggggcgggcggctcggcttgagccgactcgggcggccttgggccggctccggcgtgcggaagagagaggaatgttgggccgaattcggcccaacggcttagggaggggtttttgaactttttaattaaaataatttgtgaaatgttgtttcaattattaaaaatacttcccttgctcaaataattcccagaaaaatctagaaaatagaggaacaagcaaagtatttaataaaattttatctagctcatttttatgttgaaaattttcctagattattagagtttaacttgtaggcttttaaaataaattctaataattccaattaaacaacaatttatatatttaggatttttagggcgtgacagctatactcatgaatggtgaggtccccgatcagagttcgggcctcattttcggcctgggttagggtgagaactgcgcaaaaaggcaaaaaaacaagagaggcaaaaaaaaaaaaaaagaacaaaagggtatgagataaataaagagttagcaaattagaaaaacttatagaaaattccctaaatacccctgaaaatttactcaatcccttcaatacccctgaatttgacatcatcccttatatacccctgagttttcattttgatctcctctatacccatctccattagttgaccattagttgaccgctaaatattttaaaatgactatattatccatcctatacatatgtggtacctacccaataaattttcatatgaaaaaaattaacttatacaaaataaaagcaatataatcatttaatgcccaacttaaaaaataaaagttattattttttattttttaaaaattatgattaaatccatacattagtttcgctagaaaattaagagcaaaaactaaatgttatttaggtttaaatttttgggaagatatacgaaatttgtcaaatttgatctgaaatttatttaaaaattttaaatttgttttctaatttgtgataaactaattacatcccctttgttttttcacaacgaatcttttttcactaaatatttgtagaaaagtaattttcaaattttatgcagaacctttttttacgataaatcttttttattttaatgaaataatgttttatttttaaaaattcataacaaatatttagtaatttattccttattggttttcacaactcaaataatttacacataaaacatttctagcttttaacaatataccaaggacaataaaataatttctacaataactaacggtcaaactaatggtcaactaacggagtgggtatgtaagggatccaaataaaaaactcaggggtatataagagatcaaacaaatttcaggggcgtagaagggattaggtgaaattacatgggcatatagggaattggcccaaaaacttacgattaacgcctcctggcaaaacaaggcgaggcaagtcgagaacccgttcatcctcatttacggtgatctgccaacatgcaaaactcctccacgaaatcacagcagctcaaccgatgggcggttctccgcaaaagggtgaaacgggactcgatcgtcccatcaatcgccaccttcagcttccggttaggggagatcactagccggccctatcggattgccttcgtcgcgtctgtcttagctccatagggattcgtgtggtagaaccacctctccatccaatgccgctcccactttggcatggaggcattcactggccacaaatcggagcatacagcgcgaacattgaagttcacactcccaaagacggttttctttgtcccaaccggagtgaccaccatctttgagtgaacggtggcgaagaagatagcgccgaacagatcagtttatggcacgaaccccgcggtttggcaaatccagtcgaagatcgcgatccgaactaggactgagggactcagttgaggaagctccacttggaaaagttgaaggaccttggggagcaggacgtcgcatgggaagcgaagacctgcatcaaagaaggcggcgaagacaacggtccagccatcaacggggcgatgaaccactgcatcgccagcgaagaaggcttgcttttcaaccactgtacttgacgcgacgagcttcgccagatccgccttgttgaacagcgaagtgccgaggaagccggtgcagtcttcgccaatcttgcaggggtccggtccggtcgctgcggctggagcaggcttgcgcggagccatgatggaatggcgaaaaatgaaagtcagagctagcgaagactacaaggccgaaaaagaaaaggtgaaagcgagagcaagaacgcagccgggggaagtaaaaatagatggggtaaaagtgaaagcgacccacggggggactatatagccctagtcatgcgacggtttgccttccggccaatagcagcccaccacgtggcacccagggatggacacaatggtaactcttgttaggatgggccgaacagtaaaaggccacatgaacaggaaaaacgcgacccaaaacccgagtttaaagaaaagaagaagtgacctaactcacgtccgaaaaggatagaaggtcgaaaaacaacatggaaacgtttgagagaactcatgaaataacaagggttagcttctgcaggtgtacataggttttggcaggaacatcggccgaaagggggcacctcatgccataccacatatttgcacggtctcgcccaaagctccctactcgctcttgcccatgaggggcttgctggaggcatatcacgagggccttcgaccaaatctgccgaaaccaccagattagcaaagcgccgactaaaatcacaaggggtcgcttggaggtgaagccataggatgaagctgtaaggcgaagtcgaagaatggaagccataaggttcgtcatcaagtctctctgttgggtgaagccatggcgcgaagcagaaggggttcgcccaatggggctcgtcttcaacaaaagggctaggaggtgttgcggcccaagaaggctcacacaaaactttagggctatgtaataggggatccaaaaaaatttcatcattaatacattgcttttaccatccaatcatttcattgagagaagttattgtcatttcgacaacaatatagatactaatcctgatttttaaaactatagataaataaaattgttgtgtccttatgaattcaaaataaagtttacatataactttcgttaaaacaaagtttacttatattaatttaataaaattgaaaaacctatgtatttaatatatgtttaaaatttaaatatttaaaatattaatagcaatatatagcgcgtacttggcgtatagtacaccttggctgtgtttagttcagcgcaaagtttagattttggttaaaattaaagatgatataactaatatgtgtatatgacatattgatgtaatgaaaaataactaaactaaactttgattcaaagtttagaattatcggctgaccatccaaccaccaaaataatgccacaccagcatcgggctacagttcagaacgtcgcaatcagcgcctcggataaaaaaaaaaacctttcggcgctgccgaccttgtgagcccacccaaaactcgaatatacagtacgatattcacacgtctcccccacccaccccaatcaatcatgctaagctcaaacaaccgatctgcaactttgcagatttgaagattcatctcaccaaacaagaacatgatggagtattttacatctgaaaccaaaagcacaagcaaaagagagtccaatagtaacacaacaccctatctaaagcaaagaacattactacagctggaaaaattactacttcctcccttctataatactatgaaagatttttgagggatggcgaatctggacgaaagatttttgagggatggcgaatctggacacacagaatattattacagctgcaagtggcaacaaaaacaccctgctaggctgcttcgtcgtcgtcccggggacacacagctagctacatgacggagcaggcgttggggttctcgtcgctgaaggcagcggtgtagcggacctcggtggaggaggcgcgggcgagcggtgcggcggaggggtcggacaccacgttgcgcacgtaccccgcgggggccttcttgtcgtaggcgcccggtgcgtaggggtgcgccaccgtgtcgtacggcacgtatggccatggctccacccgcttcccggtcttgtacgccacgcgccgcatcaccttcccggcgtccacgtaccccgtcaccgtcaccttgttctgcttcgccgtcacctccaccgagctcacccctgcgcacatgcacagattcgtcaatcatttccacaacaaagaacaaaagctaaaggagcccttgttttgcttttcagagcgtgtgaaagaagaagcagcagcaaaaatatgattaagcacctttcatgtcctcaagggccttcttgatcttcctttcacagccttcgcagtctatccgcaccttcatctccactgtctgaaacaagaagaggatataggcataagttttttccactccaacaacacaactgtcaactagtactatcatggtacaaattcgactggaagacagatatacagagatcgacagaagagggagatgcgattaatggattaacatgttcagtattacctggaattgtttcctcttcttgaggtgtcggcgagtcctcggcacggagcagaactcggagacaacgtcgacgatgcccatctcctcaacaatctccaaccaaactcctcagtcctcactaaagagaccaaagaactgcaggtctttatctgtattactgtacaggccaagcaaagtagcagaggcttcctgagctgaaatgcaagtggattggatcctgcggtgtgtaggtatcgctcgccttctgatataaggcctcgccgcaaacggtggcatccaccggtgctttgacacgtgggcagagagacttttctgctggtgtgaacggagcggagcacatgagaggaagccggtaggaagatgatatggtccgagaggctccgttgggtgttgggttggggcccacacgtcgatacaagtgccacgtgggaggactgcctgccggcagcatggccaggtggtggtgattgatgtgagcgatatctctccaccgccaccgctattcaggtcttgggacgatgcgatgcacctaacctgccggccgacctgactgcctgccaagggatggggttcattgggagcggggatcgaacaaaagaaatagaaaaaaaatattttcctaatgtttaaccgtccgttttatttaaaaaatttataaatttcttctaatatttagtcatacataaaataatatatttatgttctattatgtaataacaataaaaatactaatcatattattttttaaaataagatgaacagtgaaacatgatacgaaaacccataacaacacttacttagggacggaggtagtttgatgaagctctctctcgtggcctgatcttctggtcagaggataattcttgctttgatcgagtacaacatttgcaatgtggctaccaaccagaacaagtctagaacgtcgtgcaatcgctacaccacaaacgatgtcataccaaccatgacacgtggttgatgatctcagcaatgcaaatgagagaacactgcaggaacaagataagatgcaatctaaattacgaataggtgatgaagcacgaagaaatagttctgattgaagtggtagatctaatcgacccgacaaatcaacacaccaactattaggagctctgaatctatagtcgccgactaatcgagcgaggattagagaaaaggtgaatggcacttggcaaaattcaactaaacaaaacccaaatgttctagagggtgcacatagacacttatagagaaaatagatctagggtttagtgttaattcgtggaggtggagggagacacttccgagatgggcctagtctattaatagtcccggttgcaataaaaactggaactaaaaatgatctttagtcccggttaaaaacaccacagctattttatgatcaccaaccgggattaaagatcatctttactcccggttcatcccgtgtcagtagtctgtcagggggccgaggatctttagtgggactaaagatcatctttatagtcccggttgataatactaaccgggactaaaaattatattgatctttagtcccggttagttttaccaactgggactaaaatttaatatgtagtatataatccctatcccttatcctctcctacacttcacaaatcccttccccttcctcttcacagatctaactcctccccctcctcgccttcctcctcacctctcctccccctcacttcccatccggtggccggcggcggcggccatggcgggcggcggcagctggcggggccgcgcccggcggcggccatggcgggcggccaaaggtgtcacgcgcggcagcggtcgtgccctctcgtctgccggccggcctcttttcttttttttttctgataatttgtgattgattgagatgtataattttgtgattcattgcatggatatgagatgtataatctgtcacacccagaaattctcgaaccagaatttctaagctgaatgtgcattaaacccctgtccaggaccagccagggtacacaaacgataattgttgacatacagacccacgtcttacaaaaatataaaagattacaaatgcagcgggaaagataaaagcgagctaaaccgggaagcttgacttcagcagcgggcgactccactccacaggcaaaccttgactgcagcgacgaaaccaacctctctgagacggctccaactgagaagaacttcaactctggtgtgggggaaaagagagcaagactgagtactacccactgtactcatcaagtcataccggaagaggaggtatgatgcaggatataaccaaaggaagctaggggttcttttgcataaagcaggcatttcaaaacagtagttgaaagcagtaaaacagctgtagtaattaatcaatattaaccaatcactatccaacgctacaccacgttgcaacaggcccaaccaaccacctgaactacaccagttcattaagctaaactaggggtgagactaatcacggtgaatctggttgatcgcccataaccgcgggcacggctattcgaatagttttactctagccagaggtgtacaactgtacccacaagacacgattccacacatgtcgccatgccccgaagtatcaccatgatactgcaaagggggaaatcgtgacaagaccctccacgtaaccctcccctaaccatccacaccacgctaaggtttcacccccacccctcaaaaggcagtgggcggtcccctcttgcgccgcggtgaatccggcagctggacaaccgaacacctcggccgacccaactccatcacgcccaccctcgctaccggtgcctaggaaagggtcgagctatacttcagatcaagcagttacccactcccgcttgcggtaagcacggtaagtctcccagggtttcccgtgaaccggtccttaactgccatgggtgcgaccagcaaaaccatgcacccacagcccaccattcagtgtattttaattaactaacaccattgcggtggcaccaatccaaaactatgctaatagacaaagtctatgtaataatgtgatccctttttgtgtactagttgagctaagcatggctaagcatttcctaaaccaacatctaatcattttgatacacaggttatcaatggcatatggtaaacaataaatggctaagtaataggacccatcccacatgacattgtaaaagaatgcaacatttaatagaaatgcagggtgtttgtaaattgggtacaatatgatcaaatgtaaagcatgacttgccttgctctcacattgacgagacgtcagcaacgccttcgagaaaccgcggatcgacgaaacggccgaaacctacgcgacaaacaaagcacacaagcaaaacatggtataagactactgaaacaggaaacaaaaccatttttaatggattatttgcatttttcttgatttactgagacttgaatggacttaaaacggagctcggatgaattacttatgaattttagaagataaactgtgtttttactaataaagaaaaagtccttaattaattattgcgcaataatacccagggctgacgtcatccaaggggggggggcggctgccgacaggcggggcccatgggtcagcttctcaaagaggagaggaagggggcgccggcacgtgggccccacaggtcagcggctcaaaagggaaggaggtggcgcctggcaggtgggccccaccaggcggtggctcaaaggcgaggcgagggtggcgtcggccgggctcggctcggcctcaaggccgaccggccgaccaaggcgaggcgacggcgaggcacggccaccgacggcggtgaccggcggtgcgggaagcgtcgacgacggccgaaaggcggcggcgcatggccggagcagcggcgtggccggcgctcgcgggaaggtgaggaaaggaggggtgtttgtaaattgggtacaatatgatcaaatgtaaagcatgacttgccttgctctcacattgacgagacgtcagcaacgccttcgagaaaccgcggatcgacgaaacggccgaaacctacgcgacaaacaaagcacacaagcaaaacatggtataagactactgaaacaggaaacaaaaccatttttaatggattatttgcatttttcttgatttactgagacttgaatggacttaaaacggagctcggatgaattacttatgaattttagaagataaactgtgtttttactaataaagaaaaagtccttaattaattattgcgcaataatacccagggctgacgtcatccaaggggggggggcggctgccgacaggcggggcccatgggtcagcttctcaaagaggagaggaagggggcgccggcacgtgggccccacaggtcagcggctcaaaagggaaggaggtggcgcctggcaggtgggccccaccaggcggtggctcaaaggggaggcgagggtggcgtcggccgggctcggctcggcctcaaggccgaccggccgaccaaggcgaggcgacggcgaggcacggccaccgacggcggtgaccggcggtgcgggaagcggcggcgacggccgaaaggcggcggcgcatggccggagcagcggcgtggccggcgctcgcgggaaggtgaggaaaggagggagagggaggactcaccgacgacacggtggccggagcggaagacgaaggcggcgacgacgacccgacgagaggaggggcggacgagcggcggcgacacctagagaaggggaggagaggagttagggatggagaaggcgaccgcgacaaccaaagtggctggctggagacggaggggaatggatagctcaccggctcgcgagggagatggggtcccggtggggttccggtgacgcgaggcggtggccgagatggcccacacggcggcggagctagcggcggcggcggcttggcgcggcggcggccctagtggcgacggcacgcggccggagatgggcggcggcggcggagctcggcgagcgcggcgcgacggcggtagagggcgtgggagaggacggtgaatgggggaaatgagagagagagctcgagtgagggtttttatgggcgagggaggggcggaaacggccggggatggcccctatttggccggcgacgtggagaggtggaggagagagagagggtgttgggggatttcaaatcccccaccacttgcgggcgcgcgcgtgcgggagatgcggggaaagggcggcgacgtgggcgcgaggtgcgggcgcggagtggaggcgcgacgtggagcggagaaggcggcggcgcgggcggttggagctccggctccaacgaccggaggtaggggacgaccgacaggtgggccccacctgtcggcgccagaaagagaaagggagggagggaggacttcggggaggggaaaggaggagcgggccggcccaggaagtggcgccgagcgcggggagagagatgggccgacggcccatctagagaaaaaggaaggaaaagaaaagaaaacgaggaaaaggattttcctgggattaaaaaattgcactttggtgatttttaattggttaaaattatttccagggctgtgaaaattccactaaaaatcttgttaatgcattggagcatggggaactcaagaaaaattccaccacgctatttccgattattaattgcatttattaactagggatttagctctaggttaattaagataatttcttcgggcaatttatttaaccaatttttaaaacaagaaaagggggaaacttctgggcgtgacataatctgtgatgtatttgatttgtgtgtattttttaggatttgtgatgtatttgatttgagtgcacttttttaaggatttgtgatgtatttgatttatgtttataataacttaagatttgggatgttactttgaattggggatttggggattgatttagggatatacatggcactagattcgggagaaaatatagagattaaatctggaaaaaaagggcaccatctgaactgacgctactctctctttagtcccggttggtgttatcaaccgggactaaagattcctcttttttttcccggttcgtaacaccaaccgatctttagtcccgggtatttgaaccgggactaaagatagcgatctttagtcccggattcgtactcccggttggaaaaccgggactataggggggttaccaaccgggagtaaaaaggctttctccaccagtgattagaaggcccaagacccaagttaggtttcagtaacagcactgccttgttttgacgattcatgttaactcggaatgaatttggatacgagaccgaatgcgtttgaaaggtagagagataagctttccatcaagtccaagatcacccaaatcggagatggcatggaggtgctaggtctgtttgaattcagtgttgtctctagaggccgaactaaatttcaaaactcattagactttaatattttatggatcccccgttcatccgatgcattgtttgacaatgttttatatttctcatgcttggttgtatgtatatacttcatgatcacatgttatcatccgcataaagcgaagacctaaacctgcagtagttgcaattgagttgggacaggaggcccactgtttcagttgcgggtaatatcttacgcaaggcctccattgcgaggattaaaaccataggtgaaagtggatcaccctatagcagtcttgaacctcttgcatggaagattcctgtcctgtagaaccattcatcagtaattttggacgatcaggtgagcaagagagatgagatccagtttctccatctatgggccaaagccaaaagttgtgagatctgtcaataaataagtccaactcactgaggccctctttattgaaggttaggtttattggtctagacttttaaatcagtttattgacttatatgatttataagctagtggatttaatgtcctaagtttagtgatggtgtcatacatctacctcacataagcaaaaaaaaaaaaagcttctcaaacctagcttttggcttaatagtgttagagtggcttatagcttcataaaagccaaacagaaaagctgcttatttgtttagacttagacttttcgacttataagttggcttataattaagcctaaataaagagggcctgagtccaggggcggatccagaaagaaaaaattgtgggggggctcaattacacagtttcttcacctctagtcatctagagacctttaatttatcatttatggtgaaaaaatcgaaggggatgctccgggggtatcgatgggtcttgtgggtgtaggggggactcgagtcccccttgcacccatgttggatctgcccctgcctaagtcgaatgcttttgggatatctaatttgaagagtatggttggcttattggttttatgcaacgttgaaccagattttgtacatatatgaaattatcatgaatagctctttttcaaataaaagcactgtttggtttggggatgccaagtctgtcagttttgggagcagcctatttgccaagaattttgtaacaattctttctaagctactcctccgtcccaaaaaacctcaacct

SEQ ID NO: 71310 - DNA, 23562 bp, Oryza sativa
ccaccaccaccaccaccaccaccaccacgtgcatcacagtgtaaaataaagttgtcaattctagacaaggatagtgattcaataccactaatacattcaaagtcttcagattatccacacaatgaactagcaatgtcagtagaacaacaatatccctctcttcgaagacatgaagaatgtgaggtgtcatcaacccaaacagtcattgagttatcttcattgagatattctgaatatacatatcaacatatatccatgaatattgaatataagactccaattctctctccctcggtatctacatcgttgcatgcagattcctcatgtattgctataacaaatggtccttcaagttcaaattatgtcgaggaagtaccaatggaaacaattttgaatcaaccaacattatccattcctttggaagcatgcaaggatgagctattgcattgtaaagaaaatggaggcattccaattccaccacctccacctcctctttgtggtaagtgtgtacaaatttcaacagaaaaattccttgtggggtgtgaaatgtttttgattccatcattgatacctcaatcaccaccctcacccccaccctcaataccattgtcttttccatcagctttaccttcaacctcaacatcatttacagctttacatcaactatcccatataaaaaccgcacctcctcctccaccaccaccacctagaggacttctagaaacttcatgtttatctccaatcacatcctccctaagagaacattcaaaaatattacctccccctcctccacctctcccaaaagaatgtttgccaactccatctccacctcaatcccctgattgtccatcttttcctacaaaatatgcaactacatctcctcttccatcaccaccaccaccacttctacataaagtacatgaatgtgttattccttctcataccaggcatgttgtagtacctgcaccaccaccaccacctccctttggagaacatcattctacttttagtaaagatttaacgacatcaccttgttccttttatgaagatcatgcaaaaaaatatactagaattcctctaccaccaccacccccagaaggtagccacggaattttagctacaacttctactgaattgattgatgctggtcctcaattgccaccattatctcatcttgaatggaaacggtgtccacatcatcctccagaaaggccacattatcttccaggagaagttggaggagctccatcgccaccatcaccacctcctcctcagagagaaaatacatcagtaggaattcaaggtggcattccacctctgccaccacctctgccaccaactctgggagattatggagtggctccacctcctcctagcattggtgcaggggctccaccacctcctcctccacctggaggaatcacaggagttcctcctccacctcctattggagggctaggtgggcatcaagctccaccagcacctcctttacctgaaggaatcggaggagttcctcctccacctcctgttggagggctaggagggcctccagctccaccacctccagctggatttcgaggtggaactccacctcccaatgcacatggaggggttgcaccaccacctccaccccctagaggacatggtggggtaggtggcccccctacccctccgggtgcacctgctcctccaatgcctcctggtgtgcctggtggtcctcctccaccccctggtggaaggggtttgcctgctccacctggtggcagaggtgtagtaggacatggacttactcgttccttggggctgaactcagctgccacagcaagaaggtcaactctaaaaccactacattgggttaaagtaacaagagcaatgcaagggagtttatgggcagaaatacaaaagcaagcagatgctaataggtaccctcttgttttttagctttttgattactagaaaatataacttctctacctctttcaccatagttacaacaaaaaatactgtagtgtaaacccgctgctatttcaatttatttctcgtatcatttttttaataaaattttactaactggtagtatcatgtatgtagccattctgaatttgatgtgaaagaattggagtctctttttgctattgctccaaagacaaaaggtggttcaaaatcagatggagctagcaaatctcttggatcaaaacctgacaaagttcatctggtaacttactctaacacattactatgctaaacagaaaatattcccagtacttttgtttaatctactgctatgataatgaattacttgattccatgcaagtgtaatgcgcacaaaattaataattactttcattttagaagacaagttttctatatagttgcggaaaaacctcattatcatattcacttttgaaaatgtgttgatggctttttgtaccgagattgtatctttagttcatatatttatatttcacggtattcattagcttctctctgacaataaaatctgcccttcattaattactggtatcacttgtgttttctaagagttaccttggtgtctttgaaatctacagattgatttaagacgagccaataacacagagatcatgttaactaagatcaaaatgccactacctgatatgatggtaagcaccctgctatttcttttttgcctttattgatgcacaatagttggacaaaagggcaaggtcattaaatgtctttgttccttgctaatactccttcagtaccatattagttttagctctaacctgaatcaaacttctctaacgacgaccgagtttataggaaaatgcaccagcatctaaaataacaaataaatgcactattaagagctatttcatggtggaattaatggaactaatttgatgttgtagatgttgatgtacttttatataaactatatcgaagttcaagaagtttgactttggacaaaactacataacttactatattggaacgaagggactaatatgactactatagtgattgaatatctatcgtgcgctatattatttccttggcgtagaactgatacaacatccaatatagctcgcttttaaccagttttgcatatgtgggctattattttgttgtttgggaattgcacacatagacctttgcattgtgacaacatccaacatagcttgtttttaaccagatttgcttacaatctgaagattaggtagctgaccaaaataaatcatcaacagagtttatgaaagttttgtttttggtgattgggttcttccactggaaagtagggtgtcagcctgcatttaagtgataaattaagtgggattccctactaacaaatattgagaattttttgggtttccttttgccaagtaggatgtagaagacattttatcgacacaatcaaaatttcatgtgaagctagcttcacatactttagatctagcttcacatactttaccacttgcgagagtgctcggtccagctcaccaaccgtgggtctcataagttacattgggcctacttcaccacaggtccaactaaagccacaacttcagatcctaggtctaaacaaaccaaaaggtggtttgatgggtgagtataacctccacatgttaagccatgatcccccatcatcaattatcaatgtaggactaaacccaacaattgcatcggatatgtaggcttcagctaaactacattactaaatatcatgtgttcctgtgttatctctgcaatgtcaaagttgatcaatggttgcagcaatcaggaaggttagtcatcgtttcactatatcgattaacttctgcaacactaccaatcagtgaaggccaaacactcgaactagtttgagatagtttctttaaaaacagggtagcaactccaaatccacaagtatagtcgcaatgatttatgttgaatattttcaagtcaatctgcatgcacttcaaggatttggatttggtttcgaaatttttatgaaaatagatctacaatggagacacgaatttttacgtggaaaacccttacaggaaaataccacgggtgccgaccgacaatgatcataattgagaagttgattcaaacataaaggaataacaatgggatcgtcgccacttcctatacggcttacaagagtatatataagggataaacggaaagacacacaatagggaaagacgtgatgacctactaggaaactagtctgaatattttgtcggcctaagatttggatcacatatttaacatgttttccatctggttcagctaatgcttataggaatgtttcaatcacattccatcttgatattaattaatacaccatatttagtccattttcctggagctgaattgtataccctgaaaccatttgcattttagaccaaggatcacctccgtttgatgaaactcagttcatgacatttagtagctacttcattcttaagaattattcagatttttagtggacatttactcaaaagttactcccattttttaaatggctaccggtaaggcttaaggtgcttcatccattctatatctactttctctacttgtaacagagtgctgctctagctttggatgattcagttctagacgctgatcaactggaaaatctcataaaattttgcccaacaaaagaggagatggaacttctaaaggttgttttaaaattaaagcttatatttccttgcactccttctgtaatctttaatttttctcttctctgaatatcttgcaaaagtaaagtatttgcactttttcctatcagaactacactggagacaaggaaactcttggaaagtgtgagcaggtaaaccttcatgcatgtttggactcttcttttgttatatattgatttgttttcacttatatttgatcagaactattgaggttataactgacaaattatattttgtacattcctattcatctcctccgtctgcagttttttctagagcttatgaaggtgccgagggttgaatctaagtttaggatatttgctttcaagattcaatttcaatcacaggtcatacactgttgaaattttgagttattatctccgtatttgaaatgtccatagattttcactatcccccttttcatttccctcttagattagggatgttagaaagaatttgctgactgtgtcatccgcttgtgaggaggtaaatatgttttaatacacctcctttggattaataagtattaatgtttatcacgtgagagctcatttcaatatgtcaatcagctcagaggctctgagaagttaaaggtgatcatggagaaaattctgtttctaggaaataaattaaatcagggaacaccaagaggtaatttactgcgtctattgacgagctataaaatctttcaaataaactttcatgcaaatatgtttagcttaaaatcattttgcagttgaaatttcctggataatttctaagctccctcttcattaggactaggagggagaaatgccctgtgacaacttcactgtatatataattacatttatcctttccactattatcaacaaaaataagttgtttctctaggtgcaacaatgtaaaacaattcaggctatagattgaagttgtttgaatgtcaatttaagtactgtatgttcaagatctgtgggtcactaattttagcttccctatacctcgtattcattgaggaagaaaaaatatttaatttttccttatcttgttgcaggccaggctcttggttttcgcttggacagcctattaaaacttacagacactcgtgcaaacaacagtagaatgacactaatgcactttctttgtaaggtatggagatatatagctgtcgtacactagttgttcatataaaatcaagcatgagtatgaaagataatgttgatcccaaaataataaatttgtctatactaattatgtggggcccaaatatcagtggtggtggccaccaccatcaccacaaggaatattcaaaggagtaaagatatattatgctcgtaggactagaaaagaatgtaattgtgatattttgcttttcaccacatttcaccaaaagagtgtcttgtaattacatacaaggcactcttcatgattaatatacctcaatagtgctatgtacattaactcaatagtgctatgtatattaactctaaaacatgtagttctttgataacttcatcactaaatcagtagttttgtgatacaatgctataaatctgtagttctatgaaaaatttggcactaaatctgtaatttcgtcatatacatttttgaatctgtagttttgcgatagtttagttaaaggcagccttagttaaaatatcgctagttttgtgatatttactcaatttgaaaggccaactaactagctaatttctttgtcatgtttaacttgtcatcatactgcttattttgctcctctcataaaattctaagtttgcttctataataagctttaattcttattaactcgatggttggtttaagtgtttatcagggccttgcggacaaatcaccacatttactggatttttatgaggaatttgtcaacctagaagctgcttctaaggtgtgtatgtcgatctgacgagagcatccaaaggacttgtgttgataaaaaaaattatacattgtttagaaaatggaagtttgtattgaacccaatcaattacatcacggtgcctctgcataactaagatacacacgaccacactcaacaaacaaaaaatggagaatatcatggatttgtaaggaccatcaatcgaaagaataaatcgtcacccatgaacaactccttaaatatatcctctaaatgcacaaagtattaagagccaccaatcctaatactagatctccacccatatacctgggtaaagaactccttgaccaccttctccaaatgtagacatgccgcaaccaccatatcccgcggatcaggcttctgtaggatagcccatgtacgaagccaatggataagacaatatataacctgtaatagtgaagttatgattttttttaatcaaaatatacattattcctgcatagccaaagcaaccaacaagtagcaaatgctcttaacaggacatgtgcttttaaattattatgaattccagcaaggcagctcccaaacatatgggctacactatgcagtggaggaagtccaaatgctacttggaccaaacagaatgggcaaaatcaaaaaaaaaaagatgtctaattgtctcatcattgtgacaaaaacaaccgttcttattgctttgccagtttccttttgtcaaattatccatcgttaacaccactccacaatgaaaataccaaagaaaaatcataacttttaagggtatctttagtttccaaagatgtttattaatattaagaacattgatgtgaattagagctaggtaatgagactgcaccgagaactccccatttgaggttaagttctaacgaaactcgtcttgctcctgagttaattgaaaatcagtgatacatgataataaatacaagtttaaggaccacccgtgcattttactcataataaattattccaagccacctattttgatcctataaggtcccttctccatgaaagggaatgattggtttctaagacttgtgcaacagtagccggcttatgcttaactatattttgaaggcaaggatactgttcttttaaggttgaattgcccaaccatttgtctctcataacctgatttgggagctatataaaggatccaaaccagagaaaatcccatttctccttcatgggggtggaccaaaagtataagtccctggccttccactaagcttgagaaagaggtttatcacctacatacttattacatatcaactgttgtcaaaccccttccgtggagagcaacttgaataagcacttactaagtagagccacattcttaatgtccaaaacatgaattcccaaccccccccccccttgttccttggggaggcactttttttctctgaccaccacatttccagtaaacctggagcgaaaatacttaagctttgtaagtatcccctttggtatggcaaagaaagacatcatatatctcgggaggctacttagcactgaattaatcaatgttagccatcctccggtggacaggagttttcctttccaactactttgatgtttttcaaagcattttatcacatctttacaatcggcatttcttaatctcctatagtgaatagggatacctagataccggaatagaaatttaccagtggaacaaccaaagagctccatgtattcattgttaaactcgttcgcttcaccaaagcaatataattagtttttatggaaatttatcttaagactgttaattgctcaaggcaaattttgctacatgacactgcttatgtgtggttttagctctaggacactgcccaaactcacttttgagggaaaacactccataaacatggtaatttgctagtggataccacgccgattaaaataataatttccggttgaagaggagagagaaaacgcgtgaaatgtcaaaaatgcccttaggcccacatgtcagctctatctcctatctctcttctcctcttccagcccacatgtcgctccccgccggccgccggccatgcccgcgcagatggcggtggaggcagtcgttgaactcgtcaccatcgacgtgacatcgagcggctcatcgagatgttcatctggaataactcgttggagaagggcgcccgccgatcggccgcggtggttgtctccatgctcaccgaggggaagttgaatgctctctgcgtcaccggcacccccggcgccatcgagtcagtcgcgtcgctgcattacgcttacctcgacgagctcaacctacttggcctccatgcccatccaccactctctgctaccgagcttgccgctagcaaaatcagtcgttccaccgccgggtatatttcgccggcgtcgtgtgcagtcgcctcccccaatctgcccttgcctctgaccatcacacgcgtgtttgtggggggaggggggattgcggcatcgtgattcggcgattgggatgagagaagggcggcagcggcggctgcggcggtggccatgagtggctcagcgtcgacggggatggggtgcgggagctacggctggcttgcgtcggccggcggtgggaggaagggcgggggtagggggtgggggtggcgaggcggcggggagaaggagcggctgcagctgctccaccgcgcgctacggctgatgggctgccggagggccagggtgcttctgctgctcgccactgcctcccaagcagtgtctacgcgggcatggccggcagccagcgaggagcgacatgtgggcaggaagagaagagagataggagatagagctgacagtgtgcccaagggcatttgcgacatttcacgcaatgtctctctcctcttcaaccagaaattattgttttaatcggcgcggtgtctactggcaaattaccatgtttaaggagtgttttcctctaaaagtgagtttggtagtgtactagggctaaaaccacacataagcagtgtcctgtagcaaaattttcctttgctcaatgacataaagcaataacgtcaggttacgagctttttctaatttatgatccataaaaaaaactatatcattggtatattgcaagatagagagaccatcattcattagatgatgtcgtactacttctgcaatttgccgatcaactttggctctattaatcagtatagccaatacgtcagctataatattaaataatatgggtgataagggatcaacttgatgtacccattctggagttgctttgaacagttgcaactgaaagcattggctgaggagcagcaagcagttgtgaaagggctgcagaaggttgaacaagaactagctgcttcagaaagtgatgggcccgtttctgaggttttccgcaaggtataatttaattccctacctttttggatgctatgtgtttagtttagatggctactgctccatccgttttttaatatatgatgcagttgactcttagatacatttgaccattcgttttattcaaaaatttatataattatcatttattttgatgtgatttaatttatcattaaatattttttaagcatgatttaattttttttatattcgcacaaaatttttgaataagatgaatggtcaaacgttcgttaaaaagtcaacggcgtcacacacacacacaaagaaacagaaagaaatttacttgacgttcctttctgtttctttaagtatggaatcttaataaacagatatatttactgatggttttgcaatctagactttgaaggagttcactgatgcttctggagctgatgtaaggtccttgtcagcactatatgctgaagtagtaagccatcgtgatccaacaagctagctttcaaaactgttccatttggattcgaaccccttttaacatactgagcggtgacagggtaaaagtgcggatgcactagcctattattttggagaggatcctgcaaaatgtccttttgaacaaggtaatattcgatctggaaattctggatgattcccaattctccatcaagttgtggtagaacaagttaatttttacagttttgtgaacactgcttgagagcatcattttttccaaacatgtgacattcactagctcaaagacagaatcaataattaaacgtctgacagaaattattagatctaataaatacttgaattttacgaattgtcggatttaggaagttggtgctctttcgttctagaattttcaagaccaggtaaatctcctgttgtgttcacgatcatctaaattaataaaagcttatatgctggaacagagggaaggtctaaagtactgaacaaagctaaggcttagggtgtgttacagtgttagttcacgttaaaattgaaagtttggttgaaattgaaacgatgtgatggaaaaattgaaagtttatgtgtgtagaaaaattttgatacgatggaaaagttgaaagtttgaagaaaaagttaaaaactaaacgagggcttagtaaatggacctgggctcatgggctggtgccatctgcagcacgttaggtcccatacagaaaatggaccactgaatttaccgtacctaatccctgatcggcaaaaagatctaggctgtgtttagttcatggcaaaattaaaagttaggttgaaattaaaacgatgtgacgaaaaagttggaagtttatgtgtgtaggaaagttttgatgtgatggaaaagttggaagtttcaagaaatattttgaaactaaacacggcgctagtataaattaacaagagttcctgttaactgattgattatgtgtgctaaattcattttcttttacctttttaaattaaaaagctatcaatgttcgtatgttctgattaattttctgatcatgtacatatgtaactgtaaatcttatactatatatttatatgtacactgtaggaggttctcctacagtatttttcctctaaaacaaatgttaatggagactttaagtagtaacagcatccttctttcctcttgctcacattaattttgaattcgacaaaaatacagtcacgtctactcttctgaactttgtggggttatttcggaaagcacatgaggagaacataaagcagattgaggctgacaagaagaaagcacagaaggaggctgagaaggaggcaaaccaggaccgtactcctgtaaagtctaaagatggactagtagatagatcaccaagatcacccttcaagtgacatgcatcactaccaattttttattgtccagccgggtcagtttcttctcgacaaatgccacctccattaccattagccattcagaccatcgtggctcaagcaatgcatggctccatgtgcttgagaaacaaggtaacgcatcattatgtacattgcacacttttgttcttactgtattgatgaaattatagtcgtcattaattatcattctaacctataatatatatttttttattttgtataggtactcaacccatgcatgctttctagcttgcaatactgtacagagctaactccgcaactatatatttaggtccgtttgtacatatttcactagacatttcttctattgtacatgtatactagaagaaataggtcagtagttgtaaactaggaaaaggaaagaacgtaagagaggatcagtaggtcagaaaccataggaaattaaggattagtgttacctcgaggcagttacagcaactggtgaatgtatagcaatgttcctgactcgtgctatcaaatgacgcatccaagtgtacaccttttatctagaagcatgtgttgtcaattaattaaaaccaagctagcttacttatatggttatggtgttactgtagctgttaatgtatagaaagaaaaggaacgaatacaaacttcgaattaaatttgaaaatatatcgctcattcaattttatttcaggaatattcgggatgtaaattttttaaaaaaaatatatcgtcgatctcgcacaatcattgagcgaaaatgaggtgacgtcgagggcggtatcgtgcggtgaaaaagcgagaccgcgtgctctcgcggaaagaacgagcgagaccgaacggtatcgctgaaaagagagcgacaccgtaccaatgcttcctttggttagtgactaatgacgtaattaactatttaataataacaattagtgattaattaataattaattaatcactaattaatcattttgaaatccggtatcgctgattggttcagcgagaccgttcgttctcgctctttcatttcgcaagaccgcacggtctcgcgcttttctcgtgcgatactacccgtgacgtcacgccacgtcactttcgcgtaatggttgtgcgaaattgacgttatattttttaagaaattttgaatcctgaatatttctaaaaataaaatgaatgaacagtgtatttccaaattttattctacaaacttccatgcttgcatattgaggagtgtttgctttcggtcagattcagtctagtacatactccctccgtcccaaaaaaaacttaacctaggagagtacatcccctcctaggagaatgaatctgccatcttctcttaggttgaggttttttgggacggaggagtagcttagaaagaattgttacaaaattcttggcaaataggctgctcccaaaactgacagacttggcatccccaaaccaaacagtgcttttatttgaaaaagagctattcatgataatttcatatatgtacaaaatctggttcaacgttgcataaaaccaataagccaaccatactcttcaaattagatatcccaaaagcattcgacttaggcaggggcagatccaacatgggtgcaagggggactcgagtcccccctacacccacaagacccatcgatacccccggagcatccccttcgattttttcaccataaatgataaattaaaggtctctagatgactagaggtgaagaaactgtgtaattgagcccccccacaattttttctttctggatccgcccctggactcaggccctctttatttaggcttaattataagccaacttataagtcgaaaagtctaagtctaaacaaataagcagcttttctgtttggcttttatgaagctataagccactctaacactattaagccaaaagctaggtttgagaagctttttttttttttgcttatgtgaggtagatgtatgacaccatcactaaacttaggacattaaatccactagcttataaatcatataagtcaataaactgatttaaaagtctagaccaataaacctaaccttcaataaagagggcctcagtgagttggacttatttattgacagatctcacaacttttggctttggcccatagatggagaaactggatctcatctctcttgctcacctgatcgtccaaaattactgatgaattgttctacaggacaggaatcttccatgcaagaggttcaagactgctatagggtgatccactttcacctatggttttaatcctcgcaatggaggccttgcgtaagatattacccgcaactgaaacagtgggcctcctgtcccaactcaattgcaactactgcaggtttaggtcttcgctttatgcggatgataacatgtgatcatgaagtatatacatacaaccaagcatgagaaatataaaacattgtcaaacaatgcatcggatgaacgggggatccataaaatattaaagtctaatgagttttgaaatttagttcggcctctagagacaacactgaattcaaacagacctagcacctccatgccatctccgatttgggtgatcttggacttgatggaaagcttatctctctacctttcaaacgcattcggtctcgtatccaaattcattccgagttaacatgaatcgtcaaaacaaggcagtgctgttactgaaacctaacttgggtcttgggccttctaatcactggtggagaaagcctttttactcccggttggtaacccccctatagtcccggttttccaaccgggagtacgaatccgggactaaagatcgctatctttagtcccggttcaaatacccgggactaaagatcggttggtgttacgaaccgggaaaaaaaagaggaatctttagtcccggttgataacaccaaccgggactaaagagagagtagcgtcagttcagatggtgccctttttttccagatttaatctctatattttctcccgaatctagtgccatgtatatccctaaatcaatccccaaatccccaattcaaagtaacatcccaaatcttaagttattataaacataaatcaaatacatcacaaatccttaaaaaagtgcactcaaatcaaatacatcacaaatcctaaaaaatacacacaaatcaaatacatcacagattatgtcacgcccagaagtttcccccttttcttgttttaaaaattggttaaataaattgcccgaagaaattatcttaattaacctagagctaaatccctagttaataaatgcaattaataatcggaaatagcgtggtggaatttttcttgagttccccatgctccaatgcattaacaagatttttagtggaattttcacagccctggaaataattttaaccaattaaaaatcaccaaagtgcaattttttaatcccaggaaaatccttttcctcgttttcttttcttttccttcctttttctctagatgggccgtcggcccatctctctccccgcgctcggcgccacttcctgggccggcccgctcctcctttcccctccacgaagtcctccctccctccctttctctttcgggcgccgacaggtggggcccacctgtcggtcgtcccctacctccggtcgttggagccggagctccaaccgcccgcgccgccgccttctccgctccacgtcacgcctccactccgcgcccgcacctcgcgcccacgtcgccgccctttccccgcatctcccgcacgcgcgcgcccgcaagtggtgggggatttgaaatcccccaacaccctctctctctcctccacctctccacgtcgccggccaaataggggccatccccggccgtttccgcccctccctcgcccataaaaaccctcactcgagctctctctctcatttcccccattcaccgtcctctcccacgccctctaccgccgtcgcgccgcgctcgccgagctccgccgccgccgcccatctccggccgcgtgccgtcaccactagggccgccgccgcgccaagccgccgccgccgctagctccgccgccgtgtgggccatctcggccaccgcctcgcgtcaccggaaccccaccgggaccccatctccctcgcgagccggtgagctattcattcccctccgtctccagccagccactttggttgtcgcggtcgccttctccatccctaactcctctcctccccttctctaggtgtcgccgccgctcgtccgcccctcctctcgtcgggtcgtcgtcgccgccttcgtcttccgctccggccaccgtgtcgtcggtgagtcctccctctccctcctttcctcaccttcccgcgagcgccggccacgccgctgctccggccatgcgccgccgcctttcggccgtcgccgccgcttcccgcaccgccggtcaccgccgtcggtggccgtgcctcgccgtcgcctcgccttggtcggccggtcggccttgaggccgagccgagcccggccgacgccaccctcgcctcccctttgagccaccgcctggtggggcccacctgccaggcgccacctccttcccttttgagccgctgacctgtggggcccacgtgccggcgcccccttcctctcccctttgagaagctgacccatgggccccgcctgtcggcagccgccccccccccttggatgacgtcagccctgggtattattgcgcaataattaattaaggactttttctttattagtaaaaacacagtttatcttctaaaattcataagtaattcatccgagctccgttttaagtccattcaagtctcagtaaatcaagaaaaatgcaaataatccattaaaaatggttttgtttcctgtttcagtagtcttataccatgttttgcttgtgtgctttgtttgtcgcgtaggtttcggccgtttcgtcgatccgcggtttctcgaaggcgttgctgacgtctcgtcaatgtgagagcaaggcaagtcatgctttacatttgatcatattgtacccaatttacaaacaccctgcatttctattaaatgttgcattcttttacaatgtcatgtgggatgggtcctattacttagccatttattgtttaccatatgccattgataacctgtgtatcaaaatgattagatgttggtttaggaaatgcttagccatgcttagctcaactagtacacaaaaagggatcacattattacatagactttgtctattagcatagttttggattggtgccaccgcaatggtgttagttaattaaaatacactgaatggtgggctgtgggtgcatggttttgctggtcgcacccatggcagttaaggaccggttcacgggaaaccctgggagacttaccgtgcttaccgcaagcgggagtgggtaactgcttgatctgaagtatagctcgaccctttcctaggcaccggtagcgagggtgggcgtgatggagttgggtcggccgaggtgttcggttgtccagctgccggattcaccgcggcgcaagaggggaccgcccactgccttttgaggggtgggggtgaaaccttagcgtggtgtggatggttaggggagggttacgtggagggtcttgtcacgatttccccctttgcagtatcatggtgatacttcggggcatggcgacatgtgtggaatcgtgtcttgtgggtacagttgtacacctctggctagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggatagtgattggttaatattgattaattactacagctgttttactgctttcaactactgttttgaaatgcctgctttatgcaaaagaacccctagcttcctttggttatattctgcatcatacatcctcttccggtatgacttgatgagtacagtgggtagtactcagtcttgctctcttttcccccacaccagagttgaagttcttctcagttggagccgtctcagagaggttggtttcgtcgctgcagtcaaggtttgcctgtggagtggagtcgcccgctgctgaagtcaagcttcccggtttagctcgcttttatctttcccgctgcatttgtaatcttttatatttttgtaagacgtgggtctgtatgtcaacaattatcgtttgtgtaccctggctggtcctggacaggggtttaatgcacattcagcttagaaattctggttcgagaatttctgggtgtgacagattatacatctcatatccatgcaatgaatcacaaaattatacatctcaatcaatcacaaattatcagaaaaaaaaaagaaaagaggccggccggcagacgagagggcacgaccgctgccgcgcgtgacacctttggccgcccgccatggccgccgccgggcgcggccccgccagctgccgccgcccgccatggccgccgccgccggccaccggatgggaagtgagggggaggagaggtgaggaggaaggcgaggagggggaggagttagatctgtgaagaggaaggggaagggatttgtgaagtgtaggagaggataagggatagggattatatactacatattaaattttagtcccagttggtaaaactaaccgggactaaagatcaatataatttttagtcccggttagtattatcaaccgggactataaagatgatctttagtcccactaaagatcctcggccccctgacagactactgacacgggatgaaccgggagtaaagatgatctttaatcccggttggtgatcataaaatagctgtggtgtttttaaccgggactaaagatcatttttagttccagtttttattgcaaccgggactattaatagactaggcccatctcggaagtgtctccctccacctccacgaattaacactaaaccctagatctattttctctataagtgtctatgtgcaccctctagaacatttgggttttgtttagttgaattttgccaagtgccattcaccttttctctaatcctcgctcgattagtcggcgactatagattcagagctcctaatagttggtgtgttgatttgtcgggtcgattagatctaccacttcaatcagaactatttcttcgtgcttcatcacctattcgtaatttagattgcatcttatcttgttcctgcagtgttctctcatttgcattgctgagatcatcaaccacgtgtcatggttggtatgacatcgtttgtggtgtagcgattgcacgacgttctagacttgttctggttggtagccacattgcaaatgttgtactcgatcaaagcaagaattatcctctgaccagaagatcaggccacgagagagagcttcatcaaactacctccgtccctaagtaagtgttgttatgggttttcgtatcatgtttcactgttcatcttattttaaaaaataatatgattagtatttttattgttattacataatagaacataaatatattattttatgtatgactaaatattagaagaaatttataaattttttaaataaaacggacggttaaacattaggaaaatattttttttctatttcttttgttcgatccccgctcccaatgaaccccatcccttggcaggcagtcaggtcggccggcaggttaggtgcatcgcatcgtcccaagacctgaatagcggtggcggtggagagatatcgctcacatcaatcaccaccacctggccatgctgccggcaggcagtcctcccacgtggcacttgtatcgacgtgtgggccccaacccaacacccaacggagcctctcggaccatatcatcttcctaccggcttcctctcatgtgctccgctccgttcacaccagcagaaaagtctctctgcccacgtgtcaaagcaccggtggatgccaccgtttgcggcgaggccttatatcagaaggcgagcgatacctacacaccgcaggatccaatccacttgcatttcagctcaggaagcctctgctactttgcttggcctgtacagtaatacagataaagacctgcagttctttggtctctttagtgaggactgaggagtttggttggagattgttgaggagatgggcatcgtcgacgttgtctccgagttctgctccgtgccgaggactcgccgacacctcaagaagaggaaacaattccaggtaatactgaacatgttaatccattaatcgcatctccctcttctgtcgatctctgtatatctgtcttccagtcgaatttgtaccatgatagtactagttgacagttgtgttgttggagtggaaaaaacttatgcctatatcctcttcttgtttcagacagtggagatgaaggtgcggatagactgcgaaggctgtgaaaggaagatcaagaaggcccttgaggacatgaaaggtgcttaatcatatttttgctgctgcttcttctttcacacgctctgaaaagcaaaacaagggctcctttagcttttgttctttgttgtggaaatgattgacgaatctgtgcatgtgcgcaggggtgagctcggtggaggtgacggcgaagcagaacaaggtgacggtgacggggtacgtggacgccgggaaggtgatgcggcgcgtggcgtacaagaccgggaagcgggtggagccatggccatacgtgccgtacgacacggtggcgcacccctacgcaccgggcgcctacgacaagaaggcccccgcggggtacgtgcgcaacgtggtgtccgacccctccgccgcaccgctcgcccgcgcctcctccaccgaggtccgctacaccgctgccttcagcgacgagaaccccaacgcctgctccgtcatgtagctagctgtgtgtccccgggacgacgacgaagcagcctagcagggtgtttttgttgccacttgcagctgtaataatattctgtgtgtccagattcgccatccctcaaaaatctttcgtccagattcgccatccctcaaaaatctttcatagtattatagaagggaggaagtagtaatttttccagctgtagtaatgttctttgctttagatagggtgttgtgttactattggactctcttttgcttgtgcttttggtttcagatgtaaaatactccatcatgttcttgtttggtgagatgaatcttcaaatctgcaaagttgcagatcggttgtttgagcttagcatgattgattggggtgggtgggggagacgtgtgaatatcgtactgtatattcgagttttgggtgggctcacaaggtcggcagcgccgaaaggtttttttttttatccgaggcgctgattgcgacgttctgaactgtagcccgatgctggtgtggcattattttggtggttggatggtcagccgataattctaaactttgaatcaaagtttagtttagttatttttcattacatcaatatgtcatatacacatattagttatatcatctttaattttaaccaaaatctaaactttgcgctgaactaaacacagccaaggtgtactatacgccaagtacgcgctatatattgctattaatattttaaatatttaaattttaaacatatattaaatacataggtttttcaattttattaaattaatataagtaaactttgttttaacgaaagttatatgtaaactttattttgaattcataaggacacaacaattttatttatctatagttttaaaaatcaggattagtatctatattgttgtcgaaatgacaataacttctctcaatgaaatgattggatggtaaaagcaatgtattaatgatgaaatttttttggatcccctattacatagccctaaagttttgtgtgagccttcttgggccgcaacacctcctagcccttttgttgaagacgagccccattgggcgaaccccttctgcttcgcgccatggcttcacccaacagagagacttgatgacgaaccttatggcttccattcttcgacttcgccttacagcttcatcctatggcttcacctccaagcgaccccttgtgattttagtcggcgctttgctaatctggtggtttcggcagatttggtcgaaggccctcgtgatatgcctccagcaagcccctcatgggcaagagcgagtagggagctttgggcgagaccgtgcaaatatgtggtatggcatgaggtgccccctttcggccgatgttcctgccaaaacctatgtacacctgcagaagctaacccttgttatttcatgagttctctcaaacgtttccatgttgtttttcgaccttctatccttttcggacgtgagttaggtcacttcttcttttctttaaactcgggttttgggtcgcgtttttcctgttcatgtggccttttactgttcggcccatcctaacaagagttaccattgtgtccatccctgggtgccacgtggtgggctgctattggccggaaggcaaaccgtcgcatgactagggctatatagtccccccgtgggtcgctttcacttttaccccatctatttttacttcccccggctgcgttcttgctctcgctttcaccttttctttttcggccttgtagtcttcgctagctctgactttcatttttcgccattccatcatggctccgcgcaagcctgctccagccgcagcgaccggaccggacccctgcaagattggcgaagactgcaccggcttcctcggcacttcgctgttcaacaaggcggatctggcgaagctcgtcgcgtcaagtacagtggttgaaaagcaagccttcttcgctggcgatgcagtggttcatcgccccgttgatggctggaccgttgtcttcgccgccttctttgatgcaggtcttcgcttcccatgcgacgtcctgctccccaaggtccttcaacttttccaagtggagcttcctcaactgagtccctcagtcctagttcggatcgcgatcttcgactggatttgccaaaccgcggggttcgtgccataaactgatctgttcggcgctatcttcttcgccaccgttcactcaaagatggtggtcactccggttgggacaaagaaaaccgtctttgggagtgtgaacttcaatgttcgcgctgtatgctccgatttgtggccagtgaatgcctccatgccaaagtgggagcggcattggatggagaggtggttctaccacacgaatccctatggagctaagacagacgcgacgaaggcaatccgatagggccggctagtgatctcccctaaccggaagctgaaggtggcgattgatgggacgatcgagtcccgtttcacccttttgcggagaaccgcccatcggttgagctgctgtgatttcgtggaggagttttgcatgttggcagatcaccgtaaatgaggatgaacgggttctcgacttgcctcgccttgttttgccaggaggcgttaatcgtaagtttttgggccaattccctatatgcccatgtaatttcacctaatcccttctacgcccctgaaatttgtttgatctcttatatacccctgagttttttatttggatcccttacatacccactccgttagttgaccattagtttgaccgttagttattgtagaaattattttattgtccttggtatattgttaaaagctagaaatgttttatgtgtaaattatttgagttgtgaaaaccaataaggaataaattactaaatatttgttatgaatttttaaaaataaaacattatttcattaaaataaaaaagatttatcgtaaaaaaaggttctgcataaaatttggg

SEQ ID NO: 71311 - DNA, 711 bp, Oryza sativa
taaaatagcttaatgaaaatttcgttaaatcaaacgggtttagggtgattaattaattaattatgttgttcgctttgtgattcttaattggagttagttggatttaatttgtatttcggaagtggagctcaatccctaattcaaattccatccaaatccaatattcctttcaaatcctaaatccttcccaaaaatttcaaatactttatatttggaattttccagagaagtccctgtctttttccctttttccttcctctctgtttctctattctgcccttattcttctttctttttctttttcccccaccttcttctacctccagctctctctctccttcttgagctgcaggcccggggaggccaagccccgagcccacgtgccgccgcggcccggcctcctcctcctctctatgtcgccggcccaagccgccgccgaccgagcccgcgccggccgcgccgcaagcccacacggccgacgccaaatcccgcaagccgcgccaccaaattcggagccgccgcttttccaaagcttgcaccgtgcgccctaaccctagctactccctcccctataaataccatcggccaccgcccctttttcccccttttttcaaagccgccgccatctccaccgtgagcagccgccgccaccgttgcttcgtgccgccgtcgggagccgcgccgtcgtcgtcaccatcttcttcccgtgcc

SEQ ID NO: 71312 - DNA, 19640 bp, Oryza sativa
  unsure (1)..(19640): unsure at all n locations
aatatccaacctgtttacattccttgcactattggtgaaagctatataggagtacatgtaagtggctagacgcactaaggatattgacgtcgaatttggtatcaaatccagttactttgcacacgtccatatgcatcaacaaattagctactagcattttccactagacaatctatgggcgtggaaatgtggaatcgatcagcatgatcaagactagacaggacagacgaaaacgacctgcacgatgctgctcacaacgacaattgatcgtgttaatcgcgtccattgtcgatttatcgatttgcttggtttcccccatcttgctacaatgcaacacggacagcaagtcagcatccggtgtgtttcattttttgttgctgaagttttcagcatgacgtaccaaaccaaatgaatgaaaagatgatcatcaccattctgatctagcttgagttgctcagaagcaacaatcaatcgtacgtacgtgtatgcatggaatggaacgcaactactcgtcggacactgattgccctgatcgatcggcatgcatatattcatggctttttttttctgttgcgcatgctagcttgattatattggtccacactaaaggtcgctagctgcatttgcatgcaaccaaccaccctgcatatatccaagctacatgtgtgtactgtacctaaagcagagcagagaaactgaaaaaagggaaaaagagaggacatatgcatatatcatcagggagaggaagaaagaaaagcaatgctaacatatctcaaatcattagagagtggtaggtagattattattcactcacagtcccagttcgccattttctcccccacaaaagtctagctcttgggctgactactaacagcacaaagtttgcagctagctcaagtcgtaatcacacattcacaacgctattagaactagctagggtcgccaatctcattcagattaatggctttcgcctacctacatgaatagcactagctccagggttcagacgattcagcggctgatacagctaggtcaatgctgagcagtgacagttttgttcttggcctcaaaaagcagctccaactttattgactactaaattaaaacgcgaacacaaaatggcgatatatatgacagtctagagacaacagtgacactaattttggtaggtataggtcaccgatccggccatgtcgcgctcgcaacaggaaaattcgtgtggattatgtcgctgaacgaagaccggcgatttgttggttggatttttttgaacgatttgttggttggattttggattggatggtgtgatttggagatgcagtcattcaaaagtctgaggcttttcagtttgtaatctctcggtcagtaggtaagcaagccatggtgttagtgaccaatcgatccctgccaaattgatggaatctcgttttcagtttactgagccgaagcaagtaggagtaggagtggcagtggcaggttgtctatgcgtgtgggtttatatgatttgaagctgtcatacagtgaaatttcagtcacagtagaactttcaggtttagtggatcgaagcctgacagtttcaataggctcagcatgttgacgatattttttttaagaaaaaataaagataagtttagaagacttgaagaagacctaatactggatttcagaaaagttggatcggttttccgtaagttttaaaacaatgaaatctcaggaagcataacaatgaaacgtgagatttagtaaaaaaaaaacaagagagtagctatatttatggcgccatatttttcaccaaaaaatagtcggttttacattgtaagtttacaaattacattgtaattttagtgtatttacattgtaagtctcaaacttacatacgtaagtcccaaaaatacatatataattttagtctatttacaatgtaaatctcaaaattacatatgtaagttccgaaattatatatgtaattaatatataatcatcactcatcatgatgtatgatgtatgtgatgtatgtgtggaaataatcttcaacctcacagaagcatagttgggaggcctcaagcccgtgcggttgtgaggcatagcgcataaacatgtaaaccgactgtaatcaatggaattttatggtgccagaaatttagcaaatccgaaaaacaatgaaacgtgagcaaaacatatagtatgcttcgtgtacttaactgttggaggtcacctcactccgtccgacgttcgtccatatcgtgggtcgtgttggatgctgaaaatgattactactacatcgatccctcttaaaatataaatattttttattgtacatggatattaagaaagtaaatggaatgattgggaaaggttatgattcgtcacgcacatccaagtccatgcttttggacacgtcgtctccaattgcattaatacaatgggacgttgtaatagaatctggagttaacgcaatggacagacccatttcttttgccattccatttctcttgctgatcaaggaggtcgtgttcaattatcagattggatcgtggtgtgatttcctctgtctgcttcacgtagtttcaagcctagaccatgctatctccctatggataccgtgtcctctgtaggacacccctgcaagacacaacccctctctctgctccactcgaactcgctttcgacatgttgccatgaaaccacacgatagcgacatagcgtggaccatggttcatgcttaaacggctagagcatattcaatctgattgtggcatatgtcatgtgcacgtaaatatgattgcagacatatatcacttctacagaaacgatttttctgtacgagaacctctttagattgtaggcagatcgtaactgatcgcgtctgtaaaaatcaacctccattttcccatacggctccttgagagttccacatgaaaaaaaaaatctatttttgtaagcggacctcttaaggggccgtatacaaaaataagcatattttcgcatacgagctatttaagtaatccacatgtgaaaatacccctctcctgcacaaattttttttctccccaacactctcttttccctctcaatacttcaaattttatcatccttatctcctcttcctcccctctcctcatattaatttcttctctcatttctctcttcctcccctccaagcgggagcgggcggcggctggctcggtgacctcgggcggcactaccgccacagccaacgaggagcgacctcgtccctgcccggctctgccaccgccgatgacgatgaggaggcggccaggagtggctccatccccgtccacgcctggtgctgccaccaacgacgacgaggaggaggaggaggcggccaggagcggcgccacctctgctgacaataaggcagcccgatccgtcgccgccgccatcggtgagctagggttacgattttttttattttattttattttttgagatttttcttttggatttttgtttttgtgtgcaacgacataagcactcccgcataaaaaaatcgctagtaccgcataccttttcggcagataggctgcccaaccacatataaaaataggttttgatcggaaaatgcttttttcagtagttatatgcttccgttgcgagctcatggtgagtttggcaaagcccaagcgtagagtgtgttagcacacaaagttgcatgggttttatcatcaattcaagtcgttttcgttccatttaggcaatccaaatatattcatgcatgttttcggtcgcttttcacagtcttgctagtttagcttgctcaaaacaatggcacaccgtatatatgcgatcgagtcaatgaagtcgcacatcgtatcatggcccacttttaagtggattattaatattagtgtagtgaattatctacactattatagatatataaattaaatactactttaataaataaactaaataaataagtttgaaccaaaaatctaataagcaatacagtagaagaagagatttgcttttaataacatatatttaccggattttacaaataatccgcgacaataatcaatctgtccaaatgtataaattgttaaaagatcgaccgatcgatcacacgattaaagtgcgagagagctttaggcgttgtcctcccttgttccggttgccacaatccatggaagccatggctggaagtatctccagtgacgatcttccacaggatggttttcggattatctacagatgccttcaactgggagtggggcagttatatgcgacaagaggttgcgccggccattggcttcatctccggcgacctaatcgcagggctactgatctccttccatgtcttcggtggtggttcttcaaggggcagctaagttttcctggtttcactaaggtaacctcaacctccaaccaagagggcccttttggatatgcatcttggtatcttacagcactgatttcttcatcactggtgctgttgtcatcaatctgatctccagccatgagcaagaagcatagggcctcaacttttcacttatgcttatacttatcagccaaaatttgaatttttcaacctaaaatttggatttgattttggggtttttttcatcaaagtttatttttcagcttttatttttaggtcgctaaaaacacgtatataaaagttttattcgctaaatgacggggccaaaagagaaggacgggattgcttttttttttttactttttattataggagtcctactttattactttcaatacttaatgcaatttgcccatcttgaaggggactctttgtaaaactgcctgttcttgcagttggttatgaatagtactcctacacctcaggttgtgttaaaaaaaacaagaagaagaagaagaccacgcgatgtcagtacgagatccgttcttagtctgaactctgaacggagtaagaattctaagccatcaacgtctcagcattcagcaattgcagctttgcaagccgccgttgcgtgatgaactcgtccgttccgtatggggaacatgtactgtatagtactcacctactaccaacgaacgcatggcccccatgccaatcagaatctcaaaatctggtgaaatcattggagacgaaagttctggactaataaatcgctgactacgaccaacgtgctccgagactcggaatagagtccagttgaatcattagacctctgtttaaatcaactctaaaatttttcaccatgtcatatcgaacgtttgaacacatgtatgaagtattaaatataggctaaaaaataattaattgtacagattgcgactaatttacgagatgaatcttttaaacctaattgcttcatgatttgacagtgtggtgctacagtaaacatttgctaatgatggattaattaggcttaataaattcgtctcgctgtttactgacggattttataattagttattttattagtgcccgagcaccctatgcggcaccctacatgtgacacgccaaaactttacatcccagaatctaaactagttctattagtagtatgggaaattttactacaggaaattgtgacttcgtggttttagctgcagggcatcgcacgaagtgacttttgggggaatacactctataaatgtggtaatttgcacccattaaaataataattttccgttaaagaagagagagaaatcgcgtcaaatgtcagaaatacccacatgtcaggtctcccatctctcttctctctctgtctcctccttccacaccgcgccaagaccgacaccgccgcagtgttcactgtggaaggcatcggtgtacatcctgggcgcggcgggtagcaatatcgtgttcatggcggtgctaagcgatagcgtcgtgctggcggtgcacaggatcaacagtgacggcaccggcgcgagtcggtttagcgagttcaacgcccagatgagcgccnnnnnnnnnnnnnnnnnnnnnncagctccatgttgcctccgcccgaaccaagcacgtggtaagcctccccatagtccataggccctcccttctcctttcatcgagccgccatccaccatagccatatcaccaccgccatcccgaacccacttccaccgctggcccatggcactcgctgcctctagccatcctcggccgcgtcgccgcctctagaaggtgcgggacgacccactctatctgtcctggccttcggccgagccaccccctccaccacccgtcaccggtgggctcgtgccgagtcgtcacgcttgctcaccttccatctctcggttggaaggaagaagaaagggacctttttgtaaaaagcgtaaatcccagggttcctaatacaaatgaccgaaacacttactcgtgggaccctagacttatatgcaaataaagaaacaattagggttcgagttataaattgcgatgggtaggagagaaaagagatgagagcgctgacatgtgggtccaggggtatttatgacagttcacgtgattttcccctcccttttaccggaaattattattttaatgggtgcggtatccactagcaaattacaacgtttatagagtgtcttccccaaaagtcacttcgtacggtgtcctacagttaaaaccgcgaagtcacaatatctggtagcaaaacttgcctagtagtatctatctcctttagagacgccggctgatcgacacaagagttctttttttttcatcttgagctacactggccagggccggcctttgggtattgaagatgggaagaacaaaggatggcatgatcgattggtgtgtgtactggtttttacaaattaggtcctatttagtattgtcggagatatgggcccgggggtgtgcggagtgagggaaatttaccttcccatcctgccgcgtggccctacagcttgaccctacccccgcaccttgtggatcgcagaagtagccgaggggcctcgaggtgccacatcatgcccctcgggccctcgcgacgttttgccccgaggcccccgcccggctgccatgtggcgggaggagcaagcggggaagggacccaggctgtaccgctttcaatgcgtgcgacgccccaactgcccctcgccgcattaaatgcggtaggggcagacgtgcggtgccgtccgactgacgcgcgtcagtcaggaatgactggtctgtgaccggcctgtcgtcggtcgcatctgactggacgggcgaccatgccctcacgtcgcctttgttcccggcggagtggaggtaggtatgacccgtcccatcagagcatgattcggagctccctctacgagaaggacggtcgccacaagtcttcacacatttatgagggaatgacaggactgtcccccgtgtcaggcgggagacggcgttgggtctcactcaaggacgagctgcggcttagcttccagacgaaggcacggatcgaggtctagtcaaggtagggtgggtaccccacccggtagaagagtaggtagaggcggtgcatgtggtatccccttgagctataaaaggaggatcttgcccaccgagaaagaggatgactccaagcagacctaagctctagggaaaaagagacgagagcattctccggagcttagggacccttgtaacactcaaccataatccctcacataggagtagggtattacgctccatagcggcccgaacctgtataatcctctcgtctacacacaactagtaacgttcagggcagatactcgatctctaggggcgagccctttcccccggccgaactcacaaaaggggatctcacgatctcccgctagagaggttcactcctcgacagctggcgcgccaggtagggggaaatcgcgcgcttccaagggaggtcgtttccttccgccccaagttttcctccgccttcgacgatcatggtcgaggttttggaggaagaggtgctggtgcacacccccgctccctctaggagtgaagatgctagcgggagtcgcagcccccgtcaccgctgccgcaactctcggactccgccccgctgtgaccccctgcggagagaggatcccacccgatagggtggcttggccctctccccgcctccagacggggggcggccgcggctcgtcggagcgcgccgccgcctgacatatggcgacagcggctcgccccgaggtgcgcttcaggtggcaggagcccttctacggcatcctccggtgaacgcagagccggaggcgtccaacgatggttggacgacgtcgccaacctggtcaccactgctcagcggcagctggctgcgggtggccgttccaccgccactggtacgtcacgtacctccaccgccctctcatcggcaaggaggagggcccgtcggacggccccaacgtcatcaggggcctcgggaagtcagaggcatcacgatggcctctacgtggagcaggacgctcgaatcaacatcgagtgtcgccgggacaagcgccgcgctgcccgcatgggagaaggcgcctcctcgtctggagtgccgcgttcctcctcgcgaggcggccctcccctcacatccacccctagagggactggttgcagggccttcgtggcgagtctccggaatttccggtggccctcgaagtttcgccccaatctcacggagaagtatgatggcagcatcaatccctccgagttcctccagatctataccacgatcatcgtggcggcggggggggggggggaggggaagagaccgggtcatggcaaattatttccccatggcccttaaggatcaggcgcgtggctggctcatgacccagccccccgactccatccactcttgggaggacctgtgccaatagttcgttacaaacttccagggcacataaccccgcccaaggaaggaggcggacctgcatgctgtgcagcggaagcacgatgagtccctccgctcgtatatacagcgcttctaccaggtccgcaacactattccgtgcattccggcccacacggtcgtttatgcattccggaacggcgtgcagcacaactgcatgctagagaagatcgccaccaaggtgcccaagaccaccgccgagctcttcgagctggcagacaaggtggctcggaaggaggaggcgtgggcctggaactcccccaccaccggtgcggcggctgcggctgcccccgaatctacttcccgctccaagcggcgggataggaggggcaaacggaagccggcccgctccgatgacgagagccacgtccttgcggctccgcgcaagaagaaaaccactgggaacaagccgagctccaccgctccctctagtgagggtcggtcggcggacaagtagtgctcggtgcataacacttatcggcatagcctcgccaactgtcgctcggtcaagaacttagccgattggtttcggaaaaccgatgagaagcggcaaagtcgacaggagggcaaagcccccgcgacccctgccaatgaccggcgaggagaggccaagaagaagcccccgccgatgacggcgacagtagcgaggatctggaattccagatacctcaggaaactgtcgccacactcgacggggggggggggggggggcttgcgctcacacctcccgccgcagtttcaaggccatgaggcgcgagcttctggccgtcgtcccaactcatgagcggcatggaacgcgcgctggtcggaggtgaagctcaccttcgatcagagcgaccatccgacagtgctcgctcggggtgggaagttggccctcgtggtctccccggccatccacaacgtcaggatgaagcgcgtcctgatcgacgggggggccagcctgagcatcatctccccggctgcctttgacgcactcaaggccccggggatgaagctccagccgtctctgccaatcatcggtgtgaccccggggcacacgtggcctctgggtcatgttgaactcccggtgaccttcagcgactccaacttccgcaccgagcggatcgacttcgatgtggcggacctcaatctgccctacaacgcgatcctgggcaggcccgtgttggtaaagttcatggccgccacccactacgcctacctccagatgaagatgcagggccctagtggccccatcaccgtctttggcgacgtcaaggtcgccctcgcctatgcggagcagcgtgccgacagcctggcggcaagtacagagccacaggccccggaagcctccgcgccccgcgcttccaagaagcgcctcacctcggccgacgaggtgcccgtcaaggagatcccccttagcgatgatccgtccaagaccgccaagattggcggtacattggacgccaaataggaaagctcgctcgtctccttcctgcgggcaaactccgacgtcttcgtgtggaagccgtcggatatgcccggggtcccagcgaggtgatcgagcaccgcctcgcagtgcggccagatgcacgacccatccgacagaaagtacggcgctaagccccagagcggcaagccttcattcgagaggtgacgcggctcctggaggccggcttcatccgagaagtcatccacccagagtggctggcaaacccggtggtcgttccgaaggccaacggcaagctccggatgtgcatcaactacacggacctcaacaaggcatgccctaaggatcccttccctttaccacgcatagatcagatagtcgactctactgcagggtgcgacattttgtgtttcttggatgcctactctgggaatcaccagatccgcatggttagggaagatgaggaaaaaactgctttcattacgcctgtaggcaccttttgttatacaactatgccttttggtctcaaaaacgcaggtcctacttttcagcgcatgactcgcattaccttgagtaatcaaatagggtgtaatgtagaggcgtatgtcgatgatctggtggtaaagacgcgccaccaggacacattgttgcaggacttggctgaaactttcgacagtcttaggtctacgcgcatgaaactgaaccccgaaaagtgtgtgttcggcgtgccggtgggcaaactcctcgattttctagtctcatcctgaggcatagaagctaatcccgagaaaatacgtgcgatagagaggatgcgcccccccagcaaactcagggatgtgcagtgcgtcacgggatgcatggccaccctaagtcgattcacatcgaggctgggagagagggcgttgcccctgttcaaactcctcaagcgtcctgggccgtttgtgtggacggaggaagcggagcaagctctcaatcagctgaaagtttacctcacctccccccatcctagtagccccggggcccgacgaaccgttgctgctctacttgggccgcgacccccccacgcggtgagtaccgcccttgtagttgagcgcggcgagggtgacccgcttcgtgaacccggccatgggaaggaaccaggggtccccttaactggtgatggcccctcgtccccccacggctcggagcccaaagcccccaacccccgagagggcccctaggcccccgtgggaggaagagaggctctgacggatggccccaaggcctataacccagagatggcccgagatccccccgaggcccctgagcatgggcgccccgggccaacagcccctgacaacaaggaccggccccatcgaaaggtgcagcggcccgtctactttgtcagcgaggcactccgagacgcgaaaacccgatatccacaggcacaaaagatgctttacgcagtcttaatggcctcaaggaaattgtgccattacttccaagcgcaccgggtttcagtcgtgacatcttaccctctcggtcaaatcttgcacaaccgagagggcaccggtcgggtcgtaaagtgggccatcgagctcgctgaattcgacctgcacttcgaaccacggcacgcgatcaaaagccaggttctggctgacttcatcgcggagtggacgccggtggacgaccctgttctgtccaatcttccctccctccccggaggcggaggagacccgaacgccgacattcgcgccgggcactgggttatgcactttgacgactccctcaacctccatggtgcgggggccagagtcacgctgacttcaccaaccggggatgtcctcaagtacgttgttcggctcaatttccgagccacgaacaatatggcggaatatgaaggactcctcgcgggattgagggcggggccggaaagggcatccgccgcctcctagtcctaggcgattcccagttggtcgtaaatcaggtctccaaggagtaccagtgcaccgacccgcaaatggatgcatacgtctacgaagtgcgacgcatggaacgccacttcgacggactcgagctccggcacgtgccccgacgcgacaacgctatcgctgacgagttgtcgcgtatcgcgtcgacacgagccccactcccttcagggaccttcgaggaaaggcttgcgcagccgtcggcgaggttggaccccccgagggaacccggctccacggcctcggccccgacccctgacgacccgcgggcctcggggcccgagggggtcgatcccaacccccctcgtcaggtcgcctggatgtctgacatccaggcatatctcgacaataatactcttcctgaggatcgcgcagaaactgagaagcttgcgtgtatctctaagcggtacgtgctcgtagaagggaccctctaccggcgggccgccaacgggatacttttgaagtgtatttctcgggaacaaggtatcgagcccattgctcacgctcatgagggtgagtgtggggcccattcggcctcacggacattggtcggtaaagccttctgtcaaggtttttactggccaaccgcgttgcaagacgcccaggaatgggttcggcgatgcaaggcgtgccagttccacgccaagcaaacccaccagccagcccaagccttacaggtcatcccgctctcttggcctttcgcattctgggggctagacatcctcgaacccttcaaagcggctcgaggcgggtatcagcacctgtatgtcgccatcgataagttcaccaagtggcctgaggcttaccggtcgtcaagatcgacaagcattctgccctcaagttcatcaggggcatcacgtcccggttcggggtgcccaaccgtatcattacggataatggcacccagttcaccagtgagctgttcggcgactattgcgacgacatgggcatcaagttatacttcgcctcgcctgcccaccccaagagcaacggccaggtcgagcaagccaacgcagaaatcctcaaaggactcaagactaagacgtacaacgtcctgaagaagcatggggatttgtggctcgaggagttgccgccgcgagcagtcgcgcttagggctgagcaagctctcaccaatgtgggaaggaccatacaaagtgatcggcgttccccagccgggctccgttcggctaaccacggaggatggcacggagttgcctaacccctggaatatcgaacacctccgccgcttctatctatagcgacgcaattttttgctttctaggagctcgggccaacccccgcacaacccctcggtttgtgcgggcttggccgggggctaccactgtcaattactttgtaactttttccctttccaagcaataatttttttccgcttaagcggaggccgttgcacgccttttcttactctttcctatggcacgtcctggtccaaaggatgattcatgtttgctccgagccctacgtggcgttgggtgatccgaaaaccgccgaaagggagtccaaacgcgggccgtgccccgggctgcggcgaaccctgggggctcagaagggcctacacacggtcatccccgacctccggtcgtcgcagccttggtctggccagacccgctgggcggctccctcggggtaacgatcttacccctcgccacctaggtcccgcggaccgaacgcaaatttcccttttcaccagaacgagcccgaagggggggtacaaagatggtaagaacggcgacccaatcacagggaagctaactggatatatccgcctttgtttttttttcttcttttcttgccgcaggcattcaaaggagaaagcaagagtgcaaaacatgcgaaggggaggctttatttacaaacagggtggtgcaatggccgaaagattagaagcgttcactgcgagcacataacaaaataagagaagaaaagcagggatagtcacggagttcccaagcccccgaggccggcgccgctgaccacatcgtcccagtcgtcgctgccaccgccttcacttccgctctcctcgtccgaggtacccgaaggtgaaccgaggggccgatccctcgaagctggagatgatcgcgtcggccgcctcccggacctgctcccaagccctcgcctcggtccctggggggaaatcctcaagcgcacgccatgggactaagtcggggtcacgggcttggtggcttgcgagaactaattccaccgcagccctcggaatcgcccccgggaggggcactgccgctgacgctccccgcggccggttgtacctcggctgtggcggattcagagccggacccggcgtgtggcccgtgggccccgccaggatgctgcgaggactccatggcatctgatcagccgggaccaagccgatccgatcgctcggatttcaacccctgtgagggatcggacgtcgagaccccctgggatggaatctcactacaggagagccccgatcaagttaaaaaaaagagagaaagagaaagagaaaaaaacaggaaaccgaagtggatgaagagcaccgggttggatgctggcaatcgaacctgcgagggggccgtttgaaggtccactttgggggctcgatgaaactcccccggcacggctccgtttgccctatcttccggagccgcttcttcttccgtccgaccccggacgcggcagggcatttgtggcccgccggtggtcggtccgccgttcgctcggcgccccctccatgcggtggagaaggcggcccaaactcggacatttttcgcttccctttcgggtcgctggccgaatctcccccgggcccacgattaggaccgggcgccctggagccgtcgcccccgctggagccgccattccgaccgccacctgcggtcgcaccactgctgcccgtgccatcgccaccaccgccagcgccgctccggcgggaccgacccctgccagcgccgacgaccgtcatcacggccaggatactctcccggtcgcggtcgctgcagaggggaggatcccatctggaatcagtgtttgctcggcgatgtccagacccagcactcgccagatcaccatcttcgcgccctcctcgccctagtcccagcgctcacccacatgggtgcgcatgggatcgttgggcccagtgtactcccatgcgccacgggaccgctcctggaggggtgcgatgcggcaatggaagtagtcaccaaaaaccatcgcccccgttaggccctggtttcgcagacccctgaggcggtcccgcactgcgtcgtactcctcgcctagatccgaaaccgccaaccatgcggtggatcgctcggaagggccagtagggagccgaagtcacggatggtccggcagcacagtatagaaccaatccttcttccaatcctcccacttcttgcggaggtggctctcgatgtattgccccgccgtccctggccggggctagagatagcatccacccaccaccgcaccctgctacagctatgggacgaagaagtgctggaacagccgcattgtcggccgcaccccgatgaacatctcgcacaaatgaacgaagatggccaacgtcattacggcgttgggtgcgagatgcaaggcatggatctcgtagaaatccaaaacctcatggaagaacctggagaatggcgggatcaaccctgccatggcaaaggacaggaggtgcacggatcgctctgggtaccgcggccgcggccgcgactcccccgccctcacggcagtgtcctccggcatgatcttgcgggggaggctaaggtgcctctccgccgtgatgcgcgacgccgggagcacagcgtcaccagcgtcttgggcgatgatgactggtgatgaggagctcggtgtgcggagtagcgaggagcggcaagagtgttagggcttggggagcgagtgtgcgagtgagcagtcggcgagaggaagtaggcaaaatttccacctcctatccttttatccctgcctcacccgcgcttgcctcctcgtttcacgcccccactattgcccccacgattctcgcgcatgtggttgcctcatcgtttcctgcatccactcatcacgtcgcccactgaatccgcgccccgcgtttagtgcgcctgtcagcggcacactcggcgcagggcgtgcaatgttcacgggtgcaaactaggcaggctcgccgtcagttccatcgcgtgcaaggcgggcgagggagtcgaggcgtggtcttgccgaccccccgattttcgcgccccaagcgcccccgtcgtcagcgcggttagtggcggtcaaatcgccattatggctaatgcaccagcctgacagctcggcggcatctgtttagattccccaccgggcccacaaccacagcttgggaagtcgtgaggcgccacgtcagactgtcctcaaggggccaatgcccgacgtggtgtcgggggctactgtcagagatatgggcccggggtatgcggagtgaggggaatttaccttcccatcctaccgcgtggccctacggcttgacctacccccgcacctcgtggatcgcagaagtagccggggggcctcggggtgccacgtcatgccccttgggccctcgcgacgttttgccccgaggcccccgcccggctgcaatgtggcgggaggagcaagcagggaagggacccaggctgtaccgctttcaatgcgtgcgacgccccaactgcccctcgccgcattaaatgcggtaggggcagacgtgcggtgccacccgactgacgcgcgtcagtcaggaatgaccggtctgtgaccggcctgtcgccggtcgcatctgactggacgggcgaccatgccctcacgtcgcttctgttcccggcggagtggaggtaggtatgacccgtcccgtcagagcatgattcggagctccctccacgagaaggacggtcgtcacaagtcttcacccatttatgagggaatgacaggactgtcccctgtatcagccggggacaagcgctgggtcccactcaagaacgagctgtggcttagcttccagccgaaggcacggatcaaggtccagtcaaggtagggtgggtcccatacccggtagaagagtaggtagagccggtgtatgtggtatccctttgagctataaaaggaggaccttgcccaccgagaaataggatgactccaagcagacctgagctctagggaaaaagagacgagagcgttctccggagcttaggacccttgtaacactcaaccatgatccctcacacatgagtagggtattacgctccatagcagcccgaacctgtataatcctctcgtctacacacaactagtaacgttcagggcggatacacgatctccaggggcgagccctttcccccggccgaactcacaaaagggggatctcacgatctcctgctagagaggttcactcctcgacaagtatagcttcggactaaaaaaattttgaagccgagtattcctagctttataaatctatatatctaactttttttattacgttaataacatttggatgaatcattttattcctattttagataaaaattaaaatatcaaaccactgtaatttaacatatcaaatctagcatagacataagatatagagttgtgccaaataggacaatagaaagcaatcatcttgaatgataattaatcatgccatgttaacttggttgcactacgactacgttttcatcttcacaaacatcttctttctttttacaaacaggctaaagaaaactcgtatgtaaaaagatttaggagtgacccatatacgaaaattaattttcacaaaaaaaactacttaacaggtatatatatgaaaatatgtttatttttatagacgggcatgctaaaatgctaacatgcccacatgtgaaaatagaattttcataattagtgaattttcgtccacatgagaaaaggagacatcgttttcttctccttttctctcagtggcaagtcctgaagtgatcctctccttcttctcagtcctctctcacccaccacctctcctccccatcttcacccttcccctctccctcatttcctctttctcccccatcacttctctcacccagcggccaacgatggagcacccactacaggagcatcgctgatgaagcgcccatgacaagagcggccagcgtgcacctcaacacctcctcctccaccgccggttgcctcgcggcggtcgaagccagtgtcggcgtccctacgatgtcttctccctcagctcctcctcctctaccgctagtggctccgcggtggccggatttgccagaggtggtcccgagacgagcaggccgccagcagcagcattgaagcgatggatccgctggcttcagctggcggcggtggggtagcagcggatctggctagtggatcatgggctagggtttctgtaattattttgcatgcgggtgacttagcatgcccctatgcgaaagtaggtttattttttacttggttgcggtacccgtatgggataattggcatttctacatacacctagctagctgacggctgacgctaggcgatccttccgtccctatgaaaaagtgattctgcttgtttagaaaaagcattaatgtagtagcagtagtgttgacccattcatgcttatattactctctgctccagcaatgaagcttaaggggaaaaaaggaaaggagatcaagaacttgtgctcatctaaaagttgtgctccagtggaagccagcaggtaggttctccgtattcaactgtacacagaaatcaagacagacaagtgctcgtataaaatgagcagaagttgactctagaatgtgactagatgcgcggtccgatccaatcatctcgtcagatgaccaaagaagaaacatgtctcactaaccaagataatttgtcatattcgtacgaattatctatacctttctgacgtgtgtcttacataatgctactagatcagatctggcacataggctgtatttagttcacactgaagtttgtaagtttgttgaaattggtatgaagtgatagaaaagttatgtgtgtgtgaaagttttgatgtgatgaaaagttaaaagtttggaaaaaaaaactttaaaactaaaccgggcctagtaataatagaactgttctgaattttaacgctttagtgcatttttaaaaaaatcattttataaatagattatgtgtaaactaattccaaaatagctaacttacgacctcaacgacgacacatttctgacaatgacggggtggatgactagctacaattaatttttagtggagtctattcgcgaaacaaattttacaaaagaccaaatgtcaagatttttgtccattcatcttatactagattgaagacatgggaattttttagcgtgagtagtgtagaagtccaaagcacatcaaattagcattatactactgccttcgtccatgata

SEQ ID NO: 71313 - DNA, 8679 bp, Oryza sativa
acctcacctcacctcaggagtctgtgaggtagcccacttgtatttggtgtcggtcaataaagacagatcttcctatgatatgacctagaaacaggtctaagtgatcatcatcgagtcaatgccccgagcatactctaagacatttcaatgtctcgcaaacgacaatcaacacatagcacatactccccctgatgacaacctttgtcacaaaccatgttcccatagcattaaacatctctcagatgtatgcgtaggcaagaatccttcagatcctcaaaccattagtcttaaaaaacttgtctcatttcaccgctaaaatgagaatagggaacatagagagtaatgcatttcatcactatcatataccatagtaccacactgttatgcaacgcaatctgtttcatccttcagaaggattatggggataaataagtcgcaacggcacacacctcctcggcgtgactccatcaagaactaggtcttgatcattacaactctctctgacagtaccaacaacaattggggatccataagatcaaccacaagcctttcaaagacatgttgtaacaatcaaagtaactagctagtctgaaaatttaagcactatgggggataacacacagccaacaacaccaagtatacctcaataggtattagaggacaccactattccaaccatcaggtggagtagatatcacgagtgtacacactccaaagtgataatcgcgagatgcacatgtgcctacagaccctgtctatttgatctcatcaggttcctcattgcaatcttatcaggtcacaattgggtcttcatccctccaagggattacacaattattggtgtgctcagacttactaattattttgtatctcagaggaaatttcatcaatgaggtctccccgttagagaaaattccatcaatgagattttctcccaacgggagatggtactctttccggaatacctattggtagaagatttgcatgatgctattccactatggagtctattcaagacatcctcatggatttcccagatcccttaactgcatatttaatttcatgccattttaccaatacctttatttagcggaacattcaactcacgtgggagaggtctcatgaaggacctacttgaaccatcgcacatcaccacctcattatatcaataatgacccataaaaatccaaacaatgttcgcgattttcaattggcgattcggttcagcctcaactgcatttccatttgacccgatttgagcactgtatgctcatgccatggacttgtttcggatctgggttctctcagagagaatcattagcaagaggcgacatagtgtcgacacatttattcccacttacacatttaaccagatattcgtcatttcccaaaacgatcgatccatggttgttccgtattcctagcaccataatatgcgcgcattgctaggaatgtcgtctccacgacgaaaaccattatgaggtatatcaccttccaaaggtgaattttccaccaggagaatcagaggagtatgctcacatccagtgagaactcttatgctctgactaaggcctacgaaccgtgttagcaggcgtccccgcacaacatgatctaatgccataagtcttacctggatacgatattattcccgagtctatccacatttaccacaattgggagcattactcttttttaacaactatctagttgttcctcatatgattttgttggcaaaaactcgtgcaccaagcaaccaggagtatgaattaaacatacaagttcagctcatttagtgcgttcactcaaagaaatctccaagcattccaaaatgggcatttctctccccctaatgccgagatgtcttgcaatagcatactaccaatccccatatcgtcgcataggattaaggaatttcacctcgatcacaaatgttctcccacgaatgtatgcttcggtggtgatatatttgggaaatattacgcactttaattggagagatttttcccttatatgcagtgagcctggacatataccgatacaatggcatgaatattgtatccttccttcctccgaagggttatcctcaacctcctagttaggatatacaattctgcaaaaaccaccattgctaccaaatgtatatgcaaccaacatgcaaatactttagccaaatgcactctccatgaattaatgctcacctagtgccattcaaactcacaatcgattccggatcgacgtgcattagacatcccatgtcatatgcttaagtaggcaacctatggtggcaaaacgcattccgatgcgctcaacaaggagtatgatagcaaagtgcgcggccactagcctgcgctgccaagcagatttttgtggtgcagagttatgttaaagtccagctcgtctaatgcccaagtttgacttcaattacttataccaaactctagaattgggtcatagttaagcagcatgtttttaggtacgatccacgagcgaattatcaaaccacatttgctaatgtcccctggacatagccatcagaagataatcaatacctccgacaatggtaatattcacaataaaaccattatattcagacatccacaaaaatagtggaatatgtcggtgcaaccgtcgttggcataacgagctcaacgcatacaacatgacgaacctttgcatggctggcacacgtccacacgcgaaaaatgccagtgtgcgacaaacatggtcatcaacccgtgggtgatcaaccaacacaacctgggagtagttattgactacgagagcgcgataacacacaacagtgcatagccaacatttgtctgaaatacagttacgtcaaactgtgtgagtggttgtaactcctcggattatacactaattgttcttctaaactaaagcattttatcaattctagcatgaagataagctttagaatagaacaggaaagaccaagaactttatttatctaagaaatatcgatctaatacaaagttccaaactaagcaaaagataaactgcttggcaacagtatagtcgaccaatgtcctcctaggacatgctctaaactagccatacaactcctgttgtcagaacaactttattagacaaacactaccaacaattggtcaacaaccagaggtgaccatttagcgctagatccacacgaggaccgagactgagtcaacacccaagtcaagctgttggcgctatagtgaaatgggaatcatgcctattcacagcatctacccttgggcttattcctctagatttgccacctcttttctggtgtcctcgcaagacatcaggttccaaataatattgagaagatatgtgcacaccaagggcaaccatacgaacagtgtcattccaccacatggaaaacactttacatctttcaccgggccaggtgaaaaatatctcaaattattgaacctcacaactccacgttgccagaaaattgaggtataatcatttatctccaaatcagaaaagcgtgctctcaacctttgggaaagcaaaaaaatgtcgaccatagtccgaccatactctgattgagatgttaagccactagggaaaaggcacaatgaatcccaaacacattgtctaatttcacacatttcaacgactcagaatcccattcttgagtgtgatcatagggatagagtgatctacattaatgcccaaagccatacaatagtcattgaaggcctttacgtgaaatcacccacactatcatccgaatcgtttcatgcggttctcagagaacgcaacacgcaaacggacgatatgcgcagtgaattcggcaaaagcatggatctcgtacaacaagtatacgtgactccatctcgtagacacatcgatatcaccatttatgtatggaggagtgtatcagtaaagagtggtcttatccatagtcatggatatttaatttcccagaatttccatgcattaggtgattttctgttatttatttggtcttatttggcattatattcccaatatttatgccacacagaaaaccatcacacataaatgcaggaaaataaacccatcataatgcttccaaggggggaattctacactatgtgtacacaatttatggaagcatcataacctagaaaaccatctctagattatttagttggaattgcatcaattttaaaagcaaagcaatgcttaaaaaacaccattacatggttatttacgagtctggagacccacatgcaaaaccaaactatacaagtcctaagcaacaagacatagccacagtaacaaaattaatataatctcttgttaattacaaggttcaaactgtaaaattgcattaaccagtgaactatagcataaaaacccaacactccgggggcttaaatgcaagttgtcaataaaccgaaattaatcgggccgaattaccgttcaggccacgatcttatttgggctagcaagcacagcgtagcccaaaatgcctaatgggccgaatttccgaaactgtaggcccatgaggatttccaggtttattatttttattaatttgtttgggctgtctcattactgttgggctttattcagtcgggcggaggcagaccggcccagccggttcgcctaagtgaccgagagagggaagggggggaattagggtttcccctttcccattcattgtccgcaacggcgtacaccgcccggcgcaccggcccctcaggcacggcggcggcgttggaggccgtcgactgtcgactttgaagggatttagggcggcgcacggcgaggaggtcatcgacgacccatccactaccgcgattggcaggacggcggcaacgacattactcccatgtggcaatttggtgcggtggcggctcggtggcacacgacggagctccgcgtcgacccgcgcatcctcatgacggcggcgaggtgaactcaacgacggcaactgagaccccaacaacggcaaccaaattgcatccggccatatcgtctcggcagaggttaatccagtagcagacagccgacgacccatcatcctcccaccacggctcgacggtagcgtcgatgggaggtcaacggcggcagcgcctcgcttcggcattaactccggcggcaacgacgatatgggtttagggcttgctccaagacggcggtttcctgcgacggcatcaacgcaaggccgacggtgtacccaacagcgacggcgaacgacagttgacatatctccaagtccgactgcacagactgagaatatgtcgtcgcgttcccggcgtggcgtcatcagagaaagagagagagagagagagaaacagagagatgcgagggagggtgggcgagacggccggttcggcccagccaaattaggcacgtctctagtccaaggtatcccatcaattttagtgatttctctcacactgttttctctagttttcatcagataaaatagatgcatatagatcaaaagcagaaaattaatctactgctggatcaagagcaggatcaaatctactgcaagcaaagcatccataatatgataaaaacgagaaaatatatataatcaatcaataaaaacatatatagaccgcatacctcaatagacacatgcccggatgtatctatatatgaattagtaaattagtttagaaactaatcttactaattaccgtgattagcgtggttgatgaagagcacgtatttatctcttggtagtagatgtcaggtgcaaccaagcctcgcatcgcatgtgcgtgtggctgacgtgcatgtaggctggccgaccggccgcctggtggaggcccgactgactcgggccatgcatgagattgatcatgcatgtggctgctccgtgcggcagggcaacacgcgcgcatgccgatcagcccatggcctgaagtctcgcgcgcagacgacggcgagaatcgatgcgcacgcggcggagccgtgagcggcatcgcacggcggctcacgtcttgcaggccggaacgccgtccgtccacggccggtcgcgaggtcctccgtggacggtcaagcagccacggacgacaattcctctcctggctgcatcgtcagatacgcgtgcgacgtgccactgccatcacggggaggcgatcggccggccatacttgaccaatcggcatcgcgcgtcacgtggaggagacgccgcgcaggtgccgctcaacggacggtggccaacacgagcacggcggcggctcgcccatcggctgcgctacatgcaatcatacaggaataacgacaattagattggaacgacaaatcggagatggtagagctactgataacgtgttgtaaaccaacacgtctattagcggatcatcggatccgttccatgtccctcacatagcagtagaggcgtgagatgatgtaaaatacccgcgcccatccctttgtcctcaagaacattgtagaagtagacaatgaacacagatatagggtggagctctctcttcattatagatcttatctggagtacaagctagccattaggcattagatgtcacaccctgcccctgtatatataggggtcttaggaggagatagatcttatctctactccggttcggattggtccacaagaaaggatctttatctccccaggagataatattccgtaacacttttctcctgaagatgaagattaagtttttttacgcaaaaccaggtggtattaacgtatgattgattgagttttaattattataaacttgaaaaatagattgatataatattttagagcaactttcatatagaaagctttcgcacaaaacataccgtttaacaatttgaaaagcgtgtcacgaaaatcttaatcttcatctaacttttgttggagaaaagaacgggacctttgtattgaattcactatttgtattcaactcactatatatatatatatatatatatatatatatatataagaatatcataggtaggaaattattaaatgcgtgatttctttcgtcaaagtgttagcaaccaaatttggtaacatcagcatcggagagaagattagatcgaagcaaagtcggaagcggagatcgagtttgaaaatagggtaggaatcggctaaagtccagatcagctacgacaagatcggctgagtctgagtcgagctaaataagccgatatagccgattccgacaataccacttgtgcgcgacaccggttcaagttaatgtacttcaagatgattgccacgtatggatagagtctttcacatcctgattttcgttttaggatttataaattatttaataaagtattattagaatttatattaaatgtttattaatttacaagtgaagttaaatgtgggaaataaaatttcctaaatataaagcatggatggatttattttttattaaattctccatggttaattatactctctggaattttctcggatttttcggagctcaattcctaattttaatcatacaaagaacatttcagtaattatccacatattaaattaataattaaatggtctgtttttaatattcctaaatactttgagtgtccaagtatgttcaagatttttcttggaattatttgagcattggaagtatttttaacaattcaaagatcatttcagtgattaatttaattggaaaagtaattaaaatccccttttccttttccggctgaaactggaaaagttcaccttcagtcctcggcccattctcccttcctttcagctggctttattcctcctctgaagtccatttcttgtccctccttcaatcgggctggagaaaaagaagcccagtcaaagtctaattcgcgttcctgccacagtgtcgtcttcaagcttggacatagcccgtgcagccgccgagccgtgtgtaccgctgccgattcctccgcccgattcgctcgattctctgaaccgtttcttgaattagttgagggtaaatattcttcctatcctcctctatcttttcccccaagaatcggactttatcccgaagaaatcaacgcggaatcgagctcgattcgagtttatctctccaccaaaccctaggttttcccggcgcgattccttgcgttccaagcccgatctctctctcccatgcctataaatagaaccccaaggctctcctctttcgtttccaacctctagctcgagctcccgtgccctagccgtctctccccacgctagccatctctctcctcctccggccgccgctccagccggctatagccgtcggctccgccatcaccggtcagcgccgtcgcctccatcggtaccgcatcgaagagaggaagagcggcctccacttccccgaagccgaagacaaccggaaggccattgccgacgtcaagccgatctgcttcgcctccatccgcgccgtgccgtcgcctcagtcgtccccgacttgtgccgccacctccctcggcatcgcagcaccaaggagaagcccgtccacccctccgttgccgctgctcgtcgccgaaaagccgctgccgtcgtcgaccagtaccttgccgccttcggagtttgtcgccggccgtcttccgtcgtcgttcgtcgtcgtgccgcccctcagtgagttccccgcgtcgtgctcgtcgcgttggtgccctccgtttcgccgccgtgacctagatcgccggtgaccgtgatgtcccgagaggccgttgatgacgtcatcgatgacgtcataaagccctttt

SEQ ID NO: 71314 - DNA, 815 bp, Oryza sativa
tgtgctaatgtttctaagcatggctaagcaatcatatctaatatctagctgaaccactatatatagcccaactagtcaaattataataacccaaggtatcaaggaataaagtaatcaagaacaaaagggctataacaaacaataggttaattccacccaatgacatttgaaaataaatgcaatagttgaatagaaacaatagctttaaacgtgatcaacatgctcaaagggttgtttgggatctgtgtgacttgccttactggccttggaactcttcaaaatcctctcctgcaaactcagactctccgaaaacgtcggaacctaaacagaaaagagcaaaatcaccaaaacagaacacaaaccagcatgaacagtacatgtggatattttcaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttaaaaaggaaaagggaattattgcgtcagcgagtagggttcgcggtggaccgagtgcacggcggcagctcacggaaacgaacggccgagatcgatcctatccacaacgaacggccaagatctaacggtctacgaccggtctacgacggacggcaacgatgacgtcggcaatgacgtcatcaccggcggcggctcgggcggcaagctcgccggcgaacaacggcgcgacgacgcgaacgaagaacacaactcgtagagggcaacgtggcgaact

SEQ ID NO: 71315 - DNA, 5260 bp, Oryza sativa
caaacttcacgacggcgttggcggccgccatctcgtccgtcgtggcgggaggggctcatcatcaggctctgtccaccacaccccgtggcagcgccgccggcgccggagacggcaacggaaacgggagctccgccgcggcagtcgccaccggcgccgcctcgccggcggcgacggccgaggcacctgcggcgtccggatcacctcctcggctcgcgacgcagtcctgcaccacgtcgaattgatcgatcacagagacatacgtgacatatatcatatactagtatgaatcattcatgcgtgcacgcatgcgtgcatgacgcccacacatacttgacatacataccgttttttgttttgagatttgagatcgatacatatacttcttgtattatgtacagtaaaacgtatggagtaaatagtagttactagtagatgaattgattatatacacacagagttactgagaaattaattaatatcactgtcttagtgtctttattaattaggtttatttcattcatattggggaatttcctacaacatgctacaagcattgctgtacggtactgacataaccgactgagatgcaaacgttgtttagtggactgggccagctcagttttcggcccacactacgaacgcaaatatgcgtccaactgatcaaattaattaacatggacgccgttgatttcgatccatgatctcccttaggctttgttggggaacattactacaccagcgggcggacggatggaaggcaccgccgagatcgagacgcgatgaatcctcttctcattttaaagtccaaatataccccccaaacttttggttgaatttcgtctaccaccgtgaactctaaaaccggacatgcaaccccgtaaactttgtcataccatccatattatcctctaagatggttttgtgaattttgaaagcttgaacgaacaattttcaataactaatataacatatttgcatattatcaattacaagtaatcaatttattcgtatacagtgatattataatattattatgttggcatttatttgaaaatgagagctaataaggagaaaaagaaagacttaaatcaaaattttaatatatgtgcctaaagtgtatgacatgtgatcaaactcatctaacttatatacaaattagataaaatcactatgcaaaaccatcttaggggttatataaacggtattgtacgtaaagtttagggggttgaacatctgatttcaaaattcagggtgctagatagacttccatataaagtttaggggttatttggactttttcctttttcaaataaaaccgaccgaaagggagctaggcggccgcaccaaatgctggaagttcaggtctggtcggggttacaaacggcgtccacacctggacgctacaatagccagcatccatcctataattaaaattttcatatatgatttactacatatttgtaattaatgggttattaattatctctaataatataaaaagtacccgttcatcaaacacaatctcttcttccattcgcccagctgaaagttcgttctcctgcgcctgatttgcattcaagagacttcattaccctgtcttgtcaaacccaacctctagccgcacccgtatccaatggcattcactctccacgtctcaaatctcctttctgccctcccttgcccttgcccgcctttacttggcttaactcccctaaacctaccgctcactcctttcaagctactcttcttgcccacccaactcccagtctttttcctcctcgccctcaaccctcgaaaaccaaaaccactcgccccaagcccatgctggatcgctgcttccgttatcctgctcgtgaccactaagtcaagaagtgcagagactcgttgatctgcgctgcttgctgcctctcctggcaccgacaagactcctaccgatcttctgtaggctcaaactccactcccagacaaccaccttccttccccagcctccgctcgtgccacctagcatcctttgccgctcattgggtgcgcaaaacctcctcccagaaaccccacaaaacctcgcttccccactgccccaggggaggaggtagagtatgggaggggagtacccaggaacctcgtcaagaaatatttttagctatacatcacctattttcaccatatgtacacccctctcaatacaaatttagacacccgcatcaacttaaacttgatctaaaatagagtaaatcaagcaagaggcaccctcctccatttcgttctagctccgcccctgcactgccccttaccctagctccaccaaaaccctaatggcggacaaggcagtgactgcatcagatatggcggtgatccctctggaagtggtcattggtctgcttgaagccagcctggcgaggggctccccccccccccccagctactgacggcctgtctgctgctgctagtgcgacggctgaactcacctcggctgtccccatccccgcgccttctactgctaaagccctagcgcgtcggctgatggtttgacggccgatctccccactggctcttcccagctgggggatttgcctgtcgtgcctgcctctctgaccgcctctcagggtctggtcggggaaggggctccgctggccttggtcccggaaagagaccttgtgccctccgcttctcctcctccgctagaacaccagaactcctccacttacaggcgtaaaaacaagggcattctttccattgtgggtgccaacccctctctcctggagcacgtgcctgaggttgcacccccctccccccccccccaggatgtctttgtcctggggagccctagtgcctttcaccccctttctcccccgccacaactactcataactttcggtccctccctccaaagaatgaagccccacctacccccttggccactctgatcggctgtgctctctctggcattcctctgggcacaaagcatccctctcatggctcagatgacgatgagattgagtatgcttcaagggacactcctgggggctctggtcctgcacaagcagaaccccttcttccgacaaatctggcagaagaagatttccaagacgccttcattctgtttgttgacatgcgtatcactgcgcattttgccacggcttacaacaccccggccagtgacactcctgcccggatcatcacgaaaactatggaagcggctcatcctaccgccaccttcaaactggttgcctcctctcggggcaccatggctcttcgctttgccagtcgggctgacagagagactgccgtcttgaaccaggaaggtctagaggtgaacgatcacattgtgatcatggaaaggccaaaggcttctatccaaaattcaatctaattttggaaattccaagggtaggataaaggtgacatacaaaagaaagaactaagatactctcactaaaatataatctaagctaagtggagaaagaataagaaaaaaatccattcatatacttctagtatacaaacatctttagtctatactagctagtatatagtcgtgcaaccaataccccttaacagtgctctcctggtgtttcgagatgaccacccctgattgccgagttccttatgacaacctgttatggttgtccaaccggggctaaatacggaggagtaccctccccagaaaagtgtcttaggagtatatactaacgtggaggaatactcatactgagctgtcaccatcagcgatccgcctactgtcccgcaccatatatgcccaattaatgatatctaataattctggtcaatgatatctaataatctaagcaccaggctcatattattaaatactactctacatccgagctcccgaccttgatggtgatgtaatttcatcattttgctctgaaccaagacaaatgttactttcttattttttgtgaaattagttgttaagaagatttggaagctagagaaaaatatttgtagaacatgttgatgccatttttccaatctaatagtggattagagtttccaccttttgctgatgaactgattaaagttacagtaactggttagagtttccactgcatctcctacagtaaatgattaaagcttctaaattactgatgaactgaactctaaaatatttacctttctcagcatagcagtgtttgggatgcaacaccatgtgaagtgcagttagactgaattttggagataaattactgaggtgctgaactctaattgtgaatgcctttgtactttttgttcttttaaccctgatggatgatgtttgtaagagaagtacatatgcagtgctatttcggtgaccaaggttcagatcaaatcatataaagtaaggctctaaaagtcatataaaatactatgattgttttcctttttctaaaaaaaaaaacccctcaggtttgcattttggattgcatctcaggctactttggctgctgctctaggtaatttgctatcattgctcgttggtctgtgttttgtaatccagtctttaagatttgtaaaggataagatacaatctcaggtaaaagattcatggatgctagccaattttaactgcgtaaattgacatcgacagcggcattgaatcattggcaaattaatagatgattacactgtaatatagattatatatagtagtagataattcatgttgtccttgcacctgcagaatttatttgttataatcaaatgcaaatgggagtattaaatactggaggttgcataaaggactaaccacagtccaaacattcagatatatgttgctgttagattgcgtctctggatttcttcagagtctgaaattttcttaggtgcttgtgccaatcttacatggccttttattgcttctcatattgggaagtatagttctctggtatgccctactcttaaatgttcttttctttgtaatttcaggttgtttttgttctaatggtctctgagaattgattttgcttgactgtgtgccttttgcaatctttatgctctgtaatctcgaaggatacactgttaaattgagttttatgggtctaagtataaatgggctgtttatatagaacgtcaacattattactctgtttgccgctgcataaatttccaggggtcaaaacatccatttagcttttattggcatgaatccaatgattttcagggttcaaaaaataacaccaatttggcgtttatgactgcagagatatgataagttcattttcactgtccttattaaattttcaaatgaatcagcattgat

SEQ ID NO: 71316 - DNA, 1431 bp, Oryza sativa
cctctcccttttcaatctctattgttcaaacatcaacccaaatagaaccacctgacctagatctaacctaggtgatcctagagcaaagtttaacaggccatagttctcggatatactacagggtgacggagtcacaggccgccgtacgcgttgagctcttcctgggccgatcgacctggttgggctgatggaatctgggatttttggttttctctataactgtgttgggttgtatgcccatatcacctccattcgagttgtatgcaccgggagcgtacaatgtttaccagaaataactgtgttggtctttcttgtccggtcagtcgcccaagatgcttagttcgtccatttggttctgtatggtcgttagactttttaacatggaatttattttctgcctcttagagcatctccaacagatatataaaattagaaacataaaaatcctattttggggacagcccaaaataaaaaaggcccaaaatacaatccttctccaagagatgcctaaaatattggttctcaaaattttaaaatttgccacatcatcattagtgggccttttcaactaattttctacccgctcgttaaaattgcctgcgagcgcggagggggcgatcgcaatgcgcacggaggactggacctggactacttggtcgatcgtgatcctagtcgcgcgggagatcacgagttagcaagtacaaattaaccagtcagcaacagcgagtgagatagtcaagcagggtacggcagcgagcagcaaggattggtgacaggcacaagcccttgtgcgtttgaaccattctagcacaggtagcaaaattttgctaacaatgctttgttgtatttcatttttttatgtttctgatctgacaatgtttttatggaaaaaaacttaatttgatatgatgaataaatatttggaaaaaaacgaaaagtctagctgatcctctacatggcagtgtcatcaatctgcaggttaaaattatagacgaccatcatgttaggattttcttctatcaatcacgttttttttttatattttgatctgacaatatcgctaggtgagaacttatttagttgtgatgtttaatggttggccagttgatttgatccgtgatgagtcgtcctcgctcctcgtatcaacggcttgtggatgaatcatcgtccgacgatgatgattttctttggggggcgcaacactaaacctgcatcgctattgacactttgatgatgcaccaaaacactgtgtgtctatgatgggacatgaagtggttgatgcaaaagaagaagcacgtcaattgagattataccaagaccatttttctgataatcctacctatagcccagttttattcaggcacaggtttgtattaagccaatttaatttgatctatctttattatatgaatagatacgtatgccttatta

SEQ ID NO: 71317 - DNA, 1131 bp, Oryza sativa
acccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccacttggcgggcactctcagtgtctatcagaatgccacgggcaagatctgcggtgtctggcgacgagttccacgtgattacaagcgcatcctgcgcgacgatcgtctccctgttgtcctcctctggggcaacaaaccgcaggccgagttggctctggccggaaaggtggccaaatacgcggcctg

SEQ ID NO: 71318 - DNA, 7555 bp, Oryza sativa
gtgaaaaaaaataaaattcaaaaaaaaggaaaccctagccggccggccggttatgccgccgcccgcccccgcctccagatccgggtgacctgaggcccgccgccaccgaccacgtcgccacccgcatcgtcgtcggccgctcccgccgccgcccgccccggttccgccgccggccaccaccgtcgctgcccgccatccccacccccgccgcctccagatccgggcagcccagccgcctccaaatccgccgccgctcgccagccccgccgcctccagatccgccgccgcccgccgcctccagattcggacgggaggagtctgtcgccgccgaccacatcgccgatcgctcccgtcgccgtcgaccacatcgccgggcgggaggatgcccaccgcccgcgtcgccgcccgcatcgccaccgttgtggacgccgcccactcaccggatcgccgccgtcgcccgcatcgccacatcgtggacgccgtccgtatcaccacatcgccgccgtcgtggatgccgcccactcacccgcacccccgccgctgagctaggtcgccgacgccgcccactcgcctgatccgccgcccccgctgcgcgccggccgtcgccgtagccgcagccgctccctagggcggcggatccagccctcccgagggcggcgccgccggatccgccgcccgccaacgcatcgccgcccggcggcactctcggagagggagagggggaggagaaaagaaagagaggagaggagagaaagagagagagagagggggtgggtaaaaaatacagggagagatagaggagatgagttaaaaaaatttgaagtggtgagagggaaaagagagcgggaggagatgaaattggggtggtatttttgtatgcggaccacttaatgagccgtctgcgaaaatagatttttgcatgctgttccttaagtggaccgcatgcgaaaatagttattaaaaaattaatttcaaaatatgagaacttcgaatccaattttaggatattaaatgaactcaaatgaaatagttgtcaaaaacaaagttgtagaactcgttgagatctaacaattttcttttggtcatttctccatccgagtttcatttaactatataaaatttgaactttataatataagaaattcaaatacttttttcacatagtaaatgatttcaaatataaaagttgtcaacaacaaagttgtataacttatcaagatctacaacttttgtattggtcatttttctatatgactttgtttgtacagtttaaatttgaattttcaaaatatgagaacttcaaacaacattttcaaatacaaaatgatttcaactgaaaaagtcatcaataacaaagtggtataactcatcaagatctataacttctattttagtcatttctttatccgacaaagtgatttgtaacattattcgcaaaatgtatatctcttatatagttttatagaaactgcataagagatgtacattttgtgaacaatcttacaagtaactttattagatgaagaaatgaccaaaatagaagttatagatcttgatgagttatacaactttgttatcgatgatttttttagatgaaatcatttactcttcaaaatattatttgaagttttgaaattcaaatttttaattgataaaataaagtcataagaaaaaatagccaaaataataccaataagaacacaataacatgatagagcatgattttagaaacatttagaaaaaaaaatcatccaatttagagttcatatgagtgagatacactattttcaaattttattttcgcatacggcttcttaagtggctcgtatggaaaaatcgatttttccatgcgggcgcttaagtgagccgcatgcaaaaataagcttatttttgcatgcggccctcttaagaggcccgtataggaaaatcgatttttccatacgggccacttaagcaaccgtatgggaaaacgccagtagttatgatccgcatggaaaaatgatggggcctcgtacagaaaaattattttttaagtagtgtgggatgacttaattaatagcttgtctcatgtgctatatgtttagggccaaaatagttacaaccttcgtctcattgatcatcatctgatcattaaatgataaccgatgctctctcatctcatcatcttactcgtcatttgacttgttccattaactttttataatttgtgcgtgtttccaaatgctgcacgcatatgagcagcactggatccaggactactccgtggggagagtgacggatgaccagggccgtagggcattcgccctggtgaataacctaggcggtacgagaagagccgtgctgatcagcacaaagaataataggcagctggagatggctccctacggcgattgcgtgaagctgtcgatgctgtggtcgcagggcgtgcagctccccggtgggtacagcgaagtaagggtgctcagtgacctctccatgactctcaacggcatcaacggatttgtcaaggaaggcacggtcgtgggcatctacaatgcggagccacactctattcatgccatctggaagtttgatccaattaacaagtgagatgatgtactactatagtagtagtaaacacgaaatattatatttgcatgcacttattggtcatcttaatttgtaataaacgtgcacgatttttcttccgccagaaaatttgtgtgccattttcggatcaggtttgtttggcaggaaagacctgccaccagaagccgaattgtgtgtatcgggtttccaacaaaatcgagagatatcagcaactattagaagattgggacctagctccttataatgttgcgttctccacaacatctgcgagtgcgacggagatgccgacagtgccttagagctcttcgacaatgacatggtcatcgataacgccttccgcgcgcctcgctaccgtgcagacccacaccaccatctatgccccttcactattgtcgacgccttgcccacacttctgcgtggaggaggaccaagccgctcccgttgtcccccgctctgtcccccatagcctccatcctcggcgcgcagaggaaatgtggcggccagccacgcgtggctgccttggatggtactgggaagagaggagaagatagtgctagccactgaaatgtgagggtgtatgggtcccacgctgacttgtttgccacgtcagctaaaagcgtaaaaccaggcataatactgcctatgaccttggtgatacgaatttcaaactcgacgacaattgatggaccaaaagcaaattaactcgttcataaatatagttaaatggaataagttcacttgaggtcccttaacttatcaatgaatccgattttcatccttcaaccgaaaaaccagatacaacgggtccctaaactatcaaaaccagtgcaaagcaggtctctcagcagttttgatggtggttttggctgatgtggcgcttacgtggccagtttgacttgatccccttcctacgtggcggtgacgtggcattggaagcaaaatataaaaataaaaaataaaaacaaaaatgtgaggcccacatgtcagtcagacaaaaggaaaaaagagtgggacccacctcctctctatccacggacgagtggacgacggttgagggagcgaccgacacctcctctctctccctccctacatccttcctcaccagccggcgagcgcacacggagagggaaaaaggcgtcagccagcgaggggggcggagctgctggccgcccgcctgctgcgtgcggatcagcccgccctggatgattctctgccgtagcgtcttgccgccgtgcggccagtcgaaggagttgacggtgttcagcgtcgccgcgtcgacgcggctgtccatgttgaagctgatcggcacctcgtcgccgacgtagtacgtgttccgcagcgacgccagcagccgccgcagcgacttggcacggttctgcgtgatgatgttccccgagatccgcatcctgttccagtctgcgtgaaatccatagatcggttagagctttgatgtagtttttggttgcaacaatggcgaatgagaactttgaggtagaagaagattactgggcagagaggtggggtggagggtggccatccagagaaccttggagatggagttgcgggggaggaggacgaaggcgatgtggttgatggcggagtcggcggccatgcggaaggcgtccttgatcttggcgtcgacgttggcaacggtgatgatgacgctcgggttgtgcatccggatgataccacgcatgctagagtagacggcctggaggacgggcacctcggagtgggatgggccggagagcgcgccgacggcaaggtcgaagatcttgaaccgcctctccttgcacaccaccttgggccacttgagcaccgtcgccgcctcctctgcaggggtagtgcccaccgccggacacgacgaggtaagccttacagccgggggtggtgcagaaccgctctagcagcaacgccagcgcgtggacctcgctgagcgagtgcgcatagaagagtgcgtccaccttctgcgggtgcatggcctcccactgtgtgacgtagccggaggtgagtgcgcgccaccactgctcgtcccgcatctgcacgatgtccttgaagatcaccgtcgtctcggcgaggtacgcaagacggtgcttgctgtccccccacgtctccttggccgcaactccacctccatcgctgacctcccgtactacttcgtccacaccctcctcaccgtcatccacgccatcctcccgccgccctccaactcccgcaaccctggtagcctagctccgcgtcgcagcccgccgaagagtacggcgcagtgggcggcggccaacgggcatctccgcccccctcgccggccggcgaggaaggatgccgggagcaaagaggaggcgccggtcgctccctccctcgtcgtccactcatacgtggatagagaggatggtgggtcccattcttttttccttttgtctgactgacatgtgggccctatatttttttttatttttcatttttatattttgcttctagtgtcacgtcaccgccacataagataaagaccaagtcaaaccggtcacgtaggcaccacgtcagctaaaaccaccatcaaaaccgctgagggacttactttgcctggttttgatagttgagggtatctggtttttaggttgaaggacgaaaatgggattcgttgacgagttaagggacctcaagtgtacttattccaagttaaattaaaggaataagatcactttgactcctgaactgaccactgaatctaaatcgtatccctaaatcacaataccagaaatcttaacccccaaacttgcaaaaccggtgtaatttgactccctttgtggttttgaaaggcggtttcgctgacatggtgcacacgtggcagtgttgacccagtctttgtcctacgtggcattaacgtgacgcttatgtggcattaaaataaaaaatatatatgcggggcccatttgtcattcacccaaatatatttgtggtagatcccacgtgccatcctcccttatcccttcgtcctcctccctctcctccctctctatctctccctctttctcttcgcgcgtggggagtggcgtccggatcggcggcggcgatggggggcgatggacgaagcggcagtggcgggtgggagggcaggcgtgcagccattggagttgcggatccggaggctagatatgcccctcgcttcattcctcctcccgatagactacaccatggccgctgccgctgtgctgccgaccgtcgccggggagctagccactgacgagaccaaacattcacaaatctcaacagggctagccgcctaggcccaaggcagagctggctggctactaggaggacgcgggagctcgggtccctcggcagcggcgcgggcgctccagctctatctgtttggccgcgtcggggaaggggaaccatggcggagagggtgccttgcttcgaagggggatagggaagaggacaaatattgcccgctgggcagtagccaaaagcaaaggagtgctgggacacatctatacacagctaaacaatggcgatagatcctacaatgctcaaaactaaaaccactacatcagttcaacatctcgaaacaagaaatttaaaattgaaaaaacaaaacaaaataagccacgacaaattgtccaaatttcacacgccgaccagcacggacttgaggaaactcctttctcagcggcatggctccggcgtcctcaaaggacaccgcttctgacgtcgacaaggacggtcactgctccatacacggctccggcaacggtgggagggtgtcgttaatggcgctgctggagtaggcggagcggcggtgggcgacggtggccggggacgccagcctgagatgcatcgagggaggtgatgatgaacgccatttggtgacgcccacgccgatcgtcgtcgcgagcaccgagttgcggctagctatgccggccgccttgaagatgcttgggtcgtacagcaccacggcctttaagccgatgaggtgctggaagaagtagatccccaggacggcgatgacgatgcgccgcaccggcggcgtcgggtgcaggaacgccgagggagccgacgccgacgccagcgacgcagcggccggcaaggagtgtggcgaagttgggggtgaggcccgtgaggacggagcccgcgaggaagatgcaggcggcgagatagaggaggggggagagggaggaggaagaaggaagggataagagatgatgacatgtgggacctacatgtcagtgggtcccacacattttttttgtgaatgacaaatgggcccgcatatatattttttatattaatgccacataagcgtcacgtcaatgccgcgtgggacaaacatcaggtcaacactaccacgtgtgcgccaccaagggagtcaaattgcaccggttttgcaagttcgggggtcaagatttctggtattgcgattgagggatacgatttagatgtggacagttgagggagtcaaagtgatcttattcctaaattaaatgtcccccattaacaacacgaaggcccacgagatgcaagacccacacctgtgcaagatccaaaggaaaaagtacaccgaaggtccctcaacttgacatcgagttacaaaaatatcctcaaaccgcaaaaccagatatccggcaccctttaactaatcaaaaccggttactttaggtcctccggtggttttgactccagttttgtccaacgtggcagctgagtcagcgtaggacctacgcgggccccacatgtcaggtgtccacgtcagcacctctctttttcccctcttctctttctctgtttctcctctcgtgccagatctcaccgagaacatggtctgcaccctgggcgcggcgcgttctcgccactggtgagggcactggtgccgctgctctacacgtgcgccgcgtgttcgtcatcgcggactgggtgtacatttgatggcacgaacatcactgagaggatcataaacagcaccaaggaa

SEQ ID NO: 71319 - DNA, 975 bp, Oryza sativa
ctctctcttctctctctctctctcagatttcaacacctttccacatcgaattaagaaggataatgtaaagtaagcagcgtgtggcagatcaagtacgtgtgtttcatacatggagatagctagcaatcgatccccatgtttggtttgtcgttttagtaccatgcaacgtgcgccctcgggtgttgggaacgtcaaacgagtacatatttgccttcgatgggaaagggggagacaagttgttaacatagcactgtcgataaaacggctgctagcttttgtaaaagaacaaatattagctagataacctctccgggttagggcccaatgtaacaggcaaaaccatagcttatatttttcggaattgctaaataattgtcgacaattttttgtttgcagaactatcgatttgtgagccgttagatcggcatcaagatgcgcacaagcagattgaaaaaaatcacatccacacttgtgggcatggatcgaacccacgatctcataggtgcatatgcttgggttcctaaccaactaagcaacaacatgattctgagcagtttttttgccagttacatagtagttacattgtacaatgtaactacgctgtaattatatatagtgtagttacatttgaaagtttttcatctaaaaaactgtcgacaggcttttatttgcaaaactgtcaatttgtgagccgttagatcgacatccagatgcgcacaagcagattgaaaaaaatcacatccacacttggggccatggatcgaacccccgatctcaccgatgcatatgcttgggttcctaaccaactaagcaacaacatgattctgatcagtttttttgccagttacgtagtagttacgtatattgtaactatagtctagttacaacgtaactacgctgtaattatagagtaatttcagcgtagttacaattaaaagtttttcataaaaaaactatctaccgttatatagctaa

SEQ ID NO: 71320 - DNA, 58114 bp, Oryza sativa
tgtcttttaatcagctttaccttcaacctcaacatcatttacagcttacatcaactatcccatataaaaaccgcacctcctcctccaccaccaccacctagaggacttctagaaacttcatgtttatctccaatcacatcctccctaagagaacattcaaaaatattacctccccctcctccacctctcccaaaagaatgtttgccaactccatctccacctcaatcccctgattgtccatcttttcctacaaaatatgcaactacatctcctcttccatcaccaccaccaccacttctacataaagtacatgaatgtgttattccttctcataccaggcatgttgtagtacctgcaccaccaccaccacctccctttggagaacatcattctacttttagtaaagatttaacgacatcaccttgttccttttatgaagatcatgcaaaaaaatatactagaattcctctaccaccaccacccccagaaggtagccacggaattttagctacaacttctactgaattgattgatgctggtcctcaattgccaccattatctcatcttgaatggaaacggtgtccacatcatcctccagaaaggccacattatcttccaggagaagttggaggagctccatcgccaccatcaccaccttcttcttagagagaaaatacatcagtaggaattcaaggtggcattccacctctgccaccacctctgccaccaactctgggagattatggagtggctccacctcctcctagcattggtgcaggggctccaccacctcctcctccacctggaggaatcacaggagttcctcctccacctcctattggagggctaggtgggcatcaagctccaccagcacctcctttacctgaaggaatcggaggagttcctcctccacctcctgttggagggctaggagggcctccagctccaccacctccagctggatttcgaggtggaactccacctcccaatgcacatggaggggttgcaccaccacctccaccccctagaggacatggtggggtaggtggcccccctacccctccgggtgcacctgctcctccaatgcctcctggtgtgcctggtggtcctcctccaccccctggtggaaggggtttgcctgctccacctggtggcagaggtgtagtaggacatggacttactcgttccttggggctgaactcagctgccacagcaagaaggtcaactctaaaaccactacattgggttaaagtaacaagagcaatgcaagggagtttatgggcagaaatacaaaagcaagcagatgctaataggtaccctcttgttttttagctttttgattactagaaaatataacttctctacctctttcaccatagttacaacaaaaaatactgtagtgtaaacccgctgctatttcaatttatttctcgtatcatttttttaataaaattttactaactggtagtatcatgtatgtagccattctgaatttgatgtgaaagaattggagtctctttttgctattgctccaaagacaaaaggtggttcaaaatcagatggagctagcaaatctcttggatcaaaacctgacaaagttcatctggtaacttactctaacacattactatgctaaacagaaaatattcccagtacttttgtttaatctactgctatgataatgaattacttgattccatgcaagtgtaatgcgcacaaaattaataattactttcattttagaagacaagttttctatatagttgcggaaaaacctcattatcatattcacttttgaaaatgtgttgatggctttttgtaccgagattgtatctttagttcatatatttatatttcacggtattcattagcttctctctgacaataaaatctgcccttcattaattactggtatcacttgtgttttctaagagttaccttggtgtctttgaaatctacagattgatttaagacgagccaataacacagagatcatgttaactaagatcaaaatgccactacctgatatgatggtaagcaccctgctatttcttttttgcctttattgatgcacaatagttggacaaaagggcaaggtcattaaatgtctttgttccttgctaatactccttcagtaccatattagttttagctctaacctgaatcaaacttctctaacgacgaccgagtttataggaaaatgcaccagcatctaaaataacaaataaatgcactattaagagctatttcatggtggaattaatggaactaatttgatgttgtagatgttgatgtacttttatataaactatatcgaagttcaagaagtttgactttggacaaaactacataacttactatattggaacgaagggactaatatgactactatagtgattgaatatctatcgtgcgctatattatttccttggcgtagaactgatacaacatccaatatagctcgcttttaaccagttttgcatatgtgggctattattttgttgtttgggaattgcacacatagacctttgcattgtgacaacatccaacatagcttgtttttaaccagatttgcttacaatctgaagattaggtagctgaccaaaataaatcatcaacagagtttatgaaagttttgtttttggtgattgggttcttccactggaaagtagggtgtcagcctgcatttaagtgataaattaagtgggattccctactaacaaatattgagaattttttgggtttccttttgccaagtaggatgtagaagacattttatcgacacaatcaaaatttcatgtgaagctagcttcacatactttagatctagcttcacatactttaccacttgcgagagtgctcggtccagctcaccaaccgtgggtctcataagttacattgggcctacttcaccacaggtccaactaaagccacaacttcagatcctaggtctaaacaaaccaaaaggtggtttgatgggtgagtataacctccacatgttaagccatgatcccccatcatcaattatcaatgtaggactaaacccaacaattgcatcggatatgtaggcttcagctaaactacattactaaatatcatgtgttcctgtgttatctctggaatgtcaaagttgatcaatggttgcagcaatcaggaaggttagtcatcgtttcactatatcgattaacttctgcaacactaccaatcagtgaaggccaaacactcgaactagtttgagatagtttctttaaaaacagggtagcaactccaaatccacaagtatagtcgcaatgatttatgttgaatattttcaagtcaatctgcatgcacttcaaggatttggatttggtttcgaaatttttatgaaaatagatctacaatggagacacgaatttttacgtggaaaacccttacaggaaaataccacgggtgccgaccgacaatgatcataattgagaagttgattcaaacataaaggaataacaatgggatcgtcgccacttcctatacggcttacaagagtatatataagggataaacggaaagacacacaatagggaaagacgtgatgacctactaggaaactagtctgaatattttgtcggcctaagatttggatcacatatttaacatgttttccatctggttcagctaatgcttataggaatgtttcaatcacattccatcttgatattaattaatacaccatatttagtccattttcctggagctgaattgtataccctgaaaccatttgcattttagaccaaggatcacctccgtttgatgaaactcagttcatgacatttagtagctacttcattcttaagaattattcagatttttagtggacatttactcaaaagttactcccattttttaaatggctaccggtaaggcttaaggtgcttcatccattctatatctactttctctacttgtaacagagtgctgctctagctttggatgattcagttctagacgctgatcaactggaaaatctcataaaattttgcccaacaaaagaggagatggaacttctaaaggttgttttaaaattaaagcttatatttccttgcactccttctgtaatctttaatttttctcttctctgaatatcttgcaaaagtaaagtatttgcactttttcctatcagaactacactggagacaaggaaactcttggaaagtgtgagcaggtaaaccttcatgcatgtttggactcttcttttgttatatattgatttgttttcacttatatttgatcagaactattgaggttataactgacaaattatattttgtacattcctattcatctcctccgtctgcagttttttctagagcttatgaaggtgccgagggttgaatctaagtttaggatatttgctttcaagattcaatttcaatcacaggtcatacactgttgaaattttgagttattatctccgtatttgaaatgtccatagattttcactatcccccttttcatttccctcttagattagggatgttagaaagaatttgctgactgtgtcatccgcttgtgaggaggtaaatatgttttaatacacctcctttggattaataagtattaatgtttatcacgtgagagctcatttcaatatgtcaatcagctcagaggctctgagaagttaaaggtgatcatggagaaaattctgtttctaggaaataaattaaatcagggaacaccaagaggtaatttactgcgtctattgacgagctataaaatctttcaaataaactttcatgcaaatatgtttagcttaaaatcattttgcagttgaaatttcctggataatttctaagctccctcttcattaggactaggagggagaaatgccctgtgacaacttcactgtatatataattacatttatcctttccactattatcaacaaaaataagttgtttctctaggtgcaacaatgtaaaacaattcaggctatagattgaagttgtttgaatgtcaatttaagtactgtatgttcaagatctgtgggtcactaattttagcttccctatacctcgtattcattgaggaagaaaaaatatttaatttttccttatcttgttgcaggccaggctcttggttttcgcttggacagcctattaaaacttacagacactcgtgcaaacaacagtagaatgacactaatgcactttctttgtaaggtatggagatatatagctgtcgtacactagttgttcatataaaatcaagcatgagtatgaaagataatgttgatcccaaaataataaatttgtctatactaattatgtggggcccaaatatcagtggtggtggccaccaccatcaccacaaggaatattcaaaggagtaaagatatattatgctcgtaggactagaaaagaatgtaattgtgatattttgcttttcaccacatttcaccaaaagagtgtcttgtaattacatacaaggcactcttcatgattaatatacctcaatagtgctatgtacattaactcaatagtgctatgtatattaactctaaaacatgtagttctttgataacttcatcactaaatcagtagttttgtgatacaatgctataaatctgtagttctatgaaaaatttggcactaaatctgtaatttcgtcatatacatttttgaatctgtagttttgcgatagtttagttaaaggcagccttagttaaaatatcgctagttttgtgatatttactcaatttgaaaggccaactaactagctaatttctttgtcatgtttaacttgtcatcatactgcttattttgctcctctcataaaattctaagtttgcttctataataagctttaattcttattaactcgatggttggtttaagtgtttatcagggccttgcggacaaatcaccacatttactggatttttatgaggaatttgtcaacctagaagctgcttctaaggtgtgtatgtcgatctgacgagagcatccaaaggacttgtgttgataaaaaaaattatacattgtttagaaaatggaagtttgtattgaacccaatcaattacatcacggtgcctctgcataactaagatacacacgaccacactcaacaaacaaaaaatggagaatatcatggatttgtaaggaccatcaatcgaaagaataaatcgtcacccatgaacaactccttaaatatatcctctaaatgcacaaagtattaagagccaccaatcctaatactagatctccacccatatacctgggtaaagaactccttgaccaccttctccaaatgtagacatgccgcaaccaccatatcccgcggatcaggcttctgtaggatagcccatgtacgaagccaatggataagacaatatataacctgtaatagtgaagttatgattttttttaatcaaaatatacattattcctgcatagccaaagcaaccaacaagtagcaaatgctcttaacaggacatgtgcttttaaattattatgaattccagcaaggcagctcccaaacatatgggctacactatgcagtggaggaagtccaaatgctacttggaccaaacagaatgggcaaaatcaaaaaaaaaaagatgtctaattgtctcatcattgtgacaaaaacaaccgttcttattgctttgccagtttccttttgtcaaattatccatcgttaacaccactccacaatgaaaataccaaagaaaaatcataacttttaagggtatctttagtttccaaagatgtttattaatattaagaacattgatgtgaattagagctaggtaatgagactgcaccgagaactccccatttgaggttaagttctaacgaaactcgtcttgctcctgagttaattgaaaatcagtgatacatgataataaatacaagtttaaggaccacccgtgcattttactcataataaattattccaagccacctattttgatcctataaggtcccttctccatgaaagggaatgattggtttctaagacttgtgcaacagtagccggcttatgcttaactatattttgaaggcaaggatactgttcttttaaggttgaattgcccaaccatttgtctctcataacctgatttgggagctatataaaggatccaaaccagagaaaatcccatttctccttcatgggggtggaccaaaagtataagtccctggccttccactaagcttgagaaagaggtttatcacctacatacttattacatatcaactgttgtcaaaccccttccgtggagagcaacttgaataagcacttactaagtagagccacattcttaatgtccaaaacatgaattcccaaccccccccccccttgttccttggggaggcactttttttctctgaccaccacatttccagtaaacctggagcgaaaatacttaagctttgtaagtatcccctttggtatggcaaagaaagacatcatatatctcgggaggctacttagcactgaattaatcaatgttagccatcctccggtggacaggagttttcctttccaactactttgatgtttttcaaagcattttatcacatctttacaatcggcatttcttaatctcctatagtgaatagggatacctagataccggaatagaaatttaccagtggaacaaccaaagagctccatgtattcattgttaaactcgttcgcttcaccaaagcaatataattagtttttatggaaatttatcttaagactgttaattgctcaaggcaaattttgctacatgacactgcttatgtgtggttttagctctaggacactgcccaaactcacttttgagggaaaacactccataaacatggtaatttgctagtggataccacgccgattaaaataataatttccggttgaagaggagagagaaaacgcgtgaaatgtcaaaaatgcccttaggcccacatgtcagctctatctcctatctctcttctcctcttccagcccacatgtcgctccccgccggccgccggccatgcccgcgcagatggcggtggaggcagtcgttgaactcgtcaccatcgacgtgacatcgagcggctcatcgagatgttcatctggaataactcgttggagaagggcgcccgccgatcggccgcggtggttgtctccatgctcaccgaggggaagttgaatgctctctgcgtcaccggcacccccggcgccatcgagtcagtcgcgtcgctgcattacgcttacctcgacgagctcaacctacttggcctccatgcccatccaccactctctgctaccgagcttgccgctagcaaaatcagtcgttccaccgccgggtatatttcgccggcgtcgtgtgcagtcgcctcccccaatctgcccttgcctctgaccatcacacgcgtgtttgtggggggaggggggattgcggcatcgtgattcggcgattgggatgagagaagggcggcagcggcggctgcggcggtggccatgagtggctcagcgtcgacggggatggggtgcgggagctacggctggcttgcgtcggccggcggtgggaggaagggcgggggtagggggtgggggtggcgaggcggcggggagaaggagcggctgcagctgctccaccgcgcgctacggctgatgggctgccggagggccagggtgcttctgctgctcgccactgcctcccaagcagtgtctacgcgggcatggccggcagccagcgaggagcgacatgtgggcaggaagagaagagagataggagatagagctgacagtgtgcccaagggcatttgcgacatttcacgcaatgtctctctcctcttcaaccagaaattattgttttaatcggcgcggtgtctactggcaaattaccatgtttaaggagtgttttcctctaaaagtgagtttggtagtgtactagggctaaaaccacacataagcagtgtcctgtagcaaaattttcctttgctcaatgacataaagcaataacgtcaggttacgagctttttctaatttatgatccataaaaaaaactatatcattggtatattgcaagatagagagaccatcattcattagatgatgtcgtactacttctgcaatttgccgatcaactttggctctattaatcagtatagccaatacgtcagctataatattaaataatatgggtgataagggatcaacttgatgtacccattctggagttgctttgaacagttgcaactgaaagcattggctgaggagcagcaagcagttgtgaaagggctgcagaaggttgaacaagaactagctgcttcagaaagtgatgggcccgtttctgaggttttccgcaaggtataatttaattccctacctttttggatgctatgtgtttagtttagatggctactgctccatccgttttttaatatatgatgcagttgactcttagatacatttgaccattcgttttattcaaaaatttatataattatcatttattttgatgtgatttaatttatcattaaatattttttaagcatgatttaattttttttatattcgcacaaaatttttgaataagatgaatggtcaaacgttcgttaaaaagtcaacggcgtcacacacacacacaaagaaacagaaagaaatttacttgacgttcctttctgtttctttaagtatggaatcttaataaacagatatatttactgatggttttgcaatctagactttgaaggagttcactgatgcttctggagctgatgtaaggtccttgtcagcactatatgctgaagtagtaagccatcgtgatccaacaagctagctttcaaaactgttccatttggattcgaaccccttttaacatactgagcggtgacagggtaaaagtgcggatgcactagcctattattttggagaggatcctgcaaaatgtccttttgaacaaggtaatattcgatctggaaattctggatgattcccaattctccatcaagttgtggtagaacaagttaatttttacagttttgtgaacactgcttgagagcatcattttttccaaacatgtgacattcactagctcaaagacagaatcaataattaaacgtctgacagaaattattagatctaataaatacttgaattttacgaattgtcggatttaggaagttggtgctctttcgttctagaattttcaagaccaggtaaatctcctgttgtgttcacgatcatctaaattaataaaagcttatatgctggaacagagggaaggtctaaagtactgaacaaagctaaggcttagggtgtgttacagtgttagttcacgttaaaattgaaagtttggttgaaattgaaacgatgtgatggaaaaattgaaagtttatgtgtgtagaaaaattttgatacgatggaaaagttgaaagtttgaagaaaaagttaaaaactaaacgagggcttagtaaatggacctgggctcatgggctggtgccatctgcagcacgttaggtcccatacagaaaatggaccactgaatttaccgtacctaatccctgatcggcaaaaagatctaggctgtgtttagttcatggcaaaattaaaagttaggttgaaattaaaacgatgtgacgaaaaagttggaagtttatgtgtgtaggaaagttttgatgtgatggaaaagttggaagtttcaagaaatattttgaaactaaacacggcgctagtataaattaacaagagttcctgttaactgattgattatgtgtgctaaattcattttcttttacctttttaaattaaaaagctatcaatgttcgtatgttctgattaattttctgatcatgtacatatgtaactgtaaatcttatactatatatttatatgtacactgtaggaggttctcctacagtatttttcctctaaaacaaatgttaatggagactttaagtagtaacagcatccttctttcctcttgctcacattaattttgaattcgacaaaaatacagtcacgtctactcttctgaactttgtggggttatttcggaaagcacatgaggagaacataaagcagattgaggctgacaagaagaaagcacagaaggaggctgagaaggaggcaaaccaggaccgtactcctgtaaagtctaaagatggactagtagatagatcaccaagatcacccttcaagtgacatgcatcactaccaattttttattgtccagccgggtcagtttcttctcgacaaatgccacctccattaccattagccattcagaccatcgtggctcaagcaatgcatggctccatgtgcttgagaaacaaggtaacgcatcattatgtacattgcacacttttgttcttactgtattgatgaaattatagtcgtcattaattatcattctaacctataatatatatttttttattttgtataggtactcaacccatgcatgctttctagcttgcaatactgtacagagctaactccgcaactatatatttaggtccgtttgtacatatttcactagacatttcttctattgtacatgtatactagaagaaataggtcagtagttgtaaactaggaaaaggaaagaacgtaagagaggatcagtaggtcagaaaccataggaaattaaggattagtgttacctcgaggcagttacagcaactggtgaatgtatagcaatgttcctgactcgtgctatcaaatgacgcatccaagtgtacaccttttatctagaagcatgtgttgtcaattaattaaaaccaagctagcttacttatatggttatggtgttactgtagctgttaatgtatagaaagaaaaggaacgaatacaaacttcgaattaaatttgaaaatatatcgctcattcaattttatttcaggaatattcgggatgtaaattttttaaaaaaaatatatcgtcgatctcgcacaatcattgagcgaaaatgaggtgacgtcgagggcggtatcgtgcggtgaaaaagcgagaccgcgtgctctcgcggaaagaacgagcgagaccgaacggtatcgctgaaaagagagcgacaccgtaccaatgcttcctttggttagtgactaatgacgtaattaactatttaataataacaattagtgattaattaataattaattaatcactaattaatcattttgaaatccggtatcgctgattggttcagcgagaccgttcgttctcgctctttcatttcgcaagaccgcacggtctcgcgcttttctcgtgcgatactacccgtgacgtcacgccacgtcactttcgcgtaatggttgtgcgaaattgacgttatattttttaagaaattttgaatcctgaatatttctaaaaataaaatgaatgaacagtgtatttccaaattttattctacaaacttccatgcttgcatattgaggagtgtttgctttcggtcagattcagtctagtacatactccctccgtcccaaaaaaaacttaacctaggagagtacatcccctcctaggagaatgaatctgccatcttctcttaggttgaggttttttgggacggaggagtagcttagaaagaattgttacaaaattcttggcaaataggctgctcccaaaactgacagacttggcatccccaaaccaaacagtgcttttatttgaaaaagagctattcatgataatttcatatatgtacaaaatctggttcaacgttgcataaaaccaataagccaaccatactcttcaaattagatatcccaaaagcattcgacttaggcaggggcagatccaacatgggtgcaagggggactcgagtcccccctacacccacaagacccatcgatacccccggagcatccccttcgattttttcaccataaatgataaattaaaggtctctagatgactagaggtgaagaaactgtgtaattgagcccccccacaattttttctttctggatccgcccctggactcaggccctctttatttaggcttaattataagccaacttataagtcgaaaagtctaagtctaaacaaataagcagcttttctgtttggcttttatgaagctataagccactctaacactattaagccaaaagctaggtttgagaagctttttttttttttgcttatgtgaggtagatgtatgacaccatcactaaacttaggacattaaatccactagcttataaatcatataagtcaataaactgatttaaaagtctagaccaataaacctaaccttcaataaagagggcctcagtgagttggacttatttattgacagatctcacaacttttggctttggcccatagatggagaaactggatctcatctctcttgctcacctgatcgtccaaaattactgatgaatggttctacaggacaggaatcttccatgcaagaggttcaagactgctatagggtgatccactttcacctatggttttaatcctcgcaatggaggccttgcgtaagatattacccgcaactgaaacagtgggcctcctgtcccaactcaattgcaactactgcaggtttaggtcttcgctttatgcggatgataacatgtgatcatgaagtatatacatacaaccaagcatgagaaatataaaacattgtcaaacaatgcatcggatgaacgggggatccataaaatattaaagtctaatgagttttgaaatttagttcggcctctagagacaacactgaattcaaacagacctagcacctccatgccatctccgatttgggtgatcttggacttgatggaaagcttatctctctacctttcaaacgcattcggtctcgtatccaaattcattccgagttaacatgaatcgtcaaaacaaggcagtgctgttactgaaacctaacttgggtcttgggccttctaatcactggtggagaaagcctttttactcccggttggtaacccccctatagtcccggttttccaaccgggagtacgaatccgggactaaagatcgctatctttagtcccggttcaaatacccgggactaaagatcggttggtgttacgaaccgggaaaaaaaagaggaatctttagtcccggttgataacaccaaccgggactaaagagagagtagcgtcagttcagatggtgccctttttttccagatttaatctctatattttctcccgaatctagtgccatgtatatccctaaatcaatccccaaatccccaattcaaagtaacatcccaaatcttaagttattataaacataaatcaaatacatcacaaatccttaaaaaagtgcactcaaatcaaatacatcacaaatcctaaaaaatacacacaaatcaaatacatcacagattatgtcacgcccagaagtttcccccttttcttgttttaaaaattggttaaataaattgcccgaagaaattatcttaattaacctagagctaaatccctagttaataaatgcaattaataatcggaaatagcgtggtggaatttttcttgagttccccatgctccaatgcattaacaagatttttagtggaattttcacagccctggaaataattttaaccaattaaaaatcaccaaagtgcaattttttaatcccaggaaaatccttttcctcgttttcttttcttttccttcctttttctctagatgggccgtcggcccatctctctccccgcgctcggcgccacttcctgggccggcccgctcctcctttcccctccccgaagtcctccctccctccctttctctttctggcgccgacaggtggggcccacctgtcggtcgtcccctacctcccgtcgctggagccggagctccaaccggccgcgccgccgccttctccgcttcacgtggagcctacactccgagcccgcacctcgcgcccacgtcgtcgccctcttcccgcatctaccgcgcgcgcgcgcccgcaagtggtgggggatttgaaatcccccaacaccctctctctctcctccacctctccacgtcgccggccaaataggggccatccccggccgtttccgcccctccctcgcccataaaaaccctcactcgagctctctctctcatttcccccattcaccgtcctctcccacgccctctaccgccgtcgcgccgcgctcgccgagctccgccgccgccgcccatctccggccgcgtgccgtcgccactagggccgccgccgcgccaagccgccgccgccgctagctccgccgccgtgtgggccatctcggccaccgcctcgcgtcaccggaaccccaccgggaccccatctccctcgcgagccggtgagctatccattcccctccgtctccagccagccactttggttgtcgcggtcgccttctccatccctaactcctctcctccccttctctaggtgtcgccgccgctcgtccgcccctcctctcgtcgggtcgtcgtcgccgccttcgtcttccgctccggccaccgtgtcgtcggtgagtcctccctccccctcctttcctcaccttcccgcgagcgccggccacgccgctgctccggccatgcgccgccgcctttcggccgtcgccgccgcttcccgcaccgccggtcaccgccgtcggtggccgtgcctcgccgtcgcctcgccttggtcggccggtcggccttgaggccgagccgagcccggccgacgccaccctcgcctcccctttgagccaccgcctggtggggcccacctgccaggcgccacctccttcccttttgagccgctgacctgtggggcccacgtgccggcgcccccttcctctcccctttgagaagctgacccatgggccccgcctgtcggcagccgccccccccccttggatgacgtcagccctgggtattattgcgcaataattaattaaggactttttctttattagtaaaaacacagtttatcttctaaaattcataagtaattcatccgagctccgttttaagtccattcaagtctcagtaaatcaagaaaaatgcaaataatccattaaaaatggttttgtttcctgtttcagtagtcttataccatgttttgcttgtgtgctttgtttgtcgcgtaggtttcggccgtttcgtcgatccgcggtttctcgaaggcgttgctgacgtctcgtcaatgtgagagcaaggcaagtcatgctttacatttgatcatattgtacccaatttacaaacaccctgcatttctattaaatgttgcattcttttacaatgtcatgtgggatgggtcctattacttagccatttattgtttaccatatgccattgataacctgggtatcaaaatgattagatgttggtttaggaaatgcttagccatgcttagctcaactagtacacaaaaagggatcacattattacatagactttgtctattagcatagttttggattggtgccaccgcaatggtgttagttaattaaaatacactgaatggtgggctgtgggtgcatggttttgctggtcgcacccatggcagttaaggaccggttcacgggaaaccctgggagacttaccgtgcttaccgcaagcgggagtgggtaactgcttgatctgaagtatagctcgaccctttcctaggcaccggtagcgagggtgggcgtgatggagttgggtcggccgaggtgttcggttgtccagctgccggattcaccgcggcgcaagaggggaccgcccactgccttttgaggggtgggggtgaaaccttagcgtggtgtggatggttaggggagggttacgtggagggtcttgtcacgatttccccctttgcagtatcatggtgatacttcggggcatggcgacatgtgtggaatcgtgtcttgtgggtacagttgtacacctctggctagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggatagtgattggttaatattgattaattactacagctgttttactgctttcaactactgttttgaaatgcctgctttatgcaaaagaacccctagcttcctttggttatattctgcatcatacatcctcttccggtatgacttgatgagtacagtgggtagtactcagtcttgctctcttttcccccacaccagagttgaagttcttctcagttggagccgtctcagagaggttggtttcgtcgctgcagtcaaggtttgcctgtggagtggagtcgcccgctgctgaagtcaagcttcccggtttagctcgcttttatctttcccgctgcatttgtaatcttttatatttttgtaagacgtgggtctgtatgtcaacaattatcgtttgtgtaccctggctggtcctggacaggggtttaatgcacattcagcttagaaattctggttcgagaatttctgggtgtgacagattatacatctcatatccatgcaatgaatcacaaaattatacatctcaatcaatcacaaattatcagaaaaaaaaaagaaaagaggccggccggcagacgagagggcacgaccgctgccgcgcgtgacacctttggccgcccgccatggccgccgccgggcgcggccccgccagctgccgccgcccgccatggccgccgccgccggccaccggatgggaagtgagggggaggagaggtgaggaggaaggcgaggagggggaggagttagatctgtgaagaggaaggggaagggatttgtgaagtgtaggagaggataagggatagggattatatactacatattaaattttagtcccagttggtaaaactaaccgggactaaagatcaatataatttttagtcccggttagtattatcaaccgggactataaagatgatctttagtcccactaaagatcctcggccccctgacagactactgacacgggatgaaccgggagtaaagatgatctttaatcccggttggtgatcataaaatagctgtggtgtttttaaccgggactaaagatcatttttagttccagtttttattgcaaccgggactattaatagactaggcccatctcggaagtgtctccctccacctccacgaattaacactaaaccctagatctattttctctataagtgtctatgtgcaccctctagaacatttgggttttgtttagttgaattttgccaagtgccattcaccttttctctaatcctcgctcgattagtcggcgactatagattcagagctcccaatagttggtgtgttgatttgtcgggtcgattagatctaccacttcaatcagaactatttcttcgtgcttcatcacctattcgtaatttagattgcatcttatcttgttcctgcagtgttctctcatttgcattgctgagatcatcaaccacgtgtcatggttggtatgacatcgtttgtggtgtagcgattgcacgacgttctagacttgttctggttggtagccacattgcaaatgttgtactcgatcaaagcaagaattatcctctgaccagaagatcaggccacgagagagagcttcatcaaactacctccgtccctaagtaagtgttgttatgggttttcgtatcatgtttcactgttcatcttattttaaaaaataatatgattagtatttttattgttattacataatagaacataaatatattattttatgtatgactaaatattagaagaaatttataaattttttaaataaaacggacggttaaacattaggaaaatattttttttctatttcttttgttcgatccccgctcccaatgaaccccatcccttggcaggcagtcaggtcggccggcaggttaggtgcatcgcatcgtcccaagacctgaatagcggtggcggtggagagatatcgctcacatcaatcaccaccacctggccatgctgccggcaggcagtcctcccacgtggcacttgtatcgacgtgtgggccccaacccaacacccaacggagcctctcggaccatatcatcttcctaccggcttcctctcatgtgctccgctccgttcacaccagcagaaaagtctctctgcccacgtgtcaaagcaccggtggatgccaccgtttgcggcgaggccttatatcagaaggcgagcgatacctacacaccgcaggatccaatccacttgcatttcagctcaggaagcctctgctactttgcttggcctgtacagtaatacagataaagacctgcagttctttggtctctttagtgaggactgaggagtttggttggagattgttgaggagatgggcatcgtcgacgttgtctccgagttctgctccgtgccgaggactcgccgacacctcaagaagaggaaacaattccaggtaatactgaacatgttaatccattaatcgcatctccctcttctgtcgatctctgtatatctgtcttccagtcgaatttgtaccatgatagtactagttgacagttgtgttgttggagtggaaaaaacttatgcctatatcctcttcttgtttcagacagtggagatgaaggtgcggatagactgcgaaggctgtgaaaggaagatcaagaaggcccttgaggacatgaaaggtgcttaatcatatttttgctgctgcttcttctttcacacgctctgaaaagcaaaacaagggctcctttagcttttgttctttgttgtggaaatgattgacgaatctgtgcatgtgcgcaggggtgagctcggtggaggtgacggcgaagcagaacaaggtgacggtgacggggtacgtggacgccgggaaggtgatgcggcgcgtggcgtacaagaccgggaagcgggtggagccatggccatacgtgccgtacgacacggtggcgcacccctacgcaccgggcgcctacgacaagaaggcccccgcggggtacgtgcgcaacgtggtgtccgacccctccgccgcaccgctcgcccgcgcctcctccaccgaggtccgctacaccgctgccttcagcgacgagaaccccaacgcctgctccgtcatgtagctagctgtgtgtccccgggacgacgacgaagcagcctagcagggtgtttttgttgccccttgcagctgtaataatattctgtgtgtccagattcgccatccctcaaaaatctttcatagtattatagaagggaggaagtagtaatttttccagctgtagtaatgttctttgctttagatagggtgttgtgttactattggactctcttttgcttgtgcttttggtttctgatgtaaaatactccatcatgttcttgtttggtgagatgaatcttcaaatctgcaaagttgcagatcggttgtttgagcttagcatgattgattggggtgggtgggggagacgtgtgaatatcgtactgtatattcgagttttgggtgggctcacaaggtcggcagcgccgaaaggtttttttttttatccgaggcgctgattgcgacgttctgaactgtagcccgatgctggtgtggcattattttggtggttggatggtcagccgataattctaaactttgaatcaaagtttagtttagttatttttcattacatcaatatgtcatatacacatattagttatatcatctttaattttaaccaaaatctaaactttgcgctgaactaaacacagccaaggtgtactatacgccaagtacgcgctatatattgctattaatattttaaatatttaaattttaaacatatattaaatacataggtttttcaattttattaaattaatataagtaaactttgttttaacgaaagttatatgtaaactttattttgaattcataaggacacaacaattttatttatctatagttttaaaaatcaggattagtatctatattgttgtcgaaatgacaataacttcacgtcgaaggacgtggttctctcaatgaaatgattggatggtaaaagcaatgtattaatgatgaaatttttttggatcccctattacatagccctaaagttttgtgtgagccttcttgggccgcaacacctcctagcccttttgttgaagacgagccccattgggcgaaccccttctgcttcgcgccatggcttcacccaacagagagacttgatgacgaaccttatggcttccattcttcgacttcgccttacagcttcatcctatggcttcacctccaagcgaccccttgtgattttagtcggcgctttgctaatctggtggtttcggcagatttggtcgaaggccctcgtgatatgcctccagcaagcccctcatgggcaagagcgagtagggagctttgggcgagaccgtgcaaatatgtggtatggcatgaggtgccccctttcggccgatgttcctgccaaaacctatgtacacctgcagaagctaacccttgttatttcatgagttctctcaaacgtttccatgttgtttttcgaccttctatccttttcggacgtgagttaggtcacttcttcttttctttaaactcgggttttgggtcgcgtttttcctgttcatgtggccttttactgttcggcccatcctaacaggagttaccattgtgtccatccctgggtgccacgtggtgggctgctattggccggaaggcgaaccgtcgcatgactagggctatatagtccccccgtgggtcgctttcacttttaccccatctatttttacttcccccggctgcgttcttgctctcgctttcaccttttctttttcggccttgtagtcttcgctagctctgactttcatttttcgccattccatcatggctccgcgcaagcctgctccagccgcagcgaccggaccggacccctgcaagattggcgaagactgcaccggcttcctcggcacttcgctgttcaacaaggcggatctggcgaagctcgtcgcgtcaagtacagtggttgaaaagcaagccttcttcgctggcgatgcagtggttcatcgccccgttgatggctggaccgttgtcttcgccgccttctttgatgcaggtcttcgcttcccatgcgacgtcctgctccccaaggtccttcaacttttccaagtggagcttcctcaactgagtccctcagtcctagttcggatcgcgatcttcgactggatttgccaaaccgcggggttcgtgccataaactgatcggttcggcgctatcttcttcgccaccgttcactcaaagatggtggtcactccggttgggacaaagaaaaccgtctttgggagtgtgaacttcaatgttcgcgctgtatgctccgatttgtggccagtgaatgcctccatgccaaagtgggagcggcattggatggagaggtggttctaccacacgaatccctatggagctaagacagacgcgacgaaggcaatccgatagggccggctagtgatctcccctaaccggaagctgaaggtggcgattgatgggacgatcgagtcccgtttcacccttttgcggagaaccgcccatcggttgagctgctgtgatttcgtggaggagttttgcatgttggcagatcaccgtaaatgaggatgaacgggttctcgacttgcctcgccttgttttgccaggaggcgttaatcgtaagtttttgggccaattccctatatgcccatgtaatttcacctaatcccttctacgcccctgaaatttgtttgatctcttatatacccctgagttttttatttggatcccttacatacccactccgttagttgaccattagtttgaccgttagttattgtagaaattattttattgtccttggtatattgttaaaagctagaaatgttttatgtgtaaattatttgagttgtgaaaaccaataaggaataaattactaaatatttgttatgaatttttaaaaataaaacattatttcattaaaataaaaaagatttatcgtaaaaaaaggttctgcataaaatttgaaaattacttttctacaaatatttagtgaaaaaagattcgttgtgaaaaaacaaaggggatgtaattagtttatcacaaattagaaaacaaatttaaaatttttaaataaatttcagatcaaatttgacaaatttcgtatatcttcccaaaaatttaaacctaaataacatttagtttttgctcttaattttctagcgaaactaatgtatggatttaatcataatttttaaaaaataaaaaataataacttttattttttaagttgggcattaaatgattatattgcttttattttgtataagttaatttttttcatatgaaaatttattgggtaggtaccacatatgtataggatggataatatagtcattttaaaatatttagcggtcaactaatggtcaactaatggagatgggtatagaggagatcaaaatgaaaactcaggggtatataagggatgatgtcaaattcaggggtattgaagggattgagtaaattttcaggggtatttagggaattttctataagtttttctaatttgctaactctttatttatctcatacccttttgttctttctttttttttttgcctctcttgtttttttgcctttttgcgcagttctcaccctaacccaggccgaaaatgaggcccgaactctgatcggggacctcaccattcatgagtatagctgtcacgccctaaaaatcctaaatatataaattgttgtttaattggaattattagaatttattttaaaagcctacaagttaaactctaataatctaggaaaattttcaacataaaaatgagctagataaaattttattaaatactttgcttgttcctctattttctagatttttctgggaattatttgagcaagggaagtatttttaataattgaaacaacatttcacaaattattttaattaaaaagttcaaaaacccctccctaagccgttgggccgaattcggcccaacattcctctctcttccgcacgccggagccggcccaaggccgcccgagtcggctcaagccgagccgcccgcccctcctctcatgggacaccgacatgtggggcccacatgtcgggcccttctcctacctccggccggccggccttgctagctcgagccgccccttttcccctccaaatccgcacccaatccggccctttttcttccgattgtttgaggagtttttatcctctcatcctcctctatctttacccccaaaaatcggagcaaatcgttgagtatcttgcccgaatcgaactcgtttccgagtttatctccaaaaccgagtttttgatttcccgagtcgattttcttgcgggaggagtccgatctcttcaatccaaggctataaataggaccccctagtccttctttttcgtttgccccctctcccgtcctctcccgtgacccgtagagccgtcgccgcgtgaaaccatccgccgccgccgctggccgaactccggttgcgccgccacgccgcctccgtcgtcgccgtcgcttgccgtcgccgccgttggtttcgccaagaggtggagaagctcggccgccacctctccttcgccgccggccgccgtagcccgtccccaccggccaacccgagccgccgccgtcgcctcctcgtcgccggccgtcgtcggtcgtcgtttggcacgagggtgagtatcgttgggttcgtctcgtcgtcctctacgtgtacatgtcctccaaaatcccggccaatcaccctagctccggcgaggtcgccatccgagccggccgccattgatgacgtcatcatgacatcatcatcttccccttttccagtttttttctaatagattaaatcttcggaaaatcataactaaataaccgtagatccgtttcaggtggttcaagttgctaaatttttctaaaatcaagatctacatgttaaaaatatccacatgtactgtttatgcttgtttttgtattgtttatttggtttttattagtctttttcttcgttttgcgtgttagcttgtcgtttccatcgttgcgaaggttcgtgagtgcgccggaagtattcaagaagattaattgaagaccgattattgcaaggcaagtcacacagatcccaaataaccctttgagcatgttgaacccgtttaaagctattattttatttcaactatgcattattttcgaatgtcattgggtggtgaacctttccccgttaattaatggcctaagatgactttattttcctatgggttataatttgagtagcatgaaccttatatattggattggttcagctaaatgctatatgtatgtgtgcttagctatgcttagaaacattagctaactaaaggggataattataaactatattatattattttaattatggttatatttaatggtcgatcacgatggttaatcgtgtgatgttaattaattgataaataaaatctggttaaggtgggttgtgagcatatggttttgatggttgtgctcatgacaattaaggactggttcgcgagctactgttgtgaaacatttatcgtgccaaccacaagccagcgtgggcaacggctttatcttttgtatagcatgattcatcatagtgtgccagactgtgaagcggcaagaagtccgtgggggtcgctggggagtccattgcctctggttttgagggggagattatgatccaggaacggtgcactgttttgagttgtgttgtgcaaagggtactgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcaatgtttttcgtgattagtctcacacccctcacaataattatggatgttataactggtaataatttgcttagctcctggtttggagttagaactgtacagccgggtatggttgttcaggatggttgggcctgtgcagcatgggtgtgttgctcagtgttgattaaaatttctgattaattactccactgttttacttctcttaaatgttttgctaaatgctgcttttgcaaatgagcctatattatgccatcatttggtatccttgtgcacttgcatatttgctgtgtggtttgttgagtatgtcatatgctcattcttgcaataatcatcaaacctcagttgaagataaaggatccagaaggagaagacgtttggcttataccccagttgagctgcctgtgggagtggagctgaagtcatcgctagatcgttattccgctgctgttttcttttcttttgtaagtatgtaacgttattattaagatggatttgtatattaaattgtcagtttgtgtacctcggctgattcctggacgaggattttatgcacaaattagttcggaaattactacagaatttccgggcgtgacaatagccagctcctgacgcgtcaagtcaccggtcgggcaaatcgggtttacaatggctgcccctagcgcgccctggcgacgcgctccaacatgccggggctgaggacgacggcgaggtcctcgaaccactaggtgcggctggtgcaccgcacgctgaggcagctgctcttggtgtcgcacgagaaccggaacaccgagctctccggcgaggaagctcgtcagggtggcgtcccctggggtgatggccacgtgggacaccagcgcgccgatgacctggtcgaacatccctgtagcgtccaccatcgggtgcagctagccgctggcactacctgactatgtccaccacgctctgccacgaccactgcggcatctcatcgagagccttctccgtcatcttaaccaggctcggcggtgtcgacacctccgccatcgccgctattgctgccaccatgtccatgaactcaaccgtgcaccgcccataaaatcccccaagatgcggcgctggaggagaggatagagagagaagagagataggagagttgaaatgtgggtccaagagcatttttgatatttaatgtgatttctctctcctcttcaaccgaaaattattattttaactaatgatgtgttcatcagcaaatatccacgatccattttttaagagtgtcttccgctaaaagtcacttcggacagtgtcctacagctaaaaccataaagtcatgatctcctgtaacaaaatttgtcaaaaaattagcacaaatgaaaaaaaactaacacagaggttaactaactgtaatagcaaaaaggaaagaaaaacacgttacaatttttttttaactagggctggaaagcccccatttccattactaaaaatgaaacgacaagtacaacagggttcagaagtaaaaaaacaaaggaaaaggctaaacacaacccccttactggagcagcaccctgacaagagagactaacagtttctgcagggcaagctttacagagatcaccagatcacagacaacaagatgtaaagggcagacctaaccgagtagtaccatagcaaagcaaagaactcagcaacactaaactcctgaacttctttattccaaacgtcttgcatagattctccacccaaatcgggaactgaagacttcacttgccacttgtcttgccagcttggctcccaacattaagcttctttgtcttgcctccgatttctgcaagttagcccaattttcaataaaatgacatgtaagatatatcagctcaattggatcattgggccattttttatcaaaacacactttgtttctggacttccaaatggcccataatacagctgccaccccccaccatcacaagttgcttagagtgtttgtcaaaattagataaccattatccaaacatatggtttttatctctagcaggtgttatattcaaggcacacaacatcacattccagatcaatttagcaacagagcattcaaaaaataaatgctgtatggactcctccttatcacagaattggcacaatttatcacattttctccaacctctcttaaaaaggttatctttagtaaggattctgttttttaacaccagccataggaaaatcttgattttcagaggtattttaaacttccagattttttttatatgggaatgccacttgctcccttttaagagctttaataaaaggatttgacagtgaagcaaccatgcttttctagattccaccacattttatcttttattccttcttgcaaattcagaagcatccatctctgtttaatccagtctctaagtttatctccatgcaaagtccttctgaatttgataatctcccatcctttctccttcagttttgcaagggtgatatgtctagtatgggtaatgttgtataaagcaaggagctgcaaattcagaggtctgccaccataccaattatcctcccaaaacagattgtttttgccatctccaacctaagttgaacaaaatttcaggaattcttcctgacttccatcaaaccatgctagaaatgaaaattacccgctttataagtcacccatgacaaagttttttgactcaaatatttttccctgagaatggaaattatagaaacgagcgctcgtcaattcgtcattgataaatcatagaatgtcacatatgtatgttggtatgaataatctagagttgagctcctaattggcacagtccgtaaaaagacattcggccttcatggtaactatagtcctcttaatttttatatgtgtacaccgatctcaagtgaggccaaaagatggacagcgcttgaaatgaagaacgaaattaccggtgggcggtggtacaatcaaggaatgatctgcggaaaaataaaaacggccaccactttactgttctcgattaccggcatatgtagtacaccgatcttaagcgaggccaaaaggtggacagcgcttgaaatgaagaacgaaattaccggtggtacaatcaaggaatgatctgcggaaaaataaaaacggccaccacctactgttcaagatttaatttatatgtatatcatgatttgggatagatgcaattggatggtcagaaaacaatcttcactaaaacatggctacccaataagcgtttaacaactgtccatagctgctcttaggcacgaaacaatctacctgcccaaggtttgcccagcaaaaagatttcaatagttgaaatgggtaaacgaccgcctaaagctctctttcagtgaaataaacacaggtgttcgaaaataagtgttgagatcactgaagatgaagtgccttttcactggaacataatgaccatgagcatattccaccgagggaattgaaccacactagcacacctttcgttttgcatctaattgttaagtttgcaactgttcccacatttgctatccagctcgcctaatggggtcttggaagtattggagagagatgagaagtgcttcctgaaaacgtttgcttctgtcaaaataggaacaaatccctgaaaaataatgaactttccaagctttcaagtgtcaagtacctccgttcttattgttctgctcccttgactgggacatgtattcaaataggtattaaatacatcatctacacctttaccctgcagaaggaaatgtgtcttcaataacaatactaacagtaaaacaaccatcatttactaaagtatgagcagttagccacactaacacagtaatcaagttatgtatatcataaactaggaagtttatagaacaaatctcagctgacccattaccgagagttaaaaaacacaagacattgcaagtgagaatggactagatgatgtaggttgggcagttggtctatggtggattggtggtctagtaggtgcaatttggcgtggctttcctagttggtatgaagccagcagcctatattctcattctcataaaggcacacaggaaaatactagcaactaaaccactactatgcagagctgatctccctggcttcttttcatatttttgttgtactccaatctgaagttacaaaattttccattagttcctttcaccccttgtttcatcagttctcaagttcgtgttttagttagagaacttggactctgccacatctcttaacttcgcttcagaatctgaacagccagtattgttggtctgtgaccattcagttttattcgtttattcagcttttcattagtacttaacaaagaataccaaatattcaaagacaataccggtccaactgagttgactgctgtattttgataatttcagcctggtttgtctagtgtcagaaataacaacataggtaccagttttttgttagtactaacaaaatacgtattagaaactatcatatgcaatgataccttcaaatttctatcttcttcaatgcattcttctagaccagccaatccaccaaatgcaattaaaaggtgcctgtacaatgaagcgctcataaatgacaagatagccatacacccacaatggtggtcctgtgtatttttcagtttatgatgaagaatagagtggattctactttgcctctcatacactatcatctgagtctagaaatcaaccctgaataataaaaacggacatcttccacccctcaaccaccaaaaccagtttaaaatatccccttaagagcaatacaatgtggttataaccaaggttctaaatagaagtgatagttacaacaatggtggtagtgggttactaccattaccaagactaggtagtgctacgaaatagcgcattggaacaaagcagctgcaatagcagctggatagcaacctcataagcaaaatagcagctgctattgcattgcacactgaagtctgaattatggagcttaaatttgtgttgtgttaactcttgttgattacttgctttgtttttttaaatagagtaaagacctaattaaccatatctctattttctttttcataccaaggctccaaaagcagctaccctaatgagggttaaaaaaaaaaagcagctacccaaataactcgacactggtaaattcaggccagaggcaaattatgtaaactatataaaatgatgaaccagctgttcaacaatcaaatcactggaaccatcaaaataagttaaccagtaacatcaccaagtcaatagctggtctgggttcaagaactatctgactggatcacatatattgttgtatggcctattttatagtaagagtctgcaaaacactccctataacaaaaaagaaatggacatgtttaatgcaaaaaaaaaaaaaatcacattcagtttgtatatgttcattttttattcatagaaaaaaatcctgagacactggcaaaaaataaataaatagtcatcataaattatgtcatagcatctagaaacaaaattttgcattcagcagaccaaacaactatggaaaaaactgaattgaattctgaaggtagtccaagggaagtgaaaacaatatacctaaaggaaggtaagatcagctcagatgaactaatgatctttccatgctctgaagtaccaatgatataatcatatccttcctaaaaatatgaaaataattagtaataagtactctttaccctgtactacatgtgattgagctaaagaaaattgtaccttgtatggtgaatcactgaaaactccacccaaatttgaagcataccggaccttatagccccaatacaattccatttcatccctgggagaggaaggggaaacaattttccttttgcaagctagatgaaaagtaaatgacaatatgtcattaatcaatatcaaaataacagacaaaattcaagttgtagaaggcaagagctaaaataactgaatggggatataagtatgcctagtgaacaggaatgataaaatgaagcgacgcattacgaagtgaatccaaagagcacacatgtgaactgaaaatagtcactctgtttttatgttacataattaaaaaatccatccattttgctctgcagaacaagcagaatggtttacttgaaatctgtagtaacgcatgggcactatattattcatatgagaaataaaatcctgatagttgttgcagattttaaccagtcattgcaaatggttaggaaggatacttcagggtatatggattaaagaacatataccgagtaattcagatactaaaaagttctagacgaagaaaaatcaatagagccacatctgaagcctgggtcaagtgaataaatcatttacctgttgtaatgtcacgattggtacccatggcaatagttactctcttccctggttctagcatttgctcaaccagaacattctgtgatgaaagacaattatagtaagtttattggatgagaacgtacattatctaatacatgatccacaaaggtgtatatgatacaatatacattacagaatctgagaatcaagtttatcatgttgagtacaaaaagatttgctcagaggcagacatgcaactatcaatataaagttgctagacttgccaaagcactctggccaggcagctatcagcattgaagctatcccatgctgattttcatgtttcaccattctcttacccttgccccatatgcagttatgggtaatggccatggcatgcctctttggtgcaaagatatctagctgacattttgacagcttacagttatgctatgctatccttgccaaaaaaaaaaaaaaaaaaaaaaaaaaaaaaaaaaaaagcagtatgccctttgttttggcccagcttcagcgtatattgaaagcagccttactgggagtatagaaaattcaccaagcaaacctatattacagaaaaaaaaaaagaagtattttgttggaataacaaactatgaactcgtttgttatgtgtttggtatgacaccacccactagcttaactttttttcattcaattaggctaagtttacaggggttaattcctcggagtaaaggaaagataaagatagttgggtttatgaaaaggaaagggtttggttttttggaaaggaaggaaagtgtttgctctttccggaagtaagagaaggactaccttgggtaaggtaggacttctcggagtaagggaaagcaaggtgatacgtgttcctagcagtagttaagcgctattgttgctagggagcccatgtatgggggtatgcgcgtggaggaaaacgcccagaagggcaatttttgaagccctacggcactttagggtaggtttaggtactctgatacctaaaccagaatttaaatgcatttaaacgcatttctattagtgaattaattattcgattcatgcactgggttagtttgtttggacaataaccatattataacccctttgtttataactgaacagatattttatagtctaagccgtcaggttacaactgaacggatatttaattacacaagccacttgagctaaaaaatagtatgtgaaaaaaatttggataccttactcaatccgacatcaacaaatgtccccattgaacgatccccatccaatgttacgcctgtctaaattcattctactgtaagcattctgttgaatcacacatgaaaaatgtggtaacaaaaacttttccgataccagcattaaaataggaatgaaaaaacagtcgaaacaaatccaattatgctattagtactcatgttcctttttttagttgagaagcacaaaagggtgccattctaaattgaagccttaacaaagttgagcatgtgggataggcagtcctcccccaagaagtaattctacattaacacaaccaacagctcagccattcagtaacacagcaggatcaaagagcgtataaagtttatttttccttttagcatgaactacgagaattgataaagtccaaagcaaatgaattgcatattgtgcatgtaatgaatttctgaaagctacgaagaacagataaaacaactgcacaattcatgggcatactatataatatttataaaaggtgcagacatggccacgcatgacagaattattaaacatgatgaatcattcgaaataccaaacactgcatgtgcttatgcatagttcaattgatgtgctcatatacatatagtttcattcaaagatgtccctaactagttaaatatgaaatttacaacttctcctagttttctttttgaccgaaaaacagtagcagatctctagaacttgtcctaaattaacaagagaccgagaggtaagtcgcatagctcctataaatctaggaagacaaacttcatatttttctagttaggtaaaaaagttaaattacattggccatgtgatatttactttgatttctctctcctatttcaatccgatatactaaaataatggtaggagtgtattatagcaaagagaaaattcgctctatgcacagaaaaaatggcagtaccaaaaatagcacaaaacattcccccattcgaccagaggcacacgccactagtttttcttcaatttgtagcgcttccgtcacattttccgtccaagtgattggttagccaaacatgaacttgggctcctcggctaattgaacttgtccacggtggtggctgtggtggggtggccagcagcggaggagggggtgcggccgatggagaaggtgtttgcatcgctgatgaggtcttcacataggtgtggcttatggagatggagaacacagagaggtgcagcttgtcgtcgacgcgtagcagttccctgtttctctctagaaaaaaaatcagagaggaaggggccagtggtcatcacgcacagcaggaattgagtaagaagatgagacagagatgtgaagaattcagtgctcggcaatgcaaatcaatggtgtcctatggaatttaatttttgcaaatcaatgattgaacaggacacaacaaactagttcatcatggggttcggggatgggaaggagtcgttagccgccactgtcatcaacgaccttgatcccatgtgccgtcgcacggcgcaaactgccagccgccgcatgcttgcctgctctcccagccaaacgagcatgaactgatgaagaacaggaatggtccaacccaaccaatcacgtgtgaatacagagaggactaagggtaaatttgtcattttctgtccctattcacatggaaacactcgtcttgcactgcagttttggtggaagtgctatggatggaagaaaaacgagtggcctgtgctaccagtcgaaagcggaaattttagttccttgtttctgtgctacagatcgaattctctatagcaaatagccagaaaactagagtacccatggccgtgacatgattttagttccccacacaacaaatgccgacttcgccaaccatatacgataaaagcaattcaacgtggataccaatagcactgcaagaagagagagatcaccttcacgaaattcagaccactcatgcttgcgcaaatggtgtggtgcatcgagtgggggcagcaacccctgcatacaagaagcgacacggatcaatcagcacctccaggaaacccaacatgccgatgatgcaatcatgttcttcagcggtctcaccacaaacttcaagttgttgtgcatcgggaaaaggcgtcggcgcaggtattgtggagtctccagatactgtaggatgcgaacaaggaagcgcgcgccactctctacgtcatcgccgctgttctccactgaggaattgctgtcgaagaccacaacctcgtcgatgcggaagacggtcgccgcgcgggcgatttgtcctgccagctgaaacagggtaggagctagagccgcaagaactagcaagggaaggtgagaaaggatggatactgacgagggtggcgagctcgagggactgggcgttgtcgatgatggatccggcgacggcgatgctcaccgtggtcttccgattcggaaccgccacgtcatctccgttcttcttctgttgcagctgcttcttcctcttcttgtcgtggacgatttcttcgtcagccgctgaagcctctgcggctccgcagtcgtcctttcgcttctttttcttctccttcttgcaccgggccttcttggaggccgctgctgcctcggcgtctccggagttcattgcggcggcggcggcggcggcggaggcgtaggggggactaacacgagaacacctccaggttccaggagtcgagaggccgacgaaagtagggtagtgcgtaagggcccctcatgtgccggccttcggccagcgaaggggtttgcgtggagtcggactgttttcggcccagcgataagtctactttatgtccctcagtaccgtttgagtttcattgtatctctcaaccgtaaaaggtggagaagtagaaatagaggctcattcagattggtcgcccgatcgaatttgagaaatattgggcgctgacgtcagcgtccgatttacgtgcagaaactactttaaattgatttttctcttaaattacttatccaaatcataatccgattgcaccattaaattcgttgcaattaaattttcaaaacaagaccacacatggatatattccgacgaaaaaaaattagcttattattgaattatttttaaatattgcacaatgttccactaggtatatcggaattgtttcactaagtagatcgaaaatgtttcactcgtttaaatcgggtgttgtttcaccttatgtaaaaacaatgtttcaacaaatagcgaaagaatgtttcagttcgctgcaacattagatctatacatagtgaaacattgtgagtatactaggtgaaacatttttcggtggaaaaaaaatataccaaattcccttaatagggggtttccaaaatatatggatttttttgttgcaatggaatgtttcgttcactgcaacattagatctatacatagtgaaacattgtaagtacactaggtgaaacatttttgatggaacaaaaaataaactaaattcccttaatagagagtttctaaaatatgtgggttttttttgttgcaaaagaatattttaattcactgcaacattagatctatacatagtgaaacattgtgagtacattaggtgaaacatcttttgtgaaaaaatgggagggagaagtgggtgggcccaccaggtgatcacgtgggggagcgcccgatccggctcaccctgcgcgggtcacccggggtgaatcattatcgagtataaattgtccctcattttttattaaaaccagtacaaatcgataatatggaataagttcacactgcatcccttatgtttgcgcattgagtttaaatcacatccttaaaccacaatactggaaatcttaaacctccatattacaaaaccgggttaaataagatcctaagacggtacggatgattgttttggctgacatggcatcctagctagaaaaagaaaataaaaaataatatgtggggctcatatgtcggaggctttcttcttcctccaattctcccctctcttcccaatctcactccacaacggcaaccgctggggaaggaggggcggctgaagaaaagagacaaggcgatggtggcgttcgagccaaccaaaggtcgctctcgtggcgcaaacagctcgggctcaccttggttgctgagctccacctcgttggggaggccacaccgcccgctgggtacgacgcaacgacatggcggaccaacgccaaagatttcacggcaacagaggggatgaggtggtggatgacgatggtgacctcaaggctatgggagggggggggggagagaaagcctgagcaggcagtggggatgaggaggtgaaggatgatagcgagctcgaggttgcagcagtgacacggggagaaggggggtgaggggtggaggagggagctcgagtgagccggagggaacaaggtggtgggacgatgtgggcgagctcgagacgtgggtgagcttgaggccacaacagtggctaggggagcctgagcaagcggcatggcctccccatgcgaggcggagcttggtgaccagtctggccgccgccattgccttatctcctctctcctgccactatgaccgcctctcccctcgctgccatcagccattgccgcgaagagagatcgggaagagaagggaggtgtggaaagagatgggaatagaggagagaatgattggaggaagaagaaaacccgtgacatgtcaacccccacatgttttcaattttttttttggataccacgtcaaccaaaacaaccatccataagcttctttcatatcgtgactgaaaacctacaatttttcgagcgcatgaaatctagcaaacaacacaggaatttaacaaagggagagatttgcacgtgtttgtgtacgatagtatgttttattgtgccacttccgtgtaatcggaaaaaaaaaagaaactgattaagcttcacctcacctctcatcctcacaaacagtacatgagaatatttcacctgtcataatcccaccacgtaagatgcttccacaaactgtacatgagcacgatgaaacaatcaagctgtattgcacaccctccatcctaaaaaaaaattaaagcacaatcaagctgtattagaacatcacaaaatatcgatggagaatgtaaatcttgcagtttatccatcaacacgatcacaagttaatacttcacgactgacccccccaaaaatttctcatatactcctaaaccaggaacgaaataatgacgtcgcgacttggaaaagttagatacaaacagccgtacaatgatttaaaaccaaaacaggaagttcgagttccttctttttcatgttcaattctctgtgtactaaatatatgatgtcacattattacattgtcacacattctgcaaaacttcaataatttcaatgtctaaagcatatacttccttccgtttgaaatggtcaaagacttgaagaggcaaaaagaaattctactaatttcgttctactcctggattcttgatggttctccaattgcatcttccatacgttggtaccagtcaccaatttgtgtatgctcaaccatatcttttccagctgtcaagtatcggataggtctcaaaacaccaaatactgcaagatctgccaagttaggcttggagccacctggataaatgcaagttaatatcagtgcggagtaacaaacttgatgcatgtggattttcacccttccaggctgttttttcccttttcccttcctttatggaaaaatatcatacctagaaaatcccttccatcaagggcttccatccatgtgttggcagcatcgtataatgaagcacgcgcatcagttatattgtacttcttctttagcttcttagacaccatgtacattgctgcagcaccagcatacttcacagcaaaccgctcagtaaaactgaagttgcctgcattacagagttcgggtgcacatcgtcaaatgttgcactaacaaaatcatgtgtcatttctgctcaaatgattaaaacagttagcgaacagagcaccacctctgcacccaattttacgtttttgcctagagatgaagaaatctagtgttcctggataagtggatagcatggcatcttgaacttttattttttagttttctagtttgaatataattggagatgaatcatatcttactataaagttatcccccactaactccttaagcttaacatgcaaaggtgccacatcatcatccactaacaagatgctacacatcatccactaacaatcatcacatttaaacaacatgcaaacatgctatatctttatagtttttataatttaagagcttttcaaataaaaatatgttaaattatcatccaacataattcatataatgtttcaatatatatctttattatgttttatgatatcctatatacttatatagttcatcctcacttagttagtacttaaatgattaatctatggtccaaattatctttctccttttttcctctaattaagtcatatcacatcaattgtttttagcctttttttactggaattgtttttagcctttagatgattaatctacagaccaaactatctccctatttttcttcttccataaagtcataccaccttactttttacatttgaatcaccattctacatactatttaaatttaaattatcataaaccatattaatttacttaatctgatgttatctagctatcttacacattctttttttattgttatcatactaaattcccgcagcaatgcgcggggtttcacctagtatagtaaacaagtaaccccttacatgaggggattttgctgaacagtgagcacaaactaatcttccctacactgttctttccatgcacctcatgttctctcaactaacctccgctatcagcagttcagcactatgttagtatggtacctcgacgattgaatttccctatatctcacaggtaaaatccctgttcagacacattatgcataatgcttttcatttatggggcatccattgacaatcacgctgaacagtgagcattcaccaaattgtgttatctccaacatttagaaaattaatgaactatgaatggagagcacctgggttcacaaaatcaaaatattcatgccaagtatgttccagagagatcctatatgtaacctcactgtaacaccctaatttgcaaggtgcaggccccatgtacacactgcattccattctagcttcatgtaaaaggttaacctgaaggttctatggttggaatgtgtaggtttatttgttatccttaatacatctaaaatctctatgtgagcctaatctcaccaaaaatacaccacgggtcacacaggcctctagtacaaagctggggttcattcacccctttctttagaagctgatgaacttgtcagcacattttcttgtttattcctgtgttactccgataaaattcaatcctattacaaccaaatatcaacttgttaaaagccttcgatggcagtagatagtgcacgaccatgtcctatccaccccatgaacccagacacatactcgtgtagcacaaggtttatgctctgatgtcaacagtaggaccctagctttcaaaatccactttggcctggttcttctgaggagcagggacatttacatagcaccccacgtaaacttctgttcttgattcatgtaaaagggttcccaaaggtgctatggctcaaacatgttggccccaacctatctaaactcaccatgtaagactaatcccaccatcactgtacatgggccacaagtgcctctactacaggaccagggtgttacactaacttataaaaaggggtttagcgttaatgattccactcactctggtctcaaatacttcttattttgaataagcatctagtcaaacatttaaaagtagtgtcaacatcttttaaagattatttggatacatgagaatcataaatataaccaaaagaaagaaaatatagcagcacacagacaccaaagttaaaagttccaaggaattaccatgttttgaaatataatcaaaagattccaaggcctctgaagttgtccgatatatatttggcgacaagacatgcacaaggtgctcatcaacccacctaaaccaataattcaagacaaattatgttaccgtagataaactccagtttgtaagaatgttaagagagtaaaatgttggtcactcgtgcaaccagggttcgccatgctacttctagaggaatccagctcactccatcaagggtaaagcctaaatgcagccaatttagtggtagtcggcttttttgtttttcatctttcagtttgtgaatcctaccagaaaatgcataactacccctaatacaagataataatggacttactggttgtctctagccttggaaacactactatgaccagatccagagaaaaagtctataaagtaatcatcagatcataacggataagctcttagtttcatcaattaattttagtggtaaaaacacaatgaaataaagcaaagaggatagttgatggccatactgattctgcctggccttgaaacattatcaccagatccttgggaaacatgtaactataaactatcagatcgcagaaaaaatgtagtaatagtgatggctatgctgatcctgcctggtgttggaacattacaatgaccagatccagggaaagaagtctatcatgtaactatcaatgcataaacagaaaaaactgatggacaaggtttttgttcaccgattgatttacattgtaaaacaatgaaacaaaagtaaagaaatactataaaagtagaacatattgcacatactaatgccatataaatgattaaaaatttcaagaggaaagtagactttaaacaatatttgtttctagaaataggagtactataacattaatgatttgagaagctagaaccaagacctgaaaaaaaaattacaaatactaatgccacataaacagatgcaagtaatggagaaatacctgcgccatttttcttcctcttcattagtggctttatcatcagggcggaccctttgctgtaatatattgattatatctaccaacaacagatgtaacaatacgttaactctggagtttaacacataaaaagttattttacttaaaagttgaaaccacaacaatgtaaaggaaccagaccggaataaaccaatatgaaatgaatgtaacctgatgaatcaaccagctgttcaccatctaccatcagtattgggaccttcttgtactcagaccacttgatttccttcttgctcaatggattaacttccacaaccttgtagggtatatcatgatagtctaggaaagctgaaatgaagcaaatgaagaatctttcaactaaaagaaattatgccagaacagagagatcatcaatgatttcagaataacaagtgaatgatctttagcaagcaactttcaagcttcagaaatctagaatacctctatgctctaagctactgatatacagatcacacttacaatcaggattgatcatagactcacagtacgatcacacttagttatcgaagtgtatatactcatacagcagataatttgtgaacccattgacagatgacaaccccagtcccaatagcattatgaagtttcacgtacagtaaattattacatcatgctgccaatgaatcagattgctgtgcaagtttgtaggtgagggtgacacctgtcaaaaaagggatggctgatgtactaacaagtaatgacagttggacaaaaggaaaacaatttttacaacaaattctggaaggtctgattcaatgaataaacttgaccaattcttagctgggaggctcctctcttttgaagttatgcaaaatgtaccgacagtccttaaacatgtcatagatgggcacagatgcacagttggacccgtgatgatacattaaattaagggcttaaatatgcaatttgaaagttcaagaaccataatgatagaagaattgtactctactgactatgttaaattacatactgctacctaaaaacgcttagcttgtaagtttttcattaccaacaaatcaataattatcccctcaacagaaaatcaggacatagaacaacacatcatggtaccccatgaactatttccatgaagctaaacacaatactaccaaaactcagaccttgagctatttcaggagggatggtttgcctagctgggggaaaccaacaacgcttgactacaagctcaaggccaagtttgcctcggattacacaatcaacctaactcgtttcaatgatttcaacaactttcaaggtattttgagatgagaccaaaaggctggaaaaggctcagaataaacttttttgtcgtgtgcaagaacacatgcaatcaagttaccatgaagatttgtgctcactttagttcaggctggtctctggaggccaaatagggctccaaatatgccctttttttgtatctctaactcaaattggacttaaatactcatttcaaattgaacatgtatcatacataaagacaaatactcatttcagacaataagtagtgttatatactcaatcaattcaaattgaaacacattaagcaatgaggttacttgttcaaaacaaaccaaatgtagcttggcagatgccattttgtatggaacagaatttctctgaccactaaggcaaattcatagtatggcatgctctttgcaagcctctagtaaaggatcacttgctccaaacaggcaaacactttattgtatggagcaatttcgtttctgcccctactttgatgtagtctaatactgattttacccctactttttatggttttcgtttttgcccccaattttttgaaccggacgatcgtcttgcccctattttggatgctgaagttaacggtgttaagtaattagcaaaaggacatttataccctcttctattttttttcattaattgtgtttttgcttccattttatacatgttgctttggaactttatttttgtgaatgcatttaaaattaaatgacgcacattgactaatataacaattaggacagattcagacctaattgttgtggcaatgtgcatcatttaattttaaatatattcacaataataaagttccaaagcaaacatgtataaaatgggggcaaaaacacaattaatgaacataaataggagagggtataaatgttcttctgccaattacttaacaccgttaacttcaccatccaaagtaggggcaaaacgatcgttcggttcaaaaatgtgggggcaaaaacaaaaaccctaaaatgtaagggtaaaatcaatattagacatcaaagtaggggcagaaacaaaattgccccattgtatctattcatccatatgctccaagccctaacaacaatagcaccaatttataattatttttctcaaaattgtcaactgattctggaaccaagagatctcttgattgttcatcctcttgggtctccacattacacatttttcaatgctcaaacatgctaagaccatagcaaaaatccctaacagctcccaggctcaggtggaaacctcaagcatgtattagtcaatgcaacaaggtaatgactaataggtgacatggcatgggtagcaggactacactacagtgatgtcatgaagtctgttacataaaacggaacaacgaacacaaggaccctgaggtggtcagttcaatgagtgcatgtgaactgtaaggtgacaagaagcacaagtaaagccactcagtgagtggcagagatggcctcatgggagtgatccacagatggcctcattagagtgatctggcggataatagcataatgcaaacaatgcaaccatggtaactaaattaccctccattggaatgttccccacactgatatgacttatgagtgcatggacaagataacaggcccaacagaagcttcacaaaggggacaaactcaggtagcagtatctggtgagctctgctgtggcctcaaggaagaacagtaaaggcaactttggtgacaccagcaagacggtgttagtgagaatgatagcaatggttacaaagcaggcacccaattttcttaaggagtgatggaatatgttccatatttttgaaatggacccaatgtattgtgttagtttttttcccttctattagctgtactttggttaaacagatagaagtggttttcttcacctcatccagaaatcttgatgctaactgatgggagcttattttctgtaatctactaccttagaatcaattctctgtgtcgaaagatagttcccttcaaatatccttcaccttctgtaaagcatcaacaaacctatttcagatgacacctaaattagcgatacttgattttctgtgttttccccattcttgtaattctatttatctgttccaaacagccctatcagcttacgagctaaagaaactatattgggctcacaatgtgaatagtcctacctgtgcatagggacctcgctaactcatattgttcaaaatattttcattcacttttttatctaaaaaggttggatagatgaaaaagaatgaaaaaggttttacaagcaggtattgcttggtttgctaggcttagcactggtcatccagtcgttgtgcaatcagccttggtgcattctcagcagtgctcttggcattaaatcctgggtagtctatggacacgtatggattcagtgggatgtattctacatttagctattttcaaagcaatgaaagtagagaacactatcaaaaggcggtgaaacttatgttctgtagatttatgcattgtccagaaacattgttggtccgccaaactcatgacaattgactgtcctttaacttctatggttacttgaatcctcccaacctcagaaacagcttctacagcagcctcccaaccaaaatacaaattataatctatattctcgatagtaatcattaagataaaaaggcaaattacagctagtgaactattttatcgtaaccagatcaccacgaaaagtactttttatcaggtctaatgcacatcgaaaacgctagattggaggagtgcacggaagcaggagcacatcacctctgactttgttgcagaaggggcaggcctggtactggtacagcaccacgttctgcggcagcagatccatgggcggcctttccttggcctccgccgccgccatcgtcgcgaaggtcagggagaaggagaccgccccagcgattccagctggcatggcccgcgaggatgatgatgatgatgcctgggatgggggcgacggctggacgcccaatctcccgccgcccgccgcggccgccgccgtggaggcggcgtccccatggagagcgcgcgaggagaggagcagcgagcgggaggccagagcttgcgccgctcggattgacctcatcttggcaaacgaatagagcggggctgttagggttttggactggtttgcctcgccggcgccggcggaagaagagacggatttaggaattacaagggagatcctggatggtgctggatggaacgcctaaaacccttgatactttacgtattagtacttcaactactattaaattgtgttattatcgcggctaagggcccaatgacggatcggttttctaaatagacttttgttttcggaggatacctttgcgctcgttcttcttggagaagaagaaaaaaatacgcggaacagttgggttcgcaggttaacgacggatgacgggattgttgtccacggctcaacatctacttccctctgtactataaaaaaattaaacctaaatctaataacctattcaaaatcatagtaatataggtatgtttagtttttttttatgtaaagtttttaaagtatacggacacacatttaaagtattaaacatagactaataacacaaacaaattacagattccgcctgtaaactgtgagacgaatttattaagcccgtcattagcaaatatttactgtagcatcacattgtcaaatcatcacgtaattaggctcaaaaaattcgtctcgcaatttacatataaactatacataggggtgaaaacggagcggatattatccgatccgatccgatccgaatccgtccgatgtgaggatatggtaaaaatttttagatatccggccagatgcggatgcggatgcggatatggtatcaacgatatccgacggatgcggattatccgatattttaatcggattatccgatgtaatgtttggcggataatccgcacctttcagaccacacaacaactctatttagcccattttacatcgggcaacccatctagcctatatagtgtaacctaatccaatcctcccctaaatctctctctctctctgcgactcttctctcggtcccttctcctgctcccacatgcgccgccgcatggcaccataggtgcgccgtgccatcgctacagcctgctggcgccaccgccgccgctcctccttttagtccgccgacagtgtgttgtgtgctgtttgctgtaagcagtgtgctgtatggaactagtgtgttgtgtgctgtatgcagtgtgctactgtattgtgtggctgtgtgctgtatgcctatattgctgtatgcctcattgcctcatgcctgtcatactgatgagtgaactactgaactgaacactatatttttaaattttaagcaacgcagtgaactgctgaactgaacacttatattatgtttttgatggatgtgttatattaagcaaaattatattattgatgtgttttggttggtttttcctagagagctgagatcatgttcatatgttgtttggccatcgtattgcggcaattgtattgccgccctcttgttgtatggattgaatacaaacttgacatccgacaactttttgtctgtttccgaacagagtccgcaccgactccgcaccgaatccgacgtccgaaataatccgctccgcatccgcatccgcacgtcatctgcactcgctccgcatccgcttaaagaaaatggtttaggatatggtatagctattatccgtccgaatccgctccgttttcacccctaaatgtacaattggttttttcctcacatttaatgcaccatgcatgtgtccaaacatttgatgtgacgtttttggccaaattttttttatctaaacaaggcctatatcatatttttttattatgtttgttttttatgagacgaaagaaatacacctttaccaaaagcaaaagcataaggttctcggttttggacatgtgaatatgaaagaaacatgatgatattaggatcctgttgggtagggcttcaactattaaatttaatttcaagagttaggtctggactagagttatgaagcgcggtttaaacccagctttacctcgctagtttattttgtgatgcacttcactccgcttcgctcccttgttaggtagagctgaaactatttggatggactctagctctaagttagagttgaaactctgcctaacaagtcctaggtattgggtagataagcacatcagcacgtacgaactttcaaacacacattgcttaaaaaaatccacgctttcttgtttaggagctacttagttttagttgataagggtgtgcatttggtttcctcggtttggtttgatccgtttttctttatttggtttttctaaaatgccaaccaaagaagagcgtgaaaacttaaaaatcaaaccgaaaaatttggggcctcatcgtttggcttttttctaaataagccaaaacggcttattagagaataaaaatgaatttgtaggtaaagcttttatacatgtgtttttgtgacttaaaagctaatgctgaaaaagaaactacgttgaaaatatctcaaaatcaatatcaaaattaagtttgaaaattcaaattttggctttttctttagctgaataggccatccgatgggagccttttggtgtactcgtcatcattttttactcaagaaactgccttctcccatcgttgcgggcttgagacgatgatcttcactcgtgcgatcgcgtccacccacatgctcatagatctgcccttgcatcgaggttgagctctcatgctggagatcagcactctagcaaacatcgagctccaatgtcactaccgatctaatctggcagatatcaagatcctacgccatcgtagaggatctacttgcatgcgactcatgactctggcaggaggcagcaaatttccttggttgtgcagtccttctctagcactgtgcgtgaggcaagcctctcctgcaagtgaagatgaagaggcgcaaggcatttcccctcgtccttgctttcagtgcggtttccaatggctcgcttgaaagagtcacttaggcttacaaagggaagctagaaactaaaccaggtcggattgtgtgatacctggtcgaacagttcgggttgtttttctttctttaccaaaacacactgagggagacccccacggtatatattaattttttgaagtttatatacaaagatggtagaaagggataaaaaggaaaagaaaacataattacagaatatcatggaagtatatgaatctccctatgcctaagtaaatgaaggctcaaatccgagataagatttctcttccaagaagcaacggaatgctgaataccttgaaatattaggccgtttctttccttccaaatattccaagtgtcgaaacaatatttcggtaatattaaaatgggatggctatcaagcttgaaaaatggacggtttaagagacatgaggtttatacaggttcaggccttctagatgagaagtaatgcctactcctgtctggggattgatccgccgagtatattgttgatcgtatgatcagggagaaaagttatgcccttagagtcacccggatccctccttatatagagggaggagccggaattacaagatacaacccatgttcttaacggactaggcttgtacatataaattacaatcgtaaccgactaggactatcggttgtttccttgatacataagttgacataacaaccaagtcctttactaaatatattctatttctatatggtacccctatacccagtcggatatacatgccgtgtgggtatggggtatccataatctccacagtagcccctgagaccttcgcagacgacgaaataatcttctcccgagtcatttaacgaaaaatcccgagtgcttcaattatctccgccttggcctcctgagtgcttgaattaaaggctgtgaagggcttaaaaataaaaaaaaataggtgcatcgactggatgcacttaataggtgtagcccccgactatgtgattagttgaaaaaaactaaacatatagtcaaggttgaaataaataaccagccgagtggttttataatattaccgaagtaattaaatattaaagcatttgcgactccgtccgaagagtttgccgactgctttaattaaattattaagcttactatgaaacatagaaaataaagatccgagtgataaaagcactctaaagatctatcgtctatgaaatcattgtcatgattaatatttgtgatgaacaattggctttgcaaaatgatttaatcaaagaattggtttgaaaaaatgtgtgaatgttggtgtaagtgcgtgtaactaatgtgggtcaggttgtgatatctgtgcccagaaacggttgttttttctgattgtgtgcaggtgacttgaggtcagccttggtcaatggtgaggaccgagactatgttcagggaggaacagaggtctagtgcggtcaggataccatgtgagaaggtgactagagtcaggattcttggaggtcaacttcggtcaacggtggggatcgggactaaactcggggaggagttgaggtccagacggtcaagatgccaggtgacgaagttggatacgagatggcgcatggtggatggacaccatgtgggagagatcttcacaacgggcttcacgaggtgtgcgtgcaagcgtaagtgttcgcgaaggaaattgagtgataatatttggaggtatatggtgctacagtacacgaggtactgtagcatgcaggttatatgtatgcatgtacggtgctgtacatgtgcagtttgctgattggttggcttggaggtttgcatgtatgcgttggctgtttggaaggcagcaggcagcatgcagcgtctcggctcagccaggaagggagcgagaccaagcaggaaacggcaggcgtgcgcgcgagttggagtctgactcggttggacctggttcggcaggtgcggctgagagtttggatattataattgactagcaaaagtgcccgtgcgttgcaccgggtgatcagggagtgtgtacagtgacaaaaagtgttgtttggtttagacaactaatctgctaaaaaaattatttaccacgaacgtctcaagcacccgtgtcaaatcaaagatttaaatcaagattgactggttccaccacaagaaacttatccggttaaactatacccactttgcaattgtgggaatatacatgtgtattgttacctgagaaaaatatgtggacttcaacaaatcgtaaaaatcaatcttattaattttgtgagagtgagtattggcttttatttacaaattgtatttgaggtcaaatattaataagtagacattaaaaaaatgaaagaagattagacggtgaggggaaaaaataaaaaaataaaaaaaaagagcgaacaaggacaggtcaagaaaattttattatttaaacatttttaataaatagatgctcgtgttacgtgtgttgcaacgggtaaactaaaattataataaatataaaaatattagatcgttaggatttagtttttatgatatgagccctttaaaaaaatatattccttacataaaaaaaagttgtaaaagaaaggcccattagacttaaaaccaaacaaaaattaaaaccaaccctataaatctctatatgtgccggttatatggtatacttgtgctgtttttttattcaaatacagagtgctcatttttttttaaaaaaaaggcccgtcagatctaatccttatccccgagagagcaagcggagagcgagcggagcaagcggcgcctcgatccttccgtctcctcatcttctcgttttcccgacttcccttatcctctctctcctcccttcattttcctctttctcggagttctctctactgccgtcgcaaccagcgacgccctcccctctcccctcaccagtgcgctgcttcccctccccctcgcacggcgccctccacccggctgacggcgccctcctcctctcggtcttctctctcgctctcctctctctcggagccaagcggcaggcggcggcgcaagaggggaggcagcgggcgacgggtggcggcggcaggtggagacggtgaggcccagcagcagcgggaggcggtatcggaggtgatggccgcgtccgcccctctgctgcagcggcgggaggagcggtggccgcccagaggcgccctcccaccgctagatccggcgggaggaagggctccggagctgcgccgcctcgccatcctccccgccgccacctaatgcgtcggtcgatccagcggtggcggctccctccgccccctctcgccttcctccggcggcggtggcagcgtcggcggcagccgcgggcggatccggcggcggcgggcggatccaacggcggaggctccctcctccgccgcctctcttctccctccggcggcggtggcggcggctgcgacggccgcggattgatagcgtggcgacggctgagggcagcagtggcgacggccgaggtcggatccggcggattgtgatgcatattgtagttcttcttggacatttattttgtgattttgtgatgattgtggttgagtgatttggttgtgccgattttgggaattgtttctcttgtatccgattctgagagggattgggatttgggggctgcgggcgaaggcggacagaaaaaatcaacgaaaaaaaaccgggccaaaaaaccgtgaaaaaaacggacggcccaaaaaaccggacaaaaaaccgacgaaaaaaaaaccggggtagagaaccacgaaaaaaccggacggcaaaaaaaaccgcgtgtgcgttcaggaaaccaccgacggacgaaaaagcctcacggaagccttacgaatttttttattaggtatagatttagaaattgagcatagagtcctagtgtgactaggagttattctcctactttgagtaggaggttttcggtataaatagagagggagcgtgagacttccctgtatcgcttttcagagtgtggagttgatagtttagttagggtttcgagtttagtcgagatttttgtaaggagtgctgttgttgcactatgtaaacatagagagaagcaataaagttatcatgtactttgagagttcttcgatttgtgttttcttgggttcaggcggtagggaggcgatctaaccggcagcgtgcgagcggtccgactggcggcgacaggactacgtcgagatttccatcaatttgagggtaacttttatttccgctaaaagtttttgggtttttggttttccctaccattcacccccctctggtaggcttggttacttgtgttcgatcctacaagtggtatcagagccttgttttcttcccccctctgtttgatttttatcgatctagagtttttgccatggctactcctgttaggttttcaactatgcctcctgttttcgatggaacggattttactcattggtgtagtaggatgcaatcttacattatggctaagaattatgatatttggagaaaagtttctcatccttttgtgattcctgaagttattaatactgatgctgcaaaaactgagtttgaacaaaattgcaaagctcgcaatattcttttgagtgggatttctcgttcggattatgatcgtgttgctcatcttcaaactgctcatgagatttggattgctttgagtaattttcatcaaggaacaaataatattaaagaacttcatcgcgatcttttcaaaaatgagtatattaaatttgagatgaaacctggagaagctttggatgactatctttctcggtttaataaaattttgagtgatcttagatctgttgattctttttatgatgctaattatccataatctgagatttcttgtcactttttgaatggtcttgacatgtctatttgggagatgaaagttacatctattcaggagtctgttaacatgtctactttgactttagattcactttacacaaaattgaaaactcatgagatgaatattcttgctcgtaaagtcgattctaagtctagtgctttggtttcatcttcgacttctttggatgttggtgcttcttcatcggagtcttctgttcttgctttatttaatgccatgtccgatgatcaactcgaacaattcgaggaggaggacttggttttgttatcaaacaaattttctcgagctatgaaaaatgttagaaacaggaaaagaggagaacctaatcgttgttttgagtatggagcacttgatcatcttcactcgcattgtcctaagcttgagagaggaaagaaggaagatgatggtagagtcaaagatgatgacgtgaacaagaagaagaacatgaaagagaaggagaagaagaagcattgtatgcagtggttaatccaagaactcataaaagtttttgatgaatcggaagatgaagatgagagcaaaggtaagcaagttgttgatctagcttttattgctcgtaatgcaagttctgatgttgatgaatctgatgatgataatgaagaaaagcttagttatgatcaattagaatatgctgcttacaaatttgctaagaaaattcaaacatgttctattgcgcttgatgagaaggattatactattgagattcttaatgctaaaattgctagattaaaatctttgattcctaatgatgataattgtcaatcttgtgaagttttattttctgaaattaatgctttgcgagatgtcaattctattaattgcaagaaattggaatttgagattgaaaaatctaaaaagttgagtcttcttttgctcttggatttgctttacatgctagtgttgttgatgagttgattttgacaaagaatgttttgaaaaaaaatacaaagttgctttttgtgcaagttctttggtcaatgctttatgtgcaaataaggcaaaacaaaacaatggtgctttgatttctcaagattgttcaaagtgtgttttgaatgagttgaagttgaaagatgctttagagcgtgttaaacacatggaagaaattgttaaacaagatgaggtgttttcttgctcaacttgtagaaaacaaaaaggtcttttggatgcttgcaaaaattgtgttgttcttacacaagaggtttcttatttgaaaagttctttgcaaagattttcttatggtaaaaagaacctcaatatgattcttgatcaatctaaagtaagcacacacaatcgtggtttaagttttgattcttatgcttatcattctagacatcctcctgttgttttaggtgttggtgctagaagtggtaaaattttgattgaatctgagcctaagaatattgtgtttaaatctgctggcatcatgtctactttgattgcatcttcttcaaaatctactgttgagcatgcgaaaccttctgttgatgcaaaaccattgatttcaaaacgatctacttcacaaacttgtcgtgagaagtatacttgttctttttgtggaaaagatggacatttggttggtttttgttttcgacttgcccgcaaacagaaaaaggaaagagaaattgcttttgcaaaacaacggtggcaaaaatcgggtttttgttcgaggagcacagttagaccgcaggtgaaccggcggtcagaccggctgccaggcccggtcagaccgtagggacagcgacggtctgaccggcctcggggcagtttttcgcatacttcaaatcggacttttgtgaaaccaaaaggtaagttttcagctaagtctgattctgattttgtttgtgcatatgtacctactggttctattggtcgtgtgactcagtgttggattccaaaatttcttatttctaaccccaacacggaggcctcgacatcttcttgttcgtaggtattttggtggcatactccccatgtgcattcaacgttgagatgacgattgcttttcatggtaacatcaatttacttttggattgacatatttttggttctacgctctcgtttattagcttttcatatgctagtgtttgaggtagtagtttttgttaatacaagtggatacatgtcaattcatgagaaccttggtgatatcattggcaattggatgtctttttcaaaatctttaatttcttcttgatctttcttcggggagaattggaggttaatttgagggggagtttgtgctttttcatgcattcatgtttatttttatgcatttgttctaattctgaaaataaataaaaatgagaaaaagaagagctttgttttatacctctagtatattcttgtgcatgctagcaaaataattgaggtatatttgttgctatgttagcttatatgcatttttagtctttatatgaagcttagatattgcttttaagtgagatgatgcatgacactaattcttttacttgaattaagaaaaatatgcaatattgatgctagcatatggtttgatttataaatgctttatatatgtgctttattgaattgttattcctcacatacctttgtcattgctcattgcgtaagagaataaaaaatatctgtgagagagaaaaaaataaataccgaatccttggaaacagtcttgacgacaaggacgtattcgatgtgagcaaaataatgggtgccgaatctctggaaacagtcttgacgacagggacgtacccggaataaaagagaaaaatatgagcaaaaaggctcaagaaaaagtaaaaaattctcttgattgttttgtgctaatgctaatttgagaaagaatgataaatgcaataggtatatatgtatagtgtttatttttcaacctatgtgcttgtgaatatattgcattataaatcatttgaaatcatgaatccttattgttgatttgagcttaattgtaatatctttgatttatgtttatactatagtgcatgcttgataaatagctgatgaatttctcccttatattgctacacatgatcatgaattgcttttggtacattttaaagctctcaaaaaaaaaattagaaaatagaaaataataaattggttattacaagtgataatcatgatatcattgcatatgtgctttattggttattatttctcttttgcattcttgaagaaatatacaaaatgcatgcttcttgaaagggggagaattgaattgtgtttcaattttaaaaatagtcgattttgtgtttttgtcgcaaattgatgggagaagttcttccttttaaaaagggggagattttttctttttcacctttgtgatttttgtttttatttttcaaaaacataaaattgcattttggtgatgttgccaatgtgttcatcaagggggagattgtgaaatcattgtcatgattaatatttgtgatgtacaattggctttgcaaaatgatttaatcaaagaactggtttgaaaagatgtgtgaatgttggtgtgagtgcatgtgactaatgtgggtcaggttgtgatatctgtgcccagaaacggttgtttttctgattgtttgtgttgagattatagacatataatg

SEQ ID NO: 71321 - DNA, 53279 bp, Oryza sativa
aaatgaagattgagatagagatgaaacagttctaagtggtcgtagagaggggtgtactagcgatgatacttttgatgttcgaagtgatgtacatggtatgtttggtggtggtccgtaagatgaagcaaaatcatctcttccacttgaacaaggaattgagtgttgattcgattttgtttgtagtggagatagaaatgacaaatctgtagatgttgaacgaagcagattacgcctaggggataatggagaaaaaatactagatgttgacaaagaaagaaaagattttctcttgagttccagttgagttgattcatttgcatctgtacttgtgttggcacaagttggatccccattagcttgaaaactagatccttgaggttgcaagtttagtgaagacagattagagggctgaccatatgaatttgatatcgaagcctccattcccttcgtttgctcttcaacacaattagtatttgaaacattaagtagatcaatcttttgcaggggagaatttaaatcatgataagtgcccgtgctatccaaatgaggtttcactgataatagaagtcccaccctagcattctcctctgtggaatcaggtactacaccaattgtggaaccgataatagatttttctttcttcctattcttttctggtttgatcattatgctattgccataataaatgcattcttcgactagattatccccttcattctgttttagagtaaccagaacttcttcctcattgttagcctctgcatgtgtaatggtttcagaattgtggaccacatcacttaactcggttcctattgtatctacctctattactggttttgaagttgtgacctcagatattatgacctctttgatcatttgtatatcctttagactattagtttctgatataatgacctcctttaccaacacattttctatccccgagtcttcattggaatccgtcaatatttccttgttggaattgttcttttctactatgcagccatccactttacctccataacaacttgaattcatagtatctctatctccatcagttgtatttgctgaacttgacctcactactctagttatgttgttctgtataatatctccttcagcagatgtacatttttcatctgacttttctagtgacaaaaccatgccatcaattttatttttttgagatccaccaagaccaatctccatgtcaaaatgggaaaagggtgcagttttcattagttcagcacgtggagaacactctgtggaagttatagaaaggatttcagcatccctctgcccctcttgtgagtcaagattgctgaaaatttctactgcttcaaagaacacgtcgatagagccaacttccacctcgtcatcatagtcagatgcaacttctatggatgcatcagactcaccatcaaactctgaaaagagtacctggttcaggcatgcactttcatttacattttattatgttgaaaatagtatttcacatgtatgcaagaaaaattatagcctacctctgccttgaatttttttgtgaaccgttgttcagcatcccatgacacatcaatgttttcaaagttcaacggtagaatgtgagattggataaaataggtattgaacatcacccgaaacatcaacctttcatcttctaggctatcatcaatatgcaagcattcaaggacaacatctccttgcacgcaggatccaacatttaacttcactgatatattgtctgcctgctacaacagttaaagaataactaaaacaaatagaacaacaattgagataaactgcgattagtggtacctgtttgtaacgcctagcgtgtttcctaggctttgatggtggcaacataacattgcatcttttatcaacagttagaaaatcctgcccatatacacgaactattggcctacaaccacctacaccatcaaaattgggtacttccctaagaattacacaatccaaagtaaaaggaattggttgtataggccattcaagctcatcatccattttgcatatgtactgtagataccgaagatgggaaggttgtggatttagtgttgttaacatctgaagaagttcctttggcgcttgcttataaaccatgactagagttctttcttccccattatactgcttcatatatagaaggagacctgcaagcataaatgccaaaaccggccaaccgcctttctcacaatgcatgagtagaaagttttgctgcccttccagcataagccacctctcgctcaaccttaggaagtggaggaccatctccaaaggaagcaatgggcatcctaggtactggcagggatagtctttaactgtgataccgtaaagggagaacaagcctgaaaccagactttttccttcatctctgaagttaaataccatcaatgaagaatctacaaactgctcacgaagttgcaaaacaatgttgtccagataattcttgtattcaaattgttccatggtttctgtagagaagcaacagtcgaatactgcaagcataaatatttcaatcaatttctcttcaagtcaaattggattctagaaggcatcttagctaacattttagtaacactgcagaatgttagcaagctacttttcccctgtgaaagaaacattagcaagctactccctccttaccaaaatataatagcttctagcattaaaaaatatctcaaaatatagcaacttgtacacctgcttcctcttctcaaccaatcagagacatttctcaattaatttcagcacctactttcccttgtgaaccaatcataatttttttgctatttatttctacatactttcttaatacttgtgccgaactccagacgttcttgtatttaagaatggatgtaatatctgtgaagctatcacataaggaagtagttgttttatttacataattaattcagagaaaaaaccgatatgcatttcgtagacttttcaacaacatattaaaaacctatataatccatgaaattgtattatctaggttgataagtaatattaccgtatctattaattgagtgaatgtacaaagcagccccatttccaaagctagaatcaatgacacattacacaattccaccaattccacgcaacctaacccttccatgttgctgcagcgtttccccagatcctcctcagcatttgaaaagcaacaacattgcaggaggaagaagaagcatgggtttaccatagacgcggtcggcgatctcgaggagtcgatccggtggcttcctatagaatagcctccgcaacagcgccatgccctccctgccgttgccaccgccgtctctggcggccaagcctatgaccggcacccttccttccttcttctaggaacaacctccatgcgcagcacaatgccaccaaccaacacactttcgtagcaaatctgtcttgcaagagatcaaactccaccccaatgcgccgatgaaatttggccggaaagaatttcgcttccgcttctgactcgaattttttgctggattattatttttttacgataatgcttccatctggacgttggatgcaagcaaaaaaatcggaccccgcgtctaccatgcaaaaccaacaccacccatctgcaagtttgcatgcaagctcatttggtcgcccgcgcctcccatgcaaaaccaacgttttcgtccactgcaagtctgcatgcaagcatgcacgcatttaacaaggagaaggctccagaccaaacacacgagcctcaaatgatgttttccctaaactatgtatctttatttaagatctgatttcaccattgtatttattgaagataaatcattaaaaaatgatctcctatgattatcttttgaggaatataaatgtttcaaccgttaaaattcgatgtttcatgcgtgagagcgatgtgtttcacgtgttttattttttatgtctattccagttcttaggatatttcactggtgctcaacagaaatatttggaccaactgattttttttaagaaaattagggacatgattcatttgttttttttttgcgcattggtaatcctcacggtgtttgaggtcgcagccatggaacacaaggccataagtgaggaggagtaactactacggaaccggtcatccgttacggggcaaaaccctcatctgtgtcagaaaagttcatggtcagtgatgtgaaactatcatctgtatcgggccatgctccgacaccaatgatgcatgtctctgtcgggccccaaataaaacccttcatggataggttctccagcccgacacggatgactcatccgtgacagcctcaaattgagctccaataaagacgttgccctcacattgatggtaggtgtttagagcccgtcaaggatgaatcatccatgatgggctccaaatggaacccgacagaggtgttgcccccacctttgtcggcatgtcttagggcctatcacggatgataatccatgacgggctagtagtgcaacccgacaatgtagtacattctggtgacggttttgcttttgcggcccgatagggatgaggtttttcacaaaaaaattaaatttgttttattggcttgcctcaggcaaatgatagccaagcccactacatatcccaataacccagcaatataatccagcatatccttgctcacattcacggtcacattcacacaagtttcgcattcacaatcaaattcacaagtctcacacattcacaagtttcacattcacattcacatacaaatatatacatttcacattcacatattgaacccacattattatcacattcaaattcaacaatttattacctttctttccttgccaaaatgtgaagcatcttcaagggacaaccatgcatatttattgcaacatgtgaaataagtatgcaatttgaaagaagtgataaatatattacttctaacataaatgtttacaagtgtacatagataaattaaacataatcaaatagtaattgttttccaacataaaaagtcatgacttaatcatatttttcactcaaatctgattaactgatcacgataaatcatctagtatggtaggtgcccttcgaagatataacttcatgtatgatgaagacagccaattcttctctgatacggcgaaattgtgctctggaatgttggaaataacattctgaaagaggcatcaagttagtacatatcatacgcaaacctaattttatgtaatatactaatggccgattttataaacccatgaacctcaggatccaaggaggtcacctttctagcgagaatcttcatctgatgacatacatgaaatacacaggtttcgccggtttgtttcttgcatttgtagttatcatggtgatagaggtcgggtatatcttctcggtgccgaccccctttgttgacatatttctcccaagccgcattaaagtcctccttcatagatgtaaagttgtatttttttttcttattttggagttaaggaagtataccctactccatttttcacttatccaatggaatctgcaacgttaatatactggaagttgaagaccacacatgtgtagtaaaatttaaaattcctaacgtagtgtactattcactgttgattgtgtgctaataagatgaagtcttcatcctagtgggcccttaagctttcatagaagtaattaatcacatcatccaagtgagattgaagttctgcctcattatctcattatctgttcacctggtttttgttcctccgtgcctctttcgaacgtatccttcaaggttcacatgtgtggtcaattagaagcattctacaagtattaatagtatgtaagtttggtgttatttgtacttacaatgtgtagcactttaacaagccggtgtccactgctcgtagcttatagaggtaaaaaagatccgagaaggccactgcaaaataattttgttgccccaaggatggttcttggtcgtggtaacctactatggacgtgtccctcatcttgctcttggagtttgttttctccatgtagtatctatgcagcacttggcaagcagaacccattttggctaactcatggtctgcaaccaatggcacctgttgctgaaatgtacctggagcttgttttttggagtaacgttgacctccttatccagatctagttgtttgggaggtaactacggctcttgtgcctttctttttccttttgatctatctcttgcatgatgcgcccttctttgcaccatcggtggagatgaaatggccttggtgttttgcggaggagggtgaagtttggccatttcaccgaagtccgtaccatggctctcaaatggagcttcgatggccagaggaggtgaagggacttttgtggaagaatctgggcgaggtggagctggagctaaagttgtcctcaaagtgaccttgatgatgatgaggtcttttagccattggatgaagataccacgggattggaagttgccagttcatccaatcagcattcaccatgtcaacttgtactttgacatgtctagccaccaaatctgcaccgcgaactcttgtttatggagtaggtttgtatggttagccctcggcagcatgacaacagaatgtttgtgtaaccctaacttgtaggatgcattgggctacgccctgcatacaatccagaaaaaaatattagtttaagttgtacgaatcacatcagctacaacgagaactactattcgactgagacaggtggatgtcattctggaatcccagttgacaaacaactacttcgccgctgcaggggctcacttgcacttcttctggatgtccgttgtcctcgttcctttttggctagcatctcttcccttatcctagcctcaattccgtgtaatttttcattgaattcatggctaagttcactattgacggtccttaaatcataatatcagaccgtcaatacctgcatataatgaaataaacacatggtatccaacttagtggtaggtgttattactaatcatttccactagtgttggtgaaatatatgtatgcaggtaatttgaggagaaaacacatccgtcatgtgacaaaatgcacctccgcgcattcaggacgcgtttagacggattagaggcccaataagtcaataaaaaccatttagaattgggccaaaacatagcccaggttgtttggggcccattaaccaacctcccgaccgaaggagaggccgggaggagagtttttgggttcggccgaacctaccagttcgggcggaccaatcctggtgcttcctgtcatctgctttcacctggacggctcgaatttctctcctaaggcggttgcagcgtgttttggtcatttcccatacccctaaccgtcatttggagcctatataaggagctcttcatctcacttcaagcacacacaactttgagctgaattacaagaggctctattgtatcttttgtacattagaaataggtagaaagcgaggggaagctctgaaggagtgcccggaagtttggcgctcatccgacttctgcctcgacgagtgtagcttcctaggaggaattctgaaggagtactggagtatcggtgagtactggagtactggccgagtagcttcctagatggctacgaaatcagtcttggctttatagccatggttcgagagaaaaccttctctggtagtatcggtgaaaatccatacctccatcttcaggactttgagctagtgtgttcgtgcctatctatcgtcggcatgacacatgatactcttaagtggaaattgtttcctttttctcgtagagatgaagctaagcaatggtacactctatctgtcaagaaattccactgtgaatgggaggagcttaagtgcaatttctgccttactttctttccattaacccgtgtaatcaatctttgagtagacatcctttcttttcgacagaatgagaaggaatatctcggtgcagcctaggccagtttctcactgttaactcaatctggcccagacttgtcgttacccgaccacgtgttgttgcaacattttcggtacgggttagacaaggagtttgccgaaaatctcaatatttctgccggaggatcgttcgcacacaagacaaccgccgaaggaagagaactcttagatttgatcttagagaacgattctttcggccgaagcgaagccgtcccgaaggtcgagattattcatgaggaacctctgcacgtggagttggaacccgactcaactgtcgaatcctcatcccggtcgcaggagccggaggaagaagaaattcatcctccggaaatttcattccaattcgaggaggatcttttcgaagattattagaacaccttgaattattcctgagagaagagaccaccgaccaaggtcaattctaatgaacctcttgataaatctatgcttaaagagacggtgaagaggttgaccatcatcatgagtaacaaatggttaagagaaggagagctcttatctgaatcgattcagatccgatgcccctcctcaaccattatgtgtcacattggaggtaattcggtccgtgctctgtataatccctctgttggtgccaatattatgtccgcaacctttgcattcgattgcttaggggacagatcgttggaaccaaccgtcagaaccttccgaatttccacaaactctactaccgaaggtttagggattatctctggagtgcccacacggcacaacagtgttgaggtcatattagattttcatgtgtttgaaatatatgatttcgacatactcatagggcatcccatagaaaaactcttagatgtgcccgaaaccggtgtccttaacctgaaaataggaagaattgccacctccgtccctatgttgcaatcaaccaattctttgatggagtctcttcctgttcctgagccaattgagggagtgatggctatttctccattcgagaccctagagtctattttcgatgaatccatcgaagaattcaatgaaggggaggatgaaactggagaaacgatggatctgccaaaaacggatctgccgtcacgagccccaattgagctaaagcccttaccgtcaagcctaagttatgcctttctgaacagcgatgcggagtctctagtcattataagtgacaaactctctgagagggagatggcccgacttatcgccattttagaaaagcatagtgctgcttttggctattccctccaagacttaaaaggcatcagtccgaccctttgcactcatcgcattctcttagaaccgtctagcacaccatctagggaacctcagaggaggctaaataatgcgatgagagaggtcataaaaaaggaagtcttgaaactcctacataccgggattatctatcccgtaccatatagcgagtgggtcagccctgtccaagtagtgcctaagaagggaggcatgacggtcgttgaaaactcgaacaacgagttgatcccgcaacgaaccgtcacgggatggagaatgtgcattgactataggaaactcaacaaggctacgaagaaggatcacttttcgctgcctttcattgatgaaatgcttgagcggttggctaaccattccttcttttgtttccttgatgggtattctagttatcaccaaatccccatctatcccgatgatcaaagtaaaaccacattcacgtgcccatacggaacgtatgcatatcgaagaatgtcgttcgggtagtgcaatgcacccgcgtcatttcaaagatgcatgatgtctattttctctgacatgatcgaggatatcatggaagtcttcatggacgatttttcagtctatggtaaaacattcaatcattgtttggagaatttagataaggtcttacaaagatgtcaagaaaaggacttggtacttaattgggaaaagtaccacttcatggttcgtgaaggaatagtcctgggacatcaaatctccgaaaggggagttgaggtggacagagcaaaaattgaagtaattcgacaacttccacctcctgtcaatgacatgggtgtccgtagcttcttgggtcatgcggggttctacaggcgcttcataaaggatttctccaaaatcgctagacccctaactgccttgctagctaatgatgttccggttgactttgatgatgagtgtatgaaatcctttaaaatccttaaggaatcactcatctcagcaccaatcatccaaccctctgattggtcgctgctgtttgaaatcatgtgtgatgctagtgattttgctgtgggagctgttcttgggcaaactaaggatagaaaacaccatgctatcacatatgctagtaaaacgttgacgggagctcagcttaattatgccacaactgagaaagagctcctagccgtagtgtttgccattgagaaatttaggtcttatttagtgggggctaaggtagttgtttacactgatcatgctgcactaaaatacctgcttactaaaaaagatgcaaaacctcgggtaattaggtggattcttctactccaagaatttgacattgaaattatggataaaaagggagtagagaattatgttgcagatcatttgtcgcgtatgcaaatcactaacatgcagaagctactgataaatgactatctacgggacgacatgcggttgaaagtcatagactctgacccgtggtatgcaaccatcgtcaacttcatggccacgggtcatgtaccaccggtagaaaataagaagaggttgatctacgagagccgcaggcacttgtgggatgcaccttaccttttcagagtctgctcagatggtctactgcgaatatgcgtttcgacagacgaaggcatcatgatcattgagaagtgtcatgctgccccatatggaggtcactatggagcattcaggacacatgcaaagatctggcagagtggattcttttggccatcaatgtatgatgacacaaagtaattcgttcgaagatgcactagatgccagaagcatggagggatcactgctcgagatgcgatgccactgacacacaaccttcaagtcaagctatttgatgtatggggcatcgacttcatgggaactttcccaaagtcctatgactgcgtgtacatcctggtggccgttgactaggtgtcgaagtgggtagaggcagggccgcagacgccaagcacgcccgccggatgtttcatgagattatcttccatcgttttggaactccgcggatggtgataagtgacggagggtctcattttatcgataagaccttccaaaactgtttgcaagaacttggggctcagcaaaaaattgccactccgtatcatccccaaacaagtggacaagcagaaatgagcaacaaacaaatcaagaatattctgcaaaagactgtaaatgagatggggtaggcatggaagaacaagctacctgatgcacttttggcatataggactgcttataagatgcccatcggcatgtcaccatactaacttgtctatgggaagacttgtcaccttccggtagagttggaacacagggcgcactgggctatccggacttggaacatcgacttgaagggagccggatagcacaggaagatgcagttctctgagctagaggaatggagggacaaggcctaccacaatgccaagatctacaaggaaagaaccaaaagatggcatgattagtggatcaagcacaaggaattcaaggtaggggacaacgtgctgctgctcaactcacgggtgaagcttttcggacatagaaaacttcgaagtaaatggatgggtccatataacatcgtcgatgcttcatcacatggagccgtcacgctgcgtgacaacgaaggtaacatctttaaggtaaatggccattgtttaaaagttttccttgatccgttagaagttgatcatgacttggatgttgtgaatcttgtctcttttagcttctacccggagtctttaggtccccccttgatccgttagttttcaatgccatgagtccttaggcctccctctagttatcttaggtctagctttcatgataaaaataaaaaaataaaaaaaaataaagttggctccttggtcttccaaccatgtgagccctttttgcttcactcttgtctttctttttcttttttgtgtccaataaagcctctcatatacgaagacaagtgtgggggtgatcttgcacatcaacgccgtaacaaaagcaagatcaccccagacgagctatgacaaaccacacacgggaaattgatgcagttagacctagtgaggggtcagccaaatctccagttcggctaaactatctctaccaaggatcattttctattttatacagagcgcatgtttgcacaatttttcctttggacatccattctatcttgagtttaatttgactatcaattctaaaatatcgaagataattaaactcaaactagggatggtacaattagagttcatggtctccctgaaaatagcatgcatgcctattattctttgctcattacttgttgcttgtggtgacttatccaatagggaccccatgctatctaagtaattgatgaatgagatatagtctgatgatagaaattctgctcttcatgttgcacacttgggaattttataaaatgaaaaaaaacttgtataatgatgctaaactgctcattgatatttttattcccacttgagccataggttgatcattaataattagcttgctacatacgctgcttgtcattacattgagcgttgtcaagttttgtgaccctagtgaaatgcttttcatactttcatggtcaagatcacacacattccacatacacccacctattcttgacttctacactgcaagttagcattcctcatttgtcattcatttcatccatcaaataaatactcatacaagttctttcaaaaaaaagttgagagagaggcatggctatgcaaaaagaaagaaaaaaaatgctcatacaagtattgagcatgatgatgagaaaaaaaagaaaaagaaaaaaaagagatagccatgcactcttgaaattttcaaagagaaataaatggaagaggatgtatacaaaaggagttattgattcattttttttccacccacaaatttaccatacacatacacatacacatgcacattcttgaccagaaagtatgttttgtatttccgtggatccattatttgactttgcaatatatgtgatgcaagtaatgctctactcttttccataccctgagctccacaaaagccttattagatggtaggaaaagaaaaggcacaatcatatgccttgtgaggaatcatacactttgagcgatcgaaagaatcaatggaggagcaaagcatagttataattttgtgttacctcaaaaaccacaagttgttcttcatgaaaaattagggtgacttaatgtcaagattgttccatttctcaattgctcaagatcgcatggtagacactataaagatcgacaagtacaggtatggctttgaataatttgtttgcatgatgattagttaggaagtcataactctgttgtagagtccatagccttcactcgggatgagcaaaggttaagtgtgggggtgttgttgacggtccttaaatcataatatctgaccatcaatacctgcaaataatgaaataaaacacggtatccaacttagtggtaggtgttattactaatcatttccactagtgttggtgaaatatgtgtatgcaggtaatttgaggagaaaacacatccgtcatgtgacaaaatgcacctccgcacattcaggatgcgtttacacggattagaggcccaataagtcaataaaaactatttagaattggaccaaaacatcgcccaggttgttgggggcccattaaccaacctcccgaccaaaggagaggccaggaggagagtttttgggttcggccgaaccaatcctggtgcttcccgccaactactttcacctggacgtctcggatttctccccttaggcagttgcagggtgttttggtcatttcccatacccctaactgtcatttggagcctatataaggaggtcttcatctcacttcaagcacacacaactttgagctgaattacaagaggctctattgtatcttttgtacattagaaataggtagaaagtgaggggaagctctagaggagtgcccggaagtttggcgctcatccgacttctgcctcgacgagtgtagcttcgtagtaggaattctggaggagtactggagctgttggtacactttgctctaggttcagagaacttcttctattaagtaagcattcgtgttcctttcttatgttatttaattacttagtctgagtaagatatatttccatctttgcaggttcattatttagtatttatactaagtgctctagtactaggactccggatagagaaggaatttcctgcgcaagtattagagaagtaattaataacttaggcctggtgtctaggttagagattacctttgtttgttgtgtatcccacggatttgtcagaggtagacggcaggtggtgacagccctgaattccgtcctagtaatcctccatgttcgggtacatcatagagctatagccggaaccacactgacagaccagcaggggtcggtgcccgtagcaacagataggaaattacctttgcttagcttagataattaaaacacagagaaagtcctctctagcctgcctacctatagttgttgtccttggatcgtcttagccctaggtagattacacacattccctgagtttgatatccttttggggtcacccgaaggtgaagtgctacagcggtattccgtgcgcttgtggatttatctttggtcgtaagaaataccaacattcacccatgacctcccttacaatatgttctctaagatgatcttctgtctgttccttagtttgtttaacctcccttacaatctattctctaagacgaccctctctttgttccttagtttgtttgcgcttcctgtgttgtgcgttgtacttggccatcccaatgttccaaggaatgttgcatcctgtccctctagtccggccagcctgttgttggtatttcttaacgatattactagaaatatgaattcccagcaatggcgctagaaatggtcctggtatatatatggtttacagaaagaatccgcaagcgcacggatttaccattgtagcatttcacccgggagtattctaaggtatcgtatttatttaatcgcaagggaagattgtaagagagaactatgctaataatatatatacatgccacttacataatcaaagtctaagcatgggttaaaatatttatatgggtagagtgacacgaagcaaagcactcatatttcttctttaatcatttctgaactaagtggaagaagaaatagaaaaaacaatcaattcctataattctaatatacactcaactttagtctacatctactagtatacaaccatatagccaataccccctaacagtgccctcctggtgcttcgagagactaccccgggttgccgagtttcttacgacaacctaccatggccgtccaacctaggctaaatacggaggagtaccctccctaggaaagtttcttaggattagatactatcgtggaggaatacccgtactgagctgtcacaattagcagcccacctttactgactcgtagcatataaacccagataatgatacttagtaatctagacaccctgtctacattattaaatactactctacatccctcgagatgacatagagcaaccgagtaatcggacattaaacccacaccattgcacctctctggtaggctaactatatgactgtaccaatacaaacataaagtaaagacaatacttagatgaactaaagtatcgagagcatatgaagaagaattgatccagatctacctatcaatagtacattgttctttacttacagatcagaacaaaaggtgagctcatttctctctaagtctatgtgtgaaatatatgagaatttgatgctacataatatttcgcacttgagagattggaacccttggctggcataaacaacatgtgggtccagtcggaggtgaccgttgtagcggcgtacatgaggaagatcaattgctattctgttcatgaagttcatggagaattctgcattgatgagaaggctttcaacatgaatggcttatatactaggaaaggttatcaagtccactttccatcggatcaaacggcatgtcattccgagctttctaccaacggcaatctcaagttgaagacatcatgtgcgggtagaacgggcaacgcgcaagtaacaacaatggtgatgaacgtcggctttgaacggcatgtttggatggagttatactatcctatggcccatcttgggttgggaaggagtccatctataatttctccatggattgaagccttccaaagcaaggagtttctagacaaggaagaaaagattcagttcggactcggtttgggccagcctggatataccaggactaaaacgcccgtttctgtctcgtccggagtccgttttggacgtgtgagcacttgttgaaaagctaacttcatgacacacttggtggatagggcctaggacacaaattccttctggtttcacctcaagagccaaatcaaattgacggtgctgcagagaggtttctatattgtgttgtatttgattcgtagttagtttctaacacatgtaatggctatatatgcctttgtacacgacccctgagggcagaccaagtttaatcaaaagaaaatttgcagcaaatttagtcttgttcttcttctagagtatttattccgtggatgacaaatgtggtatatggtggaatggagtgtatgtgtcacgcctagagattagacaacccgaatcaccggctatctgtgcatttaacctctatccaggcatcaagcagagtacacagatgataatttgatacagttccacgtcttacaaaaatataaaaaaactcagaaaagcagcaaaaaaactaaagaccatctaaacttattcttctcagcaaagggaagcttccaccataatccacaggcaaaacctcgacgtctggcacaagcctaatcttcatagaactcaccatccgacaaattctctgcctctgggattgggaaaaataaagcaaggctgagtaccaccaccgtactcaacaactcataccaaggggaaggtatcatgcaaggatattcaaaggaatggctgataggatatttgaagtaagaagcagcatttataaatcataagttgaaagcagtaaaatagtagataattaagtagtattaacatcatcactatccaacgctaaaaccatgttatgataggtccaacccaaaccacctgaactacaccagttcattaggtcaaattattaaggtgagactagtcacggtgagctggttgaccgcccaataaccgcaggcacggctattcaaatagttttactctgattagagtgtacaactttactcacaagacacgattccacacatgttaccatgccccgaagtaccaccgagatactacaaagggggaaatcatgacaaaccctccatatagcctcccctaaccaacacacccacctccggtttcacccccatccctatacaggcaatgtgcagtccctgctcgtgccaaggtaaatccggaaggagcatagaccaaaatccaggtccatctgtactccatcactgtcgtaggctctccggaccttccattataattgagagatgaaatgaataactaaaatcatcaaacaagtacaatgaaatatccgacgcctcaagagaggaatattggagacattgctgggcctttagcctgccagtcaacttttgcctgagatgtgctcgtcaaaccactcgaaggcagcgaccagatgtgttacacattcaggagacttgacaaaaatggctaaagatctacaacatctcaaatattcttaactcatactcatgtgaatctagctcccaggatgtgcactagactcacactttcatctcaatcatagatatacatagcaaacacaattaagatgaaagtgattataaactacatctactttagttacattggccgaccggccaaataaataatagaacaacggaagcttgtctacccaatccacaagtgcaccgactagcggtttaccctagaagaagcagtcgattacctgcatcactcaaagactaagtctaaacctgcaaacaaaaggttaattcaacagcaagagtcagtacattatttctaggacttgcctaacactctacttgcaaggcatataatcaaagaaggcatgatatggttctttttagcataaagcaagttttatttgtataaaacatttccaaatcagttttgctttcaaataaatttcagcaagcaagtacttgacatattgggcatcaaagtagtcattaatcatgtataaatatacacctcattgccatccatggtagcaaggagatcattcacaaatctcatcacattttgaagttaaatttcagaatttagaagaataaacacaagtctatactcaatacatatccacacgccgctcatgaccgcgagcacggctaatcgattagttttaactctgcagagtttctacactttacccacatgatgcgaaataataatcatgcaagagcatggcacgcgataaataaatacccgatttattacccgcatcaaagcttttccaaaattcatgatttagccttacaccagcacgatacgtgttcctccatcctagtcatactggaaatatgacctagaaccgttaagtggcgggcccacgccttaaacttaatgccatggtggcggacacaacgggaaccctccacgtggcacaataccgttgtattggacacgcttagtcacctaaactaccacttcggggtaaatatgaagctcctctaaattattcaaactcatacacaccggcctaccagaatgtaaggctaaaccataaataatttactaagcttgggctatcccatactagcacatgtggttgtactgtatacgaaatgaactgacattgagtgaagtccttaggtcggtttgggcgcacactctccccctatcggtacacatctaatcaccatatatgcaccgcttgaggcccaaacctaaaatccatgttttccaccattttatttatcgaaataataagtattaaagttctgtccagattatttaaaaatcaattttcatgtttgtaatgagcccataatgacaaggaagaccattctaagcatggctaagcattatagtaacctagtgtcaccaaaactcatatataaagtggtatagtcatattgctcctaaggttatgaatgagggatatagatatatgtggggttaaggtgataatgcaaataataggagtttgtctaacgagtttaacaaaattttaatttattagtgtacaatcgacatgaaagatttgcaaacattttcaataacctctaaaacataggttcaaagtgatcaaagagagggagctgggacttgccttgcaactgaaaaatgtcagcacctaattcacttcttcaccgtttaagcaatcatctatacaaagtacacattatgcaattaaacaccgaaatatgcgaaaattccaaaatgctctaaaatgcttgatttgtgcacaatggataggtactggtataatatgaatttaggtgaaagaatttctattttatctctttttatttgagagttatgaattttagaagtttgctcggtatagggtagtatttatttaggtactattgtgaaatgctgttgtaaggtgattcttattaagtttatgtttgctgaggtgaagatatgtgttttctaagactaacacatttggtttcataatttagagttaatatgaattctttatgtattttacaagttttagtgtgttctaggcatatagtctttatgtgcacatggctttggagatttagatccagaacttgctctaacttgctagtgttgtataaaatgagtattttagttaactaatctaatcttagttcataattttagagtttatattattttactacacattttataaatacggatgttttatgttagttacttaacttatcaaccaaaagattgttgcatgagctaagttcatctaagttttggtagatggggatggaactatggctccactggtcctaacaagttttattttgatttatttggagctaccatgcatatatatacttattcatatgtattgtttaaccactattatgcgtttagtacctattcttccaaattaaggtttagagttatggtctgtacaaccaaattaaggtttagagttatggtctgtacagagggtgccataattcactctactaggttgaagtatattacttgctggttctacagaaatttggttcacttcatttagactaaagatgaattttctacaaattttacaatttaaggtatgctccatgttgcttattccttacataaatgcttaggggttcttattatactgtaagtatgtctttttattttataacattgaagtgcacaactctgtaattctatagaacttgagtttactcaaaaaggatctaagatgaattttatataaacttctaaatttcagcttatgcaaaactagttattttaaagataatagttttagaggcatttgatgtaaagtatgtatatgttttattttactttgtttttagggaacatgttggtggatatgtagaaactaagttttctctaaaatgagttgaaatgaattttgtttgcattttataagtttgtatatgctttatgtatgatttatcttagaccaaatttagaggctacatttgtactgtgagtgcaagtttttatgaaataacactaatttcatgattcgatgagttaacagtaatttgtattactctaaaacgagttgttttcaatttgttaacgattttacaagtttacatgtttttctgatgaaaatataaagctttaggcatttcatttagatttttccagaatttaaatagattgggtccacaggtcagtctcaagccaatatgcagaaaggcccttagtgtttcaggaaatcaacccgcagtcctgtgactgttctgtgtgtgaggtaggttttacaaagtagtacctagagttttgattcttctcaatcgaggtccttagattgagctgacacagagctagccatggccgagctcattctcgagctcgctggcggcaaacggcggcagatctcggtgtgcaacctaaggagaaaatgtaaaggggttcaaggtgaggctataggtggtattcttgcaagcattggtcatcgaaattaatggcgacggcggtgcgagcggcggtggttctcgggtgacggtgcatgtggagctagggcattgatctaaatgtttatctacatgcatgtgcctctatgggatcctaggatgcttaccgagcgtccaaagaaacttggcgaggtccagatagcgatgaccacgagcagaacgactcggcggcggcaagaacctccaggttgaacggcgacggctcaatcggctccaagaacaatcatgcatgtatgtccatgaggttattgaggccagagagatggtgtgtgcacgagtaatcgaataatggctcactggaggaggcggaatcgacaatggcgacggcgaccggaggtgaagaagacggtgggccgatctccgcacttgttgcgccattgcctgggattttttgaggggttttgaggaggacttcaaggagaagatgttggcgcgacggctcggcttggcttggtctacagcggttggaatgacgacgagaacccgacggctggcactcggtgttcgctccggagcaacgatggcgaggtccacgttcccgacgatccgcggcaccaaatgggatgaaacttagaggaatgaaatcagcttggagaggtgataatggaacgcaagtggaaaggcgacgaccgcggcacaatgtcgacggcgacggccgtcgtcttcatggccgatggcaaggatgagggcagcggaggcgaggcgatccctctctctcgatttggtctacacagaagtggtaatggagaggaggcgatgcagctaggaagagttgaaagcgagctcggcgttttgaggatggcgacacgtcgtgtacacgtgtcagccacgcccagaacgcctctcctccctctctcacgcctgctggtcggttaaaggagttggacggggagagggcaagcccaagtggctgccaagcgggcccaggtcgtggtaaactaggtggaagagagaggtgtgggtagaaacatgggtgagtttggtttttggacgaatttccggaattattttcctcctctaactttgtagcttcgtaacttaatgtgtgataacttaatgtgtggaccacattaactagtgttgattttactggaggtagatgattatacctagattccattttatttggttgcacttaaaaattatggatagattactcacagaaattaggagaagaggggctctttggaaactagtttggatttttaggagacctaaaaatagaagataaattctggaaaaaaaatatatttatttattataattaacctagtatttgaataaattattttccctatacgcttccatgcagctaaatgctcttttagacaaagtatggttttagctgattaggaattataattagtctattatttgagtggtttgactgatttattcgaggtataaaatttagttatgaaattataccaaaattacagtgagttgtatatgttaagtagagcctacatgaattttcccacgattttatcttgcacgaattattttagataattcgcaagacttatgtcttatatgtgtttccctttcctaaatgcatgtaaatgtttacaaaagttatatttggactctcaaaaatggaaaagttagcttccaactattttgactggaaacttttaaggtctaaaatttggatatgttataatcacgcccacccttgccaacggtgtgttagctagaaaagatatacttaagatttagcctggagcgcatctggcatgtggttagtacgagtatatcttccagtgattcctgagaaccggtcgttaattgtcatgggcacaaccaccaatcaaatcatgcatgtgcccacgacccaccattatagcatattttaattaattaattatataccaaggtggtataacatcatcataaaaattaaggactaaaatatagtgaatcccattgtgagctagttgatcttagcatggctaagcattcctaaaccaatcatctagtcaaattaatatcccaggctaccgatgaatcagggtattcaaaagggctgagtatggtaaattccatcccacatgacattataaaacaatgcaattttaagagaaaagcagggattttgcaagtacgctcaatatgatcaatgatatccatatgacttgccttgctcttgagctgacggaacctcagcgaccactttaaaataaactggagcgacggaactgctggagtctaaacgacaaacaaggcacacaatgaatacaagttaaaagctactgaaacagcaaaagaaaccaattttaatggattcttgacgtttaacgaatttactgcaatttgaatgggttaaaatggagctcggatgaattagatatgaattttacaaggtgaactcttttattactaataaccgaaaaaccttaatcatttgacatagattattgcccaaaaggaaatatgatcaaaggatagattaacattggtgagcgaaccttacgagataccgactcaacgagtcaaatctacgtgacacgggaccatccaaatgatcaaccgaaaccggcgaacgaaaccggcggctctgaatggctctaaactaaggaacgactcaacatggatgaacgaacgaaacacggggcgacaccttgttcaaactaatgagcgagtgactcaacaatggctgcggctaaatcggtaggctagacacgatttagggtaaagcctcggtacggcaaacgataggccggtaggaatttgtggttgcacttaggtgttggtatttctgacgatcataaataaacccgcaagcgcacggaatataccaatatagcacttcacccgggagtattcttaggtatcgatttccacagggaacgtgtgtgctaactccggttcaggttcatccaaagacacgaagctatggataggcaaaggatagagaggtttcaccggtgaagaacaatgtctacggaaagcttaacttcaatcctaatgaggtacttcgggcactggccagctcactgctcccagatatcgctgtactgcacacccggacagggaggacttagtgatattgagggctatcaccacctctacacccacctcacacctactgtgggatggggagcaaacatcggaaatcaactacctagacaccgcatctacgcagttaataactactctagtgtttataactcactaaagcaatcactatagtttagttgattatagtgaacgatgatcccacactctgaataggaactaaccaataaataattcttaaagagcaaaactaaattattcaaaagatatttcaattataatcagagtaataaacagagcagaaagaataagaggaggattaccgacaactccggagctcctccgaaatcttctactcaactctctccctaatcttgtataaaataaagtacaatagatcctcttataattcagctcatgcttcaagtgtgtgtttacaagtgaggatgagaggggtatttataggtagagaagtgccttgggagtgtggagatgctccaagcattcaaagagcatcttctctcatgtgttgccaagtgtcccattctgatgacggtttctaccggtattaacgccataaccgtcaaatggaagtggagcactaccgaactgaacttgggcctaggccagcagcctctgtcagggttcggccgaaccctagccgactccattaacgccgattttcggcgtggacattcattttgggcccctcattctattggtatggatggaaggcccatttggaggtgtttaattgggtttctgggtccaaaactccatatgttcatatacgcttttgattctcctcctccttcaggtatatttcttctcaacttaggtagtttgtcacttgcatacgaatatacacgaacactcgtggaaattgttagaaataaaccctacaactatgttggatgtttatatttatggttttatgcagatattgatggcttaaattttgtatttaacagccgtcaacaaacccacacacttagctctttactcgtcccgagtaaaggttaaggattaatatggaataaaatttcccaaaatataatacaagtacacaaattattcttagccatatctgcacctgtgaactttgagtatctaacttaccatcttgggtaattgataaatggaacggtcatgactcaagtccttcatgttcctcctgtcaatctcttggggttttcatatattttcacaaagtagctatactcctcaatggactttctctcaaatcactcatgtggtttgatttgtggatcttcaccaaggcatgtttgtcaaaatgtctctattctaaaaggctagataggtggagcttggtagggatcaattggggcatacctgcatcacatattgcaaagccaaaagaccggacccaaggagatagcaagtcatactctctgatcaagaatgtgcatgtgtgtgatatgtgtacgtgtatggcaaattctgtggatggaaaaaggaaaataaaagacaacaactcctttcgtatacatcctcctccaattttctctctttggaaatttgagagagtgcatggctatcttttttcttcttttttttttcatcatgccacatactttgtatgagcaagttttttttctctttctttttgttttcactgctccatacttgtatgagcaaggctttatttctttttcttttgcatagccatgcctctctctatctttttttcttttgaaagaattttggaggaaaaggcataaatgacatggagtttttattttgtggataatagataaaataaataatggaagagagatgctagcttgcagtgtagaagtttagcataagtgtgtgtatgtggagtgtacgtgatcttgatcatgaaagtatgaaaagcatctcacacgggtcacaagaatttgacaaagctcaatgtaatgccatgtagcctaaacatatatcaggattttgtaatgagaatcatatatggccttggtaggtaataatatagtcactgaggagtattgctcgaaaagaatttttgattttcacaaaataaatcccaagtatcatgacagttggacatgaatttctattgtcataaccatatcacatatatcaattacttatattagcaaggttccctatgatagatggttgttcacaactaacaagtgttagcaaagaataaaaagtatacatgataaatcattggaaaattctatctgttgagtgttaatgcttcaattttcatttggagccaaactaaattgtgttcaattttctaccaaagtttaactcacaatcatgggaggtgtggagattatgggtaccccatacccacacgatatggttatccgactaattataggggataacttgtatctatggaatatgtaacggatcatgacatgggtattacggtattacgtttccttgtatattatggaatggcctaaagtcctggtttgctaattttgtaaagtagatttagcaaaccgatactgcattggttaaggtttctatcttgtaatcttgccccccatgctatataaggtggacaggaggtcctctaggggggcatattcacatatgatcatcagatcaatactacacctggcggattcaaattcccaaataggagtagggtattacctctcatcgagagggcctgaacctgtttaaatctttgtctccacatccatccacttttaggtctcgtgcgctaccccattttattgttgccgaattcttgtttcgacaggaggataaggaaggacacctacaaacctgactacacggtgaaggatgacagcaccgggctaggcaaggggcgagagaacacttggttcggccaacccagctaggacatggttctggctgctgagttttgtgcgtgtccgtgggacaatgttcatcatgttgtccaccggggtgaaataccggtgagccaaattttattcaagtaactcaaggcacatgaagtgcctaaattttttttttatttattttcatattttttcatggcaacaatggaggttatgggtaacttagcagggtggagatatgaggcgcggatgcacaaggtgtttcagatacttaccagacggatcttaccaaacttagaactgaattgaatgcaacgaagttttgcatttgttctacttggttccctgtgcaacaagcttcacagctttctatgataccaaggagcgtgggattggtgttggagttattgtacaccgctccttggttgtcactttattccctgcaaaaggttagtggacaacaaatactagagggactacaaagaattggaaagattttttcatagcctcaagattaattgttaacatctacgctaaaaaggaattggattcaaaacttaggaagcatggatcccacaaatttgccataattttattttgtcttcattttttttcttcgagagacatttcttttattctttaaaacattttttttaatgttttattgttcaccaaattttcattaagcaaaaactcatacaggacttacagataaaattgcacgatcataacaaaggagcaattgacagtatacttactttgcaccttgaaaggtgatgtgttactctctttgcatgtttgcaatttattgatttgtttcccgaaccctgacttacctctagtgtgaattgaacttgaggactcacccatgaatttgaaaactttcctgcagggggttagtccacaaaagatatgcatctgaaagttcattaagcaaatttgactccatgtctaatttgattaaagcagactatctaaacctatagatgtcttgcgcaaacacccaaaccagagcatatgcaaatagacacaagaaacataacccatgtatgctcaagcctcattcaaataaagataagtatgagtaaaagatgtggtgaatctttcgctaccttttgtatacctaagtgtacttaccgccagcacgatgtgtatgttgaattctctggagcggtgctatggtcgcatgtaattgtcgatctcccatcagtcttgatgcggattgtggcaagggaaggctgatgaggacacaactagctcgcatataaccatgactaccttatgtattagtcaaccaaaggtgcatatgttctacattagatttacttgttatatatttgaacaaacgttgctacacaatgagttttgtgtgttttcgtttgcagaggtagttgcttgggcgaaagaaaagagaccgagcataaggaatgcatggatgattgaagaagttgattggggaccaaaccaagaccttctcctagtcttctttcatctcaccacgtcacttttggtccatagaagacaagaaataaagttccacacgttttgggttcggattcaggcctcctgatagcaccaacttcaaatggacctagccactgatcaagaaggaattttggggcccatgagtacttgttggaaagcttatggagtctaatttcagatggttttggtcccacgtcaaaattcctaccgggctgccgggaatctgcaaaacaagccatgtacctcatccaatctgtatctgatttcggttttgggccttgtaattgtgtcgtgggctcccaagggggtgtgcgccctagggcaaccctaggacgtccctaatcataattaatcagtagccgtcgtcgtttagagttgggttttgcttagattattttgttaagaacagtttcgctgctagatcggtttgtggaaccccaaattcgagtgcttaataattcatatgcaattgtgttgcaatctatcttgttcttgcttttgttcttctattcgcatgcagggattagccttctcggcgaggtcaaccaggtttaggcacggttgataaccagaggagacgtggtgctgcgattgcggggcttagtagcgtattcgttcagaagccagatcgagttgtgtcgcgactccgcccaaatcgattgtttatcaatacctatcggaagattaggacctaactccctcatcagttggcactttgaccacaccaactcaggcgagtggttcggttatgcacacaactcgggtgcatgaaccttatgccttgaaggcgtgttccattggtagaatgctgtagagacgtagggtgcatctctttttgggcaaatatgcaagttccaactggagtggagtagcaaacacctagaaaagaagagggcgtctcctcttgcttgtgtgcgagtaggtgctgcgggagcgagaacttgtgcacaactaggagtggatgaaggctaaccaaggcggcacatgagctcaagagaggggctgggtgcagccaagaagaataatagctactggcgaggtgtatagccagaaaagactcgcacataatgcggtctttgatctagatcgtcagccctcttgctctcttcctcttctcccattcttttttttcttcttttcttttgtctctcttttctttcttttttttttcttccacacttttttcagcaaggtaagactaacaccagctttaaaccaagatggcctaggttgacgaaacccgccaggaagagcttgtcgacctccctgcctcacacttggacttttgtgtcatgagacgtcaaaaaccaagtatgtgagactgggatcttcataaagtgtgttccaacacatgaacagttgatgtagctcccatgttcttaggcatcgtacgtctctcgttcttaatcttcacctgaaatggttcttgcttttattggaaagaaaacttactaagataatccggggtgtctcccggtagtgttttgtttgtggtcacaagctcaaccattgagacatcatgctgcaagattagtgtgaatacaaatacgagatttgcagtatttatgatagttaaaagcatccacaaccacacttcaaaacatgttagaaatgagggtcgtaaggtggttgtggtccttgtacaatgaagtggtactaattggacagtactctggggattccttatgagagcatgtatcttggggaactttgaaagagaggctttcatgctcatttgtggagttcgcatcctctagagttgatgtctcaaacttgtccttggcctgaaagttctccattgaaagaacggggttgtttcttgacaactgtcgagaacaacatcttgagggccaaagggacaaggctttcgctcgattggaggttgtgatggtggttctatggagtgtaattcaaaagtctcgccagaatcttctttttcaatgaaacaaagatcatcctgttctagaatagattcaggggacacatgaatctatcagggggatgcctatcaaggttttgtcataatcgctatgaggatcatccctgaatttaggagtgcaacctggagcttgatttctttggaatccggagatggctccaaggaggactctttagtcagactttatgatattgcgggcttagattcaggttcggcaaaagaaggttccttccttcctgacacaaatgcctctggacggggctcaacacactacccggcaaaggaggtattttccgatatgcgatcgagaatttccttgccttcgcgggagttttgtgcatgaatgaccctccaacagttatgtcaaggtagaatgcagactccctatctaaacccatatggaaatgttgcaatagcacgtaatcaggtatagaaagggttgggccagactatactaaattagtgaatctggactaggctgcacaaatcgattctctatttatctgctgaaaactcagaatttctacacgaagagtagtaatacgggttacagggaaaaatgggaggcataacctgtctcgcaatttctcccagtcactgtttgcacacccgacggtaaatatgtaccattgtttcgctctcccatgaagtgagaatggaaataatttccaccgaacagtctcttgcttcatgcctcgaattcctgcagatgatgtagcggttttcctggcctaaaccatagaaagatttctccctaaccatacggatgaattcgagacgaatttcattgccaggtgttaaaataggctccgatgaaggaggtggctcgtaaaattcgccctgaggagcagataattggaaaatagattgcggctccatcggttgagaaggtttactggaatacttctcggggatagcaggggtaaaggtagaagtaagaaaaataaaaaggatacgaggatgaacaaggttcggagatagacaacaatcgttccccagcaacggcgccagaaatgcttgctggtatttcttacgatcacagataaatccgcaagcgcacggaatataccgatgtagcacttcaccgaggagtattctcaggtatcaatttccatagggaacgtgtgtgcttactccggttcaggttcatccaaggacacgaagctatggataggcaaaggatagagaggtttcactggtgaagaacagtgtctacggaaagcttaacttcagtcctaaggaggtacttcgggcactggccagctcgctgctcccagatatcgctctactgcgcacccggacagggaggacttcagtgatattgagggttatcaccacctctacacccacctcacacctaatgtgggatgtggagcaaacaccttaaatcaactacctagacaccgcgtttataactcactaaagcaatcactatagtttagttaattatggtgaacaatgatcccgcactctgaataggaactaaccaagaaaaaattctaaccgagcaaaactaaattactcaaaagatatttcaattaaaatcagagtaataatcagagcagaaagaataagaagaggattaccgacaactccggaactcctcccacttcttctactctactctctccctaatctaatacacaaggattagattggaaaggaggaatcttagtggaagtaggattgggagagggggagggagttggataggagggggagggagttagacaggagtgggtggggtgcagtggcgcgcgcgcgacaatggagggagggaggcggcggccgagctaggagagggggagatggggaggaaataaaagaaaggaagaatggattaggactttcccaaataggaaaaatcaattcggtgcggcagcttcgaattaaatatatgatgtggtctcgctcattttttaaggccgttttaggaagagaatggaaacgatcccgcaaacaaaaacagacacggttcgccatgcaaaacgaaactacgaacagagaggggagtgaattaggcacaattcacgaccaaaggcacaaggaagaattattattaaggtgatcttgacacttttaaacttagcaacactgcctgacaattctgattattaaatatattgttaattagggttttctcctggttaaccaaagcaatttctatagatcatttattagtgacttggaacctaagggaagggaaaactccaggtgtgacaaacctatcccccttaaacagaatcttgtcctcgagattcggaagaactggtgaagagatggggatgggtggctttcaactcatcttctctttcccaagttgcttcatcttacgaatgatggctccactatagtctgcaaaacctgatcactttatttctggttctcctctcactggtctccaaaatacatgtaggcttctccacataagtcaaatcctcctgaatctcaacattatctggacttgctggttcctcaagcacacttaggcatttcttcaactgagatacctggaatacatcgtgaatgctggccatgttaggtggaatttcaaactgatatgccacttcacctctacgttcaagaattcggtatgacccgatgtaacgttgcaccattttcccttggtctgaaaacggtgcactcctctgagcgacataactgtaaggtacacttgatcaacaacctcgaaactgagctctctccgatgattatcggcattgcttttctgacgggattgggcaatcgtcaatctctccctgattgctcttactttcacttcggcctaactcaacacttctgtaccaaacaactgacgttctctagtttgatcccaaaacagaggcatacgacactttcgaccttaaagtgcttcaaacggtgccatgtacaaactagcttgataactgttgttgtatgaaaactcagcatacagtagattcttatcccaagatccaccaaaatcaagggcgcaaactctcaacatatcctccaaaatctgatttacttgctctgtctgaccatcggtctgcagatgatatgctgtgctaaagttcaaacgggttccaagttcctcttgcagcttatgccaaaactttgacgtaaactgacttcctctatcagacacgatcttcttcggcacaccatgcaaacagacaatcctcgaaagatacaactctgctaacctctttcctatataagttgtatgaaccggaagaaaatgtgccactttcatgagacgatccactattacccaaatagaatcatgacctgatgatgtccttggcaatccggttataaatccataccaatttcttcccacttccattctggaatctgaatagactgcaaacctgctggtctctagtgttctgcttttactcgctgacatacgtcacggagtgctacgaattctgctatctctcttttcatactgaccgaccaaaacttctccttgaaatattggtacatctttgtgcttcccggatgaattgaatattggatctggtgagcttcactaagagtcaactccttcaactctttgttgtcaggcacacacaatctttcacccatccatatcgttccatgttcatcctcagtaaaatctcgggctttatccactcgcatatttttcttaagctctgctatctctggatattttgcatgcgcaacgagtgtcggctgtgcttccaaagcggcaacaaaaccatgttctacaattcccaaattcagacgttctaggtcttgtatcagttgagtacttacttcttctaagcatgttgcattgcaataatttttccggcttaacgcatcggcaacgacattagctttaccaggatgataatctatacacacatcataatctttgatcaactctaacaatcggcactgacggagattcaaatcgggctgggtgaagatatacttcatgctcttatgatcagtatatatatctcagaacgattaccaatcaagtagtgtcgccagatcttcaaagcatgaaccactactgctaactccaaatcatgagtcggataattgtcttcatgtgtacgcaactgacgcgaggcgtaagcaacaactctaccttcttgaataagcacccatcccaaaccttgacgagatgcatcacaatacacttcaaaatcctttctctgattgggcagaatcaaaattagagcggacactaatctcctcttgagttcctcaaaactctcctgacactgcgaagtacgaacaaacttttcctctttcttcaacaactgtgtcattggcttggcaattctcgagaaattctcaatgaaccgacagtaataccctgtaagtccaagaaaactcctcacttgcatcactgtcttcggtggaatccacttagtgactgcttccacatttcacgaatcgactgctactcttttagtggtaataacatgccgaacttgacttctttcaaccaaaaatcacacttgctgaacttgggatacaactaatgctccttcatcttctccaacactacgtgaagatgattcccatgttcttccttagactttgaataaaccaagatatcatcaatgaaaaccacaacaaactatccaggtattccatgaacacattattcatcaaattcatgaagaatgtgggtgcattggtaagtccaaacgacattactatgcactcgaacaattcatagcgagtcgtaaaagttgtcttaggaatatcctcctcgcgaattctgaactgatggtaacctgatcacagatatatcttcgaaagcacagttgctcccttcagctgatgaaacatatcatctatccttagcaaagggtacttattcttgatcgtaacatcattaagcgctctataatcagtagacatcctctttgtcttgtctttcttctcaacaaaaatcactagagcaccccaaggcgatgtgctgggtcgaatgtatcctttctgcaactgctcatccacttgcttcttaacttctgccatttcttcggctgccatcctgtacggtctcttgtagatgggagctgtacctaggaccaaattgatacggaactcaatgtctttctttggcagcatagctgtcgactcctccaaaaaaacttcagaatactcacaaaccacaggaatgtcttctaactttgggacatctttcatgacttcatcctgttgttcactttccacttaattcaagcttacttctttcttctgaataaatggagattgaattactaccacttctccatttcaattaaccaacgtaattgtgcggcttgcacaatcaataactcctttatgtcttgtcaaccaatccattcctagtatgacatctaggtctttgcactccagaaggataagattggctagaaaaggtgacccttggatttctatcatcaaagaggaacaaaaactaactaatgttaagctattacttggtgtattaactttcatgggagtactaagttacacttttcttaacccgtgtacccaaacaaatctcttggatataaatgaatgcgtagcaccagaatcgaataaaactgtagaaggaattgagttcacagggaacgtacccaaaaccacttctgacgctgcttgagcttcctttgtagacacatgataaacacgagcttgaacgaccttgggtccattgcgcattgttttagggcacttatttgcaaaatgtccggtatctccgtagttgaaacacataaggggcttttgttctgacttcttctttggctggtggggctgcaaagcttgagactgggcgggcgcggaactggattatggttgttctgatttccactgttgcctcggctgaaatttcctagctgatatggcctgtgctatcgaacaatcataatagtagaaccactgtgctgtccataaccacagcgatgcttctgctgtccaccttgctgaaacctgaactgcatagctttcctcttgcgatctatcttgttacgttgatcttcctaacgaatggtcctgtccacaagtctctcaaaatcagcatagtctttagaaatctcctggttagtcaatgttgacggtccttaaatcataatatttgaccatcaatacttacatataatgaaataaaatatggtatccaacttagtggtagggtttataactaatcatttctaccagtattgatgaaatatgtgtgtgcagatattttgaggagaaaacacatccgtcatgcgacataatgcacctctgaacattcaggacgcgtttacacgaattggaggcaaaataagtcaataaaaaccatctaggattgggccaaaacatagtgaaggatgttgggggcccattaagcaacctaccggccgaaggaggggccgggaggacgtttttctagttcttgaaccaatcctggcacctcccgccatctggcttcacgtggacggctcggatttctcccctatggcggttgcagggtgttttggtcatttcccatgcccctaaccgtcatttggaacctatataaggaggtctccttctcacttcaagaacacacaactttgagctgaattacaagaggctctattgtatcttttgtacattagaataaggtagagagtgaggagaagctctggaggagtgcccggaagtttggcactcatccgacttctacctcgacgagtgcagcttcctaggagaaattatggaggagtaccggagctatcggtacactctgctccaggttcggagaacttcttctattaagtaagcatttgtgttcctttcttatgttatttaattacttagtctgagtaagatatatttacagctttgcgggttcattgtttagtattcgtactaagtgctctagtactaggactccggatagagaaggaagtttctgcacaaatattagagtagtaattaataacataggcgtggtgtctaggttagagattacctttgtttgttgtgtatcccacggatttgttagaggtaggcagcaggtggtgacagccctgaatcccatcctagtaatcctccacgttcggatacatcatagagctatagccggaaccacgctagtagaccagcaggggtcgctgctcgaagcaatagatagaaaattacctttacttagcttagatatttaaaacacatagtaagtcctctctagcctagcctaccaaccatcagttgttgtccttggataatcttagccttaggtagattacacacgctccctgttcgatatccttttggggtcaccctaaggtgaagtgctacaacggtattccgtatgcttgcggatttatctgtggtcataagaaataccaacaagcatttctggcgccgttgccggagaactgttgttaattttttggtcatcctcgtatctttattttttatttttttcttcttttattcctttccttgatggagcaacccacaattcaaaatctttctgctcctcgggctgatctttgtattcgcagaacagagtgcgtatcggttgcggaggcatcggctgaagtctgcattggctgaaatggatcggacagaagatagccgatttcattgagatggttataaaaccgtttctggacggctgaaatggatcggacagaagacagccgatttcataaagatggttataaaaccgtttctggaatcgatcaacgtgctacacaaggattgccacgatggagataagctctcagatatgcaattgtatctattaattatgatattttaaatagttccttagagatatgtttgggtaagagtctgccgtaaagacttatgtgtatcttagagtttgctagagataagagtcgtgtccggcaaggacctatcatgtatctcgggtataaatataaccctaacccatgtaattaacaacaacagttcaataacatttttggtgcatcgccaccctttttacttgctttcaataacagttcaataacaacaacagttcttgctttcgggttgagctgcatcgatttcaatcttcaacaagaggtaaacttgtcatggcggcttgcattctcgtgattagtgcttccatctttatgacattctaatcttgtatatgtaaatcgtcgagttatcatatatgctctataatctttattagttgcgccatctaacctgcaatcggctggtttctactgctagagagtagccgatagatttagattttgttattaatctagattatatagcatattgttgatgtaaaaaggaataagttcaccggaggtccctcaaattgacaccgagattttttaaggtccctaaactagaataccagaaatgtgtacccctaaaattactaaatccgtccgtagaaggtccctcggcagtattgactcagtttttgcccggttttgctgacatgtcgcgctgtgggacccactagtcagtccgccgttggggagttaatagacggggttaacggaggggagcgcagctagccagacctccattctctctcctttgctcgaactctagctgagctgcgaccaggaggcgacttgaaggcgacggcgggtttgtcggcggcggcgagctggccatggcgctggcgacgagcatcgttttcgtccaaacgcgtggcggattccaccccggttagtaccttgttggctcggcattgcgtgctattgtagctggtactgtgttgattttgggggaagatttaaaatgtggtagattcgttttttgtttgggattcggtgtagaggtcaagtagtatattgtcccatatgctttaggtgtagtaatgcttttgtatacccatgtgaatctgggtgggttagtgttggggtggtccttttttaatcggtgttaggtgttaactaggtattagggatctggatgtagtgtagttttaatagtagagtagtaaagtgcttctttttttaatttttcagagctggcagcatggatcccttcggcactctagcagttaggttccatttcaatggggaatttgttaatagagggagacagaagttgtattgtggggggagagaagcaatgtcatacatagacagggataaagtgtcattacctgaactttttggacacctaaaagatcactgcaaatttgtggatgataaggtgtgtgggttcatgtctgactgtataagtgagggtagtgtggttgaggtgtatgctgacgaacccattgtaattgatgttgatgaagaggaacacagtgattatgaggctgaaatggagttggatttggatgaagaatcagaggaagagggagatgaggataaggatggggatagaaatgtgaaagtgaaagataagggcaaagctattgtggacaaagggaagggcaaagctgttgtgggtgctggtaaaggtaaagcaatagaagtggatgaaagtgctagtgataggaggattgtcatttatagggaaaggtcacctttgagggaaaatgcacctataagggagtactcaccttctagggatacctcacccataaacactatcctaccttctgacagtgaggatgatagtgattatgtaggaggagatgattgcccttctgaggatgatgaagaggctagggagatagaaggacactacaaagagttgaagaggaagatgagagctggaaaggttcatgagctagatgaggttgtgtttgagggggtttaaaagtcagtcagctagaacagctggaggtccaaaagatggcaatgacaccccatatgcagatagtgatgatgaagactcatatgatgaggttggcagtgatggtgagcttgttagaagaaagggcaagtttccaaggtttcagaagcagccaggggttcctgtttttgagctaggaatgaagttcagctctaagcatcagttcaagaagaccattataaaatatgccctggctgaaaggaaagtgattaattttattaaagatgatcacaagagggtgagggcaaagtgtgattgggctagctgtccttgggtgtgtttgctgtccaagactacaagaagtgatagttggcagattgccacttatgacagtatgcatgcatgcccaccaaggagggacagtagacatgtttcatctgttaggatagcagaaaaatatggcaagttcattgttgataaccctggttggccactatcccatatgaaagcaacagttcaacaagagatgtttgctgatgcatcaatttctaagcttaagagggccaaaagacttgtgatgcagaaggcatttgatgtgaccaagggccagtaccagaagctttacaattatcaacaagaactgcttaggaccaaccgtgggagcactgtggcgatcaacagagtgataggtattgaaccacctgtgttcaaaagaatttacatttgccttgatggatgcaagaaagggtttatggctggttgcaggaaggtaataggacttgatagttgcttttccaagggatctacaaatggagagctattgtgtgctatagggagggatgccaataatcagatgtacctaatagcttgggaagtggcctataaagagaacaatgaagaatgtgaatggttttgtgacttgctgtgtagtgatctgagggttggtgatggaagtggatgggtcttcatctctgaccaatagaaggtaatgctcctgatccactgtttgcttttatgttctgtcaattctgtcattacacaatgcatacctaatgtcttgtgcatgttactatcaaatgcagggaataattaatgctgtctctaagtgggctccagaagctgaacacaggaactgtgccaggcatatctatgccaattggaagaggcacttcaatgataaagtgtttcaaaaaaaattctggaagtgtgccaaagcatcatgcagaatgcttttcaacttgccaagagcaaagctggcccaactgacccctgctagagctcaagcaatattgaacacacacccagagcattggagtagggcttggttcaggttaggatttaattgtgactctgttgataacaacatttgtgaatctttcaacaaatggattcttgaggctagattctttcctatcataacaatgcttgaaaccattagaaggaaagtaatggttaggatccatgaccaaaaaaaatgttctaatagatggagtactgtcatttgccctggtatacttaagaaacttaatgtgtacattgctgaatctgcattctgccatgctatatgcaatggggctgacagttttgaagtcaagcataatgagcataggttcatagttaacctagatatgaaggagtgctcatgcagatattggcaattgtcaggtttgccatgtcctcatgcaattgcttgcatctactatagcaccaacacactagatgggtgggttgctccatgctattaagtggaatctttcaaaaaaaacctatgcccattgcctgcagccagtagagggcatgactagttggccagatgatcctagagagcctctcaatgccccaggatacatacagatgccagggaggcctaagactgaaaggagaagggagcctaatgagccagctaaacctaccaaagcttccaaatttggcacaattatgaggtgcagatcatgcaagcaacctggtcacaatagcaagggctgtcacatgcacagtggggcaggtggtagcacatctgcagctgcaacatctgctccaggaaatacagtcactgcaaataacaacttagtgttgtcaagcacacctagcagcattgcacaaagcaggaaaaggaaggcagctgagctcagtactagcacatctgcttgccacactaggaagagaacatctcctacaaaaaaggtatgtcagccagtcctcattcaattaaacttttgaaattaacattcatttgctaacaacacttgtttcttttccttccagtcagcaaacacaaacagttcacttgtgaaggttgcagccagtgctaggctggcaactgaaagaggtggttcaaccagtgtgaaacttcaggccatagtgccacactctcaatgttcttcttctgcttcaatgaggatcacttctgagaaagcaagtgtttatgtgcaagctcaagaaccagccactaccaagcccaagaaaacacctacaggtccactgatgctgattcccccatgggaaactgacaagctgtgatgccatattgtgctaactatgcaatgttatgtgctttttgtgtattttggcagactctaagccaactatgcctactgtgaactttatgtaatttggcagactcttagccaactttgcctatctgtttagtttctgtaatttggcaaactgcttgccaactatgctgtgatatgtgcttgttctggcagactgtaagccagctaagctatgtggattgttatcatctaaattgagtgactttgctcaaatgatgtgtcatagcctaatctgatatgagatggtatttactgagctgatctgatgtgatgaattgactcttatcaatttgttatgctaaaatttatgtgcaaagttacgaatactcagccactgcaaaagatgatattcagtcacaattcaaccaaccactgcaaagtcagctcaaatatatgcaatgtcagtgtcattactgaatatcaatcacaattcagccaaccacaaatccattcacttaacttagatagtcaaagagcacagctcagtttcttggcaaaatgcagcaaaatgctttcagctaccagcattttgacacatagattaacacattgcacctcacagctgaactaaaatcatagcaaacaacacaagcatgcatcccaacgacatcagtacaagccaaactctctgtttctctagcctactgttacttgctctcatagcagccatgttagcttcattctcagctgccacaatcctcaattgtgccacttcattcattgctacccctaattctaggcactgctcttctacctttggcctcagttcttcaacacaatgttgcagctcattcttctcccttcttagcgataacacggcttcatgaagatcgttcaacagctccctcaaaaaactacttgttgcaggctcataccagtcaaaaaaatcgcagccggcgccctgaaaacattacatcccaaatcacccaaccatactgccagctcaaacaaaaaccaagcaagcaaacgaaatcttcatcactcacccgattgcggcatcggtagtaccatcgaccagggttgtccacgctcccggaaattcaccgggccggcttcgcaccacatcggcacatcaccgccggctgataatcatagggcccaactcgcgccgggatgggagcacgactgctgggatgcgacgaccccgacgaccggtcactgcaataactcgccatcgcctagcctcacctcctcttgtcgcccccgccgccgccgccgccgcttccgccgccgccgccgacctaagctagggtttcagctcgagaagaggaaaatgtcgcggcaacgcctggaaacagcgaggacagagcctttaaccccgtctattaactccccaatggtggactaaccagtgggtcccacagcgcgacacgtcaacaaaaccgggcaaaaactgagtcaatactggcgagggaccttctacggacggatttagtaattttaggggtacacatttctggtattctagtttagggaccttaaaaaatctcggatttagtaattttaggggtacacatttctggtattctagtttagggaccttaaaaaatctcggtgtcaatttgagggacctccggtgaacttattccatgtaaaaacacgaggcctgggagatctgcttaactccagtgtaagtccagaagcttgcctttaggtgtatgagcgtgccagttgatttgatcctgcaatcaacaagaaacaaagacaaagaaacccgggttaaatccataaacgatagccgatcggctaattgccgatgaagtatcatttatcttggagccgatgtcatatgtggatcgatcggcaatcatgaataagtaagaaagaactaattaaatctactcgatcagttgtagatattaacaatatataatccttatgtcgctatatacttaaatcaagtgattgggattgatctgtcgccatgacgagacagtataaatcacatagatcgaagtatatgttaacaacgagactatatatgttcatagcatagccgatcagatagatctagcatgtataggctaatactccgataccactctatatcaagatattaaggcaagtagaatacaccaaacaaaagcctaatatacttaagggcagatttaacatgtcaattaagcatatgagaaaatggtagttaaatcaggtaagatcggctgaaactctgacgctaccctaatcggcagccaaaggcagcctagagattgagattctaatcatcactcataagattaaactcaactgatgcagctataagtatgaaaagaaggacaatatctagacaatcaagtcgttggatgtttcatagagtggtagatatcctatataatctaagtcagcatcgatatttaacctaatcggctgccttctagtaacagacgttagccgattagaggttagatagcgatattgccagagattatataagatatatgaaaactcgacgaattacataaacaagattagtgtatcataaagatggaagcactaatcccgagaacgcaagccgccataacgagttttacctctagttgaagatcgaaaccgatgcagctcaacccgaaagcaagaactcgtcaaaacaaaatgaaagtaaaaagggtggcgatgcgccgagattgtagtgaacgtgtgttagttcgattatatggggctcgggtctatttatacccaaaaattacaaaatatgtccatatcggacacgtttcttatctctaacaaactctaagataccataagtctttgcagcagacttttgcccaaacatatctctaaggaaattacataaaatatcctacttaatagatacaattgccttcttaggactctatccatgtgtggcaatcatcatgaagcacgtcattctaacccgacaacatatgccgtgtcatattgtcggattcggctcaatcggctaaccctgtccgactaacacatgccccccaagtccagaattttggataatgtttcggatttgccatacgtcgactgcgagagaatattgcacttgccgttttccgaccgttattccaacgctttaaatactaaccgttgtccccgagaaatctcacaccgtttcctccgttttcaccgccgaagcaaactccgtcctctctctccgatgatcccctcggtgcacgaagcgattcccaggcgatttcctctccggccaactttctgcccacaacgatgtagacctccgccagtccatccgccgcatcttcaaccgagtacgcagaggtaagtttccattggctagatcctctcttttcgcatcagattagttttccctttccttatcttgttttcttcttctctgttcttttggatccgtagcaactttccaatctgatcgcagttccgagtttgtcgcataaaaaccactactttcttggtccaatcggcaatcccaatcccactgagtttatcattggtgaaaccaataggatccctttcagattagctaacccgaatctaggtcactggaagaatacttttaaatcttggccagccctcgagaaaacttcacccgagaaaagctggaccacatggtacaagcgtgtatcggctagcaagcaaacacactgggatgagattggaatcggtcaagcacttgcccttaccatagcgaattcggctaaggatgaacccctaatagctgccgccacctatttctcgtccaataccatcaacgcctttttgttgaaccaagggccgatgacaccaaccctgatagatatcaccatgatcactggtctagatgtgacctcatcggctaaccctacgagtctgaacaccaagaatcaatatgacttcaagaccaagagcataggcggttggtctggttacgtggcagcatatatgggccaaggatctgttactgctcaagaacacgtggcctttttgctcatgtggctagaaaagttccttttctgtggatccagttgtggtcctacaaccaactggcaatttgtagccgaggctctagaatcaaaaagacaatttcctctaggcaaaatcatcctcggctacctataccaaatgctgaacaatgcatcgactaagatagtcgtcggctcagtagttggagcaggtggaccatggtggctgctgcagacttggctgaatctggtagtcatgaaagctgtcaatcggccatccgtgatagaagccgaattcccaagactgcagccgattgtagaagatgatggagaagaaagcactcatcgtagatgcatgtcatatggagaatatgcattcacaccagccgatgctggagcgaagttatcagccgagctgctcaaagattggttctgcagcttctatgagggttttcaaaaagatgctcgagtttggtttccttatgaagattcagtgcatcttgatctcccatcagactttagattcgaagatatcaacaatgaaaaatctcaaaaatctaaagaagtcttctcagctgcgattagcccatgcattcttcctgtcggcatacatcaagggaggaacattcaggtttcctatgaattttatcactcgatgagctctgccagaccacttgggatgggtcaactaccaatcggcttgctctttgctgataaaattcaatgccgaggagaaatctcatcaaccttgatgatggatcggctgctgaatatccaaggacctcctttgggcagcattgaaaatatagagctggcaaggttcaggagcaagaactttgacagatggtggggtgaatggaagctgtatttgttccaccaaccggcctcaatatatgtgacagatctctttcctaatgttatccctcaggtaaaccttgacttcattaatttcttttgaacaattgtcagccgattcataacttgactaatcttctcttctgttttgcagacaacagaatcttctcctccacaccaaagcaatagtggcagagatatagagtatgccccaggcctcttgccaaatggtggttgaccaacccctccagttatcagctatcatgcccccaagaccgcaagtctgcttcaagggcagatgatagagccagccgataccggcaggaagaggaaacccagggcaccaacaatcgatccattagttctggctcctaagaagaagactaagaaacaaaaacccaaggtagctgatgatctgcctgccctagatccatccattgagcaagccttggatgaactagagattgaagaggatgttgacgaagctgcagccgaggtaagtgatacagaaagaactccatcggcttcacctaaacagactcctccgactccttctactccagctcacttctctagggtaaacagctctctttaattccttcttccaattgttttattcatagttgattactcataaatcttgtcttttgcagaagaagaagttcgctgtgaagaagaaatcggcagcaacccaatccaaaccaactctgccggtaagattcttctgaaaatatttcagttccaatcatactctatgtggactaacatctattttctttagcctcctcctcctccttcacctcctgtacagcatatgtcaagtgaatgaactccatttgctgtaggaagccacaatattgaggaagcagaacaaccagccgctcctactatcccagtaagtttccttttgacacaaggatttagatcggctatatctatttggcatctaattctctttgaattatttttgcaagccttagccgatctgttctcttttgatatcaaggactacttatagaagaggacaccacaaacaaacccttagctcccttatccgatgatgtgaagaagactcttgaagatatttctcatcagctagaggcatcttctctagacaccttggtggtagattgtggatcaattacgactcggctacacgaagttcaagctctgattcctgaagaactagccgatgtcctcactccagctgcttatcttgaaaagcatcaattcaaactggagaaatgacacgcccagaaatttagcccaaatttccagactattttgtgtattaaatccctgtccaggaccagccagggtacacaaaaagacaagtaatacacagttccaaacgtaaataaaagcgtaaatacttacagaagaggcacttagtcctcacaccgaaacgaaagcagcagcagcggaaaaaggctatcctagcggggcttcagctccactccacaggcaaaactcaactgaggtctgagccttggtcttctaacttcgtcttcagctcagaagcactacacttctgaaaaagggggaataatagcaaggctgagtacaaccaccgtactcagcaagccacaccaatgatgcagacgtgcaaggggaacacaaggacggtttgtggctatttgtataaaggcggttgtaaaacattttattgagcaaaacagtaaaactgttgagtaattaaggtaatattaaatctccactgatcaacgctacaccacgttgaacaggcccaaccaacccacctgaactacagtgcattgggttgatttattaaggtggaactaatcacggtgaatctggtcgaccgcccataaccgcaggcacggctattcgaatagttttactctgactagaggtgtacaactgtacccaaaagacacagccccacgacacgtttctgtgcgctgacatgccaccacgaaataccggaaagaggccgtgacaggacccttcgcataaccccctctaaccgattgcaccacaccttagggttcgcccccgtccacagcaagcaacgggtagcccccctctcgtgccgcggtgaatccggaagccgatcagccagacaccccggccgacccaactccatcacgcccaccctcgcctgggtacattggctagacgaaagctacactacaagcccagccgttgcccacgctggcttgtggtaagcatgataaattcttccagggtttcccgcgaactggtccttaatttccatgggtgcaactagcaaaaccatgcacccgcagcccaccattcagtcgcattttagttggataattacgaccataaagcatggccagatgtctcaagcacgcagctcattctgatactataaaggtctaatactgtaattatcccatcaactgagctagtggtaattaagcatggctaagcatatagttctagctaggtcacataagtaacatgagctagtcgatttattacccaaggttgacaaaagacagatatcaagtaaacatagcacaagcaagcagataggtagtacccggatcccatgtaattagcaagacatgcatgtttatttgtaaacggtaaaacatttataaattgggatcaacatgctcaaggggaatgtgtgacttaccttgcttcttcaaaacaatcttccgaactcttttcctcgcgaccgtggacttccaaaacgacggattctacacgttggcacgcaaaacaaggaaaaactctaataaaaaccaagaaaacagtacataaaaagtaaacaaacatgtagatcttaattttagatgaattttgcaagttgaatggcccaatttggagttcgaatgaattagatataaattttagaagttttgagccatttaaatggatttctagaattattatcgaattatgacgcaattactatttatttttcaaagggaaaaggtagtcgctcacgtcatcgaaggggaggccggcgccgacatgtgggccccagacgtcagtggctacaagggttggcacacggtggaccaagtccaccgcggcccaggagacgccgtggacccggaccacagggggtccacgggcggcggagcggcgccagccggccgagaggcggcggcgcgcggccggatggtcgctgacggcgatggccggcaaagtggagatagagggagagggagggatgctcaccgagcggacgggacgatgaggcgaggacgggaaggcagtcggcgacgaggattagcgacggcgctcctcggggaggcggcacggatggcggcccgacggtttccggcgaaggcagagaagcagccgaggtgcatgtcacatcctgattttcgctttaggtttcataaattatttaataaattatttttagaatttatattaaatgttcattaattttcaagtgaagctaaatgtaggaaataaaatttcctaaatataaagcatggctggatttagttttcattaaattctccatggttaattatactctctgaaattttctcggatttttcggagctcaattcttaattttaataatacaaagagcagttcagcaattatttaaataataaattaatcattaaatggtctgattataacgttgttaagtactttgagtgtccaattagtttcaggatttttcttgaaattatttgagcattggaagtatttttaacaattcaaagatcattttggtgattaatttaattggaaaagtaattaaattccccttttccttttcgggccgaattaggaaaagtcctctcactctcggcccagtctcctctcagcctgcagccctctccctctcttttccgaagtccatttcttgtccctccttcaatcaggccttggaaaatgaagcccagctgaaagtctgtattgccctccctcctgctacagtgcgtcttcaagctccagccagccgtccagaggccgtgttcttcccgagagccgccgtgtcctccatcaaattcgatgcatccgttgcttcccttccaaaattgattgcaaaaacggattcctctctatctcctctatcttatctccaagaactcccttaaaattcgttatctatctcacgaatttcagtcgtttttatccgggtgaactcgggataaatcttaacttccttcaccgaattcatccgttctcgagccgatctcctccacctttgcctacaaatagcagcccctcggcctcctcttcggtttccctctgtttcccgaagttttccctaaccctagccgcctccccacgctcgccttctctctccaactccggccgccatctccagccgccttttcccgtcgcgccggccgttcccgatcagtgccgccacttccctctgctccgcaaggttgatctctaccacggccgccagttcttttgcgccaaatcccgccggaaggttgccgtcaccgtgaacccgtgggttgttgccatggtttgatctccactcgcaccgttcgtcgtcgccttcggtcgccgccgcctccattggattcgcagcaccgaggagaagcccgttcacccctcggttgtcgtctcctgtcgctgaaactccgccgccatcatcgatcagtaccccgtcgtcactcccgttctcgtcgccggccatctcctttgctgttcatcgctgcgtaagtgttagtaaggatcgtcgtgtcctcctcttcatccccgtgctctcggtttccgccgttgtgccgccgtttgccgtcctcaccaccgaatagagccgccggcgtcgatcccgcatggttgccatgtcatcgccttgttagctgccgtccctaccatctaagtgtcacgccgtctctcagatcccacgtgacagccatctaaaaccttagatcagatcaatccgagccatccaattttggtcgactaggtcaaagttgatctcagccgtccaaaatcaatataaatcctgttatcccttttcaatggcatattagttctttttactatatgtcgtctactaaattcattccaataatttccggaggatggtttaggcttatgtctcagttataaattatatgtaaattgtttaattaatttggaatagtcttttctttaataggtttaattggaattaatcttgtaaaattcataactaattcatatgaagtcggaattaagtggttcaagtctctaaattcatctaaaatcatgatctacatgtttgtctactttttatgcactgtttatttgtttttttattagtctttttcttcgttttacgtgttagcttatcgtttccgtcattgcgaaggttcgtgagtgcgtcggaagtgttcaagaagattaattgaagaccgattattgcaaggcaagtcacacagatcccaaacaaccctttgagcatgttgaacctacttaaagctattgttttatttcaacttatgcattattttcgaatgtcatcgggtggtgagcctttctcaattaattatggccgaagatgactttattttcatatgggtaataaattgattagcttggaccttatatattggattggttcagctaattgctatatacataattgcttagccatgcttagaaacattagctcactaatgggatgaatcaaactacattattatttatggttatatttaatggtagctcacgatggttaatcgtgttatgataattaattgataattaaaacttgacaatggtgggttgtgagcacatggttttgaaggtcgtgctcat

SEQ ID NO: 71322 - DNA, 1160 bp, Oryza sativa
tgcgtagatgttcatgttccttttgatattttttgccctcgtttacaactgcagcttggttgtatcaatgaaatttatgatgtgtggccatacctgtctaataaatatggtgaaatcaagcttactaatactattagtattctggtttaagttaatttgctagtgccttttcaaacctgttgtgcacccatttctatcgtctattcatgccagtgcatacagcaattcctaaacatgttctgtgttctgctaaaactgagagcttaatactgtacttctcatttgtaaacttcaggtatatacacatcaatattgtcaaactatttcctttgatgttataccaaattggttctactaaacattacatttagctgatttatcttgttttgcaacaaatttgatgtatgatagagttcttcctagaattgtatcgcgtggaacaatttggatttctgtagcacataaaacatcttactatttaattttaatgtgagccagccaaactttgaaccttgatgtgctctggagttagttttcactatttctcaatttggttccggcttcctagctttgtaatctttcacttttttggtcctcagatcagggaagacccagttggctcacactctatgtgtctccactcaggttcatttttaatacatgtttttgtcatcaccaccttactgccatagattcagtgaattattttctttttttttgttcataaactgcagcttccaattcacatgcatggggggaacgggaaggttgcttacattgacactgagggaacattgtatcttttgaatttacttagcaatagcttcatctgatccatccattcaatggatttatttgcatttctgtatctctccaacttgtttccttaatggagttttcagccggcctgaacgaattgtgccaattgctgagagatttgggatggatgccaatgctgttcttgataacgtatggcccttaatttgactttaccatttcaggcctaacaaagaagctatctgttatatttgcatctatttcttgtttagatcatatatgctcgtgcatacacctatgagcaccagtacaacttgctccttggcctcgctgccaagatggctgaagagcctttcaggcttctggtaggcatggcttaacat

SEQ ID NO: 71323 - DNA, 18331 bp, Oryza sativa
cgtatccttggcaaggacaatggcggcttcctcgacaccctcgcctccgtcctccttctgaaggcgatgacatcggcgatgccgccggagcggataggctgccgcccccgacgtcgcagcatccggagccgaacccccttacgctgatatggcgagcgttcctgaagaagcaggtgagccgacgacgaggcatccgcggccgcagccgccgccggcgaggagcaggaggatgacgccgttgcgtccatctcgcggcagcgactggcacgtgagatttgggggagaagaccccgtgatctggcatgctagctgcggccacgccattcgggcggtccggcatcctgccgatgcaggcgctcagccaccggcacaccgtcctccaccgtcatcgtcgccgccgaacccgcggatgctccgggaagccagctacttctcgggctccgtctcgacggctcgccgagacagctcgtctcgtcccttgagcgaaccggtagcagtagcagctacatagccacgacgccaagaaccaccaaatcccctgccgctacgatggagacgaccaccacgacgccgcgtccagcgtctgctccgtggacgctggcccatggccgccgcctcctcgtccaactctttttgctcgaggcggcgcgagctcaagacataggtctccgaccgcctcgcagccaatgacttggtcgagctcgtcggccacctgggggaagctcgcgagaacgaggaaggagagaaacagagaaagagaaagagagagagagggggaggaagagagaggtgctaagtggacacctgacatgtggggcctttgtggggctcaccctgactcagctgccacgtaggacaaaatcggtgtcaaaaccaccagaggatctaaagtgaccggttttgattagttaagggacgccggatatctggttttgcggtttgaggatgtttctgtaactcggtgtcaagttgagggaccttcggtgtactttttccagatccgaatgcgctgcttcagcccgcgagatggacgggccatccacaaactcgaagacctatttcaggcccagtaactcaaacggcccaatacaacttttaacccatcgatcgagtgggctctctccatctcctcctccggcggaggccgcagcctatacacaccgacaccggcgggcagcggcacccacccatacacatgcatggctgcggcgcgcgtgggcctcgtctccgtctccgtctcgcacgcgctccacgcctccagctcttccccctcggggcgcccacctcgcctccgcctccccccttattttccccgccaccaccaccgtctcctccccacctttccccccaactacacgggcccctcctccgccgctgccgcgagactccgcgccagcgccaccatgtcgcaggccgccgggaacccctacgccgctgagctcgccgccgccaagaaggccgtcaccctcgccgcccgcctctgccaggtgccctcttctctttttttttccctctctgcttccccactactttgcgctgtaaggaccagaccatatctcgtcgtcggtctgaataattgctcggcttcagcggggaacaaggccgaatgcgcggactgtaatgtagaccaagactgtgagaacgtgtcgagtactacgattcggcttcagagctggaatggaaatggtggcatagactgtgtgggtagtcaaattagtcatagctgtcataaccaagattaatgttccactagggggaaaaagaaaacaagcttggatgcttgggtgcaggattaatgttccttttgcagtgaatgtttggatgcttggttctgaaggtggaattcatttatgttaatccttgtttttttccactacaggcggtgcaaaaggacattctgcagtctggtgttcagtctaaggcggatcaaagtccggtgacagttgccgattatggtacgatctgttcatctcttcagttgttgccaaggtttcttcctttgatgtttgcaactgaattattgacatgtgtactcatcagaatttggaattcatagagcatctttttcgtactgcatctttgtttgctagggaatgtaaaggactgataggacaattttgctgttcattgttacatggtgcttctgctttatcgcggctcaccattcacctctagttttcttttggttcatgtagggtctcaaatattggtaagccttgtcttgaaaatggaagcaccagcttcttcttccttctctatggtggctgaggaggtaattatcatctgtttctgtttctgcctactggtttcgatggacagcgcacaagtctttcacaattgattgggatatgtactcatgtaggactcggaagaattgaggaaagaaggcgcagaagaaattttagaaaatatcaccgagctcgtaaacgaaactatcgtagatgatggtacatacagcatttacttctctaaggaaggtatcctctctgcaattgacgatggcaagtctgagggaggtccatctgggcgacactgggtgctagatccaattgatgggactaaagggtgagtttgctgacctaaatctctgggttgcagaatatgctgctgcagtcaaaacataaaacatcagttcatccccaccattcactgcacaatcagaactcatgctgcttctttattacagttgtttgtaatgagcatagtgcagtaaatggcactacttttttccccactttgaaagaacagaagcctatcatagtcttctcttattagatgcttctaacttctaagctgcactgaagtggactaattaatatagcatgaccctgaacacacactaggttagttgatactgcatgtttcattttcttttcatctgctaggttgcatgcaacatatataagaggtcataaaattaaaagccatgtaaaaggcatcctgtcaaattagtactcttgtgatgtgcatatctcaaacttctgacccaaattcacattttttttacaacgttactcagtttcttaaggggagaccaatatgctattgccctggctctgcttgatgagggtaaagttgttttgggtgtattggcttgtcccaacctttctttgggatcaataggcaaccttaatggtggctcctcgggagatcaagttggtgctctcttttctgctactattggttgtggagctgaagtagagtctttacagggctctccagcacaaaaggttacatctccttttatttcatattataactttgacttacttttacctatttgagaatggaactaattttttaatctgcttttggttattttcacttccagattagtgtctgttccatcgacaatccagtcgaagcttcattctttgagtcctacgaaggggcacactccttgcgtgatttaacaggctccattgcggaggtttgtcctgaattattctttgcctagtacaggtccacgagagttacttgggtaatctggtgtttgaatgctggcagaaacttggtgtccaagctcctccagttagaattgatagccaagcaaaatacggtgccctagcccgaggtgacggtgccatttacttgcgttttccacacaaaggttacagagagaagatctgggatcatgcagctgggtcaatcgtcgtgacaggtatgaaggttctctttttgaacattgaaaacatagaacccaacaacctgaaaaaaaacatagaacccaactgaaacattttagattgatattctgcttgtgctaaaacgtagaaaccaactgaaacattttagattgatattctgcttgtgctgttttcagaagctggaggtctggtgacagatgcatcaggaaacgatttggatttctccaaagggagatttcttgatctcgacacagggatcatcgcgacgaacaagcagctgatgccttcactcctgaaggctgtgcaagatgccatcaaggagcaaaaccaggctgcttccccgttgtagtagctgtctcaatccacaatccacaaatatcataatgtttccatataataataattgcagtgctgcttccccatcaacattactttaaatgtgtgtacagcaccactttgttgttgttgctgctgcaaattcagtatcttattgttgcacatttctgcatctaattggtgggtgagctggcaccacatgaatgttctttcatctggattcagaagaaataattaaattggcctgattctccctaactcggggcaatattgctatgtgagttccaactactgtggtaggacaaatattttaatagtagcaatgatctcaggttgtgcaaccgatgtcatatactatgtactcatacctaatccactgacgtgattagtttgatatacctaaatcactggacattatcagtttgactccactctcactctgactaaaagcatcacctgctctccaccacgcctcagcttctgccatgtcggagctgccatcgccgccgccgccggccgccggcaaccagtacggagcggagcacgccgccgccaagaaggccgtcgccctcgccgcccgcctctgcaaggttatttctcgtttcttccccttgttatttctttctatgatcagctttgggattgagatggatgaggttttgcattgacttctggtcgtgttagctgtggccattgatctggggttttgtttacctgatcttgagatgaaaatttctgactgaaattgctgcagctgcttggatgtacttacctcttgttttgtgtcttcttgtttcttcagaaagtgcagcaggacctcttgaaattggacgttcaaactaaggctgacagaacaccggtgacagtcgccgattatggtatttgttgatacgattttacgatattcttcatctgttctattataatatatgaatgatttttcaaaataagtaatttttatttcctaaaaaaatggatatattattatgttttgtaacttgtgctagatatgaacttctgaaatagtttacattccattaccaggatcacaggtattggtaagtgtggtcctgaagattgaattaccttctaactccttttccatggtggctgaagaggtaatttacaaatagtatacatttcgccttatttgttcagttatcacacagagaagcatctttttccattacttgttgacttataaaggattctgaagacttgaggaaagatggagctcaagaaatgttgggacatatcaccaaacttgtgaacgaaaccatcataaatgatggttcgtacagcatcacattatctaaggaagatgtgctggtagcaatcgatggtggaaaatctgagggtggaccttctgggcgatattggatattggatccgatagatggaactaaggggtaagtttttatgtatcatgttcgactgctagaaaattaaatgcaagtattttgctgtgattatagatcatcccaaggtacattagccatacctgaattgttagttttagtccaagctgctctagcacaaacacaagtcacagaatccctactttagatgtggatgaacatggtgatatttcagtttttttggtggaaattggtgatttattttactagtacaattaatttggttcccttgacttgacatgtgttctatctcaatcctgtggtccaatccaacttgcttagcattaaaggtggtggttgttattgttggtgttgtataaatgtggacaatgtgtaacaaactaacaacggtacatactaataatttttttcgccgggccggcgaagcacgctggccgagcttgtaccaaggaggggaagaaaaaaaaattacaaactttacaagtgttcagctgaaatgttgaggatgaagcatcctggccattagatcgagatgcgaagcaaccaagccctgtcgtaacaccgaggcagagtgccaggttacctggctcgtcggcacgaccactataccaagaagcttgccacttttagatttggcatttaactatttgccaccgatatgtcaatgacacgtgggtccacatgtgtcgataacatgtgggtccagtggcaaatagttaattgtcacgtgtaaaagtggcaaatggttaaatatctcgaacctggccctgccattttcaagtttcaacgtcgtccactcatcgattgtgcaatgtgcccatcatgcttccttataatactttgtttatttttctcttcaatgcataatagcatcataaagttatacttcatcaaatgtggaaatgaaacaaataatattcatgcattttgaattagtataataaaaggccatgataccacatgtctttaataaattagttgaaatggaagaacactatactcaaacatgttacagccatggtgtataagtgttggtggttctgggagatataatcacaatgcaatacaaacaaactagtaaagtgttaatcgacctagggtctatttttcttgtaagtttgcatatttggcagtaattttcttatttcacctctttaacaaatgattctgaaaacatcaaagatgtgtaaattatactaatttttagaggtatattatgatttcagatactccatattccaattattgataaaaagtagtgtcctgtgcaaaaccttttgttactattggcatgattcactaaggaatttcctttataatcccaacatttgtgttaatgcagtttcataaggggagaccaatatgcaattggacttgcattactggacgaaggcaaagtagttttgggagcaatggcatgcccaaatcttcctttcaaatcaatagatcacaatggtggatcttcgggagatcaagttggtgccctcttttctgctacaattggctgtggatctacagttgagtccttagaaggctctcagccacaaaaggtaatttatcactttctcctgaactatctgtggattagattattcccttctctgaataatattatctttttatttaccatcttgttttctaacttccaattttagatcagtgtctgttctatcagcaatccagtggatgcctcattctttgaatcttatgaaagaaaacactgcatgcgtgattgcacttcctccattgcagaggttggtccccaaaagttgcatacctaatttgtttctgatatgaataatcacacaagtaaatctgattatattatgcttggcagaaacttggtattcaagctcctccagttagaattgatagccaagcaaaatatggtgctgtagcccaaggtgatggcgccatttattggcgatttccacacaaacgttccaaagaagcagtatgggatcatgcagctgggtctattattgtcacaggtatataataactatattcacaaaaaaatgaattcaactaaagtatcgttctgttctcaaataaaataaacattgttcggtaagtttttttttctcatgtttgcagaagctggaggtttggtaaaagatgcttcaggaaacgatttggatttctccaaaggtagatatcttgatcgtgatgctggcattattgcaacaaataaatatttgatgccattagttgtaaaagctgcccaagaggctatgaaggaggaaggaatactaggctgattcactcgtgcatcagatgaaaaaaaatgataattgtgatgctgttttcaatttgtgtgcaatataagtgtttgccctgtgttcttgctgtaccattatctcatatactccttttatatttatgattcatagcaacaatattttttttgtatttgatttataactgttggatcagcattttattgcctgaattattgttgttattatttatcaatgctatgaacctaaattatcaatagttactacaatatggaaacctctggtcacccaatacaactaaatatgcacatcagctgggtagtctgcagggtgcttcttgattgtatccctcagcaatcgctcttgctctcttaggttggaaggaacttcatcataaacatcggtgaatagttcagcgagcggcggtttcggcattctttctgccacctgaatggctttcagaagctgtgaagaattaaaccggcaatttcagatatcatgcatgatgttgaactagacagatatactaccattctgctaaagaaacgttacctcttgcctcacattgttcctgagttcagattcatcttcatcacaccaccagccattcccctgaacccattttctgtacctggaaatcggatctcgcgctgttcgccagtgctcgatctcatcgaccggcctgtatttggttgaatcatcggatgtcgagtgatggccgacccggtaagtcagtgcctgaaagtttaatgttcagtattcacatcaaacctattttatgttgctgtgacttgaaaaattgttcacctcaactaaaattggccttccttccttgatagccatttccctggctgtgtgaactgcactgtacacagcaagagcatcatttccatctactctgatactgcgcattccataagcttgaccacggataacagctccatcacctgcaatagcagtagaattcaagttgttgtacagatcacctgtaaattgtaattgtgatgcatgatcaagaaaaatgtcatacttctgaactgttcactagttggggtgctgattgcccagccattgttgcggcagaagaagatcaccggcgcttccataactgctgcaaagttgagtgcagcatggaagtctccctgaacatttttcatctgtcagaaatgctgggtaacaatgtagtggctgatgcatgatcagtggttgttcatcaatctacctcacttgtgccgccatcgccaaaatacgtgatggcacatgcatctttcttgtccatcttcaaggagtacgcagctccaacagcatgagggagctgtgtactgatgaatcatcaaagaatgatgaacctgcccttggcttgcatgaatttggtgtggacatggaagagatatttcagacttacgcaataggcgatgacaccgtgaaataattcagacggttcgatccatagtgtattggcatctgcctccctttaccataatccagcttattcccaaagcactgatttgcaaattcttgcagtgtgaagccgcgccatagaagaacaccaggttccctgtactgcattcagctccatagtttccagccaagagaatgacagtaagttacttgtcagcaacattgctagcttaatcatccaagttttggagtaactgatatatacctgaggcagtacaatgtcatcaatagtaagtgcagcagcagaggctatattgattgcttcctcaccatgtgaagtgagatagaatgagattcttccctgcctctgagcttcaaagaagattgtatccatgacctggagggtggccatttcattgtacattttcagagccagctccttactgacctgacaagagtgagccacacacacttcagaacggaacacacttcagaacggaaccatcttttacaacatgtttcagaaataactcatggagccttggatgttactaccatacctcttggaatctgcttccagatattgttctgccgtcatcgtcaagaacacggtaacagttgatcctatccctctgagattctggaaggaagttcatttcagcaacaaaggagacctttcctccagggaaatctattgcctgctgtggaaatagttaaaaaaaactgaatttcccatgggaaaaataaatttatctcaacattggccaccaaaaccaaaagtgaattccacttgaagtgaattactattttttagactagaacttgaattgaattattggaaaggctaatcaatatcagtctgacattggtcttgaaggtaatggactaatttatctattaattaatctatcatgataaagtcagcatccttacacgtagaagaccagatgagactcctaatcattgacctcatccattgacaccgaaagcacagcaagtattaaaactaaataatttttgggcaggtgtattaaaactaaataatagtaggattatcacacgtttcctcaatccttgtgagcttaccaaacagaagccaatcacacccaattcattgacgcaaccacacgtcactccatccttatctgattggttcatcacttgttatcaattcaattcacaattgttctgtgcttacttttctttcaaccaaatttctcttcctttcatgaaaactcaggggaggaattgacggcttggccgttactttgcagcccagggagtaagcacagagatgctgtgaaagaaaatgacaaatggtgtcctaccaaaccgaaaaagtaagaaagaaaccattttctcttgttatgtaataaacccatttttattaagataaatggattagttcattccaacctttgcttttagagacggcatgaattgattactactctctccgtcccaaaatatatctccgtgtagctatgaacatagataaacttttgtccagattcatagttgaaagtgaccttgtgccatatacatagctaaaggtgattgtattttaggatgagagagtccctaataaacttttgaaggagcatagttctatagaatatgccctgtttagatcccaccccaaaactttacacccggttacatggaacgtttggacacttatatgaagtattaaatatagtcttaataaaataactaattgcacagattgcgactaatttgcgagacgaatcttttaagcctaatttctccatgatttgacaatgtggtgctacagtaaacatgtgctaatgacggattaattaggcttaataaatttatctcgcgatttactaacagattctgtaattagtttttttattagtgcccgaacacccaatgcgacacccatataatatccggtgtgacacgccaaaactttgtactcctgaatctaaacaccccctatgttattttcatctagagttcaggatatgatccttgcagaatccagatcccaaaaggacatcaatttggcttaaaactatcgaagaataattgtatatgattcagagtttcagacacaagattattctgaacattcgtacgagcagtggcatactaagaatgggtgaaggacagtaaggcacgtgtgctgtctacatacctgatcaccaccggccaccaacccgttctccgcctcctcgacggcggcggcggcgttgctctccccggtgaaacgccggacggagcagaatccccgacgatctcccgccgccgccgcagccaccggagacggcgcaagaaccggcggcgccgagcccaggagccagggacaggcgggcgcggcgcagtgacggcgatgctgagacgaaagcagcctcctcgccgcgcggcgcgcgagctgggacgacgccatcgccgccgcacgccatggcgccatcagacgacgacgaagctgcgcctccaacctcacctatagaacccaagaaatcctctggaaatggcgctcgctgccaagaacaagaagtgacaatgcccagctacgagttaccaacctcttataggtgtccgtgttggaattggatagagatgagatgagatgagatgacatctgcattcatcagccggaagatgggggaggaagaagacgaggagagcaagaaaaggccggagacgacgcgaacgcgagagtgagttggaaagataagggcttgtttacatccagcgtcaaaattttacacatgtcacatcgaacgtttgaacactaatataaaatattaaatataggctaaaacataactaattatatatatatatattgcatctaatttatgagacgaatcttttaaacctaattactccataatttaataatgtggtgctagagtgaacattttctaatgatggattaattagttttaataaattcacctcgtggttaactgacggattctataattaataatttttattagtaaccgaacaccaaacattctataatattcgatgtgacacggtaaaattttacattatggatctaaaacatccccaagtgcgcgagctagctttagtccagctagtagctaaaggcagctgagctgagacggcatgggagagattggaggaggagcagacgggcacggctcactggagaagagaggataacagtggagaggagtggggcccacacgtcggtgacagtggacgggagaggctgacgtgtgggcccggataatgggcgcgaggaccacgtgggggtaggaaagagataggtgacaaatgtcgcctgcttggtagtacgacgatgatgcaagtgacaatggacggacggagaaaggcttggaactttggaaggagacattggttcacttcgcacacaggtagtttctgggtggatgacaaaattccgaagaaattcggatttcgtggaattcaaaactatttcaaataaaaggtctattcacttgaaataggtgctcgtatttatgctaattattatttcagtgatagacaacatacatattaacagcgagacattcgtgatgacttcatcaatcacaaggaatgccggcttagttttccggaggtgtttatagaggtaggatgtgtgtgtgcgcgttcacagggtgaatacgcgggcgttatgagctcttgtgattgtactgcgtttctcagaaaggtctcttcaccattttattatttttcttttgagacgaatccacccagggccatcttaagatttattttgggaaccaggagagattatagtatattatgaaaggtctttgaatcttaagaaataattcaaaggcatccaataagttgacaatttccagaaaaaaaatccaaaactacatgcagttaatgaaaaatcatcgtattctcatagaaatggctatatactctcgggattcgacagaacacctataatcaataaaaagacgcataactccatagcaaattctatactaatataaaaagaaattgtcaccttctaattctacaggccaaatcacttggatgaatccctactgtccatccacgcgatttcattcaccaccgcacgatttcgttcccaccgcaggatgcgaagacttcgctcctccacgcgcgcagacttcgctcgcttctcctcctcctccccatgtgtactgaagccacatcctcgcaggagctctgtcgccgctccgccgcatcctcgccggagacgccgccgccggatcctgcttcttctccaccgccgccgccgccacctcctccttcttccccaccgccgcggccggcctcttccccatcggccgcggccggagccgacgtcctccccatctgccgctgccgcagtccctgtcgccatcgtcgacgttgtctccgctgcctcgctccgctgcccatctcctgtcatgctgctgtacttgaccaatgtgcctataccctaggtgctgaacaataggagggaatctcaacatcgttgagacgtacaggtaatcagactctatcttgcagcttcgattcatcattcaattatacaatttgatggtctttctttgttgactgccaaacaattccccttcagctcactgccatcctcctctccctctgctgtgtggtttgtgtaaagcatcaccattctatacatcactgtgttcattatgagcttggctatgcaatatatggattggccattcaaatatcaatgtttttgttcttggatttgcaatgcttacgaaattactctctgaaattgtgcttgcaatgggccttgtattattttccccacgatgtgggtagtatggatttttttttctgtttgtcctccatatatgtcagctctaaaaatggacagtatgaacttaatttagtagttcaggcaatagaatatgagatcttttacggtgtttgcgaggtatttagaggtggaataatgtgcaccgttgatcaagagaggggcaaggtacggaacaaaattattgtaacatgatggcatttgagtaattaactagtaaaacataggcaatacatttgaattgaatacctccttccattggtcggtgtatcgtagtagctattggtatcgttgtagagaaaaaagtaaatcaaggatactccgttgatttagggattgattcgattatatcaaaaagtaaatcgtgtctcctttcttctctccctttggtttgttcgtgctctagggtttgaaccagttcatctccgacgttgtggccagcagcggagccacctctgctgccacctaaagttcctcccatcacccacaccggtgccggtgcggcagtgcaacctgcgtctctcccatcactagtgccagtgaaggcccgtacgttgccatcttcctcttccccaggttggacatggcgctaacgaccagattaatggcactcaccggcttgccgctagacatggacatggagaccaaatctgcgagtgcaattcacgcatgtgctatagatctacggaaaggtcctctctttgcaactccatctgcttcgttggtcttgcgagaactagttcatgagcaagcaaatgacctaaatgatgatgacatggatactactgaagctgggattggtgatgaaaatgaggctttcatagatgacaaaaatgaaaattatatggatttcgagtacatttgtcaccaattgctagcccaaggccaaaaacatgttataagaacacaatgtaaatctaaagaaaatcacgtaaaagagaacatcaaacaatacaaagtaaatctagagaaaatgaattaagaacctgttacgctagtgccgtgtaaatgacctaactcgaacacagcgtaaatctacaggaaaaccacgcaaaagtgacacaaataagaacatgtaacgctggtaccaggtagatgttaactcgtacagtcgtacctacttagtacctattataatttgggggaggggacaattttaccctttttgctctattaacaaaattatatttttatccttagtacctaagtatatatactaatacttaaataccttttacatagtatctgtgattgagaactgttggatctttaccctttttggaatgcaaacaccgtaaaagttctcatagaatatactaacagactgcctatgttttgatttccatttgtcttaacgtttttagtttcagcagtgcaaggttataattgcttcatggttctcctctctttgtttttagcaaaattaatatgaactgcacatacatcactgtgctcatattccatacagattcaggcgtgatgatatactgttgtgcaggaagaagcttcacaatttcacacaagggatttagttggtagcagctcacacactccctttgagcaaatattgttttcaggtacttatctcatttaacttaataagttgcttgattattgggacttgggagcaactcacacactcccttcgagcaaatattgttttcaggtataatactatcgatgattcttttattctacaagaaatgtgaattatggaccattatactaccttggtaaatatttttgttccagtttgaagctgaaaaacttgtttccggttgttctgattaacgtggttcaaattgattcttagaaaatgaaaagtcttcaataggtcctgttattctgtaacatgtaggttctaattgatgcttagaaaatgaaaagtcttcaataggtcctgttattctgtaacatgtaggttctaattgatgcttagaaaatgtggatttgggattttgttatagcgagcggactgtcatcaatattaacgaaaacctgttgcatattaaaactgcttttatatgctcatggtgtgttcttcaaggttgtacatccttgcgatggacggccttcctaaactaactgcaaaggaattaaaaagtcagcgagcccgagagcggtacacggcactcagcgttgaggagaaggctgcgctggttcaaaggaaccgtgaaaacagggagaggaagaattctgcatctacatcgggcacaggtgatgatattttcattcgatgcttattatggtcaagcttattttatggcaaacaatgctaaaacctgggcacattcaattggattgtagttttgaatcagagtttgcatgaaggaagccaaactgtaaattgtcagccatcatttcagcctgtgccatcctccacacctatgtcttcctccacacctggtaatatcccgtggaatcaatttgtaatatcaaattactctttgcgttttttgggggttcaatctaattgtgtatttcaagaagtgttcatcagtggaaggtttgttatcaacactgtaaaacaggaaagctgtttactcccaatccgtcccccctattaagctagccccaatcccactacttcagcacagtacatcgccactgcatttcttctcatctttcctcttccatagatcattagtaaggtctctcttctgagaatcagctatgacttttgctgaagttttcagtctgcctaatggcgcaattgttggtatggtatatcgaaccacaagtgtattttgtgtttgttcttttcttgctgaaactaactctgaaacatgtttacatttgtacaaatgttgctgccgttgtgtgtgatgtcgatcctgtagaccattatgcaaattttccaaacagtgttagaaaggtcgctttgatggattccaagtaagtcaattccaatttatttttgagtgcaattctaaaactaatattgattaggacactgttatttctgttgttctagcatattttgtttgtaatctttgttctaatggatgcagaggtgagaaactccctgttcaaagaaccagtcctgcatgacgccattaagattggtgtgaactttaggaaccaagagctactgcaaccggcagaacaaaataatgctccaggagaaccagaagtggtgatagttgaagatgatgaagtggtgattgagccattgccaaaaaagaagcgcactggcgacaagggataaactatccctccaggagttgaagtcattggtataccctccaccccttaggcataataataataggacaaaatgtgcacaactcaataattttaagatattgcccctaaataatgtgcaccgatatcatagtatggattttggtttatgctatgtagtgtttgctgttatgaaatataattagtgtcagtggccacttcaatttcaataatttattgtgctatgtatcttcttcctttgagatatcaatctaatgttcttccgttgttttctcagacattacctctgcacattggcttatgcatacctctgcacattggctgaagatcatatttatttttgagcaaattcttgtatctaatatgaaaatcagaatgcatatatgcatgcactttatgaaaattgtgcagtttgtgcataagtcagcagggaatagttagagcttcaagtgtgattgaagcagatcctctttctcatgatctatttcctttttacctattcttctttcagaatattgggttataatatattgggtttaatttatatattgaacataacgtgtcttgcacgtgcatgattactaatagtaaaataaggatgaagcctcctccggcttaagaggaagctagcgaatccagtaacacgaagaagcaagtgcctccagccaaagtcacatgagcggataagccacactagtaatttgtttagagtttatcttgctagtatgttggatttaggattgtgacataaccatccctcggagtttatcttatgaatgctatatcttgtggatatgtagtgttattaagcatcccttgcttgatccttcatccatctaattcactattgacactcacgggttttgcgcgcgagtgcatgatgtgtcaatagcgaattggactttccttattcatttccgataataagaaagatgtggatgtgatgtgacaatcaggattagcaacatgaaaagggaagatagcaattatgaaagttgtgcagacagtcgtttctatagtcgacagtgacaggatcatagcaaagtaggtggaagttccacccgttttgcccagaattgaagagcttgcaaatggattgtatcgatgactttgtattcctgttacatgcatgtactcgctgaatggtacttacactaacataaatctttggagcttcagtttggtccaacttgtacctgacaatccacagtacaagtacgtgtgaatcacatcccagacaacctctaacaacctctcaagagataagatcagaagagaagtcttggagcaaatgccttaatgtaggattcaatgagtttttaggtactgaagaatgatctg

SEQ ID NO: 71324 - DNA, 3872 bp, Oryza sativa
acaataactgaatgttttgtcttgatacctgttcagtgttcagtcacgaagtctcaaccatgtgcataattttttttccctttctaaactacatgatttaaaaattgatcatagcaattgatagtcgataggaattactatcgattttttttggcagaatagtctaggtcatttgtactgattgctctattttatccacatttactagactattgttctgttagcatgcaagttgagcattgaatttttgctactgacaggaaagaactcaggttaaatgtttgatttcacataaccaaaaaaaaaagcaatggagaggcagatgatctggtaagaacaactgatgggtgcagcactgcacaagatagtaatctttttatgacttcatccattcaggtatatacgcatatatccattcaggtatatatgcgtaagaacaactgatgaggcagatttctctactattattgatagcgtacactatgcacacattaatttaatggtggaatagtcattgtcgttaaaacaattaacaacggcgcaatatcaccatcgttaaataaataacaaggacactatcgtggattctatattttgaagaaagtttcactcaaaagtgaatcagatatgaatcagtactgcaagaaataagtatgtcttgtcatatcaattttttttaccacgcaaagaaatattttatttaccgctctaatggatcgttggatgtattttgactgccttggccatctggtggtgttggtacggcacccatccaagctccatatggggaaacaaatgaattaatctgcagtggaggtgctgtccaccaacctacgtcagaagcacaccatcattagttttctgttgatgacctattcactagaggctggaccaacggagacgacggcggaaagtgcgattttacttggaacagccatggcttcaccagacaaagggaaggcgacgccgggcttcactacaccaccccaccaaggaacgccgggaggcaaagcttgaggcgttggaggagcaatctcccgcttggatctatggctcatcacttgaggtttgaggagatatgaggattagggatgagtttcaggaagactgagcgacaagcggtggatttatggattaggggcaaacttggcttgggtctaccgcgggaataagagggtgatttggcgcataaactacgcgggaagattagcagccatggggatttggcgccctagagaagaggagagcgcgcgaggaggaagacgcaggggcgtgcagggaacacccgatcccctttggcgagaaaacgcgttgaatagcggcagcttgtgtcgatacggtgtcgttgcgagtctcgatttgtgtatatcggctctcgccaggtctgtagagagctgtgttctctttcctaatttattgtctttcacctaggagagattgatgacatggatttttgtagagtgcttaacggcacctgttgcggctgcccttagcctttgccgccgatatcgatcggatctccgactcgggacacaagtatgtcttaaaatcgcatcattaatcttaatttagatataagttaatgatcttgtgtgcttccatagttccatcaatcttgtttcctgttgagtgcattattaagcgcgcgcatcactagtcttaagttagatataataatcatcttgtatgttttcatcaatcttgtttcttgtcgagtgcattaagccctatgctggaatttgtaatttttaagggacaaaccacttcaaactttcgatgagagagagcaggaaacatagtatcattgctagcaacaaacaaatattaattccgcaccaaatactgtcccaaacaaatgagtagtccatatcccactaaacagtagtattacttcactcaaataagaaacaaatatgaattatgcatcaagcactgttccctgctgttttttagataatggattaagaaaccggcctctacatccaactgttccctgctgttgatcggtgaagtttcatttcgtcgtcagatggaagggctcgtgaaatactgctgtcattgtttgcttggccagtaaatagaaggcgcttatttcatcctgttgaatatacaattggcgaactaaatctcctgtgttggttgaacctttattctgtttgttactcgggtaattacaacttggactttgttgattctgcttcacgcagttgtgcgtacatatctgcgatttcttttgcaaagtatgccttagcttgcggtcttttgatctgcaacatcattgagatagagaattagcaccttaggtatcgagatctcctgcaacagaattaacgggcctaccttgaatgttggggtgaggagaccattttctagtgtgaaaggctcagcaacaagggtaacagctttggcaaattcaaaacctcttagctggtacagtaagtaagcacagagagatagataaggatcatacacatcatacagaacttttacttattaagagagcatgtaaggtaagaactaagaagtgaaaattaaacctgtgcctcctttccaatagagtccatgtcagccaggacagcagctcttgcccttgtatcagcgcatagctgtcttaaatcctcgtactgtaggttagaaagggaagatcataacataagcaggcaatgcggatgtaaggagctctatttgtagttctgttttttaataaataaaggcagtgtttgtgtagtgaactggaaaatatataataacatacaagaaggtaatctgctgatttggagaaactgggctgtacaaatgtatagtatgtactctttacttcaaaaaaaaggtcagcacatttacctggattccttccgatgcagcccaagccttcaacacctctggttcaactgctactacggcaaccaaagaagagtttaaactatcacctgcattcaaatcaacggcttagaatatacatggtaaataattagtacgtaataaccaatataagatcatgaatattaccatatataaagcactgcgcaataaacttgcacttagcatagacattctcaatcttctcgggagctatgtattctccttgagctaacttgaaaatgttctttttccttgagaaaagaaaattgcatcaattaaaatttaataagaaaagtaatcagacgaaacagagttccaggggaataaattaaaatagatagcctaaaaaattgtgtggaaagaggataaataattacagacaaaaagatttcagaatagagttgtggttatttctcaaaaaacatccatgcattacaacatttcgcaattgaaagctgtctgctacaataacagtagaggatagttaaggtttgctcttcgatcagtagatgaggagttaatatcttgcttttactttagtcttttagcacactagttttaaccttatcaagtccctaccatcttagtatatggtatgtattcacagaactacaaaatacagcaaattctataatttagaatagcagtgagctttcacatattagagtttcatcaccaaccatgcaaatctcatataacaaacaatataatggtgagaagaaaatagtagaagctgaatgaagatttcaagtatgcattaatatttaacaacttaatttagcaatcactgatctggatatcattaggaaactgcaaggaagctaaaagtaagtcctaagatgtacaccctctctttggaagatttgaagcatagaaaaaattgtgtgtttaacagcattaatctcagtgtaactacagttatccaaacagtgaccaatgaatgttggatcatgcccagggcttcttagggagtttcctaataggtcgcttgggtgaggttgttttttagt

SEQ ID NO: 71325 - DNA, 2397 bp, Oryza sativa
atcttaagccatgccaaagaatggatatagtaggtcgtttagttagttaaatcagatccatccttattgtgaatcattttataacttttgtcttttccacttctcttctatgcatgtttgcctttacctaacaaaatactttgagctaccagctttgtcgtcttatcatagatgtaaagtcactcacatttgaaatcagcgagtatttaacttggtacatccacgtgagatgtcgacatagtcgacctgccaagcaatatagggcaatcacactgagctcgatcgttggcaaaactaaaattaatatttacatatactatccaataagtaaaacatagagtaggtgaagactaattgtaccttctcgaagaaacaagtcatcatggaataaaaacacacaccaagaaagaatcaagacgctacctagctagcttctctctttgcagaaagcaaacaaaaaccccaccaaagaaaagaaatgtcattaaccctctcctgtggaccagcgtagttagaatgttgcatcagtgtgatatatgggcactggaatcatttgaaggtccttgtaccgtgtgtaagttgcacaagaaaatacggaagaaaacaacagatcgatgagcgtgtagactcgtgtagactcatcagacagtgatttcgtaatattaattagctgcatttcttaagggggaaatttttttatagatatatttaacgtatatttcatattatgaactagggagtgtgtcaattaataacaaggatatcgtattggatggaacttattttttctattttcttacatcgatcagatggtttgtataaattggaataaaattaattgagaatacatataaagaaaaaacatattcccttgcaaacattgtacatcagatatatcaactttttttctattacagggtatatgcgcacacgcatttgcatgtgtttaagatctttgtgggcatcaaaatttaaaccccagtgaatggtatataatacaccttgaaaaatatgcgttttgatacttattctagtagaacatattcattatattattaaacaagggtggaaagagacattttgctccaaaccatattaatcagagaaaaaaaaagttagataaagaccgataatcatggtaagtaaagactataacattgtatttatgaaaacataagtaaaattcatatgtcataaccaattcttttttttacttgaatccaattatacttttaggtctcctttgaaatgagggattgtgaaaacatagaaatagaaaaaaaatgcaaagatagagtatcatgtctgtcgttgaattcctatatgattttaagatcacaggaaaattccaagactattgtttggatgattacacgcatgaaattacaggaactttatcattggaaggaaaaaaaacatgatgcagaacctcatttacttcaaaatttctagtccatccgtcctgaaatataagcctttagaatttgtctcaaaatataacaacttctccaccaatattcttttttcaaccatttataatcctccaccattcaattttcccacctacctctacttcttctccaatcacaacactcccccatttaattttaccaattttcttaataaccgtgtcgaactctaaaaatgtttatattctgggaaggatagagtattgaatagcccattcgataagaattttagagaatttgagagaactatctatttattccaaagaagcgcatttttttcataggaaacaaattctccaaaattcctctggtttttgtttgttccaaatgagcactaaagctttaaaacttgtagaaaaacccacaagttatatcaagagcaaaaagaatccatcatgcttgttcggatgaacatctcacaattatttgtatttacagactgtatctgatgattttttttcgataagctagctatagtgcggttattgctcgttactctcacaaacgacttacataaagtaacagaggtaatagaagaaaactccaatttcaaattgaagcattaagattttttttcatttttttctcttaattaattactccatccgtcctaaaatataagcatttttagccgtgtccagattcatagctataagttattatattttgagacggagatagtacttaattagaatcaaagtttttacatatatatgcgcgaaaatctcgtcagctagcgtacgtctagactagaccgcgtaataacagcatgagattattgactagcacggtaaaacaaaagccacaaaaaaataaattcacaaagcctgagattgtaattgaagtcgtcgtcgtgtcgtcctccggcgccaacttgatcccaactgaaattgacttccttgaccaaaaacctcttctctgatctctc

SEQ ID NO: 71326 - DNA, 1311 bp, Oryza sativa
aaaaaaggaaatataacaaagaattgttagcaaaattttgcaacctgtgctagaatggtttaaaggcacgagtgcttgtgactgtcaccaatccttgcagctcactgccgttgcctgctttgagtatctctcactcgccgtcgttccctggtttatacttgctcacacgtgatctcccgcgcgactaggatcacgatcgaccaggtccagtcctccacgcgcattgcgatctcctcaccacgcgctcgcgcgcgattttagcgagcgcctagaaaattagttgagaaggcccactaatgatgatgtggtaaattttaaaattttgggaaccaatattttaggcatcttttaaaggagtgtattttgggtcaaatatttttttttctgtccccaatataggatatgtggggttttaattttgtacatctgttggagatgctcttagggtgggatcattttcccctctttattcttcttctcttctaaaagaaatgaagcgcaattctcttgtgctttagggggacaaaaaaggtttatcagaaatactatcccaacgcgcattatactctagtttagaggctaagagtcaaacatgggctttatctaaataaaaattaatctaactgtctaccgacttggaacctgcatgatacttttttaagaaaaaaaaaactttagggtctgcactaaagctcaatattttgcacaaaacaggtgaaaaataccaccatgtaatatttcaagatgaaccaacacaatatgtgcttggatgagccagtttttagataaaaatctattggagaaggcccattaggcgtagaaaaatagtacccctccattttaacttttcgcacaacgtttgaccatacgtcttattaaaaaaaattaaaaccgagggagaaactcccattgagcccacacccaggagtcctcagccaacaaggccgatcaatgagcactccactcttcccacttccacggcgtctactggtgttcgttcgcccttccacttgttgatctattttgattattatttctgacgctttgacaaattgatcaattttgagttctcttttcctgctaggtagctatcatgatctctctctctgtttttttttggaaaatacatattttcaccggtaatccatgcatctcccaaacaatcaaaattaccggggttttctatcttcgctggtatttttcgttaacacaaaattatagttatcttacactggcagcgaatggccgtccccttctgcgttcgttgctactgatgggaactaatctgtattgcatgtaaaatagagcgac

SEQ ID NO: 71327 - DNA, 7829 bp, Oryza sativa
  unsure (1)..(7829): unsure at all n locations
tgcccctcccagcccacgtcatgcagagctcggcccggcccacctgtcatgctgacgtagcacctgacgaggcctggcccacccctcctccggctctcccgattggtccacgcgctcacacgagtttacacttatgcccctgggtttattttatttttattttcacggtgcagtccaaagtccaagtcctcggatcagccttgggcgaaactttgacccctaaactgataaagcccatagcaattcttgccattttggagcggtgcaactttttgccatatggagctcaggccgccgccggccaagcaccaccaccaccgccgccgtcgcggcggcggcggcgaaaacggcggggaggaggaggaggaggagactggccgcctgtcgctgcgcggcggcggcttctggcggcgccacnacngngaggaggaggaggagaagggcggcgggaggaggggcgagatcaangaggtggacttcttcttgggcgccagcggccgcgatgtcgtcgtggcctcccggcggggacgacaaccgctttcgcgggacgacgcatggcggcggcggtggctgcgacgtcaacgtgagttcgccggcgttggactagagtagctgaaacttgagctcttgattgattggttgcttaattgatctgcagatcgggctagacttgctgaccaccaccaccgccggcgcggcggcgggtggtgccgcggccggcgccggccaggaggacaccgggaacaatcatatagttagttgattttgtcgatacccttgtgtactcttccattcctcttggtttttaattaaattaattgcttgttgtagcttaaattatttggtgtgatcccttgttggctgacacgtatacttatccatgtgatctagaaggaggcgacgacggcggcggtggatgtggagctccggcgagtggtggaggagaaccggcggctgcggggatgctggacgagctcaaccggagctacagcgcgttgtaccatcagtatctgcaggtcacgcagcagcaaaaccatcgccatcctgatcatcacctgattatgaacaacaacaacaaccggccttcactagctcaagtgagtaccttagcttcttgttctacatgttattatcatcacaagcatatgcacataaaaatgttccccttaattatcccggtaaatggatgcatggatgcaccttgcttagatcttcatttcttgattcccattttgttttttcggggcaaggatttcttgattccttgattgtatttgcctttccttaattattttcaagaattcttattttgggtagtttgttcctctgttgatctttcagattcaattttaagggtatacctagccggacttttttgtgcacaattaatggtgttattggttttatccccccctggtttattatattttctgaattctcaatgcacacgtacacattggagatcgaattgtctagtgacaacaattggaaggcatgtgtagatttttccccatgatcaagatctctggtgcaataatgtacaggtcaccaaaagcacacacaccgatgtaagatcctgtagatcaaacgagcttatgtcaatgcctcggtctgctaattaattaactgattaatcttatagaagcctgacactttccaaagcaaatctttccgaacatgatggagtagaattactgaattagatattataaaatgggcatagtagttacaaacatatatgagcatgggcagagcatggcatcaactcttgatcacttgcaagtattataagcttcggggtagtatattacattatttcctccgaaactatcgggattttcccaaatactacactgtttaatccgttttaggtacttcctccgtttcacagtgtaaatcattctagcatttctcacatttatattgatgttaatgaatttaacatcaatacgaatatgaaaaatgctagaatgacttacattgtgaaacggagggagtactaaataactttggctttcattaattgtccatccgattaatcctttttgaacgataggcaggtatacgattaatcatcatcattaatgctgtagctcacaattaatcgtgtgaacaatgttccaaaagtctccaagcgttagatcccttcccaactgcttagctttgctttgctttgcagaggacggacatgtactgtacagtgacacactaacacgagagctagctagctagctaacaaagctaactactactgctacttataactgtaggagtagtagttagcgtgtgctaatctcatgcacgtaattttcatttgcccctgctcgctttcgcccttccttttgactaacgaacacaccacgtactaactacgtacttgttgatcctaccaaacatcgacgcagacacaccggaccgcggcgacgacgacggcgacgacgcagcaattcctggagccgcgagcgtcgtccacggcgcaggccaccgccgacgcggacatggcagcgtccgacgacgaggccggccgcggcggcggcgacggcgacgcgtcgtccccttcgctgagcaacgccgccggcggcggcggcggcggcaacaagatgaggagggttggtggtcaagacgagactgcggcggcggcgccggcgagggagaacggcgagcagcaggcggcggcggcggccgagctgccgtgccggaaaccgagggtgtccgtgcgtgcgcgatccgaagcaccaatggtacatatacactagtagcagtaactatgttttgattgagatgatctagctatatatatatatatatatatcatgcatgcatgtcatggcaacattatttaattttctttgatttgaacattgcctgcaatttaattcattaatttgttcagtcaaaacaaaattaaacatggccggtatagagtatagacaacagaaagcgattgattttacttctagaagtgtacacatgaaacaaattgttgttgttattgaatttacaattacaaatccaaaagatgggacgacgtacgtcgttgctagtttaattattttgaccttttgttgctcttgcattcaattaatgatgagcaactattgaactcctgcagattagtgatgggtgccaatggaggaagtacgggcagaaaatggcaaaggggaatccatgcccgcgagcgtactaccgatgcacaatggctatcggatgcccagtcaggaagcaggtaactaaattaatatatatgcattctcataatatgcgttttcttgtgtagctttaattagcatggcgctatatataaaaaccagctgaaattggaattcatatattttttaaaaaaaaattaaagatgtttgacatagtaattatattgatgtgatccatttttttggaacattgagacgcaagttaaatttatattagttatatatatcttccgttcgatctcccttttttaaaaaaaaattgtggtcgatctcactatattaatggcgctcaccacacgcaatcttcaaaaggaaaaagaattccttgggattttcttactccattaatatgtgtcttgactctttgttaacggatttctcatcttatcgataaacaaatcgttagctctccccgtcaaaaaagaaaacaaattattagctctggttacgtgttttcattgcccctcacaaactatatatctgcatatcgatcggttattcaaactggaaaatataacaagctagctagggacgtcctctttgaccggccggttaagcttacccgatctcacaacataaaaaacggatagctgatttgatatgtgtttgcccgataaccgatctcaacacacatgcaaactggaggaccaactgattataaattgcctttaatttgatctcctacgatctttgcactgtcacacacacacacacacacacacacacacacacacacaaaagtacctgttctctgacacatatatcgattaactaagcaaggaatcatgatactgttgactttcaacacgtctagtaaatgatcgtgtaaatatcaattcatgtttatacacgtctatatatattgaagaatacttccaatagtccatatgtactgatgtgaactcatgcatccagtgagaattcagcatctctgcatccttccttgcatacgctagatatgactcctatcattgcatggacttgcatatatttatgtttctccatctatccagctagctgtatacccatagcagtactcctacataatatgcgcacacaaaactagctacgagctgtgcacacaatatatatatatgctgcgaggagacacgtatgtttccgttgttttccgtgctgacatgacgagatagaagacaagaggaaaaactatcaaatcaatttccattgtttaatactagttcatttttgtgagatatactccttccgagctgataatacttgttattttagacaaggttgatgtcaaactttaaaatctttggttatgaataatttctaaaatatttgtctttgaaatatggtgactatatatatagaatagtcttaaaaaatactttcgtaaaatcatatagttgttaacatctatatacatattataataaaaaataatggtcaaagttagtttttgaagactgtgccattatccaaaacgacaagtattattaacccgaagggagtagtacgtacgtggttataaaaataagatgccaatgcgtttttaaactttttataataagtatcggatttgctaaatgcctttagcaagaaaaaggggagtgaaatcttatggtctctggaccgttgggttcacgctaagatgttgtgtccgagatgctcctcctttagctccaaagaactcctctttctctggcgtcaaggacaccaactttgtcatagtacctatacggactagaggtttggaattgggataggggtaagaagagagagtgagttggaaaaagggaagaaaggggtatcctgtcttgaagagatggcttcgtggacaatggtcagaccaacggtgagcgacgaacacagataggtggtaaggcagtggcgctataccaccggagcagggctggagctgtggcggatccaggatttatgtgatgggtattcggaattctaaaatagcagatatatcgataccgattgacacattgaatgtacgatacattattttgatgcataatctttactacgaattgtgcgcatatataataaaatatatagaaacatttataatttcctataatcagcatcaaacatatttctattgatctaagtatgagtgaagagtaccaaagaattcggaatttttggagattgtatagcataggtcgacaactttatgtagtaaaaatattctgatttattgctaatgaaggaaaacactcataaaccacgaagaaactagtagctagcaaaggaatataacttatttccgtaggacaattgatatcaattagacaacaacatgtagagaaaaacaaatgagtgggcaatatatagatgtatatacaatttgcaaagataactatttcctccgtttcataatgtaagactttctagcagtgtccacattcatataaacgttaatgaatctagacacaaaatcttacgttatgaaacggatgaagtaggcattaaagtaattgcttattaattgccacaaccaaaatgtaaacaagaaaattaaattagcatgaatacaacccatcccgaaattgctccaggccaagcacgcttaacctcatagttctttcgcgatcagcttccggaaaaaaagttgcaacttattgatatgagtatcctatcaatcctattaagccatgtgctaggatgtcacaatatattacaaaagaaagggagggactaggaagactattgatcttattgggctgaggagagctagaaaagggtggaattgaattgttagggtataaatatcacaaatctagatagagtatggtagtacatatatattatggtcaatatatattaggtttgtgtccaaaattcatgggtattcagctgaatacccatgaattatgtgggatccgcccctgggctggaggagggcaatggacgagtcggcagagtgattaagaggcggggcagtggtgatgtctccgttggtggtgagccgccaaagaaaagggcggtggggcacctcgtcaccgctcggttgaggaggagcaggacgacatggcgttgatggtccggttgacgccttttggttttgtcaatgttaaggggcaacccgctgggcaggggaggtggcggcgatggttgaggagatggtgacgccacgacttgcgagaggaactaggggaggagagaaaatatgattagagtggtaactggtactatagctacatgaattcttggtgtgatctagaccatctaaatgtagctaattcagatgagataggcagatcaggaagtatttaacatttgagaaacgagaaccctcaaactatatatgaaaaccaacttccgaaaggagtctaatatacttgccttaattaattactccatccgttccaggttataaaacgttttgactttggaagttaaactgttttaagtttgtctaattttatagacaaatatagcaatatttataatactaaattagtgtcatcaaatcaataattaaatatattttcacaataaatttatcttgggtaaaaaatgttactacttttttctataaacttggtcaaacttaaagcagttataacctaaatcggagggagtacatagttacatgattgcatgcggccggtgatgcggtgcccgatgctgcatgcatgtatttgccttcattagtgcatgcgagaaagatgcatgtaactagcgcacacattggtaagtagcacagtaattgacatgggagtggattctaagagcaggtacaataagatggtagatgctggcgataggacgaccatgtcagtgttgatgcttagctagaggtgaaaaaggtggtgagagagattaacgggcgactaattagggcaagtgctatggtagatgtgactaccacctccaaatttatctattttattcactcatgaactaagaggcaacccatacaatgtatcacctctaacacacaaataccaatatctctaatactctcacacacttcttaaaatttgtgtggaggttgcctcttgatttaggggtggttcatcttctctctctccacttctctcctccactcatcacccaatccattgtggcattcttaggggcaacatatgagatattatagtacttgcccttagtcgctagctgctcacactatccaaggcaaagtatttaactgctgttggctgcatgctatggcaacgcaagaagctgggtggggtcacctcattctaccgcatgcatttgttcatggttgatgggaactgtgtagcaatagaagatagtagatatctattgtatgcactagctattagcactaactataatttgctgatgtggttatttttgtagcctttagctagctatttactattgaccttgctctaatcctccaggggattttcttttaaattcgatgcatgcaattagttgtgaaaaattgtgaaaaaaattgataaattagagtatagtgatatgtactaatccaaaaatcaaatttaaattagacctacacatcgagaaaaaaaaagataaattgagatacgaatagtacgctactatttatatattaaatgcatatatcatctgtgtgcaggtgcaacggtgcgccgaggacaagaccgtgctgatcaccacctacgagggcaaccacaaccacca

SEQ ID NO: 71328 - DNA, 9406 bp, Oryza sativa
ataccgtttaggaagcgtgcgcatgtgaaaccgagagggagtgagttggattacggaagtatcggacacagcccagggtactgcggcaccagatcaattaagcttgacgccgtggcaatgttggctcgtggaggcttgcttcccggcccgtgtcccatctactgctcccagtgtcccatctacagctgagccctgaagtttcatactgtgctggcgtgtgaaaaagcacacaagagctctaacgatggtgtcgagctgtgaaaacaagctaccatgatcaagacgttttccagatacagctcattcctaggcctcaatttcacacatggtactagacacgtagttttggcatcgaattggtcttgctcgatcatctccgcgatgttaatttgtgtgcatggcgtatgggacgagtgataaactgatcatgttgagagggagcggaagatgggatatatatagatacatgggtaggtgaactagtgaatatggctatgtgaacgactgatcgttgatgcatcacataaatgagcttctggaaaaaaagatgtcttccatcacaacattaatttgtccttacaggatttgtacagaaaagatgtttcttcccatgaaaaaaaaagactaatattatcgatagaacatggaaaatctatattaatggcataatatatgcaaaatccaaaaataaattggtggagacggagctaaagctgaagctagagccgtctctgccaatgtcaatccatgctggtgctgccatctctattgtcacatgacttttcatgcctgcgtcaattgtctgtatgcccaggatttggttggaatctattgctgaattcctgtacccgttgatctattttgatcactgtcgatgcaatactcacgctttgatcaattgtttttgagttctcgatccctgctaggcaatcattttttttttttgaaaatgcatgtttcactggtaatccatttcccaacggctagattaccagggatttccattccactggcatctttctagacaacgaaaattatagttacactttaattacgacggtagagatattgagaattcccaagccgtctctcagtctgtaagttgaaattggacctccattattaaaattatttccctccaatgtgatccctatgcatagcaatgaaattaactatataagttaccatagttcataatggacatacactcatacaacttccattatctgcattaatgggataaattgtctgcatgaaggaatccttatcgagtgagggtctgatggagtgcacaccacatggcatgagttgcaggcttgtctccttaacccattgtaacttataaaaaacagataaaatttcaagattaaacaaattacattaattgagtgtcactcttagccaatgtgtgcacgtgggcgcccctgcccatggcactgaggcaccgcttcaagagattgatgcaacaactacatgagctcgatgtcttagaggttcaatcccaggtccagcacactgaggagccctggaaggtcactaagcaggcacgcgaaacaacacaaacgaagtgaaaccaccatagcaagctgtgcagataaactatcacggtgaagacgttttcctcatacaactcattcctagccgacctttatttttttcacttatactcatgtcgcttttgcatcactcggtatgagactgtgaatgtatgatcatcatgttgagagggagtggaaggtggatatatatatatagatatatgtgaacacatggttaattaggtgaatcggtgaagggtgcgcagctcaactggttaggtttttgtggcggaaccagattcaaatcctagattttacatgtgtgctcgtatttacggctaattattctttcagtggttcaaatcctagatgttatatgtgtgctcgtatttacggctaattattctttcagtggtaagcaacgtatccgttgacaacacttgtagtgacttggtcaatctcaagatatgccggcccaatttttcagaggtactcatatagatagggtgaacatgtgtgcgttcatatgggtgagcgggcacctgcgtttgtattgtgtttctattaaaaaaagtgaaccattgaatatggttatgtgattgtgcatggatgacataaatatatataatcagcttcattgaaaaaggttgcgtatgtccatcactgcattaatcgctttttcgtggctaacacaaaatcacctaatgatttgcggtgtaatcaacagagtcgccaaaatcgatagatcaaaacctgactttgagaataattcactttcgtagaataacacgactaatttacaagtaaattagcaaagataaatattgtacttacacgatgacgaacgactagtttcggagcaaattagcaaaggataacctcctcactttcgtggagaaacacgaccgtttttcagcgcaaaacagtaaagattaactaaattctagggttgtcagaactcagccgtaaaaacaaaatagaaaataacaaaatagtagattgataatttttgggggttctcaatctaatcagcaatgcgctatatatatagcagtctggtctttggtgtcctatccaaataataggaatattaacatatctgtaaaatacgttgcctaccgcgtgaagatccgcctggcgttttttggtcttcatcctggatgcagttttaccaatccggttgtattctctgcacacaaattccagaccatgtcttctgctacgttctcatcgtctcgtgcgatcagccggtcagatgtaaccaacacaattcgtcgtcaaccaccactgccgctccggccgcatataatctacttgcacacaactgcataccatctacttgcatctccatcgaggcgtcaactccaggcaaggcatcgactgcacctttgcatgcacacaacactgatgcgctccatctccaagcagagtcaactgctgcaataacttagtgatttgcaaacacaatcttccagtgcattactgattcctgcacctgcacccacacccacactaaatttgacctttcaaggaaaccactcaaaaatacaccagctattcaaaataatctgacctactaaaataaaactaactctttgccaaattatgacacaaacagctacattcttacatataagatatttcctcccatggaaaaattcgcactattatcgatagaacatggaaagtgtgtattatatatgtcataatgtttgcacaaaatgtaaaaataaatgaaccaaatatattctaaaaaaatattttcgtgagtaaaaaatcttgcaacagtaattaaactaagataaaaaagaaaccccaaaaatgtaaagaataatgatatttgtaacaccagaatatattgtaaccagtaaaatatactcaaggtacgtaaacttaggtgatgggtgtaaacaagtagaacaacttgtgtatttagtgagaatgacgtatgcaaaatcagagaacttgtgtattctgtaatatatgcaaaatctaaaaataaattaaacggtttaatgctgcaaattattaaacttgccaagaacagtaattaaataatgcaaaacgttaaataattgtgaatacacacataaacaataccatgtataataatggaatatgactattttgctgtaaaacataggttccttgaaataaaatgcaacaaatggtgtttgtgttacacagatgcctaaaaacctcagttcttacaaaatttacacaaaacataaattttatggcccgtgcgatgtacaggtcattgactagataaccctaacaacaatacctaccaaaccacatgttaaaaggattagtccattttattcctctcaattgttgtgtttgtctaaaatacaaccctcaactataaaatcggatattgaaccctctcaactctcaaatcatttaaattcactccctcagagcaaacataggtgacactttcctacatgatgcttaggtggcatctactcagcaaaacgtgttaaaataaactaggacccacttgtcatcctcctctctcttttccgcccctagatccccaagctgtcccctttctctccctctctcacttgctcggatcggagatcgctctcatggaaaatgcagttgctgcagggaggagcccgatggcggaagcactcagaggttgaggtggtggcgagcacttatatttttagtctcactaatagcactaaaatttagtactattgatgaacaccttaaacaaattatgtttactctatacaataaataaactcaagacacaaaagaaaattttttttatcaccttcatttctttcactcattccctaaaggatgccaagtgtagatctcaactggctacattgtagtaattatataggagtattcattattcagttaaggtggtccgagtaagaggttatcattgacaatagagcttaactggcctacttgctgataaaattatgctccacactcatcttgaggagcacgactataataatgtgggacccatgaatcaaggcactagagaaaactccttagcggctaagttggcttcacccgatcgtcaaaggagaattcatataaaagtttaattattttatcctattaattggtagaagcggtatttttaaatatttatatataaatttggacgcctgtgagacatgggcacttggtatgatgtggagattatcttcttatggtattaatgatgtatagggtttatttttgcatacagctgcaattccatctattaaaaagacactcatatttcaagacaataataataagttgtggtgaatgatgaatttatatataaccaggataaagtgatttttggttggatatgattgctattctgatcatttagtatatatcaaaatctatggtctatttcttatagatatggcttcttttagtattccttttatagacaactagaaaggaagcccgtgcagatgcacaggcatcttatttattgattatataaataatactaagagaattaagtcatatctcaccatatatatataacaaattatagattttgcctcgtagtaataaaaaattatgttgtgaaatagaccgtagactttaatataaatgataagaatgtctcttagatttaatcaaaattcacttttgtccaggtaagtgtaaactctcctattatcaccattacttattatcattgttcttaaaacatagatatgattttaataaatggaactccatctaaaccaccaaaataagtctaatacatcattaatacataaaactttatttcaattatttacctaaatgtttatgccaacacttatttctaaatctacggataagtattctaaaactaactcttctattggttattaggatagcaccgttaaaaaatagacatgcccctctaatggggggaaccatcaagattccttcaagcatgggtcgacatagtcgtgcctctcacagcctcacgaccattgtggagcacaattttaattaatcctagttcactatcgacacccttaaagactattgcaccagtaagtaggaagttaaacactattatcaatggtggcctccactgagcctgcctcaagtcaaccatatgtgtgccccatgctatagttgtggtatccatgctcggtgccctctagggaaacaaagagaagatggatatgatgcaaatagttatttggttcttcccataaaatatagtttctttatgttttgtttagacacaattttgtttatggtgttaatcaaaactgcttaatttttatggtacaaatacaatgtcatctttagaaatgagtgaagttgatcactaaaaatatatatagctaaacaaacacgtgaccgtgacaatgttcagattattatatcattgtttatattttgacaaagatctatattttagcatcttgtttgttttcatcacctattgtccataattgcatgagacacctttactaattctaaaattgtatttatttcccaaaattatttataataactaatttgttgaggtgcacttatagttatgtcactgtggtttatggcattacattcatcaattatcacttatgaccattatattataattcctctactataagagaaaatatcatgaatagtttcatgctcatgttataggattgttcatttgttatcaaacctatttggcaaagaaaaaacgtatatgaccataattcttgtgatagattaaggggtcgtattatagcaagatcattgcctgagcataccaatccaatagttatgaaaaataaaaataaactttgagaatctcaatctcacacaaacaaaaattaaatcagatataattaaaaaacataatgttgtttcatttttcatgcatgtagatttcagttagtgttatataattgttaagtgatatttgaccataaattatgatgtgaaattattttgaagattatcatgagattaattattatatgccacctaaattatttaaaaaagtattatgatattgcttattatatgttagctccaggtgctataatgtatttagttataatataactattatatgttatcaagatttgaatacacctgattataagttgactatagaatttaaaaataatctaaaaaactttgtgtgtaaacacatttaatttgttttttatatttatctagtttaacttgcatttttatttttggagtaataaattttattttatggtatagaaaatcctatttttaaaatcatctatattttttcgatggttctaccaacttatattagtattatttgggctttatagctttattatcatgtgttcatatgtttctttgcttttttcaatcgaacattgctaaatggtttctctcgtatgcatgagacgttgaacacatgatattatctatatatgcaaaatatatagaccaacttatattatcgatagaacattgaaaatgtgtattaatggcataaaatatatgcaaaatctaaaaataaatcagtggagacagagctgaagctggagccgtctccgccaatttcaatccatgctggtgctgccatctctattgtcacatgacttttcatgccagcctcaattgtcggtatgcccatgatttggttagaatctgttgctgaattttagtacccgttgatctatttttatcattatcaatgcaatactcacgctttgacgaattgattttgagttctccgtcattgctaggcaatcattttttatttttttttgaaaatgcatgtttcgctggtaatccatttcccaaacggccagtttaccagggatttccattccactggtatctttgtagataacgaaaatcacagttgcactttaattactacggtaagatatacagaattcccaagcagtccctcagtctttaagttgaaattggatctccattactaaaatcataacccccccccccccaatgtgatccctatgcatagcaatgaaattaaccatataagttggcacagttcaaaatggacatacactcatacagcttccattatctgcattaatgggacaaattgtctgcatcaaggaatcctgatcgagtgagggtctagtggggtgcacaccacatggcttgagttgtaggcttgtcaccttaaccccttttaattaattaaaagaacagataaaatttcaagattaaacaaattacatcaattaagtgtaacttttagcgtacagctacgtgacctcgagccctccatgtcttacaggttgcaatcctatgctcagttcactgatgaggcctggaaggtcactaagcaggcgcacgaaacagcacaaacgaggtgaaaccaccatagcaagctgtgcagaaaaactatcacggtgaagacgttttcctcatacaactcattcctaggccggcctcttttttttcaacttatactcttgtcgctttggcatcactcggtatgagaatgtgaatgtactgatgatcatgttgagagggagtggatagtggatatatatagatatatgcgtccacaggtgtaccatcgaaggatgcgtagcttaactggtttggttacctgtggttgaacaagtccacccatgttcaaatccaaaatttaacatgggtactcgtatttacggttaattatgtccatcattgcataatttgtacttgctagattcctaacaataatacgtacccaaaccatgggtacttgcttacgtggtgcttaggttgcatctactcagcaaaacatgttaaaaaaaaactaggacccacttaggggtggatagcgagccagctcggctcggctcggtctagctcgttaggataacgaactggctcggctcggctcggttcattatcctaacgagctagaaaccaagctcggctcggctcgtttgaaagcttgagctggctcgttcggcttgcgagccaaaccaacaacccagctccatggcagactcgcagtaagcagcggcgtgcatggcgagatggcgggtggcggcggcgcagagagtggcgggcggtggcggcagagagtgcttggtgcggtgggcggtggtgctcccgcggcggcggcgccgatggccatggggttggcggcgttgagttccttcggtggacggtgactgaggagtggccggatgcggcggcggaggccggtaggtggctggtggcggcggtggcggctggcggctggcgcaggagcgtggcggcagcgcttggcggtggtggctggcgggtgacggttggtggcggcgcttggcggtggcggttggcgggtggtggctggtggcggggaggatgagaacgagagaaggggattgatcggaattggccacaccagatcgggatcgggatcagtcactagtgttttttgctcccgagttgggctgttgggcctccattctctgccaaaatccaattccaaaggcccacagctcatgtgccctggctcattaaggcttgcgagcggctcgcgatccagcttgagctggctcgttatctctcagctcgttaggaaaatcaaacgagccgagtcaagcttgtcacgagccgagcgagctaacgagccacaagcttcctgtccacccctagacccacttgtcacccacctctctcatttcctcccctagatccccgagctgtcccttttctctccctctctcgcatgctcggatcgaagatcgctcttgtggcaaatgaagttgcagtagtgacaacggagggagaagccggcggagaggagggatggaccctcaaggtggagcccgtggcggaagcacttggaggttgaggtgggggcaagcactgatagcccaaggtggtggctgagcacaagtaatccaacagtgagctcgaggtggtggagctcg

SEQ ID NO: 71329 - DNA, 18531 bp, Oryza sativa
tctttttgtgtaagtgctttgatgatgtgctccttccagtcacaaaataatgatgttcacatgtagtcaaaccaattaactttgaccatagtaattatttcaaacggtaagttttgtgtgtataaaactgatagagtaaattatcataatattacactagtttaactttttcgtggcttttatgaagttaatttttttgatagaattatgaagttaaaatttaaagttctgccatgttgaccttgaaaagccaaaaacttgattctttagtaaacgtagggaatattgtacaaattcatgtttcacacaattaatttcgttttttttttgttgaagcaggttcagtcaaatcataattttcaatttaattatttgttgtgtttaataggactgttgctgaacataggcatggtaatccatctgatgtgcttgattggaagatcgttggagatgacagtgttttccctgctaggtattatgatgcattgctttactgtatcacgttcaatgttagtataaatttgttgataacagaaaattactgaatgacagatggttggtacctaagccgtattggtgttatcctgaatttctggtccagcataaacttgcagttaaaatgagtagaatcgagaccattccgtgttgaattgctctccatatcatatcttgtgaacctatttaacgtcgagagaccttatttaaattgtcggtatgttcagtgtttataagttgtgtttacatttggacaaagtgctctgagttttgagcccgactgcccgagggccatccgatccgaccagtgatggacgtcctacggggtcttttcacagccaaattcaatccttacattttttataagctcaaaaacatatagggtgtgtttagttcacgtcaaaattgaaagtttagttgaaattggaacgatgcgatggaaaagttggaagtttgtttgtgtagaaaaattttgatgtgatgaaaaagttgaaagtttgaagaaaaaatttggaactaaactcggacgtagtatgaaattcagcctttgaacgcgtgcaagctagtagcttcgctcgtcatcctcgaacctgacgatgaagaggtattctcagatctgacttctaagccccttattcttgagccagagagagggtggatcggaagggaggagagatcgggagggagggggggatcggatgagaaggggagggttaaagttcaaaatgccaatatttgaaaagcaatatctcacaagatatgtattattttttaaaatcgctcccactacagtaaattaggaattgaaacaaaaatatataggttaaaagtctcaaatgctaaccatatacttgttactgcacaaaagtaaaagtgttactgcactgaaggtatacgttaccacgtgtttatgcagtaacactatccaaaaaatacagtaaaacgccatgtagtaacatcatgatgcgattgtagtaatgtacaacagacaagtagtaacaagtaatagtatagtattactacttgtggagagacaatatctctcaagtgatgtaaggttttttaaaaccgtttgcaccatgatgctagaaaaaaagagctaatcaaaagtagatccgtcatgactatatttcaactatattttaacgctgttactgcaagtaagacacagtgttactgcatagaggtcgtcgtgttactgcaccgtcctgggacgagagctgagaagaggtgggtggtggggggagttagtaggcgggtttgaccggtgggaggggcctttaaccgaggtgggaggtgggttttgggccttggtaaggaggggaggtgggtgtgacccttgggagggaggctgttctatacccggaagaatagtttttctatatatatgtgtgtgtgtgtaacggactcaaattttcagggaaaaatttttgcaaaatatttcaagtcatgctcttctcgattcttcctttgagtaatctcacttttgatcttttctttgacttggatctaaactttatttgctaagttaaaagctttctttaaaatccctttttaaattttacaaaacctttccgtttattttatttaatctttaactttggctctaaattatatttcctttgaatccattcccgaacatctccagcaaatactctttcaattcccgttcaaccatctctagaacacatgaaatattaatctctctagaattaatatcttttcatttagagcttactacactaccaccaaatccacttttatcttccaccaaatacttcccctttgatctctacccaaacacatgaattatcaattcttattttctccagaaccaatacctttcctttggatctccacctaaatattcccatagtccataaaatatcattgtcaatctccctaagttaatatacctatcccttagaatttattaatcaaccaccaattccgtccgtagaaaaattcccatccacatatactggaggttaaaatcccaaaatttatccaaagttagtagataaattaattatattttctttccatttgactattttaaattttaaaatattagagaaaatattttgtgatgagttctatatttggttcttattgaattcttttaaaattggagcatctttatttttatccttttcaaatttatatctcaaaaataaatatcttgattttattttaaacagtatttcaaactccttttacttcaaaaaccttatattcgaatttattttataaagtttaaaagaccctcaaacattcctcttttaaattttatctcctttaagatatatttaaaaccttccattcaaaaattcccctagttttcaatttcttttgaattctatttaaattcattgtccaagttcaaaaagtccacatactcccttaggttccattacctttgaatcccatctaaattccttgaccatatccttggcacaaagaataatatattcctaaaataattgctcttgtgctaaggaaattccaacttatattcttcactcaatttccccttttagccaaaaatatacataataccaattttagaattcaaatcctatttattgccttcaactaattcccttctatattcccaaaaatattttgaggaatattattaatttcccttcctatttgagtgcttccaaataaattccctcaaactccacctctaaatattgcactcaaataaattaagaaatctcttttatgaactctttccaaattcaaattctttgtaaaacctagctatccaaatcaagtattcaaattagacttctttctttttgtcatcgggccgaaactccgttctttcttccttttggcccaatcttttatcttttatttttttcctcctccctcttgggctgccggcccagctaagccgagccggtccaattcggaccatagcccagccgcctctctcctcctccttccaggtgtgcgtgttgtacacgcgcacggcgcacgccgcctcaaactcccttccgtcgtcacgaagtaatcggcgccgtcttttcttccttcacgccagcgtcgccgtggtcaagccgtcgaccgcctccagaaccgcctctccccaccgcccctctcccctataaatagccggccatccctccccttctttacatacaaacagagctccatctttctctctcttgccatgtccggccgtcgccgtcgtcggccgatctccctcaccggagcttcgaaagccaaacccttgcgccaccaactccgcctcgccgaggtgattccattttttcctatttcccctctcctttagccactgccacaagcactaccggcaccaccatagccggccagagctgagctcttgctgccgccgttccggccattctatttactccctatgccttccaccgacctccccggatgcatagcgagcgggaacacgcttgtccgccgccgtcgaggccattaaaccaccgaagcaccggtgccctgtgccctcttcccctctgttgttgctcgggagaagaaacagaaggaaggagagaagaacgggaggaagaagaagagacatatgacagtgggccccgctgcacagtaaacttcctcttttatttgatttcaatctttagacaaccgtatctttccaaccacaaatccaattccagtgaacctttgatctaaattcatctaatttcaaaccctcccttttgataccaaatttcctatttaaaattttgtttaaatacccttttaatttaaacctatttgatttatcttaaatccctttaattttaaaatttcttattttatttaaaaccatttttaaattaaattatctttaaatatcatttctttatttatttaattaccttttctttatttcttttaaaataccattttaaattttatttctttaatatattttttaaaaaactctatttgaattcaaatttctttaaaccattcttttacaatccttagccaccaaaaagccgctgtggaaactttacaccttctatggagacgttcgcgtggtctcaaaccccgatgtcaaaccgttggtcgtaaaacccggcataacctaatcctaaggtcgaagtgtcgctcttcgcaccccacgcctcaacgcgtacagtggtcggagcctcactactccctcgacctccacaagcatgccacacactagtccttgagctatgtgcgaccctagctgctctgttgtcactcacaactgcagagtaacactattccgctccacacaaatctcctaactcactagccgttgtgctacttaactgtagcatcgactagacgagccgatatttagccgttatgctaccaaccttagcatcggctaaccactccaaatatctaaccgtcgtgctactctattctagcaccgactagaaaaccaaatccaccaaatcaaccccacctatccattttatccttttcctcaattccaacatttagaaaccaaaacctctcttttgttttccaaactaaaatttattttgaaccattcctttttccttcgccttgctccaattttatttattatttggtttttatcatttctttgtagcaatttgcttataggctttatttgctatcttttcgtattcgtacgttagaccgtacagcaagttttatcagcatccaaggagctgacgtggacccagatggctacgctaaagccgcaagaaatcttaaggtgcaaggaaagacataattaaaatttgatcatatagaaaacttgatatgatcttcatatttaatttgatgcataataccttactcttttaacatctcatgggtagatgttaaatgcttttaagcatgattgcatgagaacatagaaagaagcattggttatcattttatgtgatttactattccaaacaactttacaaacttaggaatccaattaaaatgggcatttatgagttgagattataaatgctgtgattatgaatgttgatgaagtttgtgatgttggtgtggggagtttggaaagttttgggtggtttaaccggattataattacccccttataccatggaaatgacatagttgcgtccatccacacaatcaagtaattggacttagcgtagtacattgtcccactatatgaaagactgttgggtggctctatgagcggttttggggtgaacttgcgtaaggagtttgggcggcagtgtttcacaacagtgggattcatgaaagtgtgacgatatagataccttgcctaggcctggcaagagttcgaccactatgatgaaccaagaccccactgtgtagtaactagtagtaagtgggaccttcgaacggctctggtgtccttagccttgcaaattgttgacatcgtgtgggtaaagctggacagtctctgcagaggtgaattaaatcattcgaatgtgccatactcccggttctgcagttgtgtcatcagggtgattcctactcctgaagtataagtagttttaaaattaaagagttgaggataaagatgatttatggtttttattattcctttactttatttttgtttatttattcatatctactcacctttaattatttataatatgtcttgttgagtacataagtactcacccttgcataatttgacatatagaggaaacgtgctaacaaggagatcggaaggaagcgagattttacggcaacgacaagtttatctaggctagtctacactcgagcttttgcctgtggagttatttgaattctttggagtttattagctgtagttttagtagttgaagagcttaggagtttagtagtttagcactttagatttttcttgtattttcaaataaggatattttagtttggatcttttcaacctttaacaattgtataattagcttgtataaccaaatttgtataattaattgaaagctgatctgtatatcaatctgtgatcgaaatcctggacgatcacgagatcgaaatcctggacgatcacgaatgaattttcggggcaccaagcctaaattgggtgtccccacagtgtgtatatatgtctaaattcattaacatcaatatgaatgtgggaaatgttaaaatgacttacattgtgaaacggagagagtatataagaaacactgccaaaactccaaaactgggcaatactgtcaaataaccaaaattttgacattaaatttggtaagattcattttggatacaatctaaatattcccgttcttttggtgaagcgtcctccctcccctctcatgcttcaagaagcatctccgtcggatttgaccatgctaaaaaagtcttgattttgtgagctcgacctgctgtcaggaatagaattgtcacacataaaaaaatgagttattttaggtaatggtcaatttagcaatcgttatgggcagtagctaatgatggagatgcctatttggacggacattgtctcctgaacagacttgttccatgccctttcttgtgctagttgtagggaccaatgacatgtcattccatgatccagcaggcaatagagcccagaaactcacaaacctggcaatttcaaccaatacagacagacaaggcatgcagatttaacaccaggatttggaggtcacgactcacgatcagtgaggcagtgaccaatcttgcattcaaatatgttaagatgataatatcgataatttacatgtgtacatcctaaacagaacctaaatcggcatgttttgccaatacacggcacatgttaatgggactttttcttcatccttaggaagctaaccaatgtgattctggagggagcacctgtgcctgatctcttcttgattgctgtcgttttacacagctttccatctcttacggtagtcgtggttgtagatgatacattatagaactgcatacatacaagttgtgttcaagttctaaaaacgtctggatgaagatttcacttcttctcaagaactgctggagagcaattacctcgcatacaccgtgcaaaagcaatctctgaaatgggtcctggacattcagtacaagcatatctttaccactagtgtcttcgatgaaggtcctaactcgttcctgcaaatgtgaaaaacagataaaccaatataaaacagctactgaatgaccagcaagtgcagcacattatgcttctcaagtacttatgcaatacaacccaaatgcaaaatcatattgtaattattaatttccacttgcattcacatagcatgtgagtgcatacatcaaaagtttcacagaaatgccaaatgccgacaaattagaactcaaccacctcatttctgactgataacatgtcgtaacacaaaatcaggtcacccttgtttatggctgaagcctgagcagtagaagagtagaactgcttccttttcattaagaagataactgtactaaaaattgtagagacagagatgcaagagcaaacaggatgtcgtttaaaaagcttaggtaccccaatggtttatactttgtaatagaaagccaagagacagatgcatgtttatatggttgcgaaggaatattctagatcttagatgtatgtaaagaaatctgagaccctcaaaagtggcaatcattttagatctagatgttctttagatggtccaaactggtgtaacaagatagatattctaatgcaattgaacactagaaacaaaaactccaaggaccctaatttgcaccagattgtttgttaaaagacatctcatttgttcctggagaatagtgcttaaacttttatagttgtaatcattgatcacaataaaaatccatcaacactactagaagtagataacacaggaggatatactgtcagtttttataacataaatatcatttgatcctttaaaactacaaaaccagaaagatgcaatctgatgcagcaaaccaaaaactctcaaaagcaaacaaatgttagcaactgttgtgacaaacagaaacacaaaaaggttaattcaatgagatagaaagccatacttcgtatatttcaagaagatctgggaggaaatttctctttatggcttctcttgtttgacgatctatatgatgccaagaattgagagcaaccaattcatctctgtccaaatggttcttctgttttgtagaagactgtttcatctgttgcaccaatcgtgcctacagatgaaaagcacagtaagtaaaatggatccataaaaaagtgcacatgatacctaatgctatgcagctcttatttctcattgcacagagtagcaacacactagtatacctcaacatccatgtcaatactcctgaaggcatcccattcaccgacacttgtcctgcagaatgcagaaacgggcagttcctcacctacatgcagaacatagatcggtgtaatatagaaatgaaatgttccctatctctataatagtacatgaaaaatgtaacctgactataatgcctgcattaaatgtcaatgcaattaaagtgcacaactgatcataagtgtttaaggaaaaaagtgacaaacagggaaactggatagcatacagcattctcacgaatccgtacatttttagttaatgacataattcttgttaaagttaacgtgtgcatgctgtaaggaaaaaaaattgtttctcattctaatgtcaacacatagtaaagagtatgcataacatggattttatcttcttcataacttattactactctctaaacagaatgaaacattcaatgacttagtaccccctaaacagaatgaaacattcgatggccaggctgtaagacatgcaatatggtgttaaaaaatgtgagcagcactggatcttaccccatggtggaggagcaaaaaggcctttgatttcttccacatgaagacgggggacaagttcaatgagcaaccggtcattcaaccacctacgagatctccgattactaacctgtgcaacattgcaatctataaaccatcaacccgcatattcttaatgtcaaagataacaacatactgtatcaaatataacagggtttttttttctgagctgctattccatagatcatcatccatttctcataacagggatcaaaccataatttcattcaatcataaaactagcagcaaaggaacaaaatcacttttttattttccctaataggatgagccgcctcaccttggcggccatgtcctcaagaacttcaatcttcctctcaatcatctgcccacgcgacttgacggcatctccacctaagttcacaaaatcgaacaagggttaaaaatcgcttgcgtcaggacgcattggggggcaattcggagatacaaaaaaggaatctacctttggcggagtcgaacaaggaggcgtagaactcctcctccctccgcagcagatccgcgctcgccatgctcgacttccccgtgcttctcgcgatcaattcctctcctccgccggcaaggcaggcctcttgctccgattccgggatgtgcgtgttctagggctaaaattggggaatcgcaaacggtgtcggtgtctcggtgatcgctaggggagggggaatatgcggcggaatcgcggatgcgactgtgcgacctagcagatcgcagtgggccgagaagcccacagttgtggagagcaactagtttgggcctaatgtgatgggcctcccaagcaaatgaaactgaaaaaagtgcaccgaaggtccctcaacttgtcagcgagataaaaaacgtcctccaaccgcaaaaccaccttaactatacaaaaccggtcacccgaggtccttcagcagttttgatcctggttttagtctacgtggcagctgagttagcgtggaccccacgtgggccccacgtgtcagccaaccactctctctctcccctcttctctcacttatctcctctcgggtaagccggggcgggtggggaggaggtcgccggggcggccggcgacgcggcagcggcagcacgaggcgatgcggccggcaacaaggtggcgggagccggggcagcgccgcatccacgatcgcctgccgctgttctcctgccgtcacccggaactccgacgtcggcaaattctaacgacgcccactagctagtctgaccaccatgagcagactccctcaggattccacgaggtagcgagcaaggacctgctcctcctcctcgtcacggcgccggcgccgacggcgcgtgcatcacgctctagtacgtctccaacgtcatcatccacaacatccatgtccacgactgcgtccccgccggcaacgcgaacgtgcgcgcatcgccgacgcactatgggtggcgcacccgctccgatggcgacggcatctcgctctactcggcgcgcgacgtgtgggtggaccactgcgcgctgtcgcggtgcgccgacgggctcatcgacgccatcatggggtcgacggcgatcaccgtgtcgaacagctacttctcgcaccacaacgaggtgatgctgctggggcacagcgacgagtacctgctggactcggcgatgcaggtgaccatcgcgttcaaccacttcgggatccagctcgtgcagcggatgccattgtttgccgtgttcttggcttgttttgcttgtgagttgtgatagcagaagaggggaaaaatgttttttttgtgtgtgtgtgtgttggattggatttcgtctgtttgtttctcattttgtttcccgccgtcgcgtcgccggccacgtcgcctcgtgctccagccgccgcggcgtcgccggccgtcccggcgacctcctccccatccgccctggcttgcccgagaggagagaagggagagagatgggagagaagaggggagagagagtggttggctgacacgtggggcccacatgggtcccacgctgactcagctgccacgtagatcaaaaccgggatcaaaacagccgaaggatctcgggtgatcggttttgtatagtcaagggacctcgcatatctggttttgcggttcaaggacgtttttttatctcgctgataagttgagggacctttggtgcactttttccaatgaaacttgtgacgcctaggcccaaggggataagcatgggtgccccaggactaatggttctttttttggtattctcattcgagatattcttaatttgtttccatccaacaaaaagtatctcaagataccattatctcatggtatcaaatcgtttccgatcgtcggataaaacaatgcacatcctgcccagttagatctaacgattaaaaacgatttgatatcggtaccttacgttattttttattggattgaagcaaatatcttcttacaaagaacactgttctatctatccctataactcatttacctatttgtaatcactttttaatttaatatttaactatttgtcatccatatatcaataacatgtggatcctcatatttatgatatgtatgtccagtgataaatagttaattgccacctataaaattgacaaatataagggctcatatgttgttgatatatgggtgacaaataatttaatatcaaatttacaaatggcaaatagttaaatgtacattaatcacgtccctgcctgatctcttaaaccacctctctttaaatcctgctgattgctggtctcatggatcatcttctctagtgagacaccgattctttgggtctcacgagtcacgtgcgtgggtgtttcttggtgtcaaactcgacctgtgtttgattgctcgaatgtacttagcctggctcgtatgtcttatccaggttgagtttggccttggttggtaaaatgcaataaaatgcaatagagggtgtttggttgtatgcattagatgagcctggtttatctgagatgttgtttagttggttggataagaaaatttatacgcaagagattgtgtttggttgctcgtatgtaccttgaatccaattatgttttttctattgtaagagtataatcctaccaagtatatagaaataataatgtcttaagttcataacacttggggtgagttcttatgaacaatttacaactacagctttctcattctctataaacacgcgctttaaaaccgttaaacatcagcgatacgttttatgtaaaaaccttatatataaaagattcctttagaaaaattcaaataaacctattatgtcttagtttcagttcccaacaaacatacaagctgaactgctcggtcgaactcgaacccagcctatacgactgtcatttctgaagccaagcaatacgaagctttgtttgaggctttgagctgctacatgaatggatccccaacgatagcgcataacaaaagatctactagtatcagtcacacgataatagcattctgaagctgtcgctattaaaagtcgttgttgccactcgaatggaaccatattctatgaacgtttcctcctcaattatccgcaaaacagaaatcacgtgtgtttgtctcagttcgtcctctcctctcctatttttctgttctacaagccctgtgctggcgcgtcaaaatatccttgcagtcttaggctaaatttagttctaaactttttctttaaacttccaactttttcattacatttacacaaataaactttcaacttttccgtcaatcgttccaattttaatcaaacttccaattttgacatgaactaaacacatccttacacgaagtaccactgttttactttgttttggatgactagatgatttgtgatgattatctaatggtaggaacgaattggttaactattatacttttttaaaaaataatgtattgaaagtttttgaaagcttagcaagcttttcatgagaatagaacagcaggctggctgacccgttcgcggaagatggaagacgacgttgccgtccatcccaacacgcaacgccgccggccgcaacgcgccggtttccggtccgatccgcttcacacccaccacgtctgcaggccagccgcacgacgcaagcaaaagaaaaaaaaaacaaacagaccggataagattacctactactctcttagaaatacgaatctaaactataaaccttatttttttcttataaaaatataatattttacattaatttccgttagcacgttttcaaactatataagttttgtgtgaaaaatttctatataagctttaaaatacatccattcgtcaagtttgtcataattaaaatttaattaattatactacatgtcaatagttttttcgttttacgtgcactaacttaatctgcgtctttactagttttaaacatcatttatttgttccactaatatcgtttagatttataattttaagaatgcaaactagttataagtaagacgaagggagtaagagttatatgtctttcccaaacagctaaaaaaaggccgaaaaacagcggagatttctatggaattcgtctagaaagctgcgaatcttcccttaggattcgcttatccttgccaaatcctctccaaattcaaagcatcacttatttttttttttaaaaaaaacggcaaacacgagtccatgagaccacgagtgacgacgagtagtcctccacccctacgcctcgccttctcctctcttcttttcccacgcaaacgccggagacagaggaggagacaagagtccaagaccaatgcgaggcaacggcagggggcgggaggaggaggggaactccccaatgggccgccggttgcgggccgtctcggcccacctcctgccgccggcgtccaccaccaccaccaccggcggcgttgacctcgccgccaaccccaccgccggcgagtacgcgcacggtatgtcgtatcttcagtcccgtgtggtgatgcccgcgattcggatctctttggggttggattcccagctggtcgagcagactagcacttttgcttttagataataatctaaaattgtttctgattcccaaacggtggtggtaatacgcgtcgcaacactgtgttcatcggatttagttatggtcgtgtggagaggtttcgcttttctgaatttgtgctgccgagtccgcgcatcagttccatacttccgttgcttagctcggtagtatccttctcgctattggattagagtaatcgcttctaaagctccctttatatatctaaaaaattaaaaatatttagagtattcgcttgtgtgctgaataaaggtaaaagggatgaggccttttcttcctttttttagtatgccggcacacgaaagttgtggacttgtggattccccaactactgcatgtttgatttatctttcttgacaaaacagcctttttttagtttgtaactcaatgtcatagcttctccagtgcagggctacagtgctgtgctccctgagaagttgcagaccgggaagtggaatgtataccggtaggttatttatatttttggctgcatttgcttatgttgcagctcacaattgctgtttccaatcttgcaggaatgcgaagacacctcttaggttaatagatagattccctgatacccctgatattgcaacgcttcatgataatttcgtgtaagaatcctcgaaatctcatttgagcatccggcttttatttcttaatattattctcaacttggcgaagtctcagttatttacaaaatgttatgctatgatttatcaaattcttgttttgaattgtcagcaaacatgtgagtgcacaaacatagagttaagcaaaatgaacgctagttctgttttccctaggatgaattgtatcaggaggattcttaggaaaatctgattacataaaaagaattattggcaagggaagctgttctttaagctattttattgaaaccttggagccggaaaatgtttgtatctataagggaaaagtgagttaacctttatctattgttagatccacagcctgaatgcagatggtttttatctgatggttttatgaaagctgataaatttagatctgttgcaggctacatgctttacaagaaaattattattcttcaaatttaagttctgtgctaagttctgaggcaatataccccaaattgcgcaggtatgcagttgagacctttagggactgtagatacctgggcacaagaatctgcgctgatggaacagttggggagtaaggattagttcctggatatatgtgttattattggcttttgtagctttgttcaaatcttttaaatgatatatgtatggaactttgcagctacaaatggatgacatatggagaagctagtacaaacaggactgcaataggttctggtcttatttatcatggaatacctgaagtgagtcataatggtcgcaacaagtaccgtccttctttttttaactagtagcaggcagatcttgtcacacatggacaatgatataacatttgtatttacacttagagagtcccttttttttttaacttgctttattttttttaactctgaaccagggtgcatgcattggtttgtattttataaacagacctgagtggatcatagttgatcatgcctgtgcagcatattcattcgtgtctgtgccactttatgacactcttggtatgcactattcaccaaatgatcatctatatccttatcattcatctagcaacaatatttatgtaatctgcaggtccagatgcagttcagttcattgtcaaccatgcgacagtagaagctattttctgtgtgcctcaaacactaagcactgtgagctttaaccccttatctcagccttgtatagttattagtttatacaatcattaaaatttgcacttttcatgtcactggtaccagccattaactactgaaggtggcaagtagctagttatttccaggaaatagatctgtgctttcaggtgctgatctcatcctgctatgaacacacaatgtcaaaagactgcacactgcataaactgcatgctcatcatactgtttgttcttaaccatatccacatacgcacatgatcaatgggctgagcgctgggccctgaccatgaaatatgtttatgtggattctgatccttgtttcaaacactacatcagtttgtacctttaatttaatcatgatatattctttggaatgaagtatttttatgtttgcttatgtatatgtctctatttattgcagctgttaagctttataactcaaatgccatgtgttcgccttatagtggtaagttcgaaccatttataattagtatgttcaatcgagcagtcatgattttttaagaatctttgttctgttttttttttcttaacttgttttgtataggtaattggtggagacaatgcaaatatgccatctaccccaacatctactggagtggaaattataatttactccagactactcaaccaggtgaatttgctacatgatccttcagtttttgaaaactatattgtactaccttcatctcaaaatataagaacttttggggttgaacaagggtattaaggaagtatgtggagttaaatggcagaaggttttgattgatcgaaaagaggaagtagatggataaattaaatgagggaagattgcgattggttgaaaaaagaacgtaggtggagaagttgctatattttgggacaaacttagaatgctaaaagttgctatatttttggatagagggagtatatgggatactagtcttaacacctcatatagttttagagatgtctgcaccagatgagtttactaacactatatattgttcattgtatttgttctattccacgcaaaaaatgtatttgttctccaatttcagtcaaccgaatcaaactgcataccagttgactgcactccgtcatgtatgttgctctgattaaatttagacttgttccaaatgatttatccatatcagacaaagttgatgtggcatctagtttccacttatatttgtgtgagcagtgtgcctacgttttcatttttctttcttatggacacacatagtatgtgcattctgtacatattgtctttttaagttttgcgtcaaatgcctgcatatctgtatccagtcatatacataatctttggtgttagattgaaggttgctagcacttttgctcactatttttccatcgcttttgaatcttcaactcagggaaagatgagttctagaccttttcgtcctccaaaacctgaagatgttgccactatttgttacactagtggcacaaccggcacaccaaaggtaaataacccatgtttctgattattctttgctccattcaaagggcctttctaattcgacctttcaatcttgtggcacttgatgtcatatttccagggagttgttctttctcataggaacttaatcgcaaatgtagcaggatcaagtgtggtcattaagttttacccatctgatgtgtgaggagtttacattaaatctagattcatatctttctgctataacttaataaatttatatcatctctaaatgtttttgatagtagtcatgttgatatctctccacaggtacatctcatatctacctttagctcacatctatgagagagttaaccagattgcactgcttcactatggagttgccattggattctaccaaggggtatgcagatccaaaaccattcaggatgttaatttggtagttctttgcatttgctgtttgtgtaaataatagaacatgtagaacaatggagtttctgacttagaaaaggtatatatcaataaccggggccaggtgcacatgaaataaaccacttggaaaagcaattggtaatgctagttctcctgtaactgtaagttacccctagacataggagcagaattggatcaggtagtgcaatatttctaactgttagataagaatcatccagagatcaattgaacacagcagatttcgacagtctaatgtcgtttatataacagttctgaagtctgaactttctactcttcttaatacaatttcggttggttgagtttcggccgacccggctaaaaaattgaacacaatagatgcattttatgctggacctttcacctacaagatatcatcccattatagtagttgttatggcatccttgtcttaaatggatccattttgttatctcatgttagtttactgcacctctatgttgctcaccataatccttt

SEQ ID NO: 71330 - DNA, 11104 bp, Oryza sativa
ggcaatgggtgctgagctcactgacctagtgcaaagttctagcttgagtgaggatccaatccgatccgctccgaatcagtccgaagtgaggatatgaaaagggtttgtagatatccgacggatatggattcggttgtgaatatgtagccggatgtggtattggtaatatccggtagatgtggattatccgatagactgttttgtagataatccggtttttatttgactatgcgaccactctattggcactacttaacatcagctagcaaattgtgacttattagttctagtattttatttgtctatacaattggacattatttatggacctgcaatagggctatgtgtcatatgatattatgatatgtgatgtcctgtgtgaattaagtgcttcttttggacaataaacatgataatcagttaatgtgatattgtgatttgtgctgtcatttgtcccatgttgtagatgtgtcatgtgattttattattaagggcttgtgaaatattatatcattattgtcttgatgcatgttgaattgatgactgaatgttatattggtttaatatacatgccaaatctaatgatttgaatctgtttcccagccaagtccgcaccggcttcacaccctttccgacatgcagaacaatccatttcgcatccgcacccgctccgaatctgctttaataatatggtttaggatatagtatgataactatccatccaaattctatccatttcgatgaaacagagaggagaggaggaagaagtggcattgactgccgcacaaacgaaaccacttcgatactgtgaaaaccacctgtttcttcgttgagaggggttgaataccctgttttggagttgaagggtgttagcagagagatacaataattgaggagggtaaaatgtacctattcctattcccatgtaaaatgctgcattgtcactaccatgcctcctcatgccaccacccatgttataaagaaaaacctttaattataaaacttttcaagattatttttacaatgataaactaaaggactctttcggactaaatcctgcgcacacttgttggtttggcaactccacatctcagagggaatttcatgaggtaccaagaggtaccgaaatttccaaagtgaatttcggtaacttctaatacatacaaggatccaaattttagactagaaatagaaaatgtgatatgcctcttaggttctcctcgaggatcataaaatcactcatcttactttgggacattcttacccctgtccatgccatgtgacaccaaatcgatcccagtgcatactaagcccaacagcagcatcgagatcatcatgcctgattgcctgacatcgcacccaagaggtggtctttcctatttggagtattttggtaggtatctcactgtcacatcacatatatacatttgatttgggcggctaattaacgtcgttgtactgtagttgttgttacaatacacaagcaggtggactctctctgagacactgcacattctgaacaattatcatcccaaaaaccacttgatttctttgcacactctctcgatcgatcgcttcttcacctgcgcttcctcctccccttcgcgtagctcacactggtacgcgggacgaagctcggaatgcagcaatggctccactgctcgccgttgccggcgccgcaggaggagcccgtccgggagatggcgcaagcagggccgtcgtagcaggtgaacgattcttgcctctcccggaggaggtcggcgagtcgcattgtcgtcgccggcgacggcggcgttggctgcgtctcctgcggtggtggtggcggcctcagcggctcggccttcaagatggcacccagtgtgggcagcttgcgaggttcaagttgtatcgcatggttgctggagttcgttctgaatgatcttgcaggggtgccatctgatgatgcacaaatcagatgaaaatgaaatgttatttcatatttgaaccaggctgaaatgaagatttggttgggggatgaagttgaatcaaatcaaagactagatatggataaatatctgaatgttatgttcaggcaatgtaacaccctgatttccatgcaaccatgaaagcaaccgtttcagtaaattgatttctgtcaagtcagtcgttttatccaaaaacccaaatgaaatgtcagattcgagttttgaagtttgagtatgcctccgtagtaaaattcatttaaaagccctacataccacgactcgcacaaacaataaaatgctattgatatttgaaacatgcagcagtaaatatttggttggggtaaatcctagaatggaaaaatatgtatcaggatgaagctgaatcaaaccaaagattagatatagacaaaaatctaactgttctgtttctgaattaactttttctttcacacatgtaatatttttcgttacctccattgatactgtagaattcatcctcgcagtcagactctaaccaagggcaagcttcaaagaaaacctcatctctgctgctagctgcacaggtcaatcaagaagttaatactctgaaagctacagagaactaaacagtgaccagcattgaatcagtccaagaacaataatgttcaaaacatgagctgctcaactgcccattggacctggattgtgtgccactaaggaaggatgtgtgcatgcttcctgccctctctaactagaatcatcaagagatgcagagaagtgtcagcaactgatcacctctctctgattatattttttttcggtgcttgatttcttcaggggaccatatcatttctggtgtgaaagacatggatggaatgatctctcttaacgaactgcgtttacattaattatgtcgtgtccgtactttggtactgaaacactcaaatcacaggaaaactgataactgaacttccatcgtcaaaatcactcaaatcacaggaaaactgatagctgaacttccatcgtcaaaatggattttgcaagggatttccatgttcgtgatagccgaaattgatggattgatagataatctgatttttgtgatagctatttgagggtagaaatgtatgaattaactactataaagttgaaaaatgtttcagaaaaatattctctgaattttttctatataattttttttgcacgaaacgcgaagattggaaagcgtgcaacaaaagttcaaaatccaaaatcagaaaaagtagtggattgtcgatcagtactggatcatgtttttgctgaaactagataatcatactttctcttaaacaggaagaaaataaagtgcttggcagcttgtgcttcaggtttgctgatcattggctagtgtgtcaacccagacagatagcactaaactgggcaattagtttccagatttacgcatacattgactatcatcttaattcttaataatatatttggatatcattaaaattcaatgatacttatctacatatcatatgtcatttcagagatcttccactaaaacattgaatttggccataaccactttgtaatggaattgacagatgacatcgattgaaaacgtattgtggtcatggccttatcttctcttttgtgaaacaaaatccagtatatttaaggaaagaaaaacattctacaattgggacatgattatttcaagtccctcagcatgctcaaagtgacactgggataattaattactggagtatcttagatgtagaactgtgataaactactactcgagttaatttgcaccatcttagatatagaactgaacaagcaagctggcggggctttaactttatatatgtccgagcaacagaagcaaatctgacataagaaacacctgaatcaaaatacagtgcaaccatttgtaagccattcaatcaactttttgaaaataagatattacccttttcacaataacaacaatacagtatgatcgctaactcgaaagcacaagtacagatcactaaagccaccgaaactattgcaatagcacaaacattcataaagattcgccaaacaacaacgacgacgatgacgacaacaacaactgcaataacaagaatgcgaagaactccaagatcagaacagaacaaacgtaagaagaacagaagacatttaccatagccagcttctcccaggggcatgttatcatcaggtgccacttgcctgttgttggaaccaacagcaacagtctccacatttgcagcaatcttctccttggattgcaatggagttgaagagcccttcttggccttggaactctttcctctcccaatcagcctcatgcctcccctgcaactcctattcctggatgaatagtagctactgctattttgcaaggtcaaacctgaacatgagttcagaaatgagattgacaatttggagggggagagagagagagagatgattagtttaagtgaggagagaatatactatggggtggtggagtggactaatggggtgtatataaagcaaagcagcagaagagacggatcttgacttggggaattgtgtaaaatcaagggagagagagagagatgcaaattcagataattggtctcattttgagtggcagcttggagaagagatgggatggatggatgcaggatatttatggttgggtagcttgcttgaaagctaatcctgtggaggccagcgaccttgtaaggtggtgctgcaggtctgtaagaactggtgaagaggacagctgatgaaattcaggtcgggtgatgatacattgacgatgttgcaattgtgtgtagaaacttcgtactaccccatcccaaactatagtaacttaaccatatatttagatatatgcttgtctatgtttattgctaaaaattatattttgtgacagaacaaatagatagtcagcggacacatctttcatgtgatatttattttgtggtatgttgttatattttttttcgtattcctgtttgtgtaccatcatttctgcaaaggttgccatcagtccatcgactctgccaagcacacaacaaagcatagtacgtccacatgtcctactgtgactttatattaaaagtaaaacagtataagctgctacagtgtactacttttgttttacttgtcatttatggcattaacacggtcatccacacgtttcttttgaaatcttttctgttcatatatgtatataatcattaaaaatattagctatatgaaagtatttttttcattaaaaatataccaatgttatttactcatatcgattcttaatataacaatattgtttgacatattagtgatttaaggtcttaccattcttttgctgtgaagtaaactgttaaaatcatataatctgacttgactgctcagtagcgtatcaagaagaattagtggtctgaataaactagataaagatataatcccatttacatgtatgtatgacaaaaagttttagtgagaatttcataggagcttccatgatcctattgtcagtagtagtggaggctcgagctcccgtcgctcctatgctagatccaccctgtgactgtttgtagtctaaaacttaaaatagaatgaaactactatgagacagttatgttcacttgtcccactctgagttttgatggtacaaatttagttctccctctatcgcataaagcgtaatttttttgccattggtaaacaaaataagagtgagggtaaaagaccaaaatgtcagcaataccgcagtggtaaataaagggaaattaaggggtatttaaaggataaaatttgtcaatttgtgagcgagaataggcggtaggaaggtagaaatagactatttttgttacaaagtagaggatagcatgaaatgaattcatctttcttcagatactcgtacactaatcatctgtgacgtactagatgattgtcctttgtataaccattattgctttctgcatccaaggggcctgctgcgaggccttggctgtggcagctgcgcagttgcggctacaattgcagccagtgcagccgagcaccccttaaacatctcaaaatgaaaggagcaatactaccaaagtattgtaatctactcaaaaactatataaataattaaaaataaaatatatggacaagaaagggcgaacagcatagcaagaataaaagaaaagcgtcatgcgaaaagtctgcaagatgcaacaaagagagaactgtgaagttcaattagtacttgtatagaagagaagagcactggttacatcaaacatggaacaaaacagaaatttttgaattaggcaataagatgcaaccctataaatgaactaaacaacactaaactttgagtaacagttctcagagtccacagcacacttagcagtgtagtacaaggagtagaatggcaacactgccttgcacagcaacactctttcatagctggttgcttttgctaagctgagctcactgctatgagtggctagaggggcagagctaggacatggcaagcacagaccctgcagcctagccaactctgtctcagaggacaatgagttcttggagacgaagacctccttcacggataggcgacttggcagcaaaatttccactaaatcagcaatgtagccaagtccatcacccaacaatgacagccccccaatatctctctgaagaaccgtacaccagaatttaggatctggattttctttcagaatcgccccgatgatctttgcgccgaagaatgatccgttcagcttcgcggcgatcgattttcctgctgccaccagcctagggttctcctggacatctgtgccggcgaaggcatgcgctttgaagaagaaccagtactctgggcagggcaaaaacttcagtttgataggctgcactgttccaattgtagtgacatgcttgttgctggttgtgactatgatcttgctaccttgtttgccacaactcaggcttttcaggagctcctcaagcatgttcttcttgtgtatgtcaacatcctcgaaaacaatcaagaacctcttgttgaagaaactctgctccagttcatgtagtggatcatctgaatttccaacatctccgatgacatgtttaggccgtagaacaggctttggttcacacatctccatcttgtaggtgtgtgagaaattgaacagcaagattgttgtgaagtggctgcgcaccctagcatcatcacaggcatgctgtactagggtggtcttcccgaccccgatatcgcctagaatcggaagaacaccaagttttcctcttggtagatcatcctcatgcagcaagaagttgatgatcatctcctttttgacatgtcggccgaacatctgcccctcgatgaagatgttggtagctagaggccgatgaatcggctggcaggcctgaaggagcatcatgaactccttgagatcaccacacatgctctgcaagctctcaaccaccctatcaatctcatcaacaccgatgtcgtggcgagacagtatgttcctcacggtgaaagccgcgacgcgcacacgctttgcaggattgaacttggacaaggagaaaggcttgggatctacctcatcgcgattcttgtcatcaagatcaggctccccgcatccgatcgtgtcgagcaagtaacggccttggtatgcgccatcgatgagctccgagagccactcgagggtgccatggttggtgatctgcctccctttggcctcctcaactacgctatggatcttgatcagcatgcggcatatcctctgtaacttgacttcagtgctgtgatctccattgaaattactgacaacaagggatatcactctgccgatcacatcgccaacaattgccgagaagattgcttctgccatcggtgaaagtgtttagcagatggtgtaggaatctctttggaagaagccaacggatgtgtgatgtgtgtggttgaatgtcataacttttgacgaatctaagctggtgataaaagtcaagatgagaaccaataatattatcagcagctggcacataacaatattggcctgaaagagacacaaaagacttgggtgcgtgactgcatgtcataagtcttgctttaattcagagtggttttacagtcctaagcaatgatgatatactccctcgagtcacaaatatgtatcattttagactgtaaaaagtcaataagatgtaactttgatgacttcattcttagcataaatcgaaaaattgttgcataagtttaaaattgtaaaatttttgttacttcaaatgtgatcattttcatatgcacaatacctatattcacagagtgattatatttgaagttaacttatgttagaagcctacaaaattagtaggaaaaagtttggtattctaaacgactctaatataatatcataatcacgaaagtaattccaaatataatagagattttttttgatacatcatgagctgagtgatgactgggtagcctagggaaaattgatttttagaacaaactaaaattcccttggtttattgaaagataacagcagaaggatagtaatggatttttgtcagttaaaagcagaggactgtaaaaagtccaggacttccacaagacagctgacacactacgctgccctaataaattaagtttttagcaaccgaattgaccaggaaccttttttcctccctagaaactgattgcgacgaacattcaattaggcatcagtattagattacaatgacaaaagcaggcagctgcgtagatttgttgtcatcattttagtagaagagacctaaaggacagcaacttggaagtaactgacagggccaccactagtatagtaccagtcaattttttttatttttttatttttttgcctttccatctacatcttgctttgtatacaagcaaacctgtcgcttgcgagcattaatgtcttttaaccccttcgttaagtttttggggctgttatttcttccctgctgcaaatggtaaccaaagatggtgacaaccggtggtctgagtcggagccagcaagaacggattacctaccctccttcccatcgtgttgtccctctcaaccagaagaattggaccttcatgtcgtggctggagatctgtgttgcaacctttcgatctactaacaggaaatactccagcaagaagggcaaagtagggatcttagaactcccatcgtcttcccctagctgccatagccagcactttgtatcttttttgctatccgtgatacggcttgcccaagctgaacttgttggttcctattaccaggggtgcagctggaacaaaaagggaaggggtatcattcgcttgctttactctattttagatcaagtttaagctaatatgagtacctgagtttgaagagtgatgctccgatgcaatatacttgaagtattctactccgagcagaattaatctggatcgtatattttaaaggacaggtaagtaatctcctaatatccttacgagagtggtggccgtgacgttctgcgtgacgctggtggcgcgccacggcgcgacggccatggcggcgttcctgatctgcgcccaggtctggctcgccacgtcgctcctcgccggccaggtgagctagctagctacctacctacatagcttagcctacattccgatgatatatgcatggctgcttaattaactttgcttaaattgatcaatcaacctcaggccttgcttgccagcgcgtttgcaaagaaggatcactacaaggtggcggtgaccaccgcccgcgtgctgcaacttgccatcgtcctcggcgtcgggctgacggccttcctcgccaccggcatgtggttcggcgccggcgttttcaccagcgatgccgccgtcatcagcaccatccacaaaggcgttccggtacgatggtcatcataagcaagaacagattaatcttcagatattagtaaacatttttctcatgaacatatctgacgattgtctccaaatcaatcagttcgtcgttggctcgcagacgataagcacgctggccttcgtcttcgacggcaaatggaggggaatggcatcgattaggataggatagggagagggtgaacagttagataatgacagtttacgataatacccctacgtgaattattatcgctggacaaatatagccctccacatttcttctccaataaaatcgggtgggagtagaactagatctcaaccctacgattaaatacgatcaatggcacggattaatttctactccaagtagaaagcaccggagcgagtctcgagtttgaattgagggggtaccggtggacatattgtgaacatagatgaattgtagctaaaaaatttttcttaactggttcctgggcaccctcccccctcctacctagctttgcccctgcctattacatgtggtcaatgatgtcattgtaacaagatagctttcgtggttggatccaatgacaacatcaagctgagaggcttttacttcctgaatgcattgcctcggagaacctattccatgagatgtaggaagaaaacatgttgagtttgagatgaatatgtgaatgtagtcgatgagcaggacttgtagttttcataaatgttagaatagaattatattcggactcatatcataagcactccgataaataaagaggcaacacctaacgtaagtgcatagggactatagcataggcgaaggaatgacttcctggcagcctaactggtgaaatgtcctagttggggatgagcattgtaatcaatgctgtaaaatcaaagtgtgtctggtccttattctgagatgaacaattggcatttgatattattggttttgatatttgaagattattagcgaatggttttggagatgattgatttgtaggtgatgaacaggaactgctgctgactgtttggaccggtcagatcggagctatgcgtgcagtcagaccggccagcccacggtctgaccagccaactctgtgtcggtttcggtttcggattgtttcgctggatatccgtggataattcatgtttatcacttctagatgggtactatgaatatgcaatactgttgtttgctaacaatgagtcaggttggtgagaacttgtgctcgaatatggtttcttggttgatgcatgtataggtggttttgatgcctcgggtgagtgttgccggtgatgg

SEQ ID NO: 71331 - DNA, 1380 bp, Oryza sativa
aaactaaatagtttaaaatttattgattgtcaaaattttaattgttttatcttgatcttgtataagatatcatgaattatgaacggagaaaaataggagtagttatcgcggagtactatttcttaggtacggggagagaggaatcaagtcggataatgaactattttggctatatttttgtcgaaacatgatttcggcaataataaaagggggtagcgcacgagacctaaaagtggatggatgcagagacaaaggatttagacaggttcaggccctctcaatgagaggtaataccctactcctgtttggggatttgaatccgccgggtgtagtatagatctgacgatcaggttgtctcatgcccctaaagggggctccctgccctccttatataggttagggggcagggttacaagatagaaaccttaaccaagacggtatcggtttcctaaatctactttacaatcttatcaaaccaggactttaggccgttccataatatacagggaaacgtaatacccaagtcatgatctgttacatatttcatatatataagttatcccctataactagtcggataaccatgccgtgtgggtatggggtacccataatcttacagtagcccctgagatcttcacaggcgaaaatataatcttctctcgaactagattactctaaagccgagtgcttcaatcatcttcgccatgggctcccgagtacttttaccaaatctgaagactgtggagggctgaaaaataaagtcaggtgcatcgaatagatgcacctaataggtgtagcccccaactatgtgattagctgaacaaactaaacatataggcaaggaataaattatctaattaaccgagtggtttttgataattatagtcaaccaagtgacttgataccaatatatagcatatgcggcgtgaatccccgaataatatgaaccaagtgatataccgactgcttggcaaaatatgatgcgtacaacctaaaggtgacaacatctttgaaagatcacatagcaaaacaactataaagaagcttgaatgctgggaataaagaaatttccaaagtattgggcatacgccatgcgcacactgctttaacagatgtgcttaagtccctaaaagacacatggtttcaccacttctggaaatatatggcatatatgggataacatccgagcaagtaaactcataaaggatttaccaaccgcctgaaaaatgaccataatatataatcagcctaagccataatattgtcaattaaaatgcacactgacgtggcaaaaagcaatgatattggatccaatcaattgcttgataaacccaaacagcaccttgactatataaaaagtcagcggcgcagctatataaa

SEQ ID NO: 71332 - DNA, 20423 bp, Oryza sativa
cagcagcctgaaaccatgatgatcctatgagattgatagcttcagtcaagagtacattgtaacataataaagatgagcggattcatacctcgagcatgggactgtcttttggaatgttgcatgctagaactatgttcaaacctgtcttcagcactgacaaatgacatgtatataagctttctgtttttcaatatacaactaagaacgtaggccaattgttaacagaaatagtacctaagcgacgggccatgcctgaaccagtgttatcagatgttcctcctagtacagaggtgacactcactccattaccctgcaatgaccatgaagaggtaacatgggagaaatattagtttctgcaatagttatacctcaaatcataagaacacaattactctctaatttttaccggacgagtacttgcagcagcgtatagatggccaaactttgctgtgttgcatccaacccaagcatagatctaaaattaaaaagaaaattcccatatctcaaaatatatatgttgcaaatgttaggaacacagtacacaacaatggcagcagagagagcataacgtgttgcaacaagcatgaggagattcaaacaaaatgatcatcaaaattatacctaaattagatagcactaggccatggttactatcaaaaacattgtacggtgtttccttatataactagcaacggagagcacaagctatgttgaagtgttatttagagatattgaattagtagcataagcatttctttatcatattcatggtgtaaaaaccatctagagcaagcttaaatcgcctgggaaacatgcttaaaagagcatgcttcatgtcctgagttctgccatacaaataaggtaatataaacatactcaaatgtatgctatttccatataatgccattaactacatcagttaaagagtcagctatgcattgatgagtaacattttgatgattaataccaaagccaggaattgagggagctaaccatcagttaaagaaaattcatgttctcaaaacagatatgttgcagatattaggaacatggtacacaataaaggcagcacaaagagcataatatattgcaagcaagtacaacgagaatcaaacaacatgaacattgaaagcttaaatcacatggaaaacaagcttaaaagagcatgcttcatgttctgacatacatgtacaactaagataatgtaaacatattcaatatttacggtattttcatataacgcacatcaacttgtgcaattaagacttaagagtcagatatgcatcacttgactaacattttgctgcaatgccaaagccaggaattggaggagcaaaccaaaaaaaaaaaaaaaagaacatctttattgatcaattatcagcatctctttaatcaattatcacaagcacaactcagatgaactgatcttttttatggagaacttgatccaaacaacatctgaaaactctagaaaaagttgttacctagaacaatttatattttggaattacataacttggaaccaggaaaccatgtttacctgcttagagaaccttattatctgaaaatggaggataacatcatgcaggtcctcagtgaagcaagtaacctgcacacctccctcagatgatggatcacctgaagattcaacttggctgtctgtccgagatgaagaacccaccactaaatctgaaaagcttgttctcagttcctctgaagccataatgtgactctagccctgagataagatcagcacatttgcttagagaagcagacaacatggtctccacaacaaaaattggaaaatgttgtagcagcagtttgcagtgagatggcaactacaagatccatccatgggtgagagataatgaaaatgaagaggtaaagtcatcagattggggtagaatttacaaagcagagcatgatatttacagaaaccttcatagacatgcggctgcttgaattataaacttaaaatttcacactataataaatcataaaaggactaaacatagcaggcccaccagagctcagcccacacatcattgccaccaagaattcagcttccggtgatgtggctgttcattcggtagatatgtttttattgataaatacagtattacttagaaaacaattgagtatgagtagacaccaaatcatttcagtagttaaagagaactatggaaaaaatatggtgactgaacatagacaaacaagttaaggattaattatggagtgtagatgaacagtaagatttgtggccactaataatcagcctagctgatgactaccgagactgcagctacagcctacagcagggaacatgccaacaaggatcatatttaatagttcaaattttattcggacacagtactacaaattacagtaccaatcagaattatccatctaatctattgcacattttgaaactgagttgctccaagattccagttcacacagcaaacccaagttgtaaagatctgttcaacctattcagatgcatcaatgaccaatacatggcgcatgtgtgacataccaaacaccatgaactcatcgtaaacaactgcagctcccatgaacaaggatcaactaaaaaaaaatacactaaatgctactaccacatgatgagtaagggttacttcccaaggatcaactgaagaacactaaatgctccatgcgggttacctcccgaacccacctcggaagttggcaaggatggaaggatggaggatcgccggatcgacagcgacgggggaaaccgccggaccggggtggccggcgcctgcctcctcccgcttagaggctggagcagcggggagacagcgcggggcagagtgactgcaggggaggcggcggcgctgcgcggcggccggcggcgaggcgcgtcacgggaggggaagggggcggcggcggcgagagcgtgtggactccccggagaaggaaaatcgagaggggactgcttcgctcaggcaggaatgggctgggccaacagtgggccgtcgccttcttatgggccaaaatctctttttcttttcccactactgatcacattttccaaaaaaaaaaaacgagaccaaaaatctagtttcttctctctatttatcaaacacttttcgactaaatcaacagtcaaaatcacatgtttatggggttggaacatttttttttgcaatgaaaacaaagcaatatccttataattgaaaaaaaaaaagtacttttagcacaaatactctataatatgaaacaagagaattatactaaggttaaggatacaaacacatgtagtcagaaaaaaaaaagatcaaactaaaaattgtgtggtgggtttatactaaaggtgtagcctttttgtattatgcaattttagactaaacgttatacaaattaaggtgactaataaatatggggaaaaaaatgtcagcttttgtattataaaacaaaatgctgatagctcgacaggttccactggacactaactggagtagaaagatgcaagtaatcgcagtagtactggtattaatctacacaactggtattgaactattgacaagcttgcgatcgaatgtatctgattcacagcaactaagatgtaaatgactatgccgtgcttttccgatgtacaatgctacactggaaagtgcaaaagctaacaagacatgaatatgatcttgagttgttgaccagcatcagcaagcagtttcagcagccaagtatagatactgttgcaatcttctgggcgccgcgcttagagcgagtggaggtgcttggccttgtcgatggcctccctgatcttccgcgtgggctcctcgtagagcatcgccgggtcgtcgaaccgcgcggcgaggctgggctcgccgaggaacgcacggaaggtgtcggccactgagctggacagcgactccaggttgtagccgccctccaggaagaagacgcaccgcccgccgcacagctccgccgccacctcccggatcctcgccgccagcatgtagaacgtccccgtcgtgaactgcagccccgccagcgggtccagcgcgtgcgcgtcgtacctgcaaaaacaacatgatggatgttagtaatcacttcttttctgcttctatagcttggtgaattgtttggcagcatcaagattcaggtgatgtgtttctatgcacaaacaatgcaggatcatgtcaacttatttcagcatgtttagcgtggttctgttaggattggtgatttggaggcgtcaagattcagaagctatgcacagaaattcattcgggatcatgtcgatatcttttcggtatggttttttgattcaggatctttggttcttttcggcttggtgaaataattggcagcattaagattcagaagctatgtacaaaaattcattcaggatcatgtgaacctgtttcagcatggttctattctgaaagatgaaatgtgggaggaatgaacctacccggctgaaacgaggatgatgtcaggtttgaaccgctgggcagctggggcaataacctcatcaaacgcgcacctcatcgcgtaatcgcctgagccaccgggtagtggcaggttgagcgtcgtgccctcgccgttgccctggccaacttggtggatcttaccggtgccaggatagcttccaagctacatacaccaattcattgtaatgttgttgcaagcccagattatttttcctgcactagatttgtaaggtgacaagttttaaagatgaggtaacaaacctgatgagttgagaggaagaatatgtccggatcctcataaaaggcgtcacatgtgccgttaccgtggtgaacatcaaaatctattatcatgacccgctttaaaccatgttgattctgagcataccgagctgccactgcaatgttcccaaagacacagaagcccatgggaccttcaggaacagcatgatgtcctggtggccttactaaggcaaagccgagcggtggcttcgggcccaactttgatgctgcaacctaggaaaacatagaacatttctcgggaaatgggcactgcaaaggaaaatatactgaaccataaaatacaagcaagaaaagtaaagaagataaaacatcaactgagaaaaaactcgttaccactgaatcaaccaatgtaattccagcaccagcagaaaggagacattcttggaaagtctgtgaagaaaaataaattatttaaagagaggcgatatgtaaactctcataattcgagttctagtattttccatcgacaaaagaagtaaagatggaagcattcttgagtagtaatccaaatacacatatggtggaagtattttgttataaagagatctggttatctggtacacaatatgaactatggtttgccctaatgtgagttttagcctgcagtagaaggtattagaataactgagttgccaagtgtagaagccctgcagctgttcctataaaattggatgaaccacttgaactaattgtttttgccattcatctcatgagtccctgaataatttgaggaatgaattttattccattttataaagggctttctggggttttacttgatttgatacaaatgaaattagtgcagtaactagtcagtccaggcccattgatcaacatatgaatggtagaaaactagaaatagaagatttaatgatatagctgctgacagactggcaagtgcatcgatgaaataataatgcgcagaagactgtactcaataaccttccaacgagaaaagcattgggggaataaaaacaagagggaatgtgcatagatcattacagtctgggtagcatatgtaggtccagttccttcaatgaatatcaaaccttcatctgaagccctactcatagcctgcaaaaatgaccactctaaacaaaccgttcaaccaaatattatgtaaagaacagctgcataatccaaaaatctgagtggtgcatttttcgaagaaaaatatttcaatccttttatcagtagagaaaaggtaacgtagataagaagcagctgctccattctgttctatccaaaacatgtcaataccaaaaataataccactgtgatgaaaataccttttcaagtccagttatgtatgatcttgaatgaactagtgcaatatcatcaagtgaagcaggttggaaatcttgaatttcaagaacctgtgaaccacgatgctggacacaaaacaaataagatgttatctaagcacggagtaaaacacttatttttcatatgtgaacattttgaatgtccaattcaagagaaacagaaagcatttcttttgtccttttttttaatatgtttatctattggtagttctgtacgcttcagcctagaatgaaagaacatgttttcttaactgatgtgcagtcattttagaaggtacagacagtaaggcctcagttatatagaacattttaaaacttacgaaagggcagtgttattttacttatatataccttcgaagtaagctccagtttttcgagagcatcaactattgcaggaactcttttgttagtttctggatgcgcttcctgcataccagtggataatagcacaatagtgatattgattagatgaggcatcttagcatatcatgactttgcggagcactttctctttcaagcctagtattttgcacacaaaagcatataattatacagtaagatggtaacggaatgtagtctacactaaaaataaagaatgcagagaaattacagttgtaagacagtaacaattatataggatgcactttctaatcagtactaagttatcagttataaacatttaagtgaagtttggatgcttaagttgctgaatgcagagaagctcatcacacttgaaaaccatatctgaaagctgctctaaattaaagcattgaaatgagcttaccttgttatgacccatggcaggagatgtacaatagagaatatgagcatcacgaagcaaattgtcaggcaaagctaagtcttttcgaacaccatttgtgtctgaaatagaagttccattatggcttggtaagcagtatgcaatccaacacccattatgcttctgttttcttccagtaatttgtaagcttctccaggttaagggatgatgacttccaaagccacagtagtgcctgagcataggcaatatccttcctaaaataaaaagagtcagtgcccaaaatatgttaaacacaaattatacctactgcatttattgagtaaaagcagattagataaatcagtaacacatgagcatagagcagtaaaatacctaaactaagtggaacaaaaatattataccctgaaacaagaaaaaaggactttctgcaacaattatgttatgtcaaaaatagtagattgagaaggaaaccaattcagaaatactgacaaaatggcatttgttctattattaaaatggtccgtgctcattaaggaaaattaaatgaaactaaaaggacagaatcattatagtggtagccaaggacatactcaaatcacttttgcaagtaaaatgtcaataagcaacttatgcaatcagagcaataaagcatgagaactcttttaggctgcaatagcgacgacataagattgtgaatccaccacctaagtttgagtgtaatttcaacctcaaatttcacgtttgtgggaaataagccatatcttgtcttatctaaaaaaacaagatattgttcaaaccatttgtttactgtaatatgtttggcccaaaagactaatcaaacaacataacccactggaatctagtttatatgagtgtgggactaatcataagcaagtggaatgctgactgcaaacaaagtgacgaattacgatgccacaaaacgaaaccaaggcatctctcaagtagatacacacataccaccttggcagttggcgatttctttcgttcgagcaattcagtaaatgtgcatgtacgtccctgacctatatccatgcataccgtactgattaacttggattagtcgattgttcaaataaagaaggaaaaaagaagtcattcagtgcacctaggcatttccacaaacagatggtggacacggctgaaatctaataaagacaccattggcagctcaagaaatatgaatcggcaagtgatgtacccaagaacgaggtagtttcacctacctccaagaatcggaagcgatggcacccacagctgttccatcccctcctgcaaacctccagggatctatctctctctcccttcctcactgaatcccctctcctctaccacctctttgcttggttctttcctcttaatcggaaaaagaaaatacaaaacaagggaaattatctcttcaacgagtagcttggtccatgaaacaccacaggatttcacccccaagctttcgctatcttctcgtgttcttttctagcgaaaacaacggcattttttcccttttttttttgagaggcgcaaaattctccaaatgagcagccactacattgggccggatcggtcatcccaagcccactgcggcccatatggaccgattggagaaatgggccgaatcatccggcccgtttgcgacgaatccctcctcttctagaaggaaagaagccgacgccgccatgggcgtcctcttcttgttggctcgccgcgtgcgtgtcaactccgagacgcaactttgatccgagcggcggcggcggcggcggcgggaggaggaggagatggcgcagcagagcaaggagccgtgcaagaaggaggcgtgcgacatccaggcctgcctctccaagaacatgttcgattccaagaagtacgtacgcggcagtgtcctccatctccaagcttttcttctttttagttcttttagtccattctgatgattgcaatgcgatattgttggatacctctcgatttcttggatgcggctgtaaggaatttgatgaggtcttgggatatttaggtgggttgccgacgcattgactaggttttgtgggggactggaagaggcatggggaatcatcggattagggcttagtggctatctcgatctaatgttaggtttatggattcctagtatttaccagctgccaggacagtgtcagggcgcaggagttgggctttgttgttggggaagttgtgggtgatgcttatgggtggtggtcgtggcagcaagatgatgcttgcttccaggtgtttggtgaagcaagctgatttagttggtccgcttgttcaatcatgcgataagtttctgttattctgaatatatccagcaagatgatacagtattatttctgaatatatccagcatgtggccctgtgtgccttcaggaaatgagttactgttactctgttagtcagtttcataggtgcccggatgggctagcctttcaatcttaaactgctaatctgtcgcaatttgagcatgaatcggggcttttctcctgtttactgttcacggatgtgaattccataatattgtttattggattgaaatacattagaattgtctgtgaaattcaccgttagttattcatgactagcaatcttggatgctaatagcatctatctgtcataaagaaatttctagtctaggatggatgttaaaatcttgtgtttcctctattggaccttgctgttatattttaatacacatattacacatgctgttgattgatatgtacaaagagtacattagcatcaatttatcataatttcccctgctttaatttttattgtggtgtgattcctttcattatcgtgttcactacatatatggataaagcattgggtttttgtcattgtttatgaccatacaactggaacctttggctttttaccattttgctatactataccaaacattaatccgttgctaggaacctagaacaatagcaatgaactatttactgtttttattgtctaaagttgattggagttagtatgattgaacatttaaacggtgctgcaaggtaatattgtgtgtatgattttagaatcaccttactgtgtaagttaatgggatatatatgactcagcttgttatttatgcttgtttctttcccagatgtgtgagagttatccaattacttcaatcctgctgtgagcagtgcgagtacaaatcaacacactgcggttctttgactggattattgaaaaacatttccaagtgatgaaacaatacagacatgtttctctgcagctgtcaaataaaagtatgctttatttctgttcttaccatattgtttttataaactgtagttggttccacttggtcagattgggaaggcagatcaacctcatactagcattgacttttcttttgatactggacaagcattatctcaaccatgccatacactccactaactgctctatacaaaacgctgtgctaattttcgttacccatatagttatttttgccatttatatattgagtgcaattgtattttagttgacagataattttcttttacaggttcttttaggtttgcttaggattgagagtgataaccgagtttcttatgcatcatggtacagtacagactatacttccatttagcttttttattgtgtcctttttacctgaacctatctattgagttccatttgattctattatgatgagagtcacatgctcctctgtttgattagctgaattattatttttttccaacataccagatgactcagggggaagtaacaaacccgtcctcagcctgaagaagatgaatggtgttcttatggctgagttgttttgtgcttaatcggtcaacagatagacgctactttaagatagataccagtacccctaattccttgtatatgtggtgcccttcatactacatgctcttgtagacatgtgatctcatgttcccttcaaagtataataagtgttcacctggaatttcattaatgcacattatgatggtgtaagttttttcagtgcgctgttttttatccttacaatatcttctacagtaataaagttaagtttaggcgaacatcatacataaagaaggtttaaaataaaacagttagtttttttctcgacctgcctttcaatcatctcaaaaaattatcctgttaagattgtttttgttagataactgttaagattgttaggtatgctgtcaagaagataatctgtgaaattatatgaacttgtgaagtcacaatcccattgcttagcatttatggctagtttcaggtcatttgtaagtactctagttgagggattgaagtattctgccatgttatctactgtgtattgcataaccaacaaccatatcttctgaaagtgtgctcttttatcttttgtgatgctacctaccaagtgagtgcagattggtatgcaatgacatcaagctgacatgtacactacattctgtacaacaactaattcttgctgtctacttgggaccaaccagtttgttggtatgtcttcacatggccgttccttaatttgctgctaatcttggatagatgccacagtgataatgtagtcaagcattatatatgcacaagagggccatgtatgcatattcagactatcacctgtaacaataaagatcttattcgttaaagctgcttcttttttcttttacaacaaattagcgacatctaaacggctgaaagctaaagttatcccctcttttgttcacttttacttgaccaaatcgattgcattaaacacattttgacgactattgttttatcatagtttgaaatgatactgttgatgtttaccgttgttaagtctgacgagcaatgtgaggttttaaagtttgcacggtgcattcaacggggtcaagtaaatttactgaaggagggaaagtgtgttttatacttttatttctttaaagttgtctgaacttcttttactcgaggaaagctagaactaaagtaagcaccaagatttttttaccttgcctttccaaaatcaaaagcctcctttagtaatagatgtagttttcaagtgaagtcatgaatgcatttcaactatgtgattatgataacccatttaaacatgccaattttctttaatatggattggccactttgatcatcaattttgccatgatttctgtaacttgtagtgtgcaatcatgcatttatgtgtgaactttaagctttaggaccagtattcgccggagtggtggtcgatgaagtaagtgtcttgcttaccattgacagaataacttgtggttccaacgctgcatctttgaagttgacatggcagttttacccgaaagaatcaacaaaagaggcacaatgaactagatcatcatgcgtagtcctgagaatcaacaaaagattcagacaagaaacccaatgggttccttcatttcagtatgttcttcggcagctaaaatcaagtagtatcaaacagacgccaaatccaatggcattacaaaaaagacgagcgggatcagagagtatcagaccctgaacattcatcagacaaacaaaagagacaaaaccctgaaggcctgaacattcatcagaaaatcaaaagtagagaagaagaagaagaaaaaagaaaagaatcatagccattaactatgagtcaaactctggattctggtaggatgaaaaatgtatagatcgatcgatatatacacctggtatatcatgcatgcaatcatctactgcttcttctgactgtcaatcagaattttcagattggtggtgcctttcttgatgcagcattggatttgtgagccaagaagagctttttgagcagcttcagcatcatcagcaagctcagccgcctccgccggaccacgctgccggaggccaccgccgccgccgcggcggcatggcggcgcatttcgggggtgccgtcgccggcgagccacgcctccttggtccactccttgctcagcgggcacggcgccgccgccgccgcccgggagagctcctcgttgaagtcctcccacagcatgtccatcgtcttggtctcctcgccgccggcgaacctcgccgagacattgccgcagccgccgtcgtcgtagcaatagtaccagccgcctctcaccgtgccttcttcctcccccttctcgacggccgagaagctcctccggtgatcgtacaccaccgcgtcgacgacaacgccgccgccaaaccacggcggcggggtggcgaagtgaggggagaaaggcggcttcttgccggcgttgcatcgctccggtgcgacgctggggaacgtgaactcctccatggccgcaaagctgaaaccttgcattgctctctctctctctctactctgaactctaaagtctgaactatcaaatggaagcctctatctgtcttcttttttctacctcaagaaatggctagagagagaaagggagaggaggaagagagagaaggtgatatggttttcttaagctcccaagctcaagtgatggttggcaaatggaagtattattatacaacaatatttgtggtggttggtaagatgctttgggtgattagattggtccatcagagagatgccaagcaggaaagcactaagaggcaggacctaataacattattaatgtttaattaaaaggtcattatatacagctaaagtccaagggctaaagcttactcccatatcaaatggaatgacctcctaaacagtgtccagttcagacataacagagcccaatagtttaatgttctagaaagagatagccttaatagtttaaggtgtaacttctggtgttaaggaatataaagatgcaattctgaaccaatcaatcagtagtagcattcagcaaggcaaatgtaaacaattgattagctgttgtaatgttttgtatggtgattatattcaaaagcaaagtcaagctgtgagttgttttgaatggttttggagggaggatggaagagcatagaagcatcaagcagcagacaggcagtgcttttgcagcctgtgcctttctgctaaagaacagtttctgaaaaatgttgcttgcaaattcaagaactcatctctccctttcttcctctactttttttttgcaaaagaaagagtaaagacggctgcagtggccttgtcagcatatgaggtggcagtagctttcagtgctgggggttgccacctgttagccgttggtccagactattcaaaaatgtcaatgtgaaactaccatatactcaaatttagttaaggggtgaaaagtttttacgtctcacatcggatatacggacacacatttaaagtattaaacgtagactaataacaaaacaaattacagatttcgtctgtaaactgcgagacaaatttattaagcctaactaatctgtcattagtaaatgtttactgtagcacaatattgtcaaatcataaagcaattaaacttaaaagattcattttgcaatttacaccaaatctatgtaattaattttttctatatttaatatttcatgtatgtgtccaaacattcgatgtgacagaatgaaatcgacagacaaaaaaaaggaaagtgttttaaataagcaatatgaaacttaatctagtccttgtcaactactggagtactatagtaacacatgtagtggacttgctgttggctggtttggctcaacgtactccgttgaaagcgagatttcagtaccgttgtgcttcgtctggctgtttgttaggtgcagtgtttttttctctttcggagcttagtgtttagaagttcaaaatgtgttggctcttgagttgagcgagcaactgagcatatatcgtttcttgcatttgtctgaagctagagagctgtctcgatctgatctttctgtaaatcaactttgcgcagaggttgtctgatcaatctatagagcttcctctgcagattacagtactagtacgtactagtgtcagatactctttctgttttataattcttgacacggttattaataatattaaaaatatttagtgtaaaggcaacatctatagatttatttcatgtcctacttcctctgtttcatattataagactttctagcattatccacatttatataaatgttaatgaatctaggtgtatatatatatatatatatatatatatataacctgaaacggagataatataatatatatttattatataatagaaaaaatatggtcaaaatatattttggatattgtatcattgtttaaagtataacaaattatgaaacaggagagagtaagagataacaccaaccaaatcagacagacaaatccatccaactggtaatcaaccaaccaaatcgttggcgaagaactgtgacagagaaaaactggctgggccttttcggcccagaatgcacgttcgacgtagcccaattccggccccaacatttatgggccgaacgttacgacccgatccgggccaacatttatgggccgcacgtactctgcactaccttttccggcccaatatacagtgtggccgctcgtaagccgctgtatagttttggcccactatgtatggcctgggccgcacttacgccactacatatgggccgcaacctttccgggcccaaaattcatggcccatttcactcctgcctcgtcttcccctcttcctctttgtactggcggactcgagggcggccgggagctcgccgtcgccgtcgccgcggcggcggtggcggttagcacgcggcagattcgaggctgaggcgacgaactccggcggcccccagccccccacggcggatgcagtgtaggagcacgtatcaagtttggaggagttgcaggcttgcagtttcttcgaggaggttagtcaattcgatatttcgatcccttgccaccattgttggttcctaggtttctttattacccttgtttgattctgaaatctgaattcaagaagggctggacggaatttcatagttactataaaaatagtcttagtctgaatcacatgggaatgcaaatcggctgtaattcgcgttttcatattgcattggctgagtctaaaactgaaattattttgatcggttagtagtaagtgtccgatcagttcatctgtacactgtaactagaaaaggcaaataaagatcaatcaactgcagaaaatgaccaatttaagacaattcagttactgagttagttgcctggatattcgtttttataaggatcatgactcagataaactgacacccatcaatataattatataatcttttcaaattgttgtgtttactctgacaaatttctcagtattttttactcatgtgcatccactgttcaatactgacaatatgaaattcgtatatcgtgggcattcatctaaccattcgtcactgcaatttaaaaacacttacacttagctccaaaccagtggattagctaatcacactagcaaattaagaaatcttaattcggcaagcttccgtgatgatgccatctagctaaagtcctgcaagagagacagaaaacgttcttgtttcagtactactacatgtacttataaatagaagcatgtaatcagcactgctctgcttgctttgagaaaagttattatattaatactctttcacagagctcgaacagggtgagctcatcgagattatagctaaattattcacaaggtccttttctgctaggcttttgccacagtgcattgcacctggacaacaagcttggttgttgtcactgttttagcattcagatcatacctggagtggagccatagccacttaggagtgaaagattaatcaacaaacttaaataatactaatgttgtgcttgaactataatccaaaggtgattgcttgagggtttgagtttgacaaatgcttatcgagacccaaaacaccaatctagctagctggagtgcggaagttaggataatattgtagcctgatgagacttgagagagagagagagagtctacatggagtacaaaagatgactttttctccgtctcctctccttcaaacacggcctgtctctgacgcaaaaacaaagacaaattggtacctttgccttcttttttttccctttagctttattccttgcctacttgggtggtgtttggatccagggacttaactttagtccctgtctttagacactaatttagagtattaaatatagactacttacaaaactaattacataaatgaaagctaattcgcgagacaaattttttaagcctaattaatctataattagataatgtttactgtagcatcacataggctaatcatggattaattaggctcaatagattcatctcgcaaattagtccaagattatggatgggtttttattaatagtctatatttaatatttataactaatatccaaacattcgatgtgatagggacttaaaagttttagtcctatctaaacagggtcttggtacgatcatcttccttgttttctaccagtatatgatgatgttggaccaatcctttgcattcagtaacattcacattcagctgcaaactactttatggtctattgcacactggagaccatgttagctttgatgcagtaacctctaaaatttaatccatctaagaaaaggtcaaaatttcagaagaattaattctgcagcaaataggtgtaaaagtattggactgaactcttggtgcaagcaaacacaatggaccagtccaagtctgaaactgatgcagatgcaacccagagagggctccaggacctgaatgagaagctgcaggtaaacttcagaacacaggtatggacagaagaaatagatcttggaacgagtgagaggcaaatggaggtgagctgaagtccattcaaagtctcctcgtcaagtgtgtggggtaggccagatgagatgaaaggaacagcataggatgagatgtgatcattcactcccaattccaaccttccactttcctaacctccaaattccacactaagcacagcttttatttgttttacattcttttgattcaggggtgttggtaatggacggctaaagcgtccacatgaaacatttgaaaattttccattcatggtttatttggaacacatgattttttttcttattttttctttagaaaatgaaaatgtaaaatttgatggaaattatgtaaaattcgcacttctcttcaattgtatataataatgtgaaatttgaaggaaattatataaagtttgcacatctcttcaattgtatatatattaaatcaaataagaaaacaatgcttgattattcaaatacatatatcctcagttgtatggagtcaaatagaataccaaggcgttcgtgatgacttacagcaattcgaatgtacaatttaattgtggaatagtatgaaatatcaatctttgttaatctagtgaatcaagaattattattctgaaacacaccacaccaaaaacttctatccgcatatctggtgaaaagcccacttggatgaaatttctgaacctgtgaattcctttaatcttctgtttgatcaaccagtacacttgaagacaatttcattctacatgggcttgtatgctcctaactatttctctccctgcctgtatgtgtttgaggtaaagctagataagccaaagccttcgtttggtcaagctcctctgtcatttccaacacgtcgtccttttcccgggcaaaggccccacgattgttacgtagactaactttaatcactttggcacatttcaacaatctcgattacctttcctacttgaatctggtgatcataattttggctagcactagctagtccttttcagaatttgtagaagcttttcttcttcagggaaaaggtaagaatttacagatggttttggtgtagctggtgagctccagcttctttgacccggcatctacaaatggtaattaatacatttatttttcaagtctcagtttgatggtctgggagggatcctctatttcgtctgcattaatttcagagaatgacatgtctgcattagtaatagagaatggcatgtgttacttcagaataattagctgaaattgaaagtgacagtttttagattgtagtattagtgtattactagtatactattctgcaagatgcaatgtgtttctggatactaactaatctactagtagttttagtgaaacagctttgcagatgttgaatggtgccctcacattgctcaacggcataggattctcttggtacactaataaagcgaaggctagttgcctcttaataaaaatgctaagcttttcttttgaaaaggtactcagaagcaagaacttgttccagaggcagttcaaatactcaaaaagactatttataatttcatgtaccattatcttttttcctgaccattactgtgtttttttaagttgattttaaatactcttaaatcaccaaaaccaaattggacagcaagtatattccagtcagtttgcatatataaaaaattggcatccatggatataactgagaaattaccaacagaaaagatcattttttttctttggaatagtaacataaagaccattcttttgttgtttgaatggtaacagaaagaccattcttcaaagctgccaaagtttccttaaaactcagcctaaatgcaggttctcatcatcactgttctcaacctgctttcttcagtgttttcagctcccctctctcacaggttttggtcactcacacaagatatacgtttcagtcagtcaaccctggaccccaagaggtgtatgtgtgcgagagaaaaaaaaaatcctcctttccttctctctaaaagactggactcccaacgccgaagcactgggagtctgggaggagcaagaagaggagagaagagagccatggccaagaacaccgagagccccaaaacctagggaaagagaggaaaaaatcgattttcttgggtggtggttgagcctgcagtgaagttcatcagggaggaaagggaggggattaagggaaggagatacaggaatcaatgggaggccaagaacaggtggccatggcggagaggaggccttgttactgtcgcaacaatggcttcttgctgctgctggtacaagttctcctcttcttgttcttgtttcttgattcgtccatggtcgccactgccgcgtcggcgccggcaccgctaaatacgactcaggtatcgatcatgaaggagctttctggcttggttactgccagtgccaagtggaacacgagcgattcgaatccatgccgatgggatggagtgagttgctcttctagctccaattccatatcagttgtgaccaaccttactttgtctgggtatggtttgtccaactccaccatatttgcaaccatatgctctcttgacaccttgcaaatccttgatctctctaagaattccttcaccaattcgatagagcaattcttcacctcttcttgctccatgaaggctggattgcggtcacttaatctcagcagcagccagctatccatgcctcttagtaatttctctggttttccccttcttgaggttcttgacttgtccttcaattctttcagtggtgatgtcagaacccagttgagttctttgctcaagctgag

SEQ ID NO: 71333 - DNA, 5768 bp, Oryza sativa
ttggttttgatatttgaagattattagcgaagtggttttggagatgattgatttgtaggtgatgaacaggaactgctgcgactgtttggaccggtcagatcggagctatgcgtgcagtcagaccggccagcccacggtctgaccagccaactctgtgtcggtttcggtttcggattgtttcgctggatatccgtggataattcatgtttatcacttctagatgggtactatgaatatgcaatactgttgtttgctaacaatgagtcaggttggtgagaacttgtgctcgaatatggtttcttggttgatgcatgtataggtggttttgatgcctcgggtgagtgttgccggtgatggatcgggagtcaacttgggagaagatgacgtccggacgatcaggatatcatgcaggatgcttagactaaagatcaatgcacgtggttggtgaagattccatatggcatacgatggagatattgtgtgcgtatgggatgtggagtcgaatttgaaaatagtccaaatttggtataattggagtatgtaaagtttatttcttatacgggaaggttttctatgggattaggacttctagtacaaggttggttcgtggctttaggctacctatctcaggtatataaagagagggagggtgtgtcctcttggtatcgtttttgagagagttgagttgagagaaaagttagggtttcgagtgtagtcgagattttcgtgaagagtgttgttgttgcactttgtaaacacggagagaagtaataaagtttcaatctattttgagagagatcttcgatttgtgtttgctcgggttcggcggtccaaccggcgggacaccgacggtcagactgacagctattggtatttcttaacgacattactagaaatatgaattcccagcaatggtgtggaaatggccctggtatatttatggttacagaagtaatccgcaagcgcacggatatactattgtagcatttcacccggaagtattccaaggtatcgtatttgtttaatcccaatggaagatttataagaaagagaaatctgctaataacttatatatattacatatatatatatatatatatatatatatatatatatatatatatatatcaaagtctaaacatgggttactttaattatatggtagagtgacacgaagcagaaggacttagattctttcatttaaataattctaggctaatgtggaagaagaatagaaaagtaatcattcctttacttctaatatacactcaactttagtttacatttgctagtgtacagttttattgaccaataccccctaacagtgccctcctagggcttcgagagaccaccccgggttgccgagtttcttacgacaacctgtcatggccgtccaactggggctaaatacggagcagtaacctccccagaaaattgtcttaggaatatatattaacgtagaggaatgcccgtactgagctgtcaccatcagcatcccacttctactgtcccgcatcatatatgcccaattaatgatatataataatctaagcaccatgcttatattgtcaaatattactctgtatcctctagaataatatagagcaatcatttgcatgaacattaaacccacaccattgcacctctctggtaggctagtcacacaactatatcaacacaaatacaatgtaaaaccagtactcagataaagtaaagtaccaaaggtatataaagaagaatattctattaattctggaagtcttacaaaataagaaagaaaaactactagagtcataccgaaatcttctgaagactcgaggactccgagaactatcctattctattccacttagcactagagcactaaactaaacttgagatagagatcaaagcttcttgcttgagtgtgtgatggaatgaagaagtgacccctttatatagcctcccaatgacggttatggcagttgaaattgtcagaaatgccccgcaatagtcattgggagtgcatctgaagcgtccacgtggagggacgaactgaacggccactgtcagggttcggccgaacctgggccggcccagtagacctccagatttggtagaggggttgacaggtaagtcctcatggcgtttatgatagttatggcggtatctaggatggttgcacctgacatgtgggcccctttatccttgagcttgcttaggagtgagtttttcttcatttcttcttcatttatgggctaatctctgcaaacaaataatactctaagtacaagtggaaataaattattctaaaataaatatgcattgcaagcatagctaattctcctttattatagttatattgacgatcgaaattagtctatagcgatcatcaacatacattacctttattctatctcttttgatcaaaatattgtgttagtgactatttctataatattgtctggaaagcttaaaaaaacctaataaatgatattacagccgatgggacatatttagggtttgctttacttaattttcaactcacagccgatctggggaaaccaacataggctagatctactattgatacatcatcggcttatcggccaatcatctatcggttatttaactctgttttcttgatttccttgttggttgtaggataaaaccagctggcatgcccttgacccatgaggcaagccttggacctgaacatgagttaaccagatcgcccaagccgccttgttttccgtcaacaaggttttaacgaggaaacagatgcatcacaatattcaaagtgccatgcactcttttctcccacttcttttccactgggtttcaggtggagtttttgacgaggcatgtgcataattcaaattcgtccaaggggggagtgttatgaaaactattttgttctggacaaattaagatattagtgaaaagcttactgcagaaggaggcatacattggaagccagcttccaagagaagccaacttatgacgtaagctggcttatgagagaaggcaacttacgacgtaaacggcgtaaaccaagtcagcttgtaggagaagccagcttagagtgtaagccatcaacttcctccgccaataaataggaccctgaaggcactacttggaaaagcattatcgcaagcggccgaaaacggtcttcacaggcggggcggccgtccgcctgtaagccaatgactgtgaagatcgccgatcttcgcaagcggtgcggccgtccgcctgtgaagataatttttgcgggcggacgttggctagtccggtccgcctgctaaaataggaatcggccgcctgcaaaaaaaaaaattccgcctgcgaagtttggtaggaaatattggaatttaataataatttgctcgtaaattacttttaaattatttaatagaaattcttgccggtagattattatgtacatatattggaagattatcaaacatttggtactgataaatgtacatatattacataactcaaaagtgttgccaaaaatattacaatatttttttacattgtcacttcaaatacgccatctaattaatacattatggcatagcactgttccactcccaaagatccttgaattcgtcacttgtggctagggcaccctctgggtcgatgaaatctcctttcacatggtagcactcatggtggatgaaatcgcacagatcacgctgaacatttctgatgcctgtatcttcaacgcttgttcgacgttctaatcttggcatctgcatgcattgaagataaacaatatattagtatcataaatatgtgaagctgtctagcacatagtatagatacttacatcctttgcgttagtcctgtacctcccattaactctaaggaattcgcaagcgtaatacccacaaaggaccgttccttgcggttgcttgtgacacttcaggacatatcataaaaaaatagttaaaatttgtaattagtgaaacaattggtatacattaagtgagtggagtattaccggccaataggtacgtactagtagcttctcccttggtcggactgttctccaaccttgaacttgtagtactggtacgcactgtacggatgtcggaccctttcacattaaggaggatattacttataatacattcatataaaaatgcaagagtcataatcacttactactgtaagattattagaaattctttgtatgactgttgtttttaatcgggagggtccaagactaccacggttcagtctttagggtggatgagtaaacagatataatgatcgctaaaataagacatatgcgtagaagataaatgtacgggacgtacttaaaattataagctaccatgacgactctcttattttgaaagtgcaagaaagctcgtccaatgtactgtgcgatagtaatcaacttctccttgtgcaagcccttcttgtattcacctatctcttttgcagtcttgcccttcagctggtcagaccctggtgctagcctcacggtatgttgtgtttggcagatccgagttggatctaagaagccgataggtttcttttttcttcttagtatccatgtattgcatcctacagaagaagtttgttagtaacaatcacatggatttgtattgtacatatttttcatataattaattaaaactcatacttacatgcaccaaacaccgacatagttgacgtccatcttatcccgacgatatatggcatggagatctgagaaatctagccatacgtaaccttgttcgccgaaacaatatgccggtgatcgagctgttatattgcccaagcctttcttactggcctccatgtagaaggtatgttaccttctcatctcccatggtccttccttcagtgcccattccggcaagagtgctttcccatgttcgtacttttctgggcaatcatcagttgcgaagtatgttggcccggctagttcagcggccttctgggggtcatcatctctgagcttggcacgttccttaccccctctaaagacagttaccatgaacttctccttgttctcatctttggtcttggagtcgtggctcctaagcactctaggcacctcagaactggtagtggccttctcagggaccgtggtctgttgcacctcggggtctttcgcaggagaagggtcttcaaatatttctggctctgtaccgtcccattccaatcctggtacttcttctatttctgtcccaactgatgccacaaatttcacctctggttcagccactttaatatccatttggacatccggcactgcaatctccatgggcacctccggcacttcaatctccgatggcacttccggcactagattttccttatgcatctaaggttcctccaccttatcagtcaccttcttcttaggaggtcttgaaggttttcccaaccctggttttggcacctcatgttttcgcgtggcgtcggtgcccaatctaaaggatatgttattcttgtgctagagaattacaagatcgatcgcatccccaagtacggatacaccatctgcagtagggaagtcaatgtcataggactcaaacccttcgtggaccacttgcgtctgcactttggcatatgcagcaggtatgaactcttcattatatgttctcccagggatagcaatggctgtagcggcctcaagagtattcccggagcgtccaatgggaacgtgcaatctgcagggtgtattctccttgaggtcatcgaaggggtaatctggctcaggttctttggtttcggggcgaggtaaaagcatgtgcttgacgcggaaa

SEQ ID NO: 71334 - DNA, 1448 bp, Oryza sativa
cctattctatcgtcgatggtagaataaaactatacccgaattatcgtatataaaaccaaacagtctactacaaaatatcggccttaattacccactggacaatacttgaacaagcagaaggttagaataaattcttcccgacttttctccgttgggaggaaaaaaaaattgtaatatccttttaccaaaagttggcaatcgctgcatagtgagaagactcgtatattccatccgcgtttttcatgcagggaggtggagtttcaaactgccgatcaacacagctagtcgggcaagaaagatgaacgttgaagacgagaatctgttaggtaattagtcaaacaactgttcccaaacaaccgactagttgtttgattaactaagtttacaaaagccaatatatatagtctggccagaagttggacactaacaagcttttttcgaccttcattggttacctactaattaattaaataacaagtgaccagcctgttggtggaatagctccctaattttgaaatgtccttagctaagaagtcatcttcctgtccaaaaaaagataagttatgaagtctcttcatgtgaaatgttttctttcgttttactattgatgtttaattatcaagtaaatgctcgcaaagagatcgatcgatgcagacgtgtggttggtaagggatggaatcccctctcctgcaatactatacgcccattacttttttagaaccttatgacttctgacgtgggctctcgattaatttgatcctctgatcacaatcgatcatatcttaattaaatttggataagggggtgaccgttacaacctatctactccacaaattaactattgaaactatggctgaacatcataataagtaactaactaaatcatatcgccgcccattgccccgcgcacgctcactctctcctttttcttttcaaagattcctatttacatgtgccaactctactatatttctatataagacaaatttgttataaatttaatttgttagtggacattataaaaacttatcgtgactagaggacactcaaatagtggtagtttactgcagaatattttcgaaccaattaaagagaattttttttaaagaaaaactcccggggccacgagcttctaacatgacagaaatttgcatatagttgctcccgagcaaacaaattcgctcttgcctctacgatattggccgcacgagcatgcttcatgcccatgaacttacaccatgtgtgggccaagcatattagaaggttagtggaagttcctccagaaaattttgtatattaagtttttttatataccttttaattatgttggaaatttttttaataaaaaattttagttttgaattcgtaatagaatttcttataggaagttctaatccattgtcaagacgagtctcttgtacaatgttttaaaatctctaaaataaaat

SEQ ID NO: 71335 - DNA, 2649 bp, Oryza sativa
ataaaatggaggagaatcgacaataatttgacgatcattcaatcggacgttatcgagaatcaaacatatggatggatgggccaagaactcagaaatgacatgaccaactgagccaaaattcacgagtctgaagtgaggaacagaaaaggaggccatcgaccaaattgtgggccggttgggccacccctgggttcggccgaacctaaccagccgtagcgccaatcgattcaggttttgactagacggctcagatggactccctatgacggttggagggtattaacgacctttccaaccgtcataactcagctataaaaggcattcacctcacttcctccaacacacacctcaagcaagaagaatcaagctctctctctagtttactagtgttctaaagttagtggagtaggaatagaataagagtcttagtcctagaagtcttcggaaggattcaggtatggttctagtagctctactctcttttgtaagacttgtacttttaatagaatattcttctttataatactttggtattgtatatgaataccaactttattatatatccaaattatattgattatgatgctagcttatctgggaaatgcaatggtgtgggtataatgatcgtgtatacgattattctatgtcatgacgatgatattatagtagtatttggtaagttaagcgtggtgtttagattgctggatattattatttggggttatataatgcgaatttgtcgaggtgggctgctaatggtgacagctcagtatgagtattcctccacgtgtatatataatcctaagttactttcctgcggagggtactcctccgtgtttagccccggttggatgattatgacgggttatcgtaagaaactcggcaatcagtgctagcttctcgaagcactaggagggcgttggaaagagggtattagctaagtaatcgtataactaggatgtgtatataatgtgtatgtatattagaagtgtaggaatagattctttctactcttgttgtgtgtcactctaccctatccattatcttaaccactgcttagactttgattattacaagtaaaatataagatattagtatagttctctctattataatctttccacgggattaaacaaatacgatactcttggaatactcttgggtgaaatgctacaatgatatatccatgcgcttgcggatgaattatgtaaccataatataccatgagtatttctacgttattgctaggaattacacttctagtaatgtcgttaacaaataccaacagtcgccttgagtggttggagacagaacagatcatagagtatcattctctcattctttgcttaactcttattccaaaatttttcaaatgattttgcaaataaaatccaagttcctcaaatgattctctcaatcactcgaagtgtatatttattcctcgccaagatattgccttgagcttgcttaggagtgagttttacttcatttcttattcatttatgtgctaatctctgcaaacaaataatactccaagtacaagtggaaatatattattctaaaataaatatgcattgcaagcatattgacggtcgaaactagtctataatgaccgtcaacaacggcatcgcaccgattagaccgacaggaacgtgtcggtcagaccggcggcagcgacaggaggcagaggcgatcgcacggcggttcggctgggagatcaacaccggttagaccagcggcatatgcgcggtcagaccggcggatcaaccccggccagaccgatctacatcggattctagggtaacttttaattccattaaaagtttagattttcggctagtttagttcttgctattcgatcctacaaatgctttaagaatgtaggtttaagatgaacctcgtaacaaaaaaaaccgtattatattatatttatttatttataaataaatgcatgtgcgagatggtgatgagctaaggcaacatttttttcctattgattaggggttaggcagggcagagagtgtgggtggggcgtgggatttggcaagcgaaggggagaaatgcggtgggggaaggggaggcaatctgtcacgcccagaagtttccccctttttccttgctgtaaatatttgttaaataaatcgtctgaagaaattatcttaattaacctagagctaattccataattaataaatgcaattaataatcggaaatagcgtggtggaattgttccccatgctccaatgcattaacaagatttttagtggaattttcagagccttggaaataattttaaccaattaaaaatcaccaaagtgcaattttaaatcccaggaaaaatcctttcttctttttctttttcttttccttcttttttctctattgggccgtcggcccactccctcccgtgctcggcctccttcctttgggccggcccgttcccctttcccctctctccgggacgctgacaggtggggcccacctgtcaggtcgtccccttcctccagccgcccgccccacgacggcaaccgccgccgaaaccgtccacgccgccgccttctccgctccatgccgcgcccccactccacgtccccacgtcgccgccctccccgccattcctgcccgcacgcgcgcccgcaaatgggcggg

SEQ ID NO: 71336 - DNA, 5662 bp, Oryza sativa
  unsure (1)..(5662): unsure at all n locations
ggaaaaatacatttcatatgtactaaaaggcacaaaatggaggagaacggggcttgccagccggccagcttatactgtcgatacggtctggtggtagtatattttgaaatgtccgtgcgcattggattcgtttttagctatgcgaggaaggcgcgcctttttgacagccattgccgttgttaccggtaccggcgcaagtgcagtgccgcacgttggcccacgttgtttggcagctcgtgccgtccccgcgccactgctccaggaatgggcagccttgcgccagcagtttgcaacgcagcgctagctttgaatcgcgcagctgagtgcgtaacgctgaggaaagaaatgaaagcgaaggggattgtggtgggtgatggcatttgtctccaagcaagcccgcaggctcccactgcgcggggcaaggcaagcaggcagcggcaggcaaggcactcggcaagcaagccccttcccttccccgggctttgctctgccagccggtttgtgcagaaaagttagcgcgcacacatgaagaaagcactgtctttaccctgcatgcaactgacaaaatgtggcagaagcattactactgtcccatcgtaccagagaaaaaaaaatgattagcccgttcacaatgcacttgtttgagatatgagaaaaaattgaaatgagagtaccggacatcaaacgagataagccattaacataatattaatcattttaaattttaaaataaattcatataatttttaaagtaaattttaatagattttttccgttcatgaagcgtgtgcgtttcttccctccggcttctctcgaacacttcaaatggcattcaatcccaacctgttggctataagatttctctccacatctgcacctcgtgtgcccctaggaagcccctcgcactaccgcataagagcaagtttaggccatatttagttcgcaccaaactttccacaaactctcaacttttcatcacattacatcacatctaaaactttcctactcacataaactctcaactttccccaaacttctccccaatttcagaaactaaacacggcctaaggcttacatactacactattaataactggtctcacatgtcatacacacacttcgttttggagttcgtgctacagctggctacaaatctatagcccgctgcttctctctctcctcatttatcttattaaaatatgtttgcagctaggttataacctgctattgtacctgctctaaatacgacttccccaaccgcccctcaagccatgtgacgtgttccctcctcccatacacgagtgtatggccgggtttagttcccaactttttcttcaaattttcaactttttcatcacatcaaaactttcatacacacataaatttccaacttttttctttaaacttctaaatttagcgtggaactaaacacaccctttatctctctccgccgagtcgtttcgttcctcacgcatagcccatccatccctcgcaggtgatgacttagggcacccacaatgtggatgaaaagtgggtagtaagaccccttactacctactttaccattgtgaatatggatagtagagcagataataactataccaggcaatagcactactacctggtaacaagcataaaaaaatattaaacttttttttctcactcactctctctcttttttatcccatcattgctttacatgtaggtcatatcttactacccacatattgtatattgtgtgaggtagaaacaactatgagtatgtttagatttatttggaatgacaaatggaaaaagtgttggtggcaaaagttttgacgttgcaaaaatactagttggtgtttagatgcatactaaacttttgctattctagcacttttcggtggagagagagagagataaatagtggtcccaaagcacgttttggcacaatttgctactatggactagcaaatggcaaatgataaattgtcaacttttactagtagtgttagatccaaaatggcaaaaagtgctctaaaatggtaaaattttggaggatctaaaccgggcctataacctagttttgtgagtcccatcttactacccacttgataaatatttattgattatgcccttgggggagggtggaaagaagtacggctaccaggaacataccagtagggaggaggacacatcaacaatgttgcagcctcaccaggagagggtattagggctttttccttgttcttataaataggtcgtttttgtcaaattcgatctcaccaaaggcctatttgtaagaaagaataattgcattttaacattataaaaagaccctcgacgtacatatttttgacgccgatcccttttgtgttagcaacttaccaccatgtatcagcatcgagagatgatctatttttatttttttatatacgcattttcaaaataaaattttaaaacaactaaattataaaatagtcatgcaggatatttcggttggttccgttgccacaattcatccatcttactagtttatactcctcacttatatatatatatatatatgtatatatgtatatatctatatatgtatatatgtatatatgtatatatatatatatatgtatatatgtatatatatatatgtatatatgtatatatatatatatatgtatatatgtatatatatatatatatgtatatatgtatatatatatatgtatatatgtatatatgtatatatatatatgtatatatgtatatatatatatgtatatatgtatatatatatatatatatatatatatatatatatatatatatatatatatatatatatatatatagatctatactcctagggagtacgtactccctctcccatccaccgttcatttgatcgatcagatatgtactccctccctcatcataacgggtttggctcggtggatccgattagtttttctaattaaaagaccggactgcttattccgtaatttggggtttgctcccaacaggccaaacagattatcccgaaaattggggttttggggggcggcgcggcgacggaactgcgcgacgacggaccagcgattcagctttcggggttttgggggtcagcgcggcgacggaccagcgattcagcggcgactgtgtggctggcggcggtacagagatagcagtttgttccttcctccagtgatgactcctccccttcctccagcgatggatcctctctcaacaacatgtgttcctgaagcagaagtaatcgatctagagtcggctgaatgcaggagcggggcaacaatggcaaaatcgatgggccatagcagtggatttcatccaaagcagcaggttagtattcgtttatttttgtacggcaagatcaagacacgttgcctaaaattttcttctttgccgcagggtcacaggaaaattagtttgtcaccacagtccaaggtatgccacctgaaattgaatacatgtatgcctgtagagagggattaggtgtagttcggttcatgtactctctcagtttcagatgctaatttttccccttttagtgcatatgatggttttttgggtggatgaagttaatgctgttttagcccccacccccataaagaaaaatgtagatggtagtacgtactgaattttcaacggtatatactcattttttctttggaggggaactttttggaatctgctagacggtattaagtattgatttttggtgtggcagggttcttactgaactctctggtaagcaatagtatatactgaatttttatgtggggagctttattctctactttattggacgatagcatatactgcattttccacatctatactgaatctttccacagtgattcatagactgaactttgatacgcaccagtatttactgaatttttcatagatatactgaatttttctatgggaggctttgtactgagctttgttatacgacagcatatagtatgtactgaattttgtatgtggtacatactgaacttttctagaagatagcatatactgcatttttccacatatatacagaggcttttccatagtggtttacatactggaccttgttacgaagaagtatatactgcacttttacatagagaggtatatgctgattttttacatacagtaatattctctaaactttgcatatactgactnttctttcagtgcacatgatttttttttaattaagagggtacacataggtagaatttgctacgcagtattttgtacttcatctttccatacatatatgagtgtatgctgttttttttaaaaaatagaagtatatgttgaaattttaaatacactggtccatgtagtattgtctatttatgaaatgaaaaactaattatctgcaggctttgaaggtttctggcacaaggggcagcctaaataagactgctgcacgggtggtatccaggtatcggcaaagcagagttttaaatagacagaagaaagacaacactacctttggtatcaactgcaggtgtcagcccaaatgcgtagtgaatatcattaaagaattcgatgataggaagaaggagttgattggtgaagttgggtttgatggacttttggatatcaagcttactaaggtaaacaggcagtttggtgcatggctactgagcaaagttgatccgaaatcatgcgctattgttaaagatgtcaaccaggagttgccattcggtcctaatgatgtgaatgcagtttttggcttgccatgctcaggtcaacctattatcccttgctctcaagatgaattggatgggaagaaacaaatattgtgcgaaatatttgagataccaaacttttcacacctgaaaatatcactcttagagagaatcctaaagaagcagtatggttatcccatgacaatagatgaaaagagggttttcatggcggcttttgtgctttatgtcacaacgaagcttttggcaccgcaatcctgcgcaaacttcatatctcctaggtatattatggctgtttctgatgttgacaatataaaacagtacaactggtcccaattcgttgtagatgaggtgaagaaagcagcagaatcaatgcccacctgctttccgaataaggctcaactatccattaacgggtgtatcatctttctaatggttagcatttaaaactgacttgttaatgcagcatacaatcaacacacatattgtcattgtgaatcatttttgcaggtaaaatatttgagaaatctccagttccggaaggttgggatcacatgtgttaaaacatgtcacatttctcagtttgaggatgatcaaattgctaggatgattcaacaagatgtagttagtaaacataacccaggattccccttccctcgttatgggaaactccaggtatgtacgataccctggctgtaatatgcctatttctggctgcaaaatttagctaatttccgatatacatgctgttcagttgatgaaggaaccaagagaaaacaaccccatgtgccagagctatctcccctaaacttatgctccggttcgaagatcccatctagagccattgatggcggtaaaaatttaataaaattcctggaatcacacttctcttcgttagacgtacgtggaactgtcgggtcacaggtatgtcaaccatccgtatgctatgttacttg

SEQ ID NO: 71337 - DNA, 9055 bp, Oryza sativa
gcgcaaggacaagggagagccgagaggaagaagaggaagagccaagagtagagagggagaggggaggggagccggcgttgtcagcgtcgttccgcccaccgccgcccacccctccgcccacagccgctcccgccgcccaccgccggccgccgctcccaccgcccaccacccgccacccgccatcgctccacccaccgcccgcaatcgctccgtccaccgcccgccgccgctgcgcccttgtcgctccgcccaccacccgctgccgcttcatttcacgctgctgctgctccgcttcctcccgccgcccgccgtcgctccgtccaccgcccactgccgcgccgcttcgctccgtcgccgctcgcccttctctcctggcaatgtatgggatagagagaagagggaggctgacatgtgggaccacacgggccacaccttttttattaattttttgtgtagctgacatatgggtcccattatttttattattttttcgagataaaattgccacgtaatcgctacgtcaatgccacgtgggacggagacctagtcaaaggctccacgtagacgccatgtcaaccaaaactgccctccatactgccgagggatcttgtttgcccaattttcgtaagttgggggatgggtcgtacccggttttgcggttaagggacgaaaatcagactgaccgacaaatagagggatctaaagtgaacttattccagacgcaaaattgtcggtgctggcccatggaactaaaaccagctcttgggccaaaccaggccaggccgattgtccctcacgccaaaccatcacgtgtgcgcttcgaccttcctccctcgcgatgggacccaccaagttcggcaccgccccattccctctccgcgtcggcgtcccgtctgttcgctacgcacgcactcactcactccccaaattccccaccacattcccccgcgattccctccactccccactcggcagctcgccattccaccaccaccgcgccgccgcggcgcatcgggccatggcgcccgccgccgccgccgcgtgcgccgcctccgtccgcgccgacccgccgggcatcctcgactacggcgccatccacgcctgcctcctgggcggggaccgccgcgcctccctcccggcgctcgcgctcctcctcctcctccacttccgcgtcctcgccgccgccgcggggacccacttctcccccgcggtctcccgcctcgcggcccgcctccgcctctccccgtccatggccgccgtcacgctcctcgcgctcggcaacggcgcccccgatgcgttcgcctccgccgccgcgctcggcggggccggcgggatgcggcgtgcggggctcgccgcgatcctctccgccggagccttcgtctccgcgttcgtcgtcggggccgtcgcgctcatcgccgcgccgttcgctgtcccgcccgcgtcgttcgcccgcgacgtcttcttctacctcctcgccgcctccggcctcttctacatctaccttagcgccgagatatacctctggcaggccatcgggctcgtgctcttctacgtcttcttcgtgggcttagtggtatacatggatttggatgctgaggggaaggcggtgagcaccaccgagctggaggtggtgaatggcattggtcgcgtggtgatggacttgccggtaacagtggaggatcgcaagcaacaacaccctactttgtgcacgatgttcagtaaggtaatgctccaatgagtggctcccgttagtttgttttgtctccactgtggttaatatagtattgagtagtcagggacaagtattctaatataaatagtttctttggtattcatttgaagatggtcgtaaaccgtcaatttgtttatgtgcaactgacaactgtgcaagattgttgacttacccttctagtttgaactcactgactgtattgtactcatttagggtaagctttagtttaatggtccaacttgtttgttatgcttttctatggttcaatttgtacaaacgattctagtatagatagttactttcgaagtgcacttgacttgaaaatacagtactaatgtgaacagtgctataagctgctgattggtttatgttcaagagtgttaacttcaccctggtagtttgcaattactggctgcaatcaacagcgagaaacagattactttatggctagtagaaactttagtagtgagccaatgttcccctgaaaaaatagttgttttatacaatacccatacaattgtagatattaagtagaaacaaacattaaatactttgataactcagtagtacactttgacagaaaggtaactggtaacaatgctgcaattcatggtgtgtttgtgtactttgataattttaagtagattttttcatgatgcaacctattctgatttactatatgcacaggataatgtacttttaacatagatacaattactcagcacactgagtgctaatgtacatttgatataaataggattactcagtgtactgaataatgtatcatgctaaacaagctaagtccttttagctgcaccaacatcatgccttgctgggatcaattcgctatgagtttatttatctgtatgtgattaggcagcttatgataaatattcccatttatagtaatggttgaagttagtaatgtcagctttgctactatgacaagaatgcatcgactactgtattgaatatatacaattgcttaatgatcaaaagatttttaaacttaacagacttgctgattgtttaactttgtttttatgaggaaatcgatggcatgttctggcaaatcctaagttctcatttccaattttttgtgacatttagctccttgtttcttattagactttgctaaaacatgaatattttcctctcggcatctgcattttcatgacactgattgtcatctacccctggcaggtgacaaaagtttgggagtggcctgtagcatttcttcttaagctcacaataccatcaacgcttcctactgaatggaacaaattttatgtttgtgcaaacatctgtctatgtcctctcctactcctgtattctttcagttcattcattccatttgatagccgaatagtatttcttctccctcaaagtcgtttccccatctggtccgtggtgcttttcgtgagcatttctttagccctgtcccacttcatttttgagaaagaagccccaataactgaaaacattgcaagcaccacaatttcctttgtaatgagtgtcttctggatctcaaccatggctggagagctcctgaactgccttgcagcaatcggagtcattatggatttccctccagctatacttggcatgacggtcttggcttgggggaattcggtgggtgacctcgttgctgatgtagctttggcaaagtctggccagccgacaatagccattgctggctgctttgctggtccaatgttcaatatgctggttggactgggaactgcacttgtaatacaaacagccagggtgtaccccaaagcttatgtactcgaattccatgttggaattgttgttgcatttgtatttcttcttttgagcctgatgggcaccctgttgatggtcacctggactaggtttcgggttcccaggttttggggttactgccttatggggctttacatcttgtttacagtagtgagtatagctatagcgagctcttctggatgatacatatttttatacataaatagcagctagtcgtttgcagtatatataagtgtttgcaatttttccagttgctgcagagcaatggttcatttcgatggggatggttcacgaggtgcaagatgcctccaggctgcaatacaacttcttatcttggcagctgatgcatacagcccttcacactgaattggcttgtactggtctggcatgttcctgtggattcttctgtaccttcattttacgagttcatgagttcaggccagaggggagatcttgctggcgatgtgcatcagtgcatgcactgtctactcggttcttttggttgaatcactgcatgtgcggatgtgccgcagcgtacacaagatatcactggatctctttcctgtggccatgttttatttttctcgaaccggtagcctgccgtcgacgttttatataaagaaaaagaaaaaggacctcatttttaaaaggaaaatgggattatggcagagaagtaactcaaagaagaggaccctgcaacccccgaaggagacctccagcgatagagtcgtagaggcatatgcattcgctccgctctcttgcacgcgtcacttctcttctccatatctatccatcgaccatcgcaggctacttcccggtacagttcccctctcctgatctcctctagctcatgccatagtcgccactcgccactgctgcaatggctactgaaaaactaccaatgccacaggccaaaaaccaaaaagtatagcacaggtacactcgaaggatcgacgcgaggtgaggaagttaccgatgcaacggaccaaaagccaaaatctaaccccgctcgcaccagctatgcacccttcgtttctatacgctcgacggactcgacgcccgggacccggccgagaacgggcgaacaacgatcggattcaggatgtctcggggggtcggagagaattagtgctggtttggtttgtggcctaaattagtcttaccaatttttgtcaatgtcaaattttgataacttttggcatagctaattttggcaaaggtaaaattgtgtttggattaaagccaaaatagtctaaattaaccgttgaaatggcctattttcttagtcatgccaaaatttggctccaaaccaaatagacaataaataatattgaaattgccaaatattggtaaggccaatataggcctcaaaccaaaccaacccttaaactccgcctctccatctgacccacataagggcaggcctactttacgtggagcaacctgcatacgcgtgggccggccttactagttactagtctaaggcttaattcggagagcgctacgtgtcggacgtatggcgcgagacgaaaaatcggacgtctcgcgcgaccgtccgatcgatgcacaagtgtgctagccatccatcatgcatgtatcaagccatccatcatgcatgtatcaaacgaattttatactattttttctcttaaaatatttatccaaatcataatccaattgcaccattaaatccgttgcaattaaatctttaaaacaagacaacacatgaatataatccgatgaaaataattagcttattattgaattatttttaaatgttgcacgctgttgcgctgagtatattgtaattgtttcactaagtagatcgaaaatgttttatcgaacgttgttttaccttatataaaaataatgtttcagcgaatagcgaaaggatgtttcaattcactacaacatttgatctatacgtagtgaaacatcatgagtacattaggtgaaacatttttaaattaaaaaaaaatcggacggtcaaatgttgcagttgaccaacaagtgaaacattatattatatatatggtgaaaaaaaaattagcaactggaacatttaaatattttatgaaacatgatgaaaatgcacgttgaaacatgtcgctgtcacacatgaaacaacaagtattaacggattgaaacacatgtttttcttttatcaaaatataatcaagcgatatcttattataaaaatttaattacaacgaatacaatggtgtgatcggatcatagattgaataggtaatttaagagaaaaatcattttgaagcttgctaaaatacatgcatgtatgcatgcatgaggtggagagagagtagtagtagatagtttcaggaattttgtgaaacacacttaagacacatattgaaacatatcactattacgtatgaaacattttgttttaacggtttgaaacgtatgtttttgttttgacataatataatcatgtgatatcttgttgtaaagatttaattgcaacgaatacaacagtgtgatcagttcgtaaattggataagtaatttaggagaaaaaatatttgaagagaggaggaaagaatgaaaagaaacaactaggtatgtgcatgtctgttacattacgacaagggttcgtctaatccaacagggtgctgatttgcagcatttttctgacgtcaacagagagaaaggagatattaacgagtaaggattgagctggccgtagacgtccgacgtttttcatctgatcggacgttcgaagagaagcattttcggcttaattcacgatggttcatgggggttcggagaattaaactccgaccccgctgcagcctgcagaaaacgtcccaaaagcctctcactgaagaggcaaaagcatccatggtacacttccattgccactaccagactatatctcaccttttttttataaaaggattttcattaaaacccagcctatacatcacattagatgtacacaaccaaaattcagaacaaagcattgaggctcactcccattacatgagaccaaacacacacgtactaaaacagcttagagagtcaataaacccctgatacaagagctaagctccccaacacatacaatcattactcaaaagaggagtctaatcacaacaccactaggcttcgatcctcattctgtagttccatccatacatggagaagaactcaaggactgttagtcccaacctcttgcaatattcgtttaccatgttgctatcatcttccttaagaagcacaaatcaaagccttgcccaatatgagcatctgaaaatcacctctcagcctcacgccgccgcaaagacgtatgcatctaccgtctactttctctatcttagaaaaaaaaatcaacttctaaatacgttggatacgatcggacgttgttgattttttttatgttaccaatgcattctagtaaaaaaaaaatggaatggccaaaaccaacatctacccaccagcgatgcagccatcgatctctggctgccatcgaggagtatactgtatactcgatactcgagagactctgccagctgccatgatgtgcgtgtgctgtgcccggacgtggctgcacataaacagcttccagtccagatcgtcctgggaggtcggagaattgaactccgaacccccgctcggcccatccatgggccttcctaacataatacgcctgggcctacaagccaaaggcacaactcgcatcccacgcccccatggcccacaaaccaccacaaagaaaagatcggccgcatcgggccatcgccgcatcgatcgccttccgcgccgccacgccgcagcggcggactgacgacgccgtccgccgcgctccggcgtcccgctcgccgccggccttctaccatgacgatccgcaggtacacggcgcccgctgaccctagcccgcactagcagccacaagcggagacagctctgccgcactcacacggtcctgaaatcctgatgagaccttgtatgatgaacttttttttttagccctagatatgcagcgtgcctggaggtgtagatcacacgcaacgcaagtcccaacggctaggctcgatgatgagatgcttctgtttctttcccgattcacaggttaaactctcttcattcctcttattgtttttttttaaaaaaattaattcaaatcatcagggcaccctgtaactacgcgttgatcaaacattgatttgactccagccatgaagatgaaatcccccttcatcagattcagaatctatcaactttacctcgcgattagccgattactactgcaatcctggtacgtggagtttcacctttatgcctactttaattgttcaatcaagcaggatagttgaggtagacacactcacactgacatcatcctgcacctgcatgcatgggttcctgatatttctgcctagaattctagcagcataactttctctactcccagttgaagctggtcttgtcccaccatatgtgtgtgtgcgtttctgcgaagcaaaaacgaatctaaacaactggtttggtatggtggtatccaattagaaatgctctgaagaaatgaaccagctgaaaccttgtctggtttgggagactttggtttcgaaactgtgggcacaaaccattcctgaactgttccttcgagatgcttccaattcgtattaagaacgaaaccaaagattcacattaacatgaattggtataattatatgcccaaagcaatactgcaacttggattatttgatgaattgacacgctgaaaagtgtactagattcattggcaccgtgtgggttggcaaattacaaagccaagattctttgcttgcttgcttgcttttctagtagtaattctttgtgcttcccctgatccaggcaatcgctttcgaggcgatggccattgaaataatgtagtgcagtaactttaggtatgcctcttgccaacttgcagctgctatgtttgcataattttagcttagataaactgatgttgtattaattagttgtaggataatttcagtggctgtcattctcatgaaagggaaagggtgaaaacaataatgtttgattccttttcacaaattactactagtagtactagcataacatatttagaagaaaaaatatacagaaaaggatgtgataaacacaaggtctgataaaaaatatcctagaggagaagaacagcagacttgtgctgaccatgttggagatgcaaaggccagccacttttaatcagaattttaactaaagttgacaagtccccatttgatccctttacaatgtatccataccacaaattaaactcttggaacacaatttggaagaactaaagaagaatcccattagcactgaatcacatggctagattctctctgcagtccacaggtcgtgcagaaaaatcagcaaatccgtgggtcttaagtcttatctaatcctgtgggcgcccattggttttgcaacaattaaacaaggatattttggtcagtacttcactactcggaacggattcaactaagccacacacaactatatataaaaaaaagatcaaaacaaa

SEQ ID NO: 71338 - DNA, 7544 bp, Oryza sativa
aagcagattattgaattgaactatgggcatctacgtacgtagcaggggctggaccagttgctgtgttgatctggatcaaaccaggccggcttggtcgccatgtttgggccacatacagtacggtacagctctgaactgatgtatgagcgtctgtatagtcttgtcgtcgtcatgggcctccgggaccacgcgtaggtacggggttgtttggttggtatactcatatcaccaaaacttaccacacttcatttagctaatatgcctaacatgtggctaacaaaattgaagccacacttcagccatagaagagcaaacttgccacacttttatgtgccaatgacatgtgggatccacatcatggtgaaggaatcttgccataagtgtggcacgaaccaaacagatgcctaacttagtcaaacctagctaacttgagttgtggcacagtgaggcaaattgtagtagtgaaccaaacagcccctacgtacgtataacagcccctacgtacgtatacatatacgtacgcggctcatctgatcaaactttcttttcgagtgtgttgaaacgcgtgggcctcataggtatcatgtatagtatgcaaacctggatggattgcaataggatccacatgtcagtgagcaatatgtatatagtactgtgaagaatctgaattggtattttatactctctccggtttcataattcttgacgttttagataaggttgaagtttaacttttgtaacaataacttcaaaatatctagtttaaagaaattagaacaacatatatagatgtcttttaaagtactataaaaaaagtaaacatgtatctatttatttatttattgtatatattttaatagaaaaataaagttaaaaatatattttggagaatggagagcgtgttattgttagaattatggaaccggatggagtactaaccaacaaccaattgatgcagtgatgatgatgacaatcatgttatcacacaccgtatggaactaactgataagtggcttgtaatggatggtaggtacaatacacagatgcaaatttggatggagtgccatcagaagctagaacagcaaacaacaaattaatagtgcacttgcttgattggaagctaaaactggaagaataatcatcatcagttcatcaccaaatcctgtacgtaaatgtgtgcttacgagtgaaattgatacccaagaatattatgtggggtgtggtttcaataggttttcagtgagagaaaatgatgttcagttattaagaaagtaccttgaggtatttaaatttcacactaaaaatactcgatccgtcctaaaatataaaaatctaggactgaacagtctgtccagatttcctagtactagcaaatgtcacatccaattttagtttcttatattttagaatggagagagtacctaatacttaaaagtatcaaattttgaattagaaaatatgatactagtagaagacaataagggttgttttggtttgaagccctaccaaaattttagtaatgccaaaacttggcacagcaccaacaaaattttggtagggttgtgttttttctaactctattgaattggtaagatttggcctcaatccaaatagctaatatgtactattcaaaactaccaaataattggtagggtaagaattggcctcaatccaaacatgccctaaaattttattcactggtctttgtagacatgtgagtatgatgtacggcttccgtgcaacttgtaaaatgattaaaaaaaagagcatatgcacatgacgataacgtccaaattaatcatccagagcacgagctgagatgtctggagtctggacagaactagccctagtgatagtgctaccactgctgtacatgaagtgtactacatcagtagtagtacgtactgaaggcgaagggcgcggtgtacgtaccatggtgcagtgagagcggatcgatgatcgatcgatcaacctggtgagagtggccgatcagcgtagatgtccccatgactccatgcatgcagcgcgaatgcgatggattcatcgatgtgtagtgcacggctgcttccaggcttgacagcaacagatcgctcgcgacgcggccaccgcgggatgctgccggcgcgccgcaaaatgctcctcgatcggggccggaaatccacgcgatcctggcgtatgtgaaactagctggcttggatagaagaacgccctcaacacccaagtacacggctagcccgatctcgatctgcccttctgagggacttctgatgtgaagttagaggatcgtggtggctgatatgtaggtcccactactcatggatccacctattagtgatcacgtcatgaggcaattcacgtcagaagaaccgattcccttctcagttgagtcttgtgaatcatgatgaccgatctagagtactcacattcacaaaagcctgtgggtgtacagtaggaacagtactgtgagatcacgcacgctggccggccgttgttggagctgtcagtcaaattggagtgacacgcaccgtacatttgggcatttggcgtcgtggaactgcggcaagaacaagatcccgtgacgcgataaccgatctaactactactagtactgtgactgcaactggcgccgtttgccgcagccaccacgcacacactacacgtaccttacgaaaatccgtagtgcgaggctccaccggcttcgtcgtaccaaattcctgccatctttcgctgcctactccattccatatgggagtatcgtcctgtacagctacgctttattctcttcccttccgatcccgttgcagggaggcagggaccaatggacctgtcattcatggtccggcagcctatacagcccagcaatcagcagaccacgcttgctattacaagcaaatactcctaaaaacaaatacgtaccagtactaaggctatgtttagttaacatcaaaattaaaagtttaattaaaattgaaacgatgtaacggaaaagttgaaagtttgtgtgtacaaaagttttgatgtgatgaaaaagttgaaagtttgaagaaaaagttgggaactaaaccaggcctaaattttcttttacaaaactcttacaaataatggtctcacccatttaacgagagtcatagaaaatttagatatgtaacacatgatattatattagtaaaatttagtacgtgtaaacttttccgataataaccacgtacatgctcactactccctctgttttataatgtaatactttctagcattgctcatattcatatagatgttaatgaatctacacacacacacacatgtacgtggtgtgtgtacaaaatatatatgaatatgaataaatgctagaaagacttacaatgaaacggaggaagtatctcataattctcatcttacttggtcccttatccaagtaatgacttagtctctttgtctcaaaaatataaacttttggtatgcaatcctcgggatgtggattttcatctctcaaggggatatcctcttgtttgcatgtcatctaaatagttataaaaaataaaaaaaaatgacaacatagattaatacgaaatatatcactccacaaacatgcaaaactaaattcaacttctataagttgcaacaaaaataacaaattaaactgaaaatagttaccgcacattcgcaacgaagttgaatttaaacttacatgcttgtggagtgatatatttcatattaatttatattactattttttcatattttttatgactatttaggtgatatgcacgaaacgagggatatctctagagggatgattttactttccccaatcctccgccctgattgctgaaagctgagtcctcgagatcacgggccgatttgtttggagcagtatgggccgtgcgcctcgggcagtgctactcgcgaaagcccaaccctcgcagccggcccatcacagactatggattccatcacctatcacctcttcagtcttcacccacgtccctcgacaccccgtccattctccttcgcgcgccgcccgcgccgtcgcccatcgcggcggcgatctccaccaccgggagcagctggcggtgccgacggcccgcgtcctctgctcttcttccgccgcaaaatcctcccctccatcgactcctcgcgacttcgtccgctgatctccatccatccatccaccgtgtactacccgtcgtcctgctgctttccgtccgcctccggtgagcacccgtgccaacgcgacgcacgtcctctttctttctcatccctctcgttctatgccccgatagatccaccccttgtgaattggagatctgaaaaagattttgtaagaaaacaattgtgcttagttctagaatgacattgtggatttttatatttgtgtatatatattttttggtaataactgttttgagtcctgtccaacaaactcattgagtgaagagtatttactcttttacttctgtataaagttgattttggagcttacaggaaagcttataaggtcatgggtcatcatcgtggacataaaacctgtatttgtgaccttttaattattactagtatatctgtgttagttttatggtgctgctttgctgttctgatccacattttgcgccttttcttgacaaaaaattatgcttcagtgctgggaagatgtggatgggtggttatgatctcagaagaaacttgaagagggatgaaaaaactgattttgtcggaatggattcaaagaagcaaagaaatgcttctcttgcaagaaaaaaggaggaagagtttgcaatgaaggagagacatctgagtccttgatttcaggtttgccggtgcttcctttttctgcatgtatcttatagctctcgccgagcattcacagttgtgttgtatcatgtttgtttaactaggtaacttgcacttcaagtctaatgaaggtgtcttcaggagtgagttcagtggagaagtcgcatctaatatgtctaaaagtgttgtttcacttgctctgcttgatggtgattatatgtgctgttatacccttcttacttttccaggcatatatatataaacaccgctatttgttaatgattaacaattacagtcctgtgtaggggacacagtgttatttgtatgctcaggcatggttgtacaacgtgatggacatgttataaagttgctgacctcagcaagcttgcttaaagcttttaatgatgaaagtcaagaccatgataacttgaaggttggtgctggtaatcattcagttgactagttgtgttcattgcttactcttcacctgattcttcattgtaggtcgaagtgcaccataaagacgctgttgtcatagggtctttgagagaatatcatttagatcataacatggctgctgtcgtcgtcgagaacttacctgatcttcgccctgtgcctttcaacaatgttcagaaatttgtaccacatagcatggtagtagctctaggccgtgatatctctggaaaattaatggccacaggtgggttgttgattggtggttcaagcggatcatacaatcctaagcttatgtcgtcgacttgtaaattctctgaggtacacctgttcttttatcacttgaagtacacacttgcatgattacaataaaaatgtttaatctgtttgttttatacatatctgaggagataagatgatgatttttcctacataactcttattccatttcactttattttgtccagttcaaccagtgtggcctgtaatcctgttctgtttggtgccaggtttatgaaggcgggccactttttgattttgatggggactttcttggcatgaacctttccctcactactgagggaaccttatttgtgccaggggatagagttcttgatcagcttgtgaattggatactccatcatgaggttaaatttgctgcacggttagcggctttgaaggcattgaggtatgttttgcatattctgaatgggacacatatcctgctcctccctgccatacgtgatttaatgcgtttagctgttttttatgccaaacagcttatgagacttgctggttttgcaataatgtggatagttgggtgttgttccttttgtagggtttttgacattgtagttcctctgcagtttcaatgtgttatgttacccttaatagcaatatgattctcttccacctatatcaagatgtttctgtgtccaattggcacatgccatcgctgccctgtactagattagtcatatgttccaatgtttatcgatatttgtctaattttattagagaaaggaacattttgtccagatttagtggtcacactgctatgatgcctcctgatactggatgtttttttataacatttgctcaattctctcgttttcttgaaatagttttatgcatactactccaggtcttcttttatctatacttttcttaacaaggatcaatatggggatctagaatccttgggctatcccgagcccccaatatcgaatggtaagtcaattcctgtaaatattgtgacttttcatgcattgtgatttttttttacttactgtatcacttacaactattttactttgtatcttcaactagatggcatgattttggctaatacttttgaagagccttttggtaacgtgtgtggtaaaggtgtctggagtgaactaagtgaagatgttgcctctaacatatgtgaaaatattgtcgcacttgcttcattcaatggtgattttacagtattgtgttgtttactgtttcatatttgtactttgatcataactaactaatgatcaaaattatgatattcaggagaaaaacgaagttttgcatgcacgggttttttttattgaatggaacgagtgtgccactattctgacttcagcgaacttacttagagatcctcgtgatgcagacaagattatcgaaaacttgagggttggtgcttctaaatattctatgatccctgttcatttgattaactgctaagagtctcaattgtgttgtttgcagattaaagtgttgcttccaaacaatcggcgcaccaaagggacagtacaacattataatttacgttacaacgttgctctagttagtgtgaaggattaccgtgttctccaaccagtaaaaattcaaccttataggcattacgctagtgaattactagctgtagggtgtatcttcaaatctggcagattaatggcctcaagagggcgacaacttcccatcggtgtcacacatgaccgcaaatttcttggttattctcaatgtacaatcactaaggtaacagcttctatttttcttgtctactatacatggtcaaagtaagtactagtttgcatcagaatatgaattagctatcatatttaattgatattaccaagtataacttctccatttcacctggctaggctggcattggaggtccgcttcttggtttcgatgggaactttgttggcatgaacttctacgatgagggagtagaaggaaccccattcctatcatggtgtgagatttgcgagatccttaaatattttaagacaaaagagtatgtctaggtctttttgtgt

SEQ ID NO: 71339 - DNA, 2718 bp, Oryza sativa
acgcctcgagtccatgaccagcatcaatcgcctcaatagtgccgcgtaattatatgcgaacaacaacaaaaaatagcaagagattaatctgggattaaaaatcaatacgataaataatgataaaaatcagattgagtttccccctgactgatttggatcaagtcagagaagaggagcttgaagaagtggtcgacggaaaggaagtgaaaactcccaaagcgaaaacgaagtcggcgactcatgaaattgattccatcgcgcttgttgataggaaactcgacgcaacccctacctggcgcgccaactgtcgaaacatgatttcggcaataataaaagggggtagcgcacgagacctaaaagtggatggatgcagagacaaaggatttagacaggttcaggccctctcaatgagaggtaataccctactcctgtttggggatttgaatccgccgggtgtagtatagatctgacgatcaggttgtctcatgcccctaaagggggctccctgccctccttatataggttggggggcagggttacaagatagaaaccttaaccaagacggtatcggtttcctaaatctactttacaatcttatcaaaccaggactttaggccgttccataatatacagggaaacgtaatacccaagtcatgatctgttacatatttcatatatataagttatcccctataactagtcggataaccatgccgtgtgggtatggggtacccataatctccacaattttgaactattttggctatattttgtatgtgtccgcatgttgcagcactaggacatttttatgattcgttactacctacaagttgaccagaagattccaccaccagaacatgtacaaaataccgttcataggtgttcatggccagttggtttaatattgaattgactttgccagttccaagcggcattaccgctggttttagaacacgcagagtgctaaaatggtaggtaagctcgataaggactagcggtgtaatatattcagtgtaaaaaaaaattgaacacccgttttaactcactactaaaaaagagttttccatgctggctaaaatgggtcttttctggcggctagtcaaaccacttgaaaccaaaggctagagaaaatgtaagctcttcacaaataggacttcaaacgccaacgaaatcgattttcattggtggctgtgtcaagccagccgccagcgataattaaattttactagcagttatgttaagccagccgtcagtgataatcaattttgagacaaaaaaaattgaaaataaccgcatgcagttaccctctaaccgccagcaaagagcctgcattaccaaacccaaaccacaaatccacaacagagtcccgcattaccaaatccaaatccaaattcttgcctctgtcgtcatctccatgaatgcgcccacgccagacctgcccgccaacccaccatgaacgcgcccaccacccgccgtggacgagcttgcacgcccgtgcgactcgccggcgccaaatccattacgacgtgacttgtcacctgcaatcaatggaagcctaacgatggaagggcatgcggaggtcgacaagggagggacgatcgagtcgctttggaagtagtgggtagatagccaccttcggatccgtgttcccaaggaagggcgcggccagctggcagtagaaccgccttgctcccgaggtccggctccccgtgccgctgccgccgagccggatttgctccccgctgcccactcccctgcactgttactgccgagcgccgccccctcccacacacgagtgccgccaccaccccttcgttctcccatggaagggtgtggccggccagcggcagaaccactgctcccgaggtcctgctcccccgcgctgctaccgctgaccggatctgctccctgccgcccactccctgcgccactagcgccaagcgccgccccctcccctgcacgagcgccactgttgctgcccctccgtgctcccaaggtagggctcccggcacctccgctgcccctcccatgcacgagcaccgacgcagccgctgccccctccccgcaccgctgctgccaagtgcctcggctggatctgggaggcagagaagaaaaaaagaaagaaagagggggagctctggattgggagagagagagagagaggaaagagtgaattagaatttaagacccgctggattcttgcttgcggtggttttaagacccgcctgtaaaaattagatttttgcaagcagcgtcttaagagcaccgcttgtaaaaatcgtgttatttttaatggtggtgctcttaagacgatcgcttgcgaaaatagattttcaatggcggttactaactcggaaccacctgttgtatttttgctagcgatttttgcgtatggctgctagagaaaattatagggtgatgctatgaaaaatcgattgtttagtagtgactattgcgtttgtctaaactacactactcaactttaaaacaaagcctttaacccacctcaactgtcaaaacttttcagtgtacccctttactcaaactaagggtgaaaatagtacaaaaaatttcttgtccgtactaataccgtttccacaaaacaagagataatctaagaaataccattgacaagcgtccaagtcccagaaatgccatcgacaagtgtgactttcaagaaatgccattttacaaaccattttgtcccaaaaatgccat

SEQ ID NO: 71340 - DNA, 15992 bp, Oryza sativa
cagctgttccaacaaaccaacattttactcaacattccaggatctgcaagaacccaaggcttgaaagatagcatggatatatgtaagatctgtgcaactctgtagatctccccaagagcaataaagtaatgagcacctgtgcaaccaacagaaggcatgttagttgatcatctttctgcaagcaaatgattaccgaaaaaacaaattatacagctctgctcattattcagagtcccaccttgagaaattactgtttcgccaacatttgcatgacaagattcctgccaaatcatcgcaccatgctgcaattcttgggcacaggacagaagcatactgtaccatgcactgacataatcacattgctcctctttggatgctatttccaaggtacgaaggattgacacgctgtgcttatagagtttaacagctgaactcatgtcttccagtgcctacgttgagtatcatatcaagaaatttcaataacccaatcaagatcatgtcatgactcatggaaacaagggcagaaggtaatggcaaacagaaacattaagtgcacatacgtatactgaaatcaagcaaaatgacatgtcatctatgaatcactttgcctggtacaatctatatatcactttggaggcaagttcaatgcagcttatagaaaagcacaatatcattttcacatttaattatgtttatcatctacaaaagaaaatgtgcatgtgactactgaagactatccgccaaagaatttaagaaaacaagtgtactgatctaaagtaacttgatataaattacaagatttgacagtgtaataaaaaaaacattttttcttttttgtcaaaaagcaggatatataaatgcctaaagacaataaggtgtatagagtctatagacaatgagacaaaaattatatttcctagataaggatgcttaccattgctattatttctgttaaatggtattctttatcaaaatccttcaaatgatcctctttggcactgttaagcagctcagaaatgcaaacatcctttgaaggatgttcatctttgcaaaaacctttcgcaagtgaagaatcttgtaattccttgcaaatttcctggagattatggaaaatgattaaacaaaatattatgtttaattcatgttttgcactgaacaataatatcaagtacttgagttgatcctagaaacaaactcaatgtctcacaacattaaataaatttgtcgggatcaaaagtgcattgcatgcacatcaatataacaatacacaagcaagttgtgaaaaagtcatgctttgataaacatacaagaataaaataatttatagcaaaacattaagcggagcacacctgaatctccctttcagtttctgtcatcacttcattcttttcatcagaaagcatagaattcttctggctttcctgaatccgtatcaattacaaaattatgaacggaagataaccaaatgatttatcagaatataatcagtagtgactgaccttaagatccttcttgtactgggatattaccgtcaatgattcttctctcagcttatggtagaaatcaatcaaaatcctatcacttgctgatttaattgaatggttttcatctgttccaaatgaagagttctgatcactgatcattagtctgtatcacatggggaaaaagggggtgaatgtggagccgaaataccatgaatactcaccatttcagtattagagaacatatcagaagagctttgcacactttctgaagaacattgcataatgtggacagcatcaatcggttcactttctttgtacaggtcgagtatggctgcattattgggtggaaaataactaaaggccttcacactttgtccagcggactcacgagttccaacatgatctgtagtttgaacattgttcaaattttcgctaacactagtaaataatgaccagccctcctggtcgctgctcattgactttggtacatcctgacaaaataaaaagattcagaccaatcagtggagaaggccatagacatatcaagacctaatacagaaaaaaaaactagaaagaggtcataacaggatttctaatgctagaatttcagaaatttttttttaatcaaaagatatataaggataaaattcatcctttgtttagcagggactagggaattcttataacaatgtctgtgtgctgttaaatttactactccgtaagtcagaattttatactatgtatacagattgtaataggcaataaaaatccttctaggcagcttgactgttcaacttgaagaatacaatcacatgatttattgatttaatttcgtgaggcaggtcgtaacgacaatttcatcgaaggttagctccaaaattttctgaagtgggattatttgcaattgatgaattgtctcattttaacagtttccacctattttgccttccaccgacaattgccattggatggatccccatgagctgaaaacgagttgcattcatcaggtttgttgtgagtgcaacatcacaataaaccaaccgatatgttattttcagaccgtgatgattcatgattgtcactacatggttggtcggccatacatcccatcaaatttctgaaaggtagttaaggtcacaaggttagcatcatcaacagtaagaaaggctcacctgagtaagatccccatgggcttgtctgccgccatcctgtacagcatccgacgaagaagaaggcgccgcggccttgaattcccagccatcatcttcgaatccgtcaccatcctcctcctcctcctccgccgccgctaccgctgacccctcctgtgtacccacctccgcggcgtcggtggaggagggttgcgggtgagatccatagaggccggcgatgaggtccttgagatcagccggcttcgatccattggaggacgcgtgcgacgctccccgctgatccgcagccgtcggcggcagctcggccggtccctcctcctcctcctcgtcctcgtcggcgccgaacagggagagggggagcgggccccgcggcttctcccaggagggcggcttctccgccggggccgccgccgacgagccaccatccggattggatccgaggcggctgtcgacgaagtcaccccagtcgtcgtcgtaggcgccgaaggcgtcgaaggcggcggcggcggcgggctggggatcggcgaaggcgaagtcgccgaaatcgaggtcgtcgtcgaggaacggggcgggcggcggcgggaacgcgacggcgtccatcggggaggtggggttggggggaggtgcaatcagcaatggcgggtgcgtgcgtgcgtgcgagagatgagatggtgggcggttggaggagaagaggacggaaagcaagagggaggctcgatggtggagccgttgatcaagttgccattgccaagctgtattccatcgtcagcgccagcaaagagaatgtgtttttttttcttattttccttttttaggaaaataatttctttgatttctttcattggctttgctaggttggcctattgctggcacctgaaatgttgaaatgccaactttgagagacagatgtgctatttcaaacattggcaataaacacaccaaaattgaaagtttaatggaaattggaacgatgtgacggaaaagttagaagtttgtgtgtgtaggaaagttttgatgtgatggaaaagttaaaagtttgaagaaaaagttgggaactaaaccaggtcgaaataagaatatgcatgtttctcaaatttatatggttctatcgtttgttctttcagcttattagccgtagctaaactttgaattaaaacttggttttagaggtgatttttatttttttttattgtagtttgttttacataattagattttaagccaaaatattacttgtaagttttttttttctaataagcgttgacttataatcaattttttgcgatttacgtaaaatactttttgtatatatgagtttccttagaaaagtggttttcaatttatttttaactttataatatttaattaattcatttataccatcaaaataatcgtaacaaatcattcaactattcagcaccgcataacataccaaatcattgacaccataaaggcaatgtattgttcataggaaaaatgtctgaacttttagctcccaaagctcaagtcacaatgcagtgaaggactgaaggcacaaaaatgccgagagattgtagaatttgacaccgattgcgtgcagttcaacactcccaactacttgtagtagaattcccagcctacagtacaatgagtccatgttttggtcgtcaaatcgtcagttctgcactatccgttcctattcattcattcttgggtttgaacagttttatgagataaccaatcaaggacacgagccactgccagaagcgaacgatggaatttgacgccttcggtttgggttcgggccttggaccaaagaggcctttgtacagctccttctgtttttggtacagagctttatcctgttccgcgagagaccgaagctcacgctggatctccttgtcttctggggaatgtttcttggctttcaggaagtcctccctcgctgattctgtctgaccaagttcagctcttgcttttcctcgtctgaacaatgctttcacattgttttcatcctctgccaacacctgaagaataggattatgagttcatcatccagtcaataattattcggtttcggaaaaagggggaaaaattcttcacttgatgaattgccaggtcagttacgtcatgaaattagtgagggttgtcttacaaaaataagttgaggaaaatataggcaactgcactatattcttcactttttggtccaagcgtctagttaccataataatatcatgttgtatgtctttattgtctgaaagtcaaatcaaaatcctaattcatctgaagctatacacaaaccgactggtgtgagtgtgacagcatgagttttaatagattgaactttatgcaaacaaaaaaaacttacaatactacactgtgcgatagcttcatcgaatctcttcagtttgattaggcatgcggccatgttgagatgacatggatttttcacagccaaggccatatctctgtatttcccgaacaattgaaacatgaagtcatctcccatgtatgcaatcgcctgtaaagaggaggagctagaggattacgattagagaatcatctcacaacagttgaagaaggacaactaaccatttcatattgctgcatggcctcctcaaacttcttttctttgaaatactcattgccctcaatcttcctcctgtccgctgcttcaatcctttcctctactgtcatgtcacttcgggctttcccctgcagttgtacacaatttgtaaggttccttagaacatccaaatcaccttgaaaaccataaataaaatgaaaccaaccaacaatagtctcagattactatcagaaataataaggataagcattatgttgggtggagatggtaagaaggatgtttccctacctctttgacatcatcaaacccaataagttcaacttcatataaaagatctgccattggagggacatttgggaatgaaaagctcccttctttcccatagcctagctcccagccaacatgcaacagtgcacgctccccacttctcatgttaccaacaccaatgcctaaaccagacatttgttttttctctgtcggtaaaaagagaaaaaggcttttattccatatgtgataatcactgataaatcccaggtatactctacatgctcaagagtgtccaaaagatatttgtaggaaagttatatagttaccctgtacctgtattgtatatttagtgaaccatcagaaaacagggggggaaatatattagtaataaaaatataactatttagtctttatgtccttgcaagttgtcaatcgccctcacacacacacacacacacccaaaaaaaaaactagaatatcaatagcaagttgaaagttgctgatcgatcaactgattttcaaaacccttattagaatcatagattatttgtggcactataagatcagaatggcataagagtaagctatttgatgtgtatcatctatagaaggcatgcatgcagtgtagaagaactagggataaaatgaagtatcattattttcaccttttccaattactagttcaatgggatgctgttcttgccaagtatcctcgaatttatgcagagagccttgaacccaagctctatagtgcactgtaacagaaaaaacagaaacaaacattatgcagatgctctccttctgaataagtatatacatggtctgagaatggaagattgatctgtaatagacagacgttgacatgcttatacaaatgatggacgtgccacttggtaagaagtgctcaaagctgatgattcatagcaaagcacaagtgcatgactagttttaaatatcatttgctctaagttgttatgagtttggtgctgctatgtgccacactagttattagtaagcctgtggtgttagagaaggctgtgcgtacatcgaattgttcatcctaaaatactgttaagtatttcatgatttctggtatctgaataagaagctctttccacagaaagttccagtactggcaatttagttaaaaagaagtgtacaaaaaagaaacagagagctaggagatagtacaacagagcataaatactgagcccctagtacatgtaactttacaaatgtatgttctgagcccctgatacacagagaataagttctcttattatggaacttccatagaaacaacaacgagatgaaatgtgatgataagacaaatgctaatgaaggtggaatatattagcctcattctataaatcaccaggataaatatagggaatgatcaaaccatttatgacatacaaaagcacgtcgcgaactttgatggtttcttgccatggccttctttgatgacttgttttttaactttgtcatgaaggacctccatattagaggaaaccacaggtgggacagagccatcttgcggaggttcagtatgcacaaaagaagcttcctctacagttatctcattatcacttgaacctgaaaaaccaggatacgggttaagaacaaagggaaattgaagcatgtttaataaagtactccctattttaatacaaattctggttctatactggtcatgttgtaatgtagggtcgaagtactatatccaatgttcagtttccaatagtgcgtgtttgttgattagaaggaaagggacaacgtgagctacatttttcgctgtctagtatccactatcatgtagcacgccgaaccatttaagctcctcttaggactccagcctccaggcatgcaggggttttcttttccagatttctgttggaagtgaattgttttaaagcaggccagagaaaaaaaggacaatagacataatccatatggttactgattgttcctgtagacctatacagaaatcaactgtatcgttctatacagttgaagcaaattcagaaatcgatttatacttgaacttgtttctccggattcatcaaaacaaagggagaaagggatgccatgtcataattaatttcactattaggtctaccagtacaatttagcatttgatttgagcatcatttggggtacttgtatcaaggtggaaactgcaaaacgatttgaattctgcctgcgtgctcgggagctcaaactaatccaagcacataatctatacgccttccttttggatcccaacaaaaagaaaaagaacattctacaccgaaattcagaaacaaagcacatccacagagcaatagccacgcggggctggtacggggtagagtggggcaggcgagagaaaagggaggctcaccagaggaggcgggatcggcggcggcggcgggtgccggcggcgagccctcttcttcctccaccacagccatcgcgcgcgtgcacggtggtttggttgggtttgggggcttccgagctccgaggcggacggttcgaggagatgagactgagaagtcaaacagttgagaataccacgagagactccagcagcagcagccgccagcgagacgtcgccgtccggccgccgcttgatgcgggcttcccttttcgacgcggccgtatcaaggaatccccatgacgccaagctctacgctattggtccaacttcatgaagaaattcttattgcacttaagaatttatcactcgtaatccctccgtactcgtaaagtcgtttataacagcgacacggtctccaaaacacaactttgacttcttttttctataaaaatatttattgaaaagtgatatatgtatacttttatgaaagtatttttcaagacaaatctattcatataatttttatattttcaaactcaacaacttaagtgttattcatgatttatattcccaaggtttgacttaaacattgtcctaaacgacttcctttataagtatggagagagtaacttataactcgtggaattcttatatattcatgatatgtggattcagtgataaatacttaattgtcattttaagagtgacaaatagcaaaatttctctttcttacgagcctcattcaatttctgttgttcttttcacggttcaattaaataattatttatgtactttataatcataatatgttttgtaattaaatttctatcataatcttatatttatcccctttttctgttttcttaatattgtgcttcgaaggaaccttaagttcccaacaactgatgtaatatactaccttgatctaaaagtcttcttcgtatttctttaattactaagaccaagaagaaactacctcatccgattaatactccatatttagcaaaattctcagcatacatgcaatggtgttggactgttggaggatggctggtcggttccgaaataaacttaattcattgttgctaaacaaagatatactctcttcattcaagtcttggatacatagaaattacaaataggaaaataaaatagtaagaaaaatttaggtggagggaatatatatttcactacaactagacatctcttgttagctgaagtaacaagtataaaaacagaccagaaccagtagtacttgttttttagataatagatttatattaaacccagcctatacacaagtagtacttgttagctgaagtaaccagtagtgcccatcttacagtgcagaccaaaatccataactctacaactaaacttggtagtcggctgcagtgaattacagaattgcgtcaaccgggacaggatgccggcaagatggggcagcactacggcagcgtgccgtgacagacaaacgtgctggctccattcatcatcagacaaacgtgtaagatcgggcagaaacgatcccaactggccaactatgcgttctatccagaggcagcagctgaaataatgcacatgctctgaaacagtcacagctactcacaatgctccccttgaatcgaaacagtcacgtttctcgcggattgtagtagaattatatatttacatcattcattgctggagctcctagctagctatgctcacctcataacctctctgtatgaaataccaagatagcatatcaccttggcaatacaggctaagctactacagatcagagcagagcggtgcagcttcctgccaaccaactctaaaatgttccaaaaatgtgtccactcactaggataactactattacctactcgttgggaagtgaatggatcagctgaggagcagcatcacccaagacactggatgaagctttgttctgtcctgatgagctgctggatttacttccctcttcaaattgtcaagttgtacttatttagctttcgccagccagctttcagtgttttggtgccaacaagaggtacattttgacctatcatagattgtcttttcaacaagaggttgtagacaagctcattccaggtatcagggactccaggcaagcaccagtggctgcaatcttgcctgtagagagggacagggcctgaaggactcaggtgtactgagacgtgcccatctttccgttgagccgtcatctgagtcacgttcagtatatccaacccgagaagcttgggcctgaagctgttccctagtacatcatttacggggttaagaaaatcagcccattgctccaatgatttaactggtgtcacatccggatgagtttccaaatgacaatttcctccagtcttccagtcaccacctctgcacaaaatatggattactaaagttgagtttgacagatcatttgaagcacatgttgtttgtgcatccaaaaaaaacattatcaacatgaagctaaagcactaatttccagccaaaagtgaatggccaagagattgcagaatagttctgcttttaaagcatctttgtcaacatgacgatggtttattgttgattgtcttactatatatggtactcagtcaagcatttcaatggaaactatgcacatatgttgctattattgtgaaagcagacactaaggtacctgactacaaaatttaagcaagtatccaaatcatattcttagaacaatatcccaagactgtcaaataatgcttgagcaaggaaatagttgaacaatcacatcactgtcgagtttgtgttttacggacctgaaatgcacaggagcatatgtacggaagatgacatgggtcttgcttgagttaacctcattgtgaagccaaccaaacaatgtctgtatggatcttttgtaagcatctccgacagtcatgtccattttaactgcatccccttcttgaaaataggtgccactgatacaagacataacagtaagagtgtaaggcttatgccatgtatattacagatatgcaattatgttaacttaaaattttgctcaaaagcagaacaaattgctcagaaccatctatcagtcatcatatatgaattagagaacataactacagaactatagtttagatattaatgcttaccttctgattgttttctcgtagttccaccagtgcccagtgttaaggatcaatacatcagcatccctccactggccccggtcagacaaccaatccatggcatctaccctaattgtatatttaacaaccccaggagctccaggtggggcacgcccttgaaggactataaaaggagatctgtaatattccacggtgcaattgtagtctctaaacttgaaaattaagaaacccatgtgttttgtgatgggattcccattaacttcgaagatggagctcttatcaggaacagcaacagagagcatacaaagaagagattcccactggttccgcccaattgaatcaccaacaaatactactcttttgtttctcaacttctccagcatatttctggcatcaaatctaagaaatcaaagaaaataatggtgaaatcagaatatgatatcagtaatgcttaattggatatgtgaattattcataacaatacttcttgatctacaagcatcagtgaggcatcatttacatgctcaaaagaaaatgaaattacaaggtcacaatcatcttcttttttttcctttatggactgttttattgagaaatcaaaggtgccccaaaagtttttattttaaaaaaaagggttaaaatcagatgttccactgttttctcataaaaaatatttatatgtttaccatagtatgtaatacagtctaatgtgttacagtaagcaattatgaaggataacaaattttccaacatgtaaaagctaccgatagtgatgataacaagaatcagtattttttctttcttctgcaaaaggcagaaacccaatctgagaatagctatacttttctgaaacagaagagacaacttttcctttctgtaagaaagacagcttaaccgaacatatagaacactggactctgacaacaaacaagacgaggtcacatttccatcaaggcaaaacaaaggtgaaagatggcaacaccatgaaagctacagacagactactaattaaacaacactagtttaactaatttatctctcggaggcctaaccatgcgcataacattgttttctaacccagtggggagcataaggcatcgagtttccaatcgcggtgcacagttcctaagtgcggtggtcgtcaacctcatttcctgtgcaaataatctaatgctcacaagggttcagattataatatgcacactcaccgatccaatctcaccaggtatcctgctaaaagggcccaaagtcagaactacatctgcaaattaacaatcattctaccaacaatgctacatgtatgagtgctagactgaaccaagtttatccatcttgagttctttacttctccaagcccaacaaattaggtgtcacccaaactagccaacgattcatatctccattactcgaaaacaatgcgcatccgaaattcatactcgatccaccaacaatgcttatgcaccattctgaatgtttggattgcagcaagagatttcgcttgagatgtctagatttctccttcacgagattgctaaagtagacaatcgagtagattcatctaaacccccaaacccccaccaaatccaaccgagcggaagcgtacaagcaagaacttaatcgaacaaaccgaccaacctggggagatcgcagcgcgacggcctccaccgccacttggagtaggacgcgtcggggcggccgttctcggagcaccggaacccgacgtccaggaaggggcagtccgtggagtggtagagcgggtagctgtcgttccacacccactccccgtcgaacaggtcgcactcctcctcctcctccccctcggcgcgcgcctccaccgccgccgcctcggccgcgatggagaccccgccgctccagagcttcccgggggccgccgacagcgcgaggccgacggccgccgagcagcggagcgaggcggcgcagaggagcagcaccagcgcggcggcggcggccaccgccacggcgagccccgccatcctggccttctccagcaccggcctcttcgtgacccgccccgccagccgcttcgccgccgccgccgccaccaccaccgccatctcgatctgctcctccacccagcgcgcctcgcttcctggcagcagcgaggtagcgtacgggactacgggcgcgacgtcactgagacgggaggttgtgcgtggccgccattaaaggcgaagtggaggtctccaagaggaagaggaggatttgagagggagatgagtatttgctttctgttttagttcggcgatttttgattggaaagcgatgcgtctactaggagtaggagtagtcatttgccataacggctgtggttagtggtgcggtttggccgcgtaggagtagtagagtagcaataaattcgggcgtggtggggagaggaggagtgagtacatgtcaagtactcgtactattaaatcgagttggatctaatttgtgttgcaactgctgatgaccccttgattcgaacgaaaatcatatgaatcttggagtatttatatttttataggattttttctatatagcccttaaagttaaaggaatgaatcatatagtcctatgtaattcctatgtaatatttcattccatgcaagttttatagaaaatttaacataatgtagaacctgagaaagttttctttaagtctttatccctcttcaaattcatatgtatttctttcggtccaaccaaacggttattcatttgttttttctatgttttctaatcatctattttatgaatcatgtctttttcatattcttctatttttcctctatttttctattcatgctattcaaataggcctttgtttttgttttgataagcactatggttgtgattgttaattttattttatttttttatcgggatgaccgaaggaagttatctgaatcttattatggatgcttgtcaaattatgggcacatgatttttatgcagcaaaatgcaagtattggcatgtgcagttgaataatttatgcttaggaatatcaatcttcatttatcccgtgagcacccctactttatccgtcctaaaataaatcaaattaaaataggatatgacataaactagtagtaatgaatctagaattattatacttaggattattttctatatatatatatatatatatatatatatatatatatatatatatacatatatatacatacattatatacatacatatatatatatatatacatatatatacatacattatatatatacatatatatatatatatatatatatatgtttcaaccatagaaattcgacattgttgcatattttatattgttatgttgcaatgtttttttttaaaaaaaaatgcaaatgatgttgtttggatgtctcaataagtttttttttaatgtttcactagtatatgtgtaaatgttgcacgtggtattatttgattgtttcaataagtattgtgtgatgttacaccagttcattcacaaatgttgcacttgatgttatttggatgtttcagtaaatatttcgtgatgtctcaatagttataacttgatgtgccatgtattatacaagaatatctagttagaaatataattatatatttttattagaaatataagtatgggagatcttgttttaaagatttaattgtaacaaatatagaggtacaatcaaatatcaaaaaagataattaatttatgaagaaaaatagtttaaagttcattaaaaggttggttagagaagagtgagaatatgtttaccatgcacctaggtgtgtatgtgcagcagcttgcgacagtgcatgcaggaggggagtagtgcatgacccacaacaacatgtatggggtagttgtgacttgtgagtgatgtgaataagtagggatgcgagagtctgatgtgttgctttagttaaggattgttttcccttttcaagaacacagttaggatagtcaagtctggaaggaaaagtccactttgacgagtgagcctaataagcagctaacgccctgcgcctggctatgggtgatcgagcctatgcgagcacgagaatcgcgagtggaaagcaacgagaaagcatggctagatcgcgcgaatttgacccaccaagaattgtagcccatgttcgtggatctaggggtctgtttagattgtagccaaaataaaccatattaaatttcggcaatgccaaaattttaggaagatgataatattgtcaaaattttggcaggatttcttatgtatttaccatatttgacaacaaactaaacgtagacttttttttgataacttttaaaaaaaatggtttggttgaaaatagcatcaaagtaacatgccataagacaagcaacctaggtgcatgtgcatcccatagacttgtattaggcttgtttgagtttaagtccactcgatttaattgagcttttaaaaaaataacaaagaaaaaaagtaaaaacaatttataacatgaaacgcaagtactattatacatggaattcagcctatcaagggccataacaagaagcaaaaggaataagtttactttaggtccctctatttgtcggtcagtgagattttcgttccttaaccgcaaaaccgggtacgacccgtcccccaacttatgaaaccgagcaaacgagctccctcggcggtatagagggcggttttggccgatgtggcatctacgtggcacctacatggctcctttgactaggtcttcgtcccatgtggcaatgacgtggtgcttacgtggcaatttcatcccggaaaaataataaaaattgtgggacccatatgttagctacaaaaaaataataaaaaaggtgggcccatgtggtcccacatatcagcctccctcttctctctatccccccctctctcccctcccacactacggagagaaggcgagtggcggcgctgaggggcgacggacggagcagcgacggagcgaagcagcacggcagccggtggtagatggagcggcgggcggcggtggacggtgagcggctggcggcgggcggcgggag

SEQ ID NO: 71341 - DNA, 9413 bp, Oryza sativa
  unsure (1)..(9413): unsure at all n locations
atacttcggggcatggcnacatgtgtgttatcgtgtcttgtgggtacaattgtacactctggccagagtaaaactattcgaatagccgtgcccgcggttatgggcgatcaaccagattcaccgtgattagtctcacccctagtttagcttaatgaactggtgtagttcaagtggttggttgggcctgttgcaacgtggtgtagcgttggacaatgattggttaatattgattaattactacagctgttttactgcttcaactactgctttgaaatgcctgctttatgcaaaagaacccctagcttcctttggttatatcctgcatcatacctcctcttccggtatgacttgctgagtacagtgggtagtactcagtcttgctctcttttcccccacactagagttgaagttcttctcagttggagccgtctcagagaggttggtttcgtcgctgccgtcaaggtttgcctgtggagtggagtcgcccgctgctgaagtcaagcttcctggtttagctcacttttatctttcccgctgcatttataatcttttatatttttgtaagacgtgggtctgtatgtcaacaattgtcgtttgtgtaccctggctggtcctggacaaggatttaatgcacattcagcttagaaattctggttcgagaatttctgggtgtgacacaatctcacccattcgatctgttatagatgaatattgatcgttggatatgatgaatgaggaatgaggaatgtatcatgtttgtgaagaagaagaagaagaagaagagatagaaaacaattaaactgtttattgcatgccatatagagaggataggctaaggtcactgacaagagggacccgcatgtcatagagaggatgcaatgggtctaccatggatctagtccatagaggaggtccactatggtccatagagatggatgcctaagataaattggccactgttgaccgaaataatctgactattcagatcaattctgatctagtgatgcagagaggtgccacgtggagcctgggtggcagccacagaggacggattagctgataaaatgctgatgtggcaaccatgttggatcaacaaaggcagacccaggagcagcggcacacggcgaacaaaggagcgagacactgaggacaccaatggacaaggaatggtgaggcgacacttaacaacactttggcaaccactgatgaggatgaacggtggccagcgacgggcttcaagggtcaacgacaatgacagtgctctaacaagacttgagaaagaagaggtggtgaccgagtttccctgtgtccttcagatgccgatggcggcttcggcggggatcatcggcgcagctcggctagagacgacgggcagtaggagcacttggaactttcggtggtcttagtcttccgggaagtggaggccggtcgcacggctgctgcagtgccgaaggaggaggtggcattgactgacgattaccggggcaatgatactgctcggccggagcggcgccgatggtggaggagagagaatgagcatgcgggaaggcggctggggtatgggacgagctcggacaaggggatgctatttattagccaaggaggaagtgaccggtggggatttgatagctagaggcagcgaagaaactagggtttatctcgagttgaccaagatggaacagcgacaaaatcagtgggattccctttgagatttttggagatttattaggagaaaagatagaggaggattgatttagtcaaattaaaccatatttcatttatgaagtttccattaaaaaaatttaagcgaataaatatgaatgtgaattttcaaaattaggcaaatttgaaaaagggatgtgacacaacccttggacgagcaacctcctcccttcctcaattcaccaccgcattagtccagtaattaataggagaggggggaatgggagacagatggtggtcactgacatatgggccttacatgggtctagctatatattttttactttttccttagaactgccatgtagtcgtcacatcggtcaaaaatcaagtcaatgtgccatgcatgtgggcactttgtaggacgaaacatacatgcaaactgctcgataagacaaaacaatccagtattgataggcgagcgaggctttctatctggttttgcgggtaagagatgtgaacaagccgggcctatggttgggggaaacaaaatggattcttttcccttcaatatgtccctatgtttgacaacttaggcccaagttgtaattaagggcttcgattagcccccacctccatctagctcgttttgaatcgtcaagaaagtaagtttcttcctctaaagaaatggataaggttttgcaatatggaaggaactaattgcatatctccaaagagagaagtgatcagaacaagaagaaagctggtatggaaactgttcgagataagcacttaggcacggaatctatacatttagcagagctttgatggtccatttgaaaatcgtctatctacaatgagctccaatcgatacatttcgcagagcttcatgaattcgatgaagtagcgttttgctcaaattaggatagaattaatctattaaacgcccctctaaatttatgcatatcaacgttagcaggaaatgaattcttgccttggcatgcaaacgcctcctcgcttatataaacgagtatatctcgtcgtcactcgccactcggtctcctcaaccattcccatttccaaatttacatcattcaacagcgtaatatccatcgaatcagcaatggcgaactactgcaggagcatgacctcccctctctcgagcttcgtcccccgtcctcctcctcatcgtcgtcgccgtgcaatcccaaggtatatattctaagctcgatctggattcatctctgaacttgtaatgtaattcttgacggattacacatttaatttaccacggtgtgtgtgcgtgtatcaatcaactagcatgggcgctggatgcccaggtggcggacgacatggtgccgacgaagccggcgaagccggtggtggtggccatcggtggcggcggcgtagtagggacgttggcggcgccgttgtgcctgcagtgccggtgctgctcgaagacgaacccgagcaactgcgagctcactagctgtagctccaccttcaactgcgaccccgccggcaagtgtaccctcgttcagcagcgctgcggctgctagctgcaagcctagctactgatgctgatgcatgaactgatgcatggttacccatggatagttcgtgttgaaagtataagcttgtatagatttgattcatctcatcaataaatcttggcattaaacaaacgatagcaaacccatagcaatggatggttagatttgattcctactacactactaccaaaaacccagtggggtttatggtaaattggtcctatgtctatacgagaattccatggatcgatcccctagagttttaaactgttccctagagctgctaaagcaacccaagggaagtaaaatatccctgggtgtaggacatagtatagacaggtgttctgctgccaagaaatggcaacaacgacgtctcctagcgaagggaaggattgagaagacggcaaaggagcacgagctctcgtagatggtggtggcgcaagaaatgcaatggcgatcatgcggtgaagctcgccacccaatgacgacgctgagggcaccactcacccgcagttgagggagctcccaacgagaagacgacacaatgtggactagaccagtgaacggtaatggcagactagcgttggtgctcaccgatctataagggtgtaagtagctaacctgcgaaacacacttacgatcaaataaaacacgaaccagtttattttgatatataagcgggttcacggtttacccacttacacccctactcaccaacctacgtgaaaggaaacaaaagagcgacagcaccggtatttatacatggcgagggaggtggacagccgaaagaggaggggtcatagcctcataggaattggaaaaacggataaaagctcatcaagtttattcagtttcgatctggtatttgaagagagagaattatgagggagaggaagagagattagtggggattgatgcaaggaacttcatgacaaagcagaaaccgacgtaacttgaggacgaaaagaaacaacgtggtgctttggtttgtggcaggcggcagcgtgcgtcaaggtgggtcgcatggtggctttgaatttgaaaacggacttgggtgattattatgattcaatttttgatgttgaaggagtgaaaatgtgaaattgacggggagaggaagacattagtgatgggaaataaaagaatagctggtccgaaatagaaatgtttcgtatgtgtgtgtccagggttggaaagttcggaccccctccgatacgatattacttcggccgaaattttaaattttttcataaattttggtaatatttgttcaaattcaactaaattttgttcaaaattttgaaaatttcggaccgaaattttcgaaatttcagcatttcggtgaggccccatcaaatcagcctaaccgatagaattaacatgtgtgtgtcggggggggggggaggggggaggagaatgaaagaacaacagaagaacaggacgtattgggaggaagcaggaaggaaagatgaggaacaggatttctctggaaatttcaaattttggaggatttggaatcgttgagtaattgttctcgaatgtgaaattttagtcaaataactccaattaacaaaagaaagaatactagcacggcattaattaatttatttagtaattaggccatttttatgaagttttctttaagctattttacatgaataaacacgaatttgaatttctaaaattaggcaaatttaaaaatttaaagaacaggacgtgacacaacaagtcggatcagcaaccgcctccctcacccgatccaccaccgcatcgcaacagagaggggagagaggcaaggtaaggataggcaaaactaaggactatcatgatttgttttttctagaacttagaattaatagatatacgaagtatttataatcttgattaaacataaataagttcgactagaagaaagatcaaaatgatttataatataaaattaatttgatttaaaattctaaactgataattgcaaattgtaattgatagcattgagtcttgttttcaacctaaaccctataggtcgtaaataattttgaattcataaatatgagtttcataaattaatagctccctattaatttaattctaaaattaataatttgaaagttataaatgaaatgaaatcttttttatcctaagccgctataaataaccaacatatttaactaaaaactttttatatgtaataataataacaataataataattattattattaaagctcctgaaaagtgtataattaatatatatatatatatatatatattattgttattgttattattattacatataaaaagtttttagttaaatatgttatatatatatatatatatatagagagagaggtatagatagatagatagatagatagatagatagatagatagatagatagatagatagatagatagatagatttacagccctctaaatgtatgcatatggacgttaggaattatattgttccctcggcatgcaacatgtcgtcgctatatataaacgagcacatctcgtcgtccctcgccattcgatctcctcaagcgttggcattcccaagttgttatcattcaacagcgtggtatatatagggatcgaccgaaacagccatggcgaactgccgcaggaggatgacctcccctctctcgagtttggtcgccgtcctcctcatcgtcgtcgccgtgcagtcccgaggtattctaagctcaatctggtttcttctatgaacttgtactgtattttctgacggatcggatgacatttaactgactatgttgtgtgtatgcatgtatatcgatcaattaactagcatgggcgttggatcagctggatgacatggtgccgatgaagacggcgaagccggtggtggtggccatcgccggcggcggcggcagcggcgtagtaggcacgttggcggcgccgttgtgcctgcagtgccggtgctgctcgaaggcgaacccgagcaactgccagctcactagctgcagctccaccttcaactgcgaccctgccggcaagtgcaccctcgtccagcagcgctgcggctgctagctgcattcctagctagccggcgagccgagcgtgagctaatgcattggatgccaaagatagttcttgctgaaagtataagcatgtatatagagatttaatttatgtcatcaataaatcttggcgttaaacaaagacaaactgattaaaaaaatgtggaacttaatataataaatgcgactggtggttctgttctggatgatctctggactccattaaggacgtgtttggttcgtggtgaaggttggataggatatagacatcagatatggtgggtctaattttttatttggttgggtggatatcacaatccagttttttttgttaggtacatgagaatgagaatggattgaatgaaaaacaataacatattaattaatagtaaaatatgttaattatcatgactatagccattctttatactaattaacaacaaaataaactaattatatctaatcaacactaattttgataagttaattactaattaacaacacaatacattaattattgttaatcaattactaatgatcaagattagcaaaggtggatatcctcatccagccgatacacttatctagcatcttcgtggaatatttccttttcaggtcgccctatccacccttgtccaccaaccaaacacactcaaaaactgaatcgtcatctcccatctagggatattcctccaacaaaatacaccctaataggcgcaccaggtatcacgtggacagctcactgtataggatgttggacgatacgccacgggtgagcaacatgggccgtggtgaatggacagtgagaaatcatgcgtagtgcttcccaaaaatctcattcaccattcacccttctaggactttaaaagcgatagttaggtagacctgatctcctgattaccagtgcacgccgacgagtgaaatagactataaatgatgatgaaatacagagatatcggggtatgtgatcagaacaccgtcacggtctccacaactcgtatctgaaccagataagtcgcacataaccataccaaattttataccactctaatgcatgcactgggcaatccgatgcactcgctagacatgtcattcgtttctactacaaaacgaagccacgtatgtgtgagcacaaagagtcaattattttttatgaggcaaagctatcgagcgctcgtgccttcctcaacaatgtatattccccatgtgttagtgtgtatgtgcaatgggaagcagatcctttgacttaactgcacatgcagttgagtcactggcatatgggtcccactttgctatggcccacatgtcagtgactcaactgcacagcagttaagtcagaggatccctttccatgtgcaatgatatagcaaaatacaccaaactagtacgctaaccgcctttattatttacaagcaaagtgtcagtgcattccaataaaaaatacgaaaaaaggtaggaaaagaaatagagcgtggttagaaaacggtcgagacgaggtgattgttgggaaaattgactctcagtatggaaaccgggagacaatcacacacgttgcttttccacccattacccatgcgagattaacgcgattaattcatagttatttccataataacgcattaacgtgattggtcatgcatgaacattccttttgggattacccccgatacccacagcgccatataaaaagggaacgccagcgtcgtgtcatggtgacgatcgctacacgatcatctcgttctcgataacactaactaatctcgatcctttactaagtgctgaagggtcatcaaacggcggtaccatgccagtgcaggtggcaccccgaaggacgtcgccatcttgcaattgatcgccggcaatccctacagatcaagccggtgaccttacctaccccgctgctacgactactttctctacaccgaacaccggagcggttcgaggaactgctatctctacatccactccggccatcggcaacctcaggacaactacggcatccatggcttccaataatggtcagtcaccctaagtttctgtattatggtgatcatgttaggctaagcacttatgatttagcctcatgatcccatcatcccatttagaagccataagatgcatctaagcctctatctattgagtgtcggtttgatgcaaaatttggtttcgatttatgttagttagtccttaattatcatcagattatgattagttaggttcgattcggttttaatttcttgatgcccatgactaattaaatttgtgtctgcattttaagatcgattactgcttgggtagaaattaggaggagaattgcagcggataaccaaaatctctaattttcacaaatgctaattcaagaaaatccccaaattagaacccaaaaattccccacaatccctgcaaatccctaagaggataagattgatgtcttaccgattcctcgaatcataacgcgagcaccgctgtgcacgcaacccgccgttgtcatggatcggccttgcgcctactctcatgggccatgcaaggttgagactcaccgtcatgttttgccgcacgtggaggacaatcgagattgcactgttgcactagcattagccttgctacgcactcaccgtcacgatatttgactagggctcctacggcaccagtgtgttgcacgagcaccgggtaactcggtcggccacgaccccttcgttgcacgctgctgggcaccacaaccaccgcctcgcacatcgccggcactccgatgcctcacccgattcgccgctgttgtcgccattaggagtagaagaaaggggattggaagaaaggaaatgggttttagggctagggttttggccaatcggccatttttctcaatccaatattatctttcattttgctctatgatgaagttttactccttgtctggaaataataatgttttaatttatttacatagataatatgcatagcttaaagtgaagagaaacattgtggatagaagcaccacaaagtataatctcgagagacacacgacaaagtccagtcgatacaaagacttcacagtcgcacacaatgattatgaaggatatagcttgagaatggcaaaactctcgcacaaaagttcccatgtaggaattggaagatgagaaaagcatactcaccacc

SEQ ID NO: 71342 - DNA, 588 bp, Oryza sativa
atcgtggccagaaggatgaggcaatcaggaagaatcaatggtgtccttttggtattttcacaaagaatcagaaaaggacggtccagagattgaggagccgggagcgttttcaggaggttgaagaagaaatcaaccatcggctgaggaaaccaaagccaagacgggagtggcgtgtcaagaatcaggttcctgtagccgatgatgctgcagccgatgaggtaaagaggttggcaaaagggaagagtgttatagcggcaccaattaacatggtccttacattgccagctgaattcgggattgatcaggccgatgtcgatgaagtggaagagggattggctaagttggttctgtcaacagaacaggcagtattcgagaaacccgaggggacagagaatcgacatcttaaaccattgtatataaatggctacgtcaatgggaagccgatgtctgagatgatggtcgatggtggggccgcggtaaatttgatgccttatgctacgttcaggaaattgggtaggaacgccgaggatctcatcaagacaaatatggtgctcaaagactttggtggtaatccatcggaaaccaaag

SEQ ID NO: 71343 - DNA, 2969 bp, Oryza sativa
  unsure (1)..(2969): unsure at all n locations
catagacatgatagggttgttggtatttcttactaacattactagaaatataattcttagcaatggcatagaaatagtcctggtatatttatggttacaaatatgatccacaagcgcacagatataccattgaagcatttcacccggaagtattctaaggtatcgtatttatttaatcctaaggggagattgataagagaagactatgctaataatttatatgttacttgtataagtcagagtctaagcagggattaattaattcaagcatagagtgacacgaagaagaactaagttactctcattaaataaatcctagggtaagtggagaacgaataaaaaaaaagaatccatcccaatacttctaatatacaagtatctttaatttacactccctagtatacaatcatacagtcaataccccctaactattccctcctggtgtttcaagagacaacccctgattgccgagttccttacaacaacccgtcatggctgtccaaccggaaatgaatacggaggagtacccacaccaagaaattaacttagaactatatactaacatggaagaatacccgtaatgagctatcaccatcagcggcccacctctattattccgcagcatataccctcaaataatgatatttaataatctaagcaccatgcttacattatcaaatactactctatatccgctagcatgacatagaacaatcatttgcatgaacattatacccacaccattgcatatctctggtaagctagctacacaattatatcgagataaatgtaaaataaagtcggtactcaaataataagagtgaagaaaaatatcaaaattgaataaagaagaatatttcattaattgtataagtctcgcaaaagagagatagtggaggaggtgatgtccatttataggttgccaatgatggttgtggtggttgcaattgtagaaaatgccacacaaccattattggggagggatcctagacgtccatgccaaaccccagccttaatggctgagatgggggttcggccgaacccagggtgttcggcctagttttcggcaggcctcctctccggtggttcctcaggccagtggtaaggtgttttgggccctttgagattatttctttggacttataggcccatctatccataagtatacctcttgacggcttccgattgattgttcgtttgttttcgtcgattctccttctctctatgtagcaatctttgcaatcaaataggatccatgtacaagtggaaatagattatactanacanaatatgcattgcaagcatagctagttctctttattttggttatactgacagtcgaaattggtctataacgactgtcaacaagggtgaaaccctttcctcatgccacacgtgtcacaactgctcgagatggagatggcccctcgtcctcggagacaggtgaagtggaacttattcttgcacttctttttttttagaactttgaggagtcgcatggtgaggaggagaagaatgtcccttccctagtcttgcaccacctacaagaccgtgaatcatcaccaaatcaatgttgctgcttgaggaggacaggttgcgagtgagtaagaaggggagggagcaagaaggaacattgctctctgaacagcggtccaataaaaaaactcctcgatttggtccaagtggggtaaatttaatgttttaatgggggtttctatatccaagtttcaaagttgagtgatgcttttcaaagaaatgtaataattgaggggggggggggggcaaattgacttattccaaagaaagaaaagaaccaacataggagtagctctcgttcacgctggctccatagcactactttgaaaacgatgttcctagacacctcaatttcatttataaaggtgagttgtaagaaaatatgcaatccacttgtgatagtggagatggaatggtttaaacagtcaatgaaaatcaatgttcacaaatgatcccttgagagaaccacctgtgtaataggtgtatattcacaggcggttcaaactatttgtgaaaatcatgattttcacatgaaaatgtgtatttttgcaccaatttttataggagcttctcttatggcgtgcatttggttcaagggcgaggttggataagatatgaccatacatgtttagttggataggaagatccaagttatttgtttggttacgcggataggataagccatttttttgtttggttggatgggatgagattagtaaattgataattaataacaaaatatgttaactatcactaatattttcataatcaacactaatcaacaacaaaatatactaactatccctaatgagcactaatattgcaatgataatcactaattaacaacaaaacatgctaatcatcactaattagttcctaatgattaatggtagcgaaggtggatgagctcatctaatcaattttgccggatacacttatccaacatcgttggagaatattttcagggtggcagcccaatccatccctcgcccgtgaaccaaatactacgaaagtctggacgaccatctcccatccaaccccatccacccaactaaacgtacccttaagaagccgattttaaaaatgtacataaccctatttcaagaaaaaatacattaatttttatataaaaattatttccctcagtgaaattatggccgaaacttttttcatttaatataatttatgagcctaaatatttgggtgaaatggaccaaaagaataaattgtttgataactatcatttatatgagtgtgaggtgggatggtcggtgggatcgtaggaggcttgaggttgtgggtttgattcttgcaaacaacagatgtatattttgtgttaaaattgtggctttctacttcacgcatgagtgggagccaggtgaggcgctaggatattttttaatttgcaaaggcttctcaaggtggtgaaacct

SEQ ID NO: 71344 - DNA, 4933 bp, Oryza sativa
cgatctgagaggataagtgcgaggcggttgtggaggagaggatagggaagaaggattatatattaagcgttgaattttagtgccggttggtaataccaaccgggactaaaaatcttctagatcccggttgataacaccaaccgggagtaaagttaggatctttagtgagtaaagatcggggggcctgacaggtttagaaccgagactaaatatcatcttcaccaaccgggactaaagattaaatatgcccactgtagccaccaaccgggactaaagatcatttttagtcccggtttttagtggaaccggactattgtggatttcggccgaccgaccaaagatggtttctccactagtgcgatatgcacgggagctagctcgggtgctacggcccactatctcggcatatatccgtcaatctcacggaccaacgggccaccccgctcaccgtcgcgttgccaaggaggggaggagatgcaacgcaatggcggatgtgccgatgcggaggtggtatgcgtggggtggggttgggttgggctggatttttcacctttcagttctattgaaaaacttactctacaaataaacccctaaaatagcttattctagaaatttccattttcgcagcgtcaatgacgctgacgtcgtcccctccgcccactggtgaaatttaagtcacaaatgtgaaggggggcggcgccaaagacattgacgccaaggaccaatttatagaaaataatttgaaaaaagacctatttataataaaaggacgcatttctaaataggttttcaacgctagcatcattagcgccgaggacctatttataaatattttttttttaaaaaaatacaaattggtccttggtaccaatgacgctggcgtgtcctccttcacatttgtgatttagcttccaccgaaaaactagaggaatgtgcgaacgttattggcactgttatgtggatcacagcgctaatgatgttggcgtcacaagaagaaccatttctagaataagttttctagaaaaattaaaatgtgaataattcagttgggttggtttagttgggaggctggttctcgagtcacatgcatggcccggctgctgctgtgctggggaggagttgaatgaatatgaatgggatggattctgtgattcctgtcgatgcatgcatgcatatggagatggagagagtgcagcagggttgttgtcctggatgagggccagcattccgatgcgcggcctcgaccaaaactgaccgcctcatgtacggccctctagtgctcaaccgcgcaacgccaagcatatcgtaccagagtactactccggtactccccctacctataggtgcagcatttttccaatcaaatcaagcgaaaaagcgaaaagggctgacttgcaattactagttactcacggtaatttttacccggcatatatatttacatgcacatatgcatatttttaaattgagaacttagccctagaacaatctagtccaaatttactcctatgaatatttgaacttaggatcttagagtgttactgaggtcactgtaatcactataatacatgccctttcgtatgttccttaagcattactctttccgtccaaaaaaaacccaatcttgggttctctccgtccaaaaaaaacccaatcttgggtttaaggctggacacatgtccaggttcaaatctaggattgattttttttttatggatagagtacatctctggtctcgtaatctcttgtcatggatatgatgtttagagctggggtcaattgtatagctggtttttaaactttactagtatttgtgccatttaagtctttgtactcttgaaatgtagaattaagagtaaagtgaacatacggtctctaatcatatactccctccgttctaaaaaaagacaaacccaggtttccgtgtccaacgtttgaccatccttcttatttgaaaaaaatataaaaaaattaaaaagataagccacgcataaaatattaatcatattttatcatctaataacaatgaaaatatgaattataaaaaaatttcatataagacggacagtcaaagttgaacacggaaatccagggtttaccttttttgggacagagggagtacatgtgtactacctagatcactgaactcttaaaatgtattttcgggtctctcaacttttctcgggtctcatgtagattcgaacaggctccaacccactccgtgtgctgacgtggcatgccatggtggtccctacgtgtcagtagaacccatacgctagtcacatatagaaaaagtttaagaacattttttttctcctctcttctttcatttatttcttcaaaattaaaaacatccttttctcctctctctctctctcctctttttcttttaaaaaatatttttttctctatgtgactaacatgtgaaactcattgacatgtaagttatatggtgccataccatttcacagagcgggttgaaacccgtttgaacctatatatcactcttaacaagtttgaagacctaaacatatattttgagagtttagggatctaaatgacatattcgtacaagtttaagggccacccatgcacttcactctagaattaatattgtaaactttgtcttactcatcactttaaccaaacagtcgcctactcacttttgtgccccaacgtagagccacaatgggtccaacagagcttcccatgcatgccctctcaaagggagtagtatatagcatggttgaaatgagccatgcataaaaatcaaatcaatacccaaaatccctagttctcgtggtgtccctaattcatcgcctacaactcaccgttagcaaatccctaactctctttgagccccaatttactatccctaattcaaaatgccgtaagagcaagtttaatagtatagctaactactagcttcaaatcaactatagtcaacttaatagccaattcatacaatagttacttacaaacatatagtacactattaatatatggtcccatatatcatatacacattgtgtcttgaagtccgtactacatctagctataaatatgtaactcactgctcttctctcctcttttatatcctcaatataggtttatagctgacttatagtctactgttgtacctgctctaattgctttgattcgacacctcggccattggatccttcaattctattgttgtcaccaatgtttgctcaagtttggtggtgtttgaatcttctgaagataaagattaagtgtttcacacaaaaagaggtggtaataacgtgtgattaattgagtattaattattataaacttgaaaaatagattaatatgatattttagaacaactttcatatagaaatttttcgtatgaaacataccgtttaacagtttgaaaagcgtgccacgaaaatccaaaatttcatccactgcttgtagcggaaacgaacaggaccaaaggttgtcacacagtgttggcttgtgaagcagaagcgcttcagcgatggtttggattagtgatgaacacaaggcgggatgtagatcgttttgcagtagtactaatgaagtagcagtggccgacatgtggatccagatccatacatcaatttatgctactgcatcagcaatccccaccgcaccagtgaggacctatttgtttcgagatttaaaaccgctcctcaccggttcaccaaaatcagtatcctgttcaagtcaaaaaggacatccatgacagtgaatcatagcccgtgaaaatggattatttcagatcattccatcgcgtgcatttccagcctttctctgcgcctttgcgctggccaccctttgcctagctagtcgcacgttacctttatacttcctccattctaaaatgttcgacgccgttgattttttaaaaatatttggacattcgtgtttttttagataatggatattttatacccggcttcatctatcaaaagatagactcatgccaattataacaaacgttcttacagagtaacacttggaaacaaaaccgagataaaagttcagacgactaaagaccgatgtgtctagctgataaccatccattggaactaaaaaattgcaaagctgatgactcaagatgttgcgatgccgcgatcaactgtgaacgcagatcctcatgccgttgcagcttcgcccattggcgtaaccaatgcgtacccctgaatagtacctgcaaaaaagatttcggtccgtaattgtcaaacactaactcgtttgttgttaaccaaactgtccagaaaagcgctgctgctgcagttaacagtaaagtattttgttttttattaccccccttagaccactgttggaataactcaactaagtttgatggggtacttataccaaacaaaatatgaaccgctcgccacaagaacttggcaatatagcaatcaaaaaacaggtgttgaattgactcaggctgatgacagaaagcgcattttaaatcaccatgccaattcctcctagctaaattatctttagtaagaatgacacctttctttaagtaccacaaaaaaatttttatttttgaagggaccttaatttgccaaatatcctgtgaaactctaataccattactgattagtgcagcatacatcgatttgacagtaaaatttcctgaggcctgcaaagaccacacaaacgagtcacccccatcctgtaataatacttcctgtatggaagcaagcactctattccatctactaagattcgctcccaccaaattccgcctaaacgaaatattcagaggggacgaactaagtactttggccacagagtcatttttccttctaacaatattaaacaatgatggaaatctgtcctttaaaggtttattacccagccacgtatcgcaccaaaatctcgtttgcgatccatctttgattttgaacgatcccaagcccag

SEQ ID NO: 71345 - DNA, 5162 bp, Oryza sativa
caagtagttcatcattaaaaaataaaataaaccgatttttaatgttttcaataattaatgcgtaattaatcatatactaggcctgcaccattagtgaggtttagtgtgtttattattaggtttctatcacttatcaaccggcaccgatgagaacgtacccctcattagcgccgctaagttggtgttgattgtcaaatccggtatccatatatggttgttattgttaaccgacacctgccgaaagggccgttctctactggtgagtgcaacaaaagactagccatatctcaaattaacaccccagttacagaagaaaaacaaacttcgtcgtcagcactctgggagacattcccttccaagcaatccattccatcaatttggatatgaataacaaaccaaactagaaacaaaatgaagttcgaaaagcggagcctagctcgatgctccattttttagtgtaggaaacatcgatagatgtatacgtatctgctattagtacgtagctactagctatctgtacagttagagagtctctgtcgtgcccccgtgctctcccatatcttttcttcacctatccccttcacatgagatattgataatgggatctcaatgcatctatatatattaataaaatcgtggttagttgttcaccgcgctgtcaacctacaccgactgggcatggccagtgagatgctctgcaaattgtacatgcatgtagtatgcgacactgaaagagatctgcgatcctctcctagctagtactaatatagctttgttgatgtctatatatatatataccacggaaataatactgcacacaggattccaccaaaaaggtgaccgttgcgtgacatgtcgattctacctgatctaatcggccagcaattcgctagtaattaagatattatatatatggtgcttgtaaaatattattgggcgacagctcagcttcaaattaaggacaaaatatatatggttaggtagctccagtttcccatcccacgatttttgtgtgaaaaatattattaggagacgtgcactactagaaaagcgttttccagacggcaaaaaatagtttttctaggcggagaaaataaccggatgtaagcaaaggcctgcaggaatagacgattttcgcaggcgacatctccatcttcacaggcgatagatccacctgcttgtgaaaatattttcagcgaaaaaaaattgccgacgccggcttccccctccgaccgacggctctcctcccccgtctgccgccattgcccgaggggagcgccgactccgccgccgctggtggctggctcccctcttccgtccagatctaggagcggagaggctcacgctatttgcggtggctattgccggagaacggatctaggtggtaggattggagtatcgccgccgcctcccctccttgttgctaagccgctgctggctctcctcttcatcagaccgggagaggagccaagccactgccttacctccttgtcgcggccgacgcctctcctccttggaaaaagtacgaattaccgccccccaactatcacggtcgaccgaattacccccctagactcaaataccagacattttacaccctaaactatttataccggactaatgaatcccctgaacaggctttgacttgagctagcacacgtggagccaacgtggcagactactcagcaaaaaaataaataaattaaaaacccatgggcccacctgccatccctctcttcaacccaacatatcccagcccccctgctctctctctctctcttgcgcgcacacgggcggccagcggtggaggtgggcggagctcgctcgagcgcacaggcgtccagcggcggaggtgggtggagctcgctcgcgcggctgggggcagaggctgaggcaagccggttcccccaaatccagccgccgccgccgccgcccggggtggcggcgcgggctcgggtggtgggcggcggcacggggacaggcgaatggcgacggcgcaggggcgggcggtgtgcagggtcggcgacagctagcttcatcgcggcgtcgtggttgcggagcaggaggaggagcctgtcgcagcagtccaggagctcccactcggcagaggcccagccgccatcggggaggaacgaagccaaaggcagaggcggaggtggcggagaggaagaccggaggcatgcggcccaggacgacaaagaggaagctgaggaggtgcgggggagatgtctagtggtgagcacggaagtggcagaggaagccggcatcgcgggccgcacagaggaaggatctgcccgcgagcgtggcacgcaccaacgcggcttgagaagggaagcggaggaggatctcgcgaaggaggtcgtgccgagcaccttgatgccgcccgttgcacggcctccccacgccaccgcccccggcatgcccttccgcgccgaccgcctgcgctgccggctcccgccagcactcgcgcgtcgccacaccccgcctgccctcgtgtgctgtccgcgcgcgtgactgcttatcgccggccctcgcgcgccgactgcttgcgccgtcggaccccgcctacccttgctcaccaatggctcgcaccgctcaacctgcgcccgtgcgaccgcgcctgacgagtgacgacgctagagagagggggaagaggaaaaaggaggagatgagagagtatgacaggtgggacccaccatgttaaaaaaaaagaaaatgtgactaggttgccacgcatacgccacgtaggacaaaagcgctctggattgggtcgagggggattattcgtctggtattgaaagttcagggtgagtgatgtctggttttcgggttcagggggaaattcggccgaccacgatagtttggcgaggtggggggggtaattcgttctttttccgaaaaataacttggatgcaagaattatacatcaaagtgaaggagaaatgaggtggtatgcaaagaaacacacatctggcgaatcaagtgcaagaatacggattgaagggcccacatgtcatgccaaaccgacctaaagtgagactaaacagctgtgcaccgccttaggagcccacaagtctgtcactggtgaaaggcgatggagagaagtagggccacgggggttcggccaaactgccatagccacttctcatcatggccctccacgtgttgcttactggttggctcccaatgacggttatgggtgtttaaccataacacaaccatcatcagtcacctataaatagagctcatctccctcacttgtaacacacacctcttggatagggatggcaatttccccgttgggggcggggacccggcgggtacccgcccctaccgggacggggatagggcgaattttcaacccgcggggctgcagggatggggccccggaactatgcgggggcgggggcagggccacaagctcacctgcgggtgacccacgggccctcggaatatagggatctaaaatatggcatacaacccataatcaaatttaagcccatatagcccaatatatatatagagatcagtaaagagaagccaaccctaaaatcaatcccgtgagtttgtcacctagccgccaccaatctctattctcgttccagtagttttgacttttgacgctatcccacaaatcacgcaacacatcacacgccgcatgctgcttcctcacctccacaaatcatgcctcgcgagttggtcccgcaccatcaagcagcagcggtcggcgctcttccacgctgctcgtatcgttgctctcacggacgccgtctcccaatcctgcaatccgccggcgccccatgtcgttctcctacctctctagccgtcggcgcctgtgctgttctcctccttctccgaccgttcctctcccttcgactgctgcaggttccccacatcattattcccttcctccacccggctgctgcaagttcccaacaccattctttccttcctccggccgctagcagtcgccgctcgcatctaggtgcggggacccggaaatggtgcggcgccctggaggggctgggggcagggattgatttcgccccgttcctcactccgggcccagggccgtgtgaacccgcaaggatgcgggggcggggccgttcctatccaacccgcacccgccccgtcccgttgccaaccctactcttggagtttgttgtgtgcttcacggaaagtgaggtaggcggcaagtggtggcagagtttttatgcactcttacgttcgggtatgacgtaagagtacataaatgccataaccacgctgggagaccagtagtgagtggtctctcagtagtgtgtttggaactaagtcctatgttgtaagcatgtatatgttaagtgtatactgaatatgattagtataaaagtaaagatgaattgtagttttctgatgctaatttcctactagcaggggcgaagctaggggcgggaggaggcctggcctcccccaatcagcagccgattcaccctaccccctaaaacaaagaaaattgatacagcatcacacttgtgttgatcgcctgatcccctgaattagttctgcatcagctacgtcatcattgatatctagttgtgagatgtgttagatttatatgtgtatgtgtatcctaagaaaccattatcagtttgctaatgacgcatggctgccgtgataagtatatatgtatgtgtttgagtttacatatcagtttccactttcctactaaatttgtagactaaatttgtagctgtagctgtaggtgtgtgtttttcttgcgcttgagccatgatgattaggaaactaattatacctattgctaattttgctaagtttttttttctaattactgtcaatttatagacttttagctctgatattttttaatcatctatagaaaatctttaaatttatatatatttatacaatttttttattgtaatcatttgttaagctggccccctcataattaaatcctagctttgccactacctactaagatattcttatagaggtgcatcttctcataattaaatcctagctttgccactacctactaagatattcttatagaggtgcatcttctgtgtgtccactacctattaattattatcctaactcatgtttgaactatggtgaattaattataagttaattaaggagatataataaacatatct

SEQ ID NO: 71346 - DNA, 1444 bp, Oryza sativa
gagctacaaatttttacggaaattcagttgaacacgttaaaaatcagacgacttgatgaattttcgtcgaaaatgcacgcgcgcacatacaaaaatggagattaccagtggtagctccggtgtcaccttccggaggatgcgccgcgccacgtcagcggccatggggtgcacgatcgccgaccggtcgaacaccggcgcggggggagatggccggccgcgcgccgccgccgaccacacgtccatgaaccgccagaagctcagcccatccgccacggcgtggtgcacggccacaccgaccgcgacgccgccccggtccccgccgccgacgaaccgcgtcacctgcacggcgagcaccggcgcggggagctcgggggcctccaggctgggcacgagccgcaagaacgccgggacgtcgtgccgcttggcggccgacagcgcccgcgcgtcgccgtcgctctccgcctccaggaacgcgaccccgtccccgacggcggacggcgagcagtcgacgacgacgtcgccagtggaggggacgtacgtgagcttcccggcgagggggaagaagaccgcgacggcgtcggcgagcgacgaccttagcgactcgacgagggacgggaagtagtcgtcggcgccaccgccgccgccgtcgtcgtcgtagaggaagaggcgttggatcggcggctgcggcaagaaccagacgtcgaagagggagagcgggatctgctcgaggtgcggcggcgagcggcggaggagcgggacgcggatggcggcaacgactctcacctccgcaccggaagccattgatccgatcaagctagctagctatactagctagtgactggcaaagtgacaatggtggttcattggttcaagtgtgtcgtgtaatcttgtcgcattgcctgcctctcgatctgtctgtagccaggattattttgcagttggggttttggcgtaggccatggatccaaactttcgtggatggagaatattgtctcatattgatgtattaaattaaatattataaagcgaacaaatagtttagaaaaaaaattatgtaaataatgttgatgtatttcttctgttctaaaatgtaaatatttttttagatgggcacgggaattaaaaaagtatatagaaataattggagggttatgattggtggagaaaaaaagtaggtgaaggggaatgtttgtggttggttaagaggagagggcatttgaaaaaaaaaaaagttttattttgagataagttactgtgatagaaatagctacattttacaatagaggtagtagaaagttttcgaaagaacagcatggcacgaataacccatacttccataccacaatgataagttctactccatatggattagacaagcacaaatgatgctatgccatttgatgcgggatatattgatgaatatgtatgctcaatattataaaaa

SEQ ID NO: 71347 - DNA, 18058 bp, Oryza sativa
  unsure (1)..(18058): unsure at all n locations
ctgccatctctctaaaggtgtaccctcaatggacaccccttgccacacctcctttacaatatcactgaaaccgtccctccgcaaccagcccaattcaaatttaaattgaggttggtaagctgcggacgcaccgcctgaattgtatagcaaaggtgtatgatctgaaatttccctagcgaggatgctaacagtagagagtgggaattttgtctcaaactccgtagaaactagaattctgtcaagcttctcaaaagtttgattttgtaagtgatttgcccaagtaaaagatctccctgatgactccaattctctaagattcaaagtgtcaattactgcattgaacagaaatggccatctatcgttaaagttatcattatttttctcctgtgggttacgaagtatattaaagtcaccacctacaactgtaggtatggtttctttagagcaaactcgtactaattcagagagaaaatgaccttttaaatcagactgtgctggaccatatacagaaatcaaattaaatttaaaatcatctgctctctgtcttaatttaaagcgaatgaaaaaatctccttcctcaatttctccaatgtcaagaaacagcaaattaacacctagaatcataccaccagagcgccccctaggggccatgcagtgccagatgaaatctctgccagcacaaatattatttaatgttgactgaggaaaagaggctctgcccgtctctgataaagcaataaagtctagattttgctccttagttagatcagacaaaaatttatatttttgttattcaaaaaatttaagtaattattaattcttgtcctatcatttgatttatggttaaatatacttttatgtatacgtatagtttttacatattttacaaaagtttttaaataagacgaacgattaaacatgtttaaaaaagtcaacggcgttaaacattgccgttaaacatttagagaaagtgggagtaatcggtagaacctggataattggacagtggagtggtgtctgtcggtgcggcttctcgatcgggtgcgcacggtgagtgaacgtgatcgatcgatcgatcgatcgcccggggcatcgtgggaggatcccgggatccacacgaccagatcgtaaagaggagaatgtgtgtgtgatgtgcgcgcgtgccggcattcggccgaatgctgtggtgaacggccggcggcggcggcacatggacggagttagtagtacattgattgcttcgatccatgatccaaaccaaccaacgacctgtgatgaatgctgagcctcgccgattggccgtcgctgtctgttccatcggtgagaaagtccaaatcacgtcgttatccgccgcacctctatgctagcgcttagctcaggacaaggcaagaatgatctactccctccgccccaaagtataagaacataaaatcagatcaaacatttaaacattttttagtcctgtgaatctgaacaaacaaccagtctagattcgtagtactagaaaatatctcatctggtactagattcttaggccatagccaacgctccatgctagaccgtggtctcacctctcccgagatgaatatttgcgccacgttagagggagtcgcaccccaggagaggttgcgaaccttagcagaggtgcgggtagtttcgtcagaccacggctctgacatgcaaggaaaaggtgaggaagcgcgttggggagaggcctcgccctgtgccgtcaccctgcgccgttgcaattaactcactcccgcgcattgctgccatgaacgaggtcgagaagggccttcccggcggcgcatcggaggatgacagtaaggtgcttcatcgcgagaagacgccgccggtgactgacgcctctatctgcaccgttgttggctatttcgtcgccccaaccattgttccaggcagctccgtcgccgaagtcatcggaccgttgcccggatccctattgcgtcggctcgatctccacctccaccgccccccgccgtggcgatcgagtcaggcaacactgaggggagagaggggagaggcagagagacggcgtcgccggagacgagaggggcgaggcatgcgtgaggaagaggagcgaccggcgaggcgtgcgggcgcgtggaggaagaagagcgatatgtgcggcgctgcgcgtggggtaaggaagggattggatgggctgagagaatatgacaatgggccatgtactaatacgcaattttttctctacacaaagggctgacatagaaaaatgtttatgggacccacttcaaagtacggagaatggttgcttaagccgggtcttggaccgcttttgctctcgtggatagtggggatgttgcctgcgttggtcttagccttatattttgggacgaaaagagtactaggactgggcaaaggttgctttgctgggcttcgcagatctctgcgagtaaatttcaacatgagaaaacatacgctgattggtactctgtttaactgtttttgaaaggcgcactgttactcctactccactcgcttcaatttcggctcgtcagcgcaagatcagacgatcttgatttactccggaatttcctctgaaatctgtcaacatattgttgttccttttttttcccatttgtttgattgtttgacatggcttctgaaacttcctccccttgttaaacccacttcacagctagaatcgcacagaatacggaaatgttaaacaccggtatcccgtttgggctcgatcgggacaggacaatttttttagcaatcaccagaaatcatcacgagcttatccgagtcccactcccaagagagacacaatgtttcttgtgcttatccgagtcccactcacaattctctcaccgtgggcatggcgcgtgagatctcgctggcgccaacggcggcggtggaggagccggcggcggcacctgctcgcgtccgccggcggcggcagctccacctcttcagtgtcgccgctgaagtgcacgaggtcagtgtgggagagcggcgtgagcgtggtggtggcgccgacgccggcgcccaccgtgttttcttcggttgacagtctccatcaacaggaggttcttcattttcttgctttaagcagtgtcaagaaaatcggtgacatgaattggtacgagcatatagatgatacatcgatcgaatctgatatgaacttattcatgtccactccctgtacatatatttgatctggaagttgacggaagcaaaaatcgtttccccatatataaacaaatgaagtgtattacatggggtaaacctttttgtggagtaaataccagccatgatactgaggaggatcatgacacctcccaagtatcacatgatcgtacttaggtataatctatgaaactcacatgaaccatgataccagtcatgatactgagaagaatcatgatacctccctcatatcacatgatccttctaaggtatcatctatgaaatatgatgataccagacatgatacctgagcagaatcatgaaacctcctacatatcacatgatccttctaaggtatcatctatgaaacctgatgataccagacatgatacctgagcagaattatgatacctccaacgtatcacatgatcttcctaagatatcatcagtgaaacatgataataccatccatgatactgaggaggatcatgatacctcccaggtatcacatgatcatccttaagtatcatatgtgaaacccacagaaaccatgatagcatacatgatatgtaagtaggatcatgtgatacttcacaggtatcacacataatgatactttgcagtatcatgtatgaaactttcaggtatcacacaagatgatatatacctagcgagggatcatgtgtgaaaccttcaggtttcatgataccgagaaggatcgtgatacctcctaggtatcacatgactctactaatgtatcatccatgaaacccgtaggcaccatgatagaagccaagatactcactgtcttgatggtgttactctcattcacagatttttcctgcatatcacctcgattcttagactgggccttctcaacatgttgtcctcccattggtgtcaagttcattgatgcaagctttggtgtcaagttcattgatgcaagctttctcagctaaaccttgtattgttttgattgcaagatcatatccttgtaaaacacgattccgaggatgtttcatggggaagcagaagagccagcggacggcgaggcttccgctggaaagaagcgaggaatcgcgcgccgcaattccgaggaggtttcactgggatgtagaggagctggcggatgatgctcgcgccggtggaaggaagcgaggaatcacgcgctttctaggaggatttgccatgatgcggagaagccggcggacggtgcgcgtgccagcgggaggaagcaaggaatcgcgcgcgaaggcgcgcgcttccgaggaggtttcgctgagatgtagggaagccggcgtttggcgagcgcttgtcgtcgttcacgttttgctgcaatgcacgcaggtggcggacgacagttgctgagagcgatgtgatattggtaccagaatcgtccccttttttaacgggattctggtatatagcatccccccacagaataataacatctccatgttttgtcaccactcaccaatggaccatgagggcagcagacaatctagaaaagattaaacaagcgactctaatgaggtaatagcacaaacaaacctatactttcttgaaaccacagacaaacatcttcttgctgcctatacaatcaacggatccatccccaacctatcaattgccctcacaatccctcacatttatccgttcctatcactgttcataagtctatttgaaaaagaggaagaaaaagaaagaactgtccgtaagactattctgctactctcatgtccttctctgtcgacaaaaccggcaacagattgttcaggttaaggcacggtaagattattactactcctaccgtgcatgagagagagatagagagagagagagagagagagcagggcctacgcttaaagccgccattattgcggcacccctcccctgccacaataaagctaccacttcaaaccagctatatggacagctatcctaacactctactactacacagggagagatgatcactttgaagcaaacaagaatagcaacctcagcctctgcaatgattcagtgcagttgcaccccccaaaacatggcccggaactcgcagcttatttttttgacctatacggctaataacttttctcatgtgtgttccatgcgtaacaaataagcatcgaatctaaatcagacactttaaatactcatatagctaactctttaattgatttggatagttaaactaggtccttgctctaacgctctttattttaccatctccaaaataacaaaggacccacatgtcagtctctactagcattcgttcttccttttctttctccccctcttcctcttcacccgctggggcaatggacgagccgacaacgcgaggccacggcagggtcgctgggcagcatagcagtgggtcgcggcgataggggcggtgacggagggcggcggcagaggcgaggcatacaacggcggcagtaaattggcacgggtgagacaaatggctgcgacaagggcgaggtgatgggtggcagtgacatggggcgaggcagcggacggtagcgagacaggcgagccgggtacaggaagcgacggacgacaacgggatagacgagttgcagagggaaagcaacaatattatatcggcgtgggttaggcgagccagacgatggcagacatagggcaatgacggtaggggcaaggcagatggcggcggaggcagcaacggcgaggcagcgagcgacagcaggggtgaggttgccggagagaagaaggggcttgtgggagagaaatttggtgtggggtccaccatttggcaagtgggtatggatggccagatttggctagttaggagagggatttggccatccaaatagcttggtaaatcgaatagagagtctgttggagtatgttgttttgctagatttgccaaaattcggcttggagagcaatttggaaaggctattggagacttggagttgctctaacgaatggaacaatggattaacatacatgcttcctaagctctcaaactatgtgatttttaaagccttttatgtacttctgtaataaatttatttttagtttcttctatttatcccaagttcatttttagagaaattattacatcggagtttgtgaaagtagtgaataattatatttaaagtagatatagtcagaaatagttgcattaggatttgataaagtaggggtattctattttttggttttgtattggtatatgtgggatatgtgaaaaatgatcttattttggtacagaggtactccgtccgctaatataaacatttttatagttgaacacaaatattaagaaaataggtataatcaaatgggcgaaggttgtgattggtttagtggtgaaggtaggtgaggaaattgaatgttagagtgttgtgattgattggaaagataatgttggtgaagaaattgttatattttagggcaaatatttaatgctagaagttgctaaatcttgggacgaagggaatattaagtttataataacgaatactccctctgtcaaaaagaattcaatcatggggatgaatctgaacatagggcttgtttggttcaataccctaccaaaatatagtttttgcactaccaatttattggtagggtagagttgtatatggttcgaggccaatttagaaccaagctttgagtagaatatagaaaatatcaaattggatattggcaatgcccatgatttggtttcaaaccaaaactgtcatatacactgttcaaactaccaaaatattggtagggcacgttttggcactaatccaaaacggcccatagtgcatgttaggtttatttgcaagattaattttttccttctgaaaaaggagggaatacgctatttgtgccgttgaatagggattataaattatttaatcatttagcgcaaaagaacaaacctcccaactgccatttagtgaaagagaagggattgtactatatatttcacacaaaacaatccctaatactttgaaacccgtgtaaatcccaacaaacataactccttctccttcactttttctctcactacgccacacaatacacaacctcctacaccatcgctgccccatgatgacgttgcttggcttcgccgattggacggaaaatgtcaatgaatccaacaagccccctacaatctctactcctccgcaagccaatggcgacgaggtgcctctatctgttttgccctcgccaccaacaccaacccactattcgttgtcgaccgtgcggcttcgttgccaccgccgtcgtctcggcgtctactgcctcccacgatctcctccctcccctcctcccactgccctctcacccgtattttaacgtgggaccctagtttgtaggtcattgatgggagttttgtgtgtccccagtgttaaagaagaagggaggtcgttagagctaggggagaaaggtttgaaacacgaatcgtgaagcacatttgatgatccaaaatctataatatttaggtatagattttctgtcgatagaaggtaaagctatcctgaaaaagaatgccctagcattccattccacatcatcacttgcccacttgagagttgagatccttcctcctactccaccggatcgctttggagaaagctgttgcctacttggacaaactcaacgcaaactgaagtttacattagggcatcatcaatgtttgtggtgtagtgtaatcttaaggtgggccctataaatagtgagccattgttatagccatacccataatgctatggttagaatttagccacaagatggccacatagaattgaaaaataattgtttcatctcttgttcatgaagtgaatgagagagaaaaaatattttctttttgcttgtggtagaacttaagcataaggtgcaccctaagctaatgctactttccacaatgtatatagctcactttacaagtgcaatcattatcttaaagttatctttttcatacattgtggttgcccttagtagaaaagaaaggggaattaaacggctgcttgttcgaagctggtacaatcatcgtggcgaggggcctctagtagtttaatggaggcgtgattaatgatggtaatctacggcacggcatgtttttggttccaattggggacagcggattaatctaatccgagggagggatgattgctgctgctgatgctgctggtcccaacagtggagcacccctgatacggagcagagcgtgaggttcctgcgcgaaatccagtggggatggatccaccattcacgacaactaacatcgaatctcaagcatcgagtgtgcggcaaataccatgccaattaaacaaaaaaaaacttgtactgctatctctgtagccctctaaataatgacggtactaagatccgtttaggtgaagaaaaatgtggtcaggacagtggtatgatactgtatttactattccaaggcttaattagcagcagtacactagcagtactgcatactgtagaaaagttcagacaattgtttctctgatcgagtctgaatgctactgcatacgatattttttttctcactttttaccgcggtagtagttgggggtggaatcaatcgttgtgagggagagggaccaggcagtgctatgaacaggcaggcagaagcagtggtgcttactgtggtcataggattgaaatgtgcaattctggtgtaagccaacctgaatgcagctgctgctgataggggacagcgctatcttaccccatcaataatgtaagtgcagggtgcaggaaaaaggttgcaaccatggccaaaactgcagcagtatgactctctcttcctccccctcctcacacatggaccaccaccaccacaaccatcatcatgatcaatccatcccctctcctccatctccattgcattgctcccacaattatcattgttatcaccttcctcaccttgggatggagtattatagtctttcttctctcataaccaaggaagaaagaatagcatggcattgagtagacaacattccactactagtggcatgtaaaaagagctctgtagctaggcaaccctccactgtcacagtcacaaaggcacaaacaaacatttggcaacacattttgctttgcacattgttcatctaccatgcatcaccacaacaccttatggagcaagaaggaaaccaccaccaccaccttccttctcgaattataaagcaccatcatcatcatcatctcttatgaaaaactatagataattactatacctaccttcgccttcaaggaagttgagttctcctttaaaagaaaggtgaaaacgagctaagtaaaaaagaaaaaagaaaaagaagaaaaaaagaagagcgatctagatgggactcatttcccatggtgtatactggttgactgatcctgagagcatctctcaaccatcatgatggcgatcacctgtgacctgatgagcttcttcctcagactcctggttggttcactttcttgaacaacaaaatgagcagcagcaacaggaggaggaagaaagcaatccggacactggagacctcacatcaccgagcagctgttcgggttctcgtcgctgaagtagttgtagggatcggcatgcgggtgcggctgcattgggtagtgcatcgggtacggcatcggcggccggccgtacccgtaccccatcgccgggtaccccgccggagcagcgccgccgccgtggccatggtgaccgtggtgaccatggtggccgtggccgttcatcatcatctgctgctgctgctgctgctgctgctgcatcatggccatgtactgctgctgggccatggggttcccggccgccgccgcggcctgcagcatctcgggcccggacggcatgccgccgccgccctggtagaacgctgccggtggcatgccctgcacggcgccggcgcccatgtgggggtggtggcccatgggcatggtcatgggcccgccgcccatctggcccattccggggaaaccggcactgccgcccatcatgttcggcctcatcatcatggcctgctgctgcgccggcatgccgcccatcggcccaccgacaccgccgccctggccgccgccgcccttcttcccctgagcagggtggttgccgccgccgttcggggcgcctcctccccccttggcgttgttcggctgcccgccgccgttcttgccgccgccaccttggttctgcttggcaccggagtctttcttgccgccgccagcggcgttgttggcgttccccttgatctgcacggggatctcgttgccaccgccgcccttcttgccgccattgccggcgccgccgccgttgttgccacccttcttgtcgccgccaccaccggcgtttggtggcggcatggccatctgcttcatcatcttgggatcgtcgaagtagtcgtcgtcgaggccgtcgtcgtcgaaatcgtcctcgtcatcgaactcgtcgaactcgtcatcaaactcgctgccatcgtcgccgaagtcatcctcgggaggaggaaggttgaacttgacggacttggggtccttgatcggcgcggccgccgcgaacggcgccatcttggcggcgtccatgaactgcggcaacttcagccccttcatctgcagctgctgctgcagctgctgaatctgctgcggcgtcggctgcggcatctgcggcggcatcatcatcttcacgtctttgctgccgcctccaccgttgccaccaccgccgccgccgccgccccccttctggcccttgccgccggcgtccttgggctggcccttgccgccgccatccttgggctggcccttgccgccgccgccgtcaaggtggagcttctgaaactggttgttcaccgccgccaccccgaccttggaaccccatagctccgccggcttgccggccttgttgagcttcttgataatggtggccggatccaccaggccggacaccgtcaccttcccctgctcagcgtcaatgctagtctggtacacacctgcagagataaatccaacgagcgtttcactcagaaacagggagtaaaaaatcacccagaaaattaaacaaccatatagctgatgaaaacaatttggttttaaaaaatttctctgtttttcataccttcaatcttgtggaggatcttcttgaccttcttctggcacccatcacagtggatgttcactttcagcacacaagtctgggaatttgggaggaacagagaaacacaggtttaccaaaacggcaaaaacagagatgttttcgaagaaaacatagcaggagacatgggaggagcacaaagtgaaaaacaaaagctagctgcccctgcctgatgaaaatggcagcaaaaacaaggagaaaaaacagaatgtctgtatcaccactagttctggttttgagttgaaaagaagcaaaaaagaagaagaaaaaactgacctgaatcttcaggacttcctccttactcatccctgaccacctcaagtgcggctccccccaccaacacaagcacaagagaggcctcctcacagatctggcacataagagtcctcaaatcagggacataacaacaacatgaagaagacagcagcaaccagcaaacattgccttctctcaagaaaaaaaaaactctatgatgagcaaaaacagagaagaaaaatgccttcttgctgaagataagttaatggcctccaatataatatctctccttcacacactcacacaaagagtaagtgctatggagagagagaaacatagacaggattattagagttttgcgtgtttgcagaaaaccaagagggatgggggggctcctattaacccggtggtccagagcagaagaaggaagagaaggaggagcaagaagagagcctcttctctctactccacactactcctgcaaagcttaatataaacacacaggcaacaccatctcctcctccttacccttttattttgctttcgccttcggcagtgcagcctgcctggaagaaggcctttctcttttgcaccctccacacagattgtgaaggaagggaagcctggggctcttgcaaaagacttgaagagaagagagattaaataccactttgtcacatgtcagtaagtacagggagatgttcaacatgtgaggtactcagatgttacacccaagcttgcgatgtcggtttttttttttttgcttttttgtaaaagtgtccaggaaatgttgctctcctgataatttcatattagcccctctagcctctgtagtattatgtagcattttggtcctgggtttcttgtgttcacctgttcatcaggtcaaaaagatttttctgaatagttctagagggacttgtgaaaatttagcaaattgtacgtaggagaacaacgacgtacacaaatatgatccatgcagatattaatattttacgtgaaaaatccatgcaaccattcaaaccattggttgatgcacgagcgcttgtcctattcggtcgtaactcgtaacatatttcgtaccactgacgaataaggtagctttaaatgatccaattgtgaaacgtgtagtcgttatgattcgccaacgtcattgcaatgcccgtacaaaaagatatattacattttagttttgtcgcacgccacattatttgtcggcatagacgttacataattaaagaaaccattttcggttatatacgacaacaactggccgacttcataaactcgacaaatccgtgttgccagaaaccgatgaaataggcacaccccgtttgctcccgtttatcatcctactacttcaactcaaataaggaattaacatggaaatgcagagcaaaaataggagaactccattacatgacttttttttttactctgggcaaaaggactcaaccataattaccctcttacgaagggactaatgcgcaaaagaagacgaggagggggttccctgtgctgatcacgcccggtcaatcatgtaacacgcggctttggggcatcgtcacgctgtgcaggcaaggcaaggcaaatgtggtccgtagacgcgccgcggccacgccctctcatctctatctctctactctatctcccctggctgcgccgcgccgcgctgccgtggcgagcgagccgtgcgcggcgtgggctgcgcgcgcggtacgtcgtccactactgcaaaccgccgcgagcgagacgatgatgcggtcacaccatcctcgcgtcgcgccgtggcgtggcgtacgtagcgcgaggcggagcggcagcctgcatccatccccaagcctgtggtgtcagaggagggtggtgagcacaataactactcaggctttctttttattgatgacgccccttgtttggcctttgctcctctgcagtctgcatgcgtttccaccctgattttcttggtccactcttccgttactgcctttttcactactcctactctccaaaaggaagagggagaaaaaacggctttggtcacgctgtgacggatggacggttcagggctcatgcggagtagcagggtattgcagtgcagctgttgttgtggccgatcgtttggatccatcgattcgaggatcggtcgtggctttgttttgacgttgctgacggacgcgaatggcagcagcagagggatcgatcgatcgatcgatccatggatgggtgacagtttgcgcgtcgctgtcgccgcgcttcttctgctcgtgcgtgacatgcacactgttcgtctgtgcgagggtgcgcttgactgttccctccacacggcatcggcgctaaaatatcatatgatcagttccagcattcgagccatgtatatggactacatgatcgatcgatcgatcaagcagggaacagttgggttcaggttcagagaggattggcacgactctgtgtttcgtaaatccgttgaatctttggagatactactagtattacaatatcaagcaaagaaaactactgtatctgtcacaagccaagatactggtactgtactgggtgtagttgagctagagatatgattgcatcatcacgagcaaatcgaggttactatggatttgttcgtatagtctcatctttgacgaagaggcgccgcaccggtcatgcatgctgctggagctagactgatgtcagggtatttgaggtggtgctagagctacactgatgtcagggtatttgacggtttgcactagccactgatttttcaacctgcggaaatttgctgtcatccatccattccatgggttacagatacatctactggtagctgtacatgcatgcatatacgcatgcgctcctaactgatcgactaatctctgtatgcatttgctagtatcgtgtttggcagtccaaggcaagatcatcagtatcgggatacatatgtatcgtagattcgtagtttctatgatattatctgggtgaaacgatacatgttggttttaggatcgttttcagtgtatcacattagtatcggaatatggagtgtaagattgttagaatcgctctagtatcgagatactaaccgtttaaaattagacattatttgaattcaaaaaatcaaaactatctaaatgcatttgtgttcatgtatctttaaaatcaatgtaaataaaactattagcattagtggatgattttctctttgacatatctctctttattatggtatatattattattactttttttagagtggctatatataattaatataaattaatattaaattattttttaagaaaaatatcatagtatcatggagctaagttggatccagatactaacaacctttgtccagaggctagttggacacacatgcatatatatccatgagtcccatcatttcacctccagttgattatatgatgtactacccccgtccaaaaatatagcaatgagacatgtccagatacattatcctggacccatcctaggttgctatattttgggacggagagagtatggtttattagtaataaaaaacaatgtatagtttaaaatttttatatatgtatttttagcgacttaaaaattaatattaaaaaaaacaacgatgaaaaatgatcaaaattgactttaaaatttatattttaaatttcaattttagcagcagccgataaacgttcatgcctgtacacatacttttttttttaagagaaaggcagcaatgtacaaatacttgattactactacaagaggacatatggcagtagtcgacatatatacacgtacagcgtacttgaattttgtacacatgtagtaattgcttgctcgcattcaggcttactactgtacaaccacaccctgaatgcagtactgcatatccgtgtgactctccagtctccactagtgaagtatttgttctctctcccatatgagaacaagaggctttatgatcatctagtcattgacactagcaataaattggctcgacgtattcttttgcagctgtgcttgcgttaacccatctccataaaactccaagagccaaacagaaaaaaagaaagagataagagtgatcagagttagccaggcccagctaagctagctaggttcgttgtggcgtgccttgtgagtgaagaactgaatatgatttcgggaagatgtaagatgtaacttggaagtagttgtggtgaaagagatggctgcttgtgctggggtttggccggcgccaactcgtgggacaccttgtagagatcagatgttactagtgatcgacttttgcaggaggaagctttcatggagagatgcatgcatatggtccggatggatcggattagttggtgtagaaaaaaggaattcagaaggggccagaatatgaccgattttaatttgttgagatatcgacgaacgttgcatatgcattttggtggtgttcgcctagcttagctgcagcctacagggtcagccaccgccatgcaggaatcagtcggtgacatgttttttgactgatcatgctttgtcagaatgtgaatgccatatgcaggagtagatgtagatcactgcatgcatttttttttgcaatcctgcgtactccctccgtataaaaataaacaaacatagtacgaagtgtgataatataaatatcgatagattatatatcgtggaagaggattttgatccctcgaagagatatctcctcgttgtttgcatatcacttaaatggttataaaaaaatttaagaagatgtattaatatgtgatatatcactccacaaacatgcaaataaaaattcaacttctagatctcgcaacgaaaaaaacaaatttgactctgaatatacgttaactagctgtggttcaatttgttttttcgttacgagatgtagaagttgaatttgaacttgtatgtttgtggagtgttatatcacatattaatacaccttcccaatttttttcaattttttttattaccatttaagtgacatacaaagaacgaggggatatcctctcgagggattaaaacagtttccctatatatcgtactagatttgtttcttgttttagaatgaagggagtacgtgcttatgttctgaattctgtgattgaactaccgaaccgaatatatgatcatatcggtcgatcatggcttggcttcggacatgtatggaaagcaaggaatggtttttggccggctttgcacttgtgaatccaagtgacagcaactgaactcacaagacaatactccaggtcgatcgtcgacatcagctacgactctgacgtacgcctacggaatcgatgcaaagagatcagttgtcctatactataactttagctaattgcaaatggttatatacacttcattggataccgacgtgttcctacaagacgcgacatacattcatgtcggcacgtcaggttcatgagcccatgtttgatcatgaaacgtcagaaagctttgctatgattcatcatttgcaacgatcggtggcgtgtttgagaacactaattctccctagccatcgtttgttttggctactgatgtaaacctgagatgttagttgtctggattcaggatgcatggggagcagacttgacatcccaggacatcgattgatcggcatcaaaagtactgaggaagacatgattacctacacagctcaatgattaatcacatgacgcctttctatacaaaagaggatgataaattcttcgtttgcgaaatttgaaacttgcttcgatcgacatggaaatcaaacaaagaccgatctactagcatacaaatacataatacattgccaacacatatagacaagaagtatactactcgtattagccaagtagagaggcagaccttaattgattaactaatgaatgacccccatcatcagaattaaggaggaccggtagtagtaccttgtaagcattgctaaagcaaaaatcaaacaagacgacgacgtttatccacaaacctacaaatgatttgatttcagatgtgatccatttaccgggcttctttaatttatcgtaacgccaacgaaagatttaattcctcatgcggtcttggaatgatttgattcgatgtggaatggaacaataatggaagcagattattgaattgaactatgggcatctacgtacgtagcaggggctggaccaggttgctgtgttgatctggatcaaaccaggccggcttggtcgccatgtttgggccacatacagtacggtacagctctgaactgatgtatgagcgtctgtatagtcttgtcgtcgtcatgggcctccgggaccacgcgtaggtacggggttgtttggttggtatactcatatcaccaaaacttaccacacttcatttagctaatatgcctaacatgtggctaacaaaattgaagccacacttcagccatagaagagcaaacttgccacacttttatgtgccaatgacatgtgggatccacatcatggtgaaggaatcttgccataagtgtggcacgaaccanacagatgcctaacttag

SEQ ID NO: 71348 - DNA, 7157 bp, Oryza sativa
tagatgtcgtactatgcactaactcgcaaacccgctataccgagcactggacgaatcatgctgcgctagcaacgcgccatgctactccgaccatgcgccataattgcatcggttgtataccttgtggtcgctccgaccatgcgccataattgcatcggttgtataccatgtagttgctttggtcacgcataccaccgaaccttcgatgtgcatcaaactgagcattacattaattcccacatatcttgaaaggtatgctcgaaaaagaaacggtaatactcacatacatatttagtcctttgaaaggatcatccgatacataatgcgcttatgaaatagctgcaattgtgtctatttgacactacgctcttcccaaaccaatctagcaagatcacacatattggcacctgcacaatgagaaaaagcactaggtaccggaaattggtaatgaaacctattatgggcaatattctcttcatacaacagaaactcattggcattgacctatggttgaaaatcaacctgcaagttgacctatagttgataatgaatggctaaagatatttttggattgagcactcgcatacaagtattaaaagccccaaaccaagatgatgatccgaatatcatcatataaaaaataaaagctcactcttttggaacgagtttaagataaaattgggagaaacctatgttgcttaggcctgtaagcctacaacatgtgaagagtgaaccatactatgttagaatatgaaaatacataagttccatggacatagttcgccatttctagcaagtaacatggttctaactttgtccaaaccccaaaatcattattaagaagataatgatatgtgtgtcgcatcagcactgatagactatacaaactctacaagtcatagacatgcaagatttgaccattggaacatcactcgcactatgtctgaaaaaaatgatacacgcaacgagttttgatggttcacacttaaaagagatgcaaaatttagggggatattttgcatgtctattaacaaaagcttgatctgaataatcaagtacccaaaaccaattacaaaaatcaaagcaataatttggatagattgtactctttttctcttggataagttttgtcacgcccggaatttctatccaaaattccaaacgcttacatgtgtgtgaaccctcgtccaggaatcagccgaggcacacaataacaaattgataatagagtacaattatcactctaattaataagcgaataaaatgtcattacagaggtagatagttcctctcaatcaataaagatctaagcagcggaaaaaataagataaacgacgcagacgactccactccacaggcagcttgactagggctacacctaatcctccacaccatcagcatcactgtagaactcctcctctgatgaatgattgcaaggtgagtatatgacatactcagcaagccacgcagcaaatatgcaagtgcacaggataacaaaggatggcataggagggtttcatttgcataaacagcatttaataaacatttcagaatttaataaaacagttaagtaataattaaacaatattaatccaatgctatacaacataccctgttgcataggcccaaccattctgaacaaccatcccggctgcacagttctatctccaaaccaggaatataccattccaaaccaggagctaatcaaattattaccagttatagcatcttttattatgatgagaagtgtgagactaatcacgaaagacattgttagacccgcccttaaccgcgggcacggctattcgaatagttttactctggccagaggtgtaccactgtacccacaagacacagccccacgacatgtcaccatgtgcctcaataccaccacggtaccttggaaaggagctgtgacagtacccctcgcacaacacaattcaaagcagtgcaccgttcctggatcataatcacccctttataaacaaggcatagactccccaacgacccccgtgggcttatctccgccacttctcagtctggtgctccgcaatgaaccatgctatacaaaaggtaaagccgttgcccacgctggcttgtggttggcacggttaatgtttcacaaccaaaactcgtgaaccggttcttaattgtcatgagcacgactctcaaaaccatgtgctcacaacccaccattatcaagttttagttggcaagtaattaattaaccaatcacgattgaccatcgtgaactatcattaagccatcattaagtaatagtgagtcataagttatcccaatagtgtgctaatgtttctaagcatggctaagcaatcatatctaatatctagctgaaccactatatatagcccaactagtcaaattataataacccaaggtatcaaggaataaagtaatcaagaacaaaagggctataacaaccaataggttaattccacccaatgacatttgaaaataaatgcaatagttgaatagaaacaatagctttaaacgtgatcaacatgctcaaagggttgtttgggatctgtgtgacttgccttactggccttggaactcttcaaaatcctctcctgcaaactcagactctccgaaaacgtcggaacctaaacagaaaagagcaaaatcaccaaaacagaacacaaaccagcatgaacagtacatgtggatattttcaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttaaaaaggaaaagggaattattgcgtcagcgagtagggttcgcggtggaccgagtgcacggcggcagctcacggaaacgaacggccgagatcgatcctatccacaacgaacggccaagatctaacggtctacgaccggtctacgacggacggcaacgatgacgtcggcaatgacgtcatcaccggcggcggctcgggcggcaagctcgccggcgaacaacggcgcgacgacgcgaacggagacaccaactcgtagagggcaacgtggcgaacttaccggtgaccaaaacaacggcggaagatcaacggacggcgacggcgtcgaggaagaagcggcggtaaccttcggcttgacaacgacggcggtgctccggcgacctacggcgacggcgaaggggtggacgagatcggcgacggcttggtgaccacgacggcgacctcctcgagcagcgacgacgaccggagcgacggcggcgcacggctggagctgcggcggcgacggcggcgctaggctacacgatgctagggctctaccggcgacgagaggcgaaggcgagggtggcggcgggtagcgacgggcttgggggtccttttataggggctaggaggcagcgttggaggcccacggtgaccggcgacggcgaaggaaggtctagggttcggggagagagacgaatccgattcgagatcgaatccacggatttccaaacgattttagccgacgattccaaaagaggaaaggtagagatcccgaagatcatttcccctctattgatttcaccggaaacggaaaggcgtggccgaatttggaaggagatgacggcggcgcggcgatagggctcgggcggcggcagcggcgcgaggaagacgaagactgacaggtgggccccacctgtcagcgggcggacgcgcgcgcgggcggctgctgccggattgggccgactgggccgagggagagagagaggttttgggccgactttcggcccaaagccaaaagacttttaaaaacctttttcaatttaaattattcatgaaatgcaattccatttattaaaaatacttccttagctcaaataaatcccagaaaaatctaggaattatagaattaagcaaagtatttaatgaaattttatctggcctcattttatattggaatttattaattaaaactagatcttctcttctaggctttttaaaataaattctaataattccaattaaacaacaatttatatatttaggatttttagggtgtgacaagttttcctctagtttcttattaagggttttaatgaggcaattcgtgcgacatactcccttcgtactcgtaaaggaaatcgttttagacagcgacatggtgtatagaacacaactttgacttcttgtttctataaaaatatttattgaaaagtgatatatgtatacttttatgaaggtatttttcaagataaatctatcgatataatttttacattttcaaactcaataacttgagagttattcatgatttatattcttaaggtttgacttaaacattgtactaaacgacttcctttacgagtacggagggagtatatgcgtacgctatgtactatttctccaatttatccgactgggtttttttgaagctttaatagggcatagacatcacacggtgagtgtcaagggggagtccatgaaggcctagtctaaatacactaattggacccatcaccgaaccttgcatatttgcgaatgcattatataaaaagaggaggggccagtcatttgtacacttggtgaatggattgaataagacaagagagtctcacctctagactttgtatctccactttatacactgaattatacaaccttgttggactactctgtagcatggggttatataatatgttgaaaaaagaaaaaaatagatgaaattattaaattaaatggataatagttgtacttatttaagacaaacggtacgtgaaaaaaaataaatctacgccgaaaatagctactccctcattgctttctactacgcgtttgcgccgttgcatactctccttcacgtccctccctgtctccctatttgccaatttgccacagcatacaaaactcgaaccacgacgagagatcgaccagtgggtccgacacgaaaaccagagagccacgtcaccgatccgccgtctccgtcttcgcgcgcacctccctccctccctcccaaaccgaaaactccgcccgtcttcccgccgcttccggatccaccgaaatccccgacgcgcatcctccgccgtccgtcccatcgcatccgacggcccacgtccacgatccgcgtgatcgcctcccattggctagccacccgcacccaccacccaaaaccaaccctatatatatatctctctctcgcccccgaccactaacatcgtctcatccgccgcctcccctcgcctcgccgcgcgcttcctccgcctccgccgccgcgtcgatctcgctcgcgcagccggtttcttctctcgtcggtgggtggggtataggatggcgggacgcgggaaggcgatcggcgccggggccgcgaagaaggcgacgtcgaggagctccaaggccgggctgcagttccccgtcgggaggatcgccaggttcctcaaggccggcaagtacgccgagcgcgtcggcgccggcgctcccgtctacctcgccgccgtcctcgagtacctcgccgccgaggtattcgctcctgtacccacccgttctcggattggatctgatttgatggcgattgatttggggatctaggtcgccattgtctccgtgttcttggatccgttcgatatgcgatattgccgcgaatccgtggggattgggtctcttgtggggatcgaatttgtgatacactagattaaatttggccttgtggtggtgttcgtcaggtgctggagctcgccgggaacgcggcgagggacaacaagaagacccgcattgtgccgcgccacatccagctcgcggtgcgcaacgacgaggagctcaccaagctgctcggcggcgccaccatcgccagcggcggcgtcatgcccaacatccaccagcacctcctccccaagaaggccgggtcatccaaggcgtcccacgccgacgacgacgacaactgagcccccttcctcctcctccgccgccgccgccgcctgcattcgtcatcttgtcttatgcactagtaggatatttagctgtttattttggaccaaggtgtgttgttgcgttaagcagtaggaagaaacaagaaaaaaattgcttagttcttggtttgttttggtggcctgattgatggctgtgaatatggtgaaatttttggctatttatctcagatgtaatcccggcgatgatcttgctgtgtttggcacttgagtggttgaagaaacgaggaacagactgaaactaaaactttgaatcgtcatcatctgagcattgaccactgagttcttgttgcgcttaacatcctatttgcttgggtgttttgagcgatctgttaaatgttttcttaacattggacagggattagttactctgcatctgttatgttatcaatccctgccatggccatctgttattttgcgctccattgtagttttgttaggattgggctgtgtttatgccatccttttgatgattttgtcaaaaatctgatgttgaaatttccggtttgatttgaactgattttctccgaattgaggggcagaagttgtttgagtcttgtcctgactgatattggattgaagtcagactaatttgatttggttgtcaatttcgtgtcttcgttcgagtgtgccatgaaaaaaacatgacccagttcatgaattgtgggtcatgttgaattcagctatcccatttttggtggaaacgctccatgtttgggcagctgttcctataaggtaacccagctgttcttgtgggactgcctgtacatttgtcgacaaatttttcctcaaaacaaatttttcctcaaaaatttgacagatataattatagtacaatcatagtgtaattacactgtaacttatatataattatactgtaacttgcatgtaactacagtataacttatatgtaagtttcacataattttaaatcgttagatctattacaagatttgttttggtgaggaagaaaacaaatcatagcacacacatatatgaaagaatttgttcccacgacctccattttaccgaaataacatgttacggagagatttttgaaagttagatacaagttacactatagttacagtgtaattacatgcaagttacagtgtaatacactacgattgtactgtaatt

SEQ ID NO: 71349 - DNA, 3795 bp, Oryza sativa
gtggggctgccgcgtgggccccacccccgtggacccggtccgcgcgctcctcccctcggctgacgcaataaatccattttaaattaaaatttaaatgaacaaattcgcaaatattcatttaaagagcatataaacttcaaatggccataacttggccatttgaactcggaattggaccgttcaagtctctaatttttccctaagaagtcaagaacccatttttgtgctttgttcctgcttgttatatggagtttattagagtaaaagccttttcttttccgttggtcgtgtagacgctgcagcttcggaggatccgctcttcgtggaagttgaagccggcgtttgggaaagcgagcaaggcaagtcacatcatccttgaacatattgaatcccagtttataaaattatgttgctttaaattattgcattatcactttatttaaattcccgcgttatcactgttttatctagccatgcctatctacctttgttatgaccttattattattgttattgttattattaccttgttcaccctagattaaacaaaaccccaactagtggacactctactcatagtaccactagtataattttaggtagatgcttcgctgattaattaggtaacattaggcggttttacaactctagactttgggatattcatatcacctggacactttggaattgttggtttattgtggaattggattcacaccgccccctctattcaaaatccccaaaatggttttaggctgagctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtgggattgggtcggtactcttgtctatggctaggatgggttgggaactatgtcacgtcttccgtccgtataccgtggtggtatgtggcacgtggttacacatgaggaagatgtgtcttgtgggtaaagatgtacacctctgatcagagtataatctattcgaatagccgcgccctcggttatgggcaagccaagcaatgtacccaagttagtgttttaattcttaaaatttgctcaacaactaaaatgtggaatggttggcctgggttggcttgggacgagctgggatccagggtcgggttgccagttcggtctgaatcatcgtaggccttgggttaaggcaggttcgtgcgggttcacgaccttgattaataatactgtgtagctctaggatcgtctttttaaaatggctttgggcaactaagtgacttttaaatgctgttttctgcaaaacttaacccctatatcattaccccttgtacccccttgcattaatcgtgcatccgccggtgtggcttgctgagtactgtggttgtactcattcttgctctatctttctccccccttcagtaagagaagctttggagaagatgtcttaggtggagtcttggcttacaccccagttgagcgcctgtgaagatggagccgtaggcccgctagtccgctgctgtttattttttattgtcaggccttaagtgcctttgtaataatgtaaatattatcgatataataaagatgtgtcttttatatcatgtttgtatggtgtaccccggcttttcctgggacggggattaatacactagcgttcgggaaaatgcaattttctcggtcgcgacattcggccaaacccccatctccaccgttgaggccacagtttggcatggatgtccaagattgcaccccaatgacgtttggagggtacttcggacaatccccctttcacaactgtcataaccacctctatataaaggcttcactctcttcacttcaacacacaccttaagcaatggctctagtagcttttctcttctcttttgtaagatttgtacttttattagaatactcttctatatacatttatggtattaaaatactctccgagtatataagtacctactttacattatgttcttgttatactgaatatacggctagcttatctgggagatgctttggtacgggtacagtgtttgcttatgcaattactctatgtcatgacgatgatattatagtagtatctggtagtttagacgtggtgtctagattacgggatatcattatttggggttatatattgcggatgagaggtgggccgctgatggtgacagctcagtacaggtattcctccgcgcctatatataatcctaagttaatttcctggggagggtattcctctgtatttagccctagttgtatggtcatgacgggctgtcgtaaggaactcggcagtcaggggtggcttcttaaagtaccaggagagcatcggatagagggtattagctagtatatcagttaactagaatgtatgtatactatgtatattagaagtataggagtagatttcctttctcttttctttccacacagcttagatgatatattatgagaatgagtagttaatgcttgtgtgtcactctacccttggattatcttaacccctatttagaatatgattatcacaagtaatatataaattattagttgagttctctctacatgatcttcccacgggataaaataaatacgatacccttggaatactctagagtgaaatgctacaatggtatatccgtgcgcttgcggatgaactctgtaaccataatataccagaagtatttctacgccattgctgggaattatatttctagtaatgtcgttaagaaataccatcagacagttgttcagataagaatagttcggatccatagacaagttttacagcatgaaggttaaggggtacaagggaaaacaaatgtcctactcttcaaaaagggggaggacggactcccccaagtcaccgacttcttccatcgtatccttgcgtgcgtcatcagcggcccccagatccaaagccttcttaaggtccagatcgggatatgccagcctcatgcacgcaaggacatggcacgccccggtgtagatgccgttggacgtctcctccccgatcctagccgcgtgcttggatgtgatctcctccatcgccgtagccagctccacaagcgatgacgtcagcgagaactcatcgggatgcgccgggatggtagtcgtgacactacactccccggcgagttggtgcaggctggtgaatgacgttcgcagcgaaccgcagatgtcgatcatgtggccctcgagctcggacatccggtgctcgagtccgcgccgctgcatctcgttgccggccactagctccctcatctttaggaggtcctcgtgggcctccggccaggtcgctcgctagctagtcggcacgttggtttgccgatgacgccgccgccctggcctcctcgatctcgtgacctacgccgcgagcaccggcctagaggatgcgctccatctccgcttggagctcctcccaggtgagggcatcggtggacgggcctcgggtaggcatgaggctgacagcagggccactccgtgccgcctcctggtccttagtagcgaggtcgccgcaggggacacgctgaaagcggcatcagtcccaccttgtgccgtctttgcccgcgccgccctgt

SEQ ID NO: 71350 - DNA, 3459 bp, Oryza sativa
tttacttacttctcaccgatcgtcaccaacctttgccttcgctaaggtggaggagacgcgtccgagtcctgagtaagatgaaatggtatgagatcaagttgttccgactacgtgttagggaaccacaaagaagcttaccgtagagtttttcgctttccgacgggtccctcgtacggaggagaatttccttcccctctttgggacgttgctaccactcgtggtggcagcaacagcgtcagaggcctccttggcgatgctctccttcaacgacgctgccgcctggtggtccatgagtggcccgattacgtccgtcagagggagagcctgcacaacgtgaagtcacgacacgatctcgaggagaaagatgtaaaggaatcatcgagtacactgacattgatcgcagcggcgcgttcggccgttcccttctcgcaaagggggatcgagatctcgcccgtcgctgagggggcgctgatgatcacctgactgacgcggcgccccccggtgtcactgtctagacctgtgaatcgaaaacgagaactcgataagttaggagaaacagatggactcggaacaagattagaaatgcgagcaaaaatacaccgaggagagatccgggtcgtgtcctctggcccagagtaatcaaaggccggatgggcacgggcctgcagcggttgaatccgcctacctacgaagtcggcagcgacttcgtaccccgacaacccccaatttcggagatcatcgatgatctcgataaaagattggagggagggagtcagggcgggtttggcggtccactcagggattttgtttggttgttctttagggacaacaaggacgggatccgagttttctatctgaagatagaaccatctcgcccgccacttgctgtgagaagaggggcattggaaggggatgtaacgcgacttcagccgatcccgaagttggaatgcaacgcatccagataccctgttgggttccatccatcgcagctcatagtaaaagcggaatagatcaaggaagggctctaccccaatgtaggcctcgcaaagatgagaaaagatgctaaggaatgcgatggagttggggttcaagtgaagcaaagaaaggccatagaaattcaagacaagaagaagaaattgagaaggcggaggaagaaaaccgcaagaaatgtaatcttcaacgacaaccatgcggcctaagatgggtttaggttatataccacctgcctccctttgcatggtcccgcgacaagggagggcaccgtcgtcttgcagcttcctcaaggacgcggtggttgaggtagacttctcaagatccatcgccgtcggaggatcgccggagaacaagagggaagaagcaagctagggttttctttgcggagagcggagaagacgaagggcgctagaaggcaggagagttttctggcaaatggacttcaaatggactcccaaaatccctttaaataagcgcactaccgacgacgcgtattccaaggaaaggagagagattgctgccggaaaattctgggtccgttgcgcgcggtagttttcagacttcaatttaaattcactcatgaccgttgaacttcatgcggtttttgtcgatagctctttgtctctatggtttttgcactgagatcgactagatgagaacgacaattccgacatcagaagtcgcgatcaatgacatgagttcatttaagcagaagtcaggggctactgtcagggttacggataaggtataccatctacccttggatgtacgttgtatactgatacggtatacccgcgcgtgtacggatagtttccgtatacataaaggaaatctaacccgtgatagaaatagaatctatggacggaaagagttctactcggacaatactgggtctttactatatcgtgaggggtccgatatctccgagtcctacttggagatcaactgacccgcggtatataagggaccccctaggcaggacctaaggcatcgaatattactgccaacacatccccacagcctacggagctggagcctacaggagccaagtcgccaggccgggagatctagtcgtgccaactcgactgcgttctcgtcggtatcaccgagttctgttattccctttgtaatctgtggtttccatcatataatcccataccaactggattagggctattacctgctaagggacctgaaccagtataatccttatcttttgtttgcttgatgtcgtactacatagatcctcgtaccaacggatcccaatactctctatatccggtctatgggtatcccccgtcgacacttctaagctttattcctaactttcagtcatatcagataatatcttgagatatgactggtttttctccaactattttttatgattgcccaaaaatattaatgagcactccttttcctgtatttctcattttctttcttctcttaatgattgagaatattttctaccttccatgtcctttctttctttctttttttagccatattttattgcaagctactaatatgagagacattttaaggacatgatggaatatttatttggtggatggaaatgttgctcacacctagggtagaggtaaaacaaccatgataggtggaaggcatattttgttaatctccagtatatggtgggtgcacgtaagtgggtatcttggtcaagacagcataaaaagaagcaacatatgattatagggttattcaattaagatcatcatattattgaggaacttataaattttattcttttttaaaaaaacatatgctccggaattccagtatcacttagagaaagaccatagcaactctatttcacaaattcatatccaacaacaatctagatttagatcatgctttatgcaatccacaagtttcaaattcaaggcaaagattttttttgccaacaaactcaaaaactatagtgaaggttaggcagtaaagcactagatagaaataagaatagagcatctattcatcatttcaactgggaaaaattaaaacattcattgatgatggcagcagtgcacgttgccaagaaaccgttgctactgccaagtgattcaaggggcagtggctttggaggaggttactgcaaccagcagcgtgcagagactgcgactggttttcagttttaggattcctctgaaccagtagcagctgctgaacaatcatctgcagatgcagtagtaggtgtctagatcagtttaccgatcgatctgaagagaggtgaattaattacaacgaatgaaactacagattcagagaggaagatgagggaggaagatactgattgttccatttggatttattttgaggagttgcattgcagatagacaaacagaattcttgatgtaaccggtgcaaggaaagattcagatttcttcctatgtcattaatttataagtttttttgttttgattttcatgtacaagaatgtaaattata

SEQ ID NO: 71351 - DNA, 7997 bp, Oryza sativa
caatatttgtctatatttatttagattggagatggtgaagatgatgttgagtctattgaattcccaaaatgcgtggtggcaagcaattagtgtctagtgggtatatgtgcttattgtcctttttttgttatttgttggcttgttgttgttgcttatcatcttgttaacacagtgctgtttgttgtactattattgaccctataggaaagggaggaggactgaaggagagacattttgccatggatgagaagtgttaactgaccatgccttttgtgtgtttgcatggaaatacagaatgatggaacttaaacaatgtatcattctgctatgttaacttatgtagttatatttatgcgcccttcctgtctagctgatgtagtcgtactttgcaatttgcatggatgatagttgatggatgaatatgtgatggagacatggacgatggacctaatttgtactctattgcgtgtatgcgcatgatgcttgctgctagcctgcatgatggataaatatgtgttatatgactcattgaaatgtatggtagtttacattttacatttttttgtccctggctcacgagccaaacgagctagctcgagctttttgccgagccgagccgagctagctttttagctcgttagggttaacgagccgagccgagccagctcgttatcttaccgagcctgaccgagccgagccgagccgagccgagccagctcgatatccagccctactcccaagcgatcaaagcccatcgtttccgccagccccagtcactgcccaggcgggcccacccccgtccacgtaagcagcagcgccggaaccacacgttaaaacaacaagcgcgcccgcgcgcggcggaggtgagagcgaccggcccgaccgagaccggtccggtcctcgcctcggccggcgcggttcgaactcgaactcgacacggctcgcgacgcgagaagcccccattcccaatccgcaaattcacttctctcctctccccaaatctccacctccaccacctctccaatccaatccaaccaaaccaaccaaccaaccctaacgcggcggcgcggcgagcgatggcgtcgatcccgccggatgacgacgcggcggcggcggcggcggcgggggcggccgagaacgggtacgggaacgggaaggggaacggcaacgggccggcgccgcgcccgccgtcggcgaagcggccgaggtcggtgatctcggcggcgcagatccgggcggagttcgagcaccacgaggccggggtggcgcgcgtcaacaacggcagcttcgggtgctgcccgtcctccctcctcgacgcgcaggcgcggtggcagcgcctcttcatcgcccagcccgacgacttctacttccacgccctccagccggggctccgccgctcgcgggctgtcgtcgcgggcctcgtcaacgccggggacgtcgccgaggtctccctcgtcgacaacgccaccaccgccgccgccatcgtgctgcagcacgccgcgtggagcttcgccgaggggaggttctcccgcggggacgccgtgctcatgctccactacgcgtacggcgccgtcaagaagtccatccacgcctacgtcgcccgcgccggggccaccgtcgtcgaggtgccgctcccgttccccgtcgcgtccgcggacgccatcatcgccgagttccgcgccgcgctcgatgtggccaaggccggggggcgcaaggtccgcctcgcggtcatcgaccacatcacctccatgcctagcgttgtcatcccggtgaaggagctcgttgccatctgccgagaagagggtgtcgataaggtgtttatagatgccgcgcactccattgggcaggtccctgttgatgtgcgcgatattggggccgatttttacaccagcaatctccacaagtggttcttctgcccgcctgccgtggctttcttgcacacccgaaaggatgatccgatagcctcccagctccaccatcctgtggtgtcgcacgagtacggcaatgggcttcccatggagagtggatggattgggacaagggattacagtgcacagcttgtagtgcctgaatctattgattttgttaaccgatttgaaggtggcatcgagggaataaggagccgtaaccatgaaaaagtgatcgagatgggtaagatgcttgctgaggcatgggggacttttcttggcacaccaccagagctgtgcggtagcatggttatggttggtcttcccggttgccttggtgttgaaagtgatgatgatgtgatgagaatgagaacaatgttgaggaaggattttatggtggaggtgccaatatactacaattcgagaagagtagaagctcaagaaatggcaaaggataagaatggtgatgcagtcacagggtatgttaggatctcacaccaagtttacaatgtaacggaggattatgagaagctgagggatgctgtcaataagcttgttgctgatggattcaccagcagcaagttgcggccttcgcagaaggtaccatctcgctaaagttgcattcgctttaattatttcgttttctttgtttgcttactctggttatccattgatggttgccctgactagtgtagaatttgatagatgccattacaactccatggttgttttatccactggtaatttggttactcgatatagttgcttttgagaagacatgtctttacaatccatttacattcttaggcattggttacttctgatgaacatcccaaataagcttcaggttctaaccatatatttctgaatagatttgggtttggtggtaaagagtcaagacaatctgttgcaagaaagtcactttctttttcgttcatccatgttttgtcaaatgcccacacataaagttttacggattgttccatagtcataataatttagaatttactaaggtttcattgacactaaacttcactagattttctcatcaataattgatcttatgcaagtatatggtgatctacagtagcatgggtttatctatgtatggattgtgaacattccgatggtatgcagtacgaatctttgctttatgtccatagaatgtggaaaagtttgtcaaaattgttctatgcatggttgaagccacatttttttaaaaaaataattatgtgttagcattctggtagatcaaaacaggcaaaagaggtgctgtagtactatgaagtgtcaagtaaaaatcattttaagccattttaaacatatttacttggaagtacatagtgcttactagatttctttgagcagcataactgcataagtatgtttttacctgttagtgtaatgtttgcagaatcaaaatgaactggacattttgactttttaagaggtgttgatgtaatcaagagaacaattgatattaactatcttatagaaaatacaactgatttaaaattctagaactgatcgtgtttagttgtactactccgaatgaatgattccatttctgcattagccttattatactcctgattgtatagaaacttagttctcatatggcatgaggtgtttacatcatcgaaataaaaaatttacgatgaatgctagtaatgcttactacattgggcatttatactgggactaaaatgttggtcatgatgtcataatatctttctgttttgaaattcaaaaacagctttttgtgaattattattgctggttcttgcttttgattagtgcacattgtacttaaggaggattatatttattcataaggaacagttattgtatttggatattgttctctgtgtgcataacctctgtttgtagtcttgttactggaaattagcgaaaaaagcattgtagcactccaaagcatatgcaatgattctgattcactgtttaagacctttgtgagaccctgtgttctactcaagttaggacagttgttcatttgctacaccggtaactttgctagtacctgtaagatagggagctgtgcctagaagcaaaattctgtgttattgtgcattttgtttgtggaaggttccctcactagaaaggtttaaagtattaagtttcacattcaaacctgaaaatcatctggtccttaacttatcacctgatttttgtttaagaaagtatgcaatcagcatttctaggttaatcgcctgaatatattggcttgcccaacaaactgtttattaattatgctaaattgttctagaggaaaccagagaagatgcattttctacttttattggctttatgtagtactagtaataagggatggaatttttcttttattttgtattgcacataattgaaagcagccaaactttggtgtagcttggtccagctagtcttttttcatgaatgaaatctgtattttgtcatcagggtgccaaatgttccttaattttgttggtaaacagtctatggattgtatgggttttcttcttcacatgttgtgtatctggggctactattctaatatttcattctgacataattttgaggcaaagctataatgcgatctaattttttatgttctatggttgcagcaggaaacgatggcctgatgaacattgcagccaaccagcactctgttggaagttatgttgtggccgactacttagatgtggatcgccgtgacagccagcgctgcggtgtgatctagatttagcccgccaatggcgttgccagttcatgtagtgtactttcagaaactgacagaagtgttgtatttgcaatccgtccgtcacaataatgcactggcatgtcttcccccttaccctcattttcaagctgtaatgtaagaacaacaataatctgaatccaaggagaattgccgccgctgtagattgaattgaatgctggctaccgatgatatcgtcaaatggcaatggaattgtggtgaatcatcttcagagagattaggagggcctggagctgtgaaacattttgaagcctggagcccctacctcatgtagagattagagctggggacaagggaattgatggcttctcttttgtggcatgtgtttcttggtgacggctttgttgctttctcgcagttagggtcagtcactatatattaactcgattcagataagtttgccgtgggctgatgaaaaaaattctgatgtgtatgaaattgcttttcatctgccggcgggtcgtcgccggctggagcagtctgctctccggcgagcaggcgaccaggcggcggaagagaaggacctgtccggtgggcgatggccgtctcgtgcttggcctttccacggttcgctcgcaccaaagtaagcaccctgtaaccctcaaggtccttaagaaaaaaaaaaccgctttaaattagattatccacaccattagatgaggtgaaagatttagtaaggacaatttaaataataatactaaaacatgtctcctggatttgctgtctttggagtttcccttcgcctgaattttgatgtcataaacaagaaaatattctgaaaacaacgggtggatatgatattcttccttggcttatccgttcagttgccagccactcaagttattgcaaaaaatataaaactccctctatctcattttaagtgtaaccatgatttttcgtacccaactttgatcgtccgttttatttgagaatttgttgaaaaaaaacataagtcacatataaagcgccgaatctaaaatcggacggaggtagtattgcctcgcctaagccatcaacaacgtacagtatgtatcaccaagtcagtgaacaccttacctgcagtgctgctttctcaaatcttgcgacaccctacttaaaaaaagttttccttggcatccttgtctaagcacgtctttttctgcctctaatctaaacaatcaacaatggccatttcttttaatcttctctgtacttgaaattcttgtcattgacatgtagggcagattgcatttgagcccacatgtcagtcgaactcgaagagtactagtagtagcaggtcggtgtgctcttaagtctaaacaaatatcttcgggtggtttcttctggactggacagagccatgcgaacaacgcttttatgaatcgtctcatcttcatgtcctattactcctaccactgagagagggccactctttcccctcgagttcttcaccggcttctttcccctcctctccggaccagggaagcagctaactgtctgcgcaagaaaggtatgagtccaggttcctcttagcttcttaaattacttgcaatcaactctgcagttaagttatttgggatcctatcactctgtggtgcataattatctctactgtgatgcctcagtatgagccttaaccttgacatattggtatatcagttctttgattctcactctctttgttcttgtgaactttggtgcctttcttgatatttgtccaaggatgatggaacttcaactccatggctccatttttacatgtcaattaaatatctatgtccaatttctgaatttcctgccataatagcatatattcgacactggaagtcaaacagctcaacgtgatgaacccttcttaatgataccggtttacaatttcaagatatccatgcgctcttccttttaatttgttgtctatattttccaaatgataacctatcataggataatttgttgtctattttcccgtattctgctgattaattagcttttataccttaggtggttcaagcacgatgggacggaaccatctttgcctggtcacttgcttgtggattctgtcatgcgcagttctgcttcatgcttctcctgatggattgctgagaattagcctgaataagaagagattggacaagaagaccttggacggtgcaaaattggcaagggaggaaagccatcgtctgagagccgacggtttaggtgatgacatagttcctttggacaactacctggacacgcagtactttggagagatcggcatcggcactccaccacagaacttcactgtgatattcgacactggaagctccaacttgtgggttccatcagtgaaatgttatttttcggtaggttcatcacctaacagacttatgaaactattgtgcacgtatacagtagaaaatgactgtatttttgtaaggaagaatgtttgatgttttgatgtctatgctttccagatagcatgctacttacaccacaggtacaagtcaaaagggtcgagcagttacaaaaagaatggtatgatagatccagtggcatctcaatattgtagatccttttggcaagtaaaaccaatgtctattaagacccttatactgttattgggatttttattttcaggagaatcttgcagcatttcctatgggtctggatcaattgctggtttcttcagtgaggatagcgtgctagttggggatcttgctgtgaaaaatcaggtgacttatcgcactattgtctcagtaaaacatttagatgcatcattgttgatgctgcaggtccatttttctttcagatgttcattgagacaaccagggaaccgagccttactttcatcatcgggaagtttgatggaattcttggacttggatttccggagatctctgtgggaggagcccctccaatttggtacctactcagaccattttataaattgtgattatgtcactacctaagtgatgattatgttttaacactgttctatgtgatatggggaaaaacaggcagggaatgaaagagcagcaactgatcgagaaggatgtattctccttctggctcaaccgcgatcctgatgcaccgacagggggtgagttaatctttggtggtgtagacccaaatcattacaaggggagccatacatatgttcctgttacccgcaaaggctactggcagtttgagatgggggatcttcttattgatgactactcaactgggttctgttctggtggttgcgccgctattgcggattcagggacttcattgctcggtggcccaacagtatgtaaccttcaatctctaactaatgttatgggcctttagtgtggtcctagaagtta

SEQ ID NO: 71352 - DNA, 9690 bp, Oryza sativa
acaaatttttcctcaaaaatttgacagatataattatagtacaatcatagtgtaattacactgtaacttatatataattatactgtaacttgcatgtaactacagtataacttatatgtaagtttcacataattttaaatcgttagatctattacaagatttgttttggtgaggaagaaaacaaatcatagcacacacatatatgaaagaatttgttcccacgacctccattttaccgaaataacatgttacggagagatttttgaaagttagatacaagttacactatagttacagtgtaattacatgcaagttacagtgtaatacactacgattgtactgtaattacatctgttaaatttttggagaaaaatttgtcaataaatatttagcaaaatcgtttcttcaaactccatgcacacttttgtagcattagaaggaaaagaagcttatggcagtaggccgcgggccgcctcactgaaacaggcggaagcccaggatgcagcccaatagtactcgcgcagcaggcctcacggtacaaggtacggctggccgacgtggcgtgcgatcacacggttcgccatttttccggcccacccattgcttctgcttttcattttggaataagttcactttagttctctcaatttgtccttcagtctgaaatttgtcatgctggtatttctatcatgaatagctggtattgtgacatcccttaactcacagaaccatattaactttgatctctcgaaaatattgtgaccagttttagctgacataacaagtgtgacccacgtggacctcacatgtcagcgggccatctattcttcatcctgggccgaggctagtcgggctagcacgactcgacctacatgtcgggctaggccgtgcctgcacatgggctgcacgcacgacccaataagtctcgggtcgtaccgggccggcccgaaggcacgatagtccatcatgcttctccatataataagtctatttttccgtcctcatctctttatattgtgtcttatgtggctggaataagtctattttgtatccctgtctttaggcaatgccttatatattagatttgagtctattttggacccctcaactattttctcgactgtgcgtgccgcgctgggccggcccgaaggcacaatagtccatcgtgctcctccatataataagtctattttttcatcctcatctctttatgtttgtctcatgtggctagaataagtctattttgtatccctctctttaggtcatgccttatatatttgatttaagtctattttgggtccctcaactatttctcttcgaccgtgccatgccgtgccgggccagcccaccctgccaaggcatcggcccaagcacgggcccaacaccaatcgtgtcatgccgtgcttgggctaggccaaatggccgttcatgggctgggcgtcaggcctcggattttatagccatctaaaccatcctatgcctctccctcttcgttctctcttccccatctctcgagaagagtgcacagtgaggagatgggtagcgactggcgcgcgcggtggctggcagagccgacgacggaatcatcctgcgcttcaacatgtcgccgagggtgggttgtggcacggtgaggcgggaacccacggcttatcggacggacggcatggtcaccgcaccggcgacacggcgccgtggtggatgtccgagcacagctcccgccacaccagctcgagcgtttggagcgcgaccacgacggtggatgtccgcagcggaccccgacctcgattgcttgatccctacagcacatcgtcggcgacgatacctcccccatcctcaccgccaagcccatcaccacggtctccaaagggttggttggttaattggtggtagtagcaaagcctatggcctccggtgatcagcttgctcaagctcatgctcgtggtgtgcctccgtgtagcactggcacgacgcaggggaagggcaagtacctgctgttaaagggaaaattggaatcatgtcattataattttataaaatttaagatatgctattctgacccacatgtcattgactcatgtgggtcctacatgttattgagataccgatgacatatctcaaacttagctaaattataatggcatggttctaatttacccgctgttaaatgacgagctcgtctgatcgttgatatggttttaccgaacatccaccatctcgttcatgaacaggtgggtaccacacattgtcgctacagtgttttttcttttttttaagttattttattacctgtcgaactgccctatcgaactgccccagtttgacaggtacccttttgaactgccccagttcgacagggtgctaaacttacgattttgtctaaccgacctataattttgtgattttctattaaaataatattatttccacaaaaaattcactatacataacggaagcaggcgaagctaatccagctgccatgtgtaagtgcacaagtgcataggatcctagctaatagtaatacctgaaataagaggcggtagacggcagcggcagcggcagcagcagcggcgctaggcgatcgcagagtcatgctgcacctcgtgccctactgccatcgaccgttgtgcggagtagtggaaggaaaatgggaagccggccgccggcgctccgatgcgtggccttgcgctgttgcgccgcgcgaattcggcgccgtgaggagaagatcagaagacgtgggcggtggcaatcgcggcatcgtgttctattcgccttctgcttgtggctttcgcgcacaatgcgtttgttcgccttcgtgctgggccaggcctcaggcctgaggatgcctggggtttgggacgggaggccccaccaccccaggggggggggggcggcgtgctctggggtggccatgctgtggtacgcataggatgtttgtcttgacgtgcaaacataggttcaaagacgacgcctttcctgtttctctgatctcataaaacttgagtagtcaataagaagaagctaagcaattactaaaatttcgaattcacttctatattatgtcaaaaggcctgatataggcatgtaatttcacccaaaactatctacaatatacaaactgctactttgatattgatacattctttctaaaaaaaacggtaatattcgagttacactcaaatgtacagtgctcattgatttcaaaagcaagtagaagttttgcattccactttctaagtagtaccttaatatatactccctccgtcccataacataagagattttcagtttttgcttacaacgtttgaccactcatcttattcaatttttttttgcaaatataaaaaatgaaaagttgtgcttaaagtactgtagataataaagttagtcacaaataaaataaataataatttcaaaaaattttgaataagacgagttgtcaaacgttacaagaaaaactcaaaatcccttatgttatgggacggagggagtattattactgaaaattaattcagatcctatataataaatgattataaatgttgtattgcatatgtcatatcttcttggttctggtatttttttccatggtcagcactcagcagatgcgagggcttactattaagaagaccaagcattaagcattactatgcgcttactacgagcacatagtgaaacaatttaagaacctgaagatcttcaacaaccatttaacttaaaaatgtatatttagttctataggcctaaactcgtgataaatgttacattgttttgcatgatcgacaagtacaaaaccggacatctcaatcgggctatccgtgacggaggcgagcggcctgctgaacactaggtgagcaataggacactaggtacatgaaggagcacaatgactcaattaaagtggcacgtgagaagatgaacatactgaaagattttaccagcgagtggttgaatccaaattaacaatgtctattcaaagcacctattggagaggatattcaacttcgacaaggacgatggaattcatgtacaaccaagaggacaacttcacaaattgccgcaatctcaaggataccatccattcgttgctgatagagtcattcatgatccacatttagtattggcaattaacaattagttgtatgtccaattgatagtataatgtgatattagctcatccttatgaacccatggggtattttagttagtgtgtatatagtaattttggttgggtggatgagcctggatgggagatggccgcctgattttctgtggtgtttggttggatggcatggtgtatggggcggcccagaatagagaatattttcgcaatatgctggatgagtgcatccgaccgatttggctggatgaagccatccagttttggtctgggtgatgtgtcctgttctgattggctgtggttggtttgattttcggttaagcaagctccaaatgattttttgtcctaaaccgtttatctaatttatgatttgattacaccattatatttgttacaattaaatctttaaaataatatctcggatgattatattttgataaaaaaataatatataacaaatgggtctcactaacttttggctttttccatccatgctacatcctccaatcaaacaagaaattggatcgccatatccatataaaccaaataaaaaattggatcgctatatttaacaaaatatggatgccatatcccatccatgcatgaccgtgaaccaaacccaccctaagtgtcatatggggtactcttgaatataatctccattttggatatcaactactgtgtacactttagtaattaatcattgtccttggttgatcacattattggatgtccctttttctcatataaatgaagagtaaatattctgacctatgtatacatccagtatatatccaaccattattacaacaaaggtgttgaatgtggatagaattgattgagtacatcctctccatcttcctttggtctaaatggatctttctccacgtctagaaatcgaaccaccataggggttttggaaggatatgacttgtccatattaaatttctccaaaattttctgggtatatgcactttggtgcacaaggattccagaaggtaaatgctcaagttgtagacctaagaaaaatttggtttgacccaaatccttcatctcaaattccgtctttaaatgatgacgtgcttcattaatatcttgtgtattgccaatgatgttgagatcatcgacatataccgagataatacaaaatcttgtgggggactttttgataaagacgcacgggcaatcctcatttttagtgtatccctttagtgaaaggaattcacttaatcggttgtaccacatcctgcccgattgttttaagccataaagtgacttctacaacttaacacaatacatgttacgatttaccttctgattcgggatgtcgattccatcaggaaccttcatataaatatcagaatcaagcgacccataaagatatgctgtcactacgtccatcaactgcataaatagacgattttgtactgccaatgatattaaatatcggaaagttataccacttgtactgccaatgatattaaatatcggagacgattttgtactgccaatgctacaagccttgctttatatctcaccacctcgttgttttcgttccgtttccggacgaaaacccatttgtatcccacaggaaagataccacaaggagtaggcattacagccgagaatacatctcttttgtaaagcgaggctaattctacgtcaattgcgtcgttccatttgttccagtgagagcccttttggcactcttttatagacctaggttctggatcaacttggaggcactcagcaatttgttcagaaaaattagtatcgacaattgtagctcttctattaaaagattctccagttttagagtagttgatggcaatttcatcaacccttatagactcatcgtgatctcctgaaacaatgtgtctatggtcttccgaattcctagtctcaacattgtgcaccaccgagctaggttgtagactatcacgatctgcttgatatatagtatcaatttggtgtgtaccaactaaaggttggtttgcatttaccgtctttctttgcttattaacaattgtttctcgctgagtggccatacttcttcctctttttttagtgagtggaagttgagtggttttatttggtacctccactctttctggcgcattctgagcaggaattaaagatttagtcacacctttataattggtaaatgcatctggcagattattcgcaagtctttgcaaatgtataattttctgaacttgaagatcagtttcagtagtacgtgagtttgtggctggaataccatgggcatcccaattaatttcgtggcattctttctggtacttgaagtctccccctaatgccgggaaatgttcctcatcaaagatagagtcagcgaaccgggcagtaaatagatcacctgttaagggttctaaatactttatgatcaacggagatttgaatcccacatagatccccactttcctgtgtgggcccatagcagtacgctgtggtggtgagatcggtatgtatacaacacaaccgaacttacgcaaatgggaaatacttggaggattcccacgtactaagtgcattggggaagtttcatgatatgcagttggtcgtagttggacaaggtcagcagcgtgcagaactgcatgaccccaacacaatgaaggtaatttgcaattcatcaataatggtcgagcaataagcttaattcttttgatcaacgattcagccaaaccattttgtgtgtggacatatggaacagagtgctgaacctgaattcccaatgccatacaataatcatcgaaagcatgggatgtatattcggcagcattgtccatacagattgattgaatcctatgttcagggtaatttgccttcaaccttataatttgagacattaatttggcaaaggcatggttttgtgtcgatagaagacacacatgagaccatctagtagatgcgtcaatcaaaaaccataaagtacctgaacggtccagattttggcacaatagggccacagatatctccttgaatgcgttcaaggaatttaagtggttctgctctaattttgagataagatggtctcaaaatcagtttcccagtagcacatgcagtgcatacgaaatcagagggtttggaaaatttatcagtgatcaaatgatgaccaatagagttgccaataatttttctcatcatctcgataccggggtgcccaagtcgatcatgccaagtgtggaatgcatcaacaagtgggtccgttgagcagtattcgatgaacatatcatccatcgcagagagtggagcgacatcttctgggagaacattgaggttgctctctgggtcagcaggagcctggtgagaacttgcaacctcagggcactcttcatgtgtaagattgaagtgggcttcaaatcttgggttctcagaagatttttttgtccttgagggatttttggtacaagagaacaagatgtttcgggatgcggcagcctttagcgacatgagtgtcagatccacacctgttgcaatgcttgttgccattgctacgaggttgtggtgccttacccttcccttttcctttcttccgacccttgaatttgcgcctgttgttgttgcgtttgtgctttccagtcagattcttaggattattcgaagaatttcctttgaatcctttcttattctcagcattattctgtacattgaagtgcaggcagtggagcagagcccggtgggcgctattgggcattctttaaagaaagctcatggtgtctttttgcctgagtcaatgtatgtataagcagagaatgtttctggaaattgttagcgcgatactgttgagtcagtattctgtcctccggaagcatagttgatagagttttctctatcttttctacctccgttggctcttgttcacaaaacttcaacctggaacaaatgttatgaacagcatggttgtattctgccatagttttaaagtcctgtaggcgtaaatgaacccactcataattagcctcaggccaaatgagttccttttgctgatcataacgctcttttagagctttccaaaggttgagagggctcgtctctaacatgtattcatgtttgagatccttgtgaatgtagagtcttaaaagaaaaagggctgtattgagcttcctgggctcaattgctgggtccccatcattgggttcctcaattgtatttaaaatcccccgagaggcaaaattgattttgatatcagaagcccagatgggatagttagtcccatcgagggcgagttcgtcgaactcttttgttgccatgtccctacaatcatggttaacattattaatttacagaggtaaattaataaaaacatgatattgtggttgtaatctcaatgcgaaatgtaagacttcatattctgtaatgttaggtggcacaatgtggataatatccaagtaattaaacagtggagtagatctcttaatggtgggcaagttatacttgctgcctaaaacacggtctccaggcaaatatattctggtgaatataccgcagccaatgtttaggactccactaccttgtgttcaaccaaatttcaaataatctcatttttcaaaacatattctcggaaaataacacatgtgggtaatcatcgtgagatgtagacctctgtgagatgggcgaaatgctcgctgcctaggttatgaccagtgcggtcaatttgtaggactccatcgggtaatcatctcaaaatgtagaccacttgatgatgggcgagatactcgttgcctaagttatggtcgatatgaccaaagtataggactccatcgacatgtgattaatttccaagtcaaagtgtgaagtggaacatgtattaaatcctccattaattatgttgtacataattaagagaatttgctaaatcaaaatacagaatttatagaattttgtaaattaataaagcgagaaagtagagcgtgtcttgaaataatatgcaaaaggcatgttattaagacaacaaataaatttagtgaaacagggtatttaaataaacacctatgttaataaacacataacatcagtggtctataggaccattacataattgtttgtacaactgatgaactgcttcgactaaattacataaaacattagggactaaaatgtaattgctgctgaaaataaaattaaaaactaaaattaaatggtaaattgggtggtgggccgaaatctaaaggattcggcctaccaccgtgtggcactaggctggcaggcaaggggggcggtgggccggcccatccggccctcagcaaaaaggcaggggaagccgtcggggggttagggttaaccctaaccgcccccacgatttcgctgctgccgccgttttcgccgctcaaaccgccacccttttcgccgcacaccgccgccatttcgctgctaccgatgccgccgttgggcgccaccgacgccgacgaggggacgccgagggggcgctgcccttcctccgccgccgtggggcgccaacgacgccaccgaggggggcgccgcccttcctctgccgccgccgcaccatctgccgcccccatctccccgttacggcaccgatgcatgatgcgccg

SEQ ID NO: 71353 - DNA, 12603 bp, Oryza sativa
  unsure (1)..(12603): unsure at all n locations
tcagatcgccacaaccaaaaagcactccacgaggaactgcaaaggaaaaaaaaaggaaattcagatgattttccacccatctggacaaaagattcaacccaacaaatgatgaaaggcttacagttgatcaggagcacttcaagtacattatggggcggtggaagagtggccatttttgagccctgcaaaatgcaaagataaatgacttcagtaagcctttaacaaagtatgacagtatgtagttcacgagtatgctttagctatgatgagaaattaaggttacctcccgacagtgataatttggacctgggagctgagtggaatagaaagtaataatccgcaaaaattgtgaagcctagaggaaagaaaagaaaaacatcattgttacatcatgattataatggttgcagagataagttaaaagacatgggacagccacttacaactaaaaaggccagcaccctgcgccagagtagaacagtgtagaaacgtttgctatgataaataaaagggtgaaaactccactgcaaaaccataaagattgtcagtcaattacactactttatgatcaagcattacatgcaagtagcttaaacaaaccaaattctgttgatgcggagaggagcaaaatacataaacgcctctgctatactacaacacaaagaagtgcatctcacattctcaccattttaacatcttaattgtacagaaaattggtgcaacaaatagcttcgaaaaacattttttgttcttacagatcatgcagacaagaccttactaaaaggaccaaactaccatactgtagtacatattggaggtggcaataatttatcggagagcaattgattaacccatggtcataaggtacaaaatcacactaagctaaattatcaaattactttttcactttcataaatcaatctggatagccactattttcaaatttatttctcactgcagctctttcaaattgtgttgtttacttgtcaatatcagcagggctgtcattgccatttacactacaagatttctggctaacttattcaagatataagaagaaagggtcattacaaaacatacatcattaattatcaaatatgtatgaactatgcaatagatgatcatatgcagtgaagcaaaatagccacctaccaacaggaaggaaatgaagatgaatgtgaacacgctctcactaacatatcctttgtcctgtccaagttcctaaaaacaaagagaagtgccaccagtggcaggaacaaatcagtaccattgttctttgacagatatgagattaatttttaccaggtcacataccggaagagccatgaatcccaagtcctggagcagtggcccaggtcgatgcaagtaatgtactcctcgagcagccagtccatgaatgtactaattataggtaaaaggatgcatgaatttccaatatcatccattaatgaacagataatattatgtaagaagtaaatcttgagaagatgatgaagaacaataaaagttggacattttattttatttttccacgctctcaaaaagagaacctgtagaaaatacaaggagaagaaagattttatttaggcgccaaccggcatttcgcattgcaacctatcaagccatatgggaaatcaaatctcacgctttcccaacagttagtttcattctttctccatcgtgtacagaaaaggactgtagatcttactgcgctctaaaatgtttactcatctaaggaagtaaatcaattataataacacaaacatggagaaaaaaagttatatgaaatcaccacagttgagtcagatttctagggaatggagcatgtctgacagggagcagtatcacaaatggaaccaactatgtcaaaggattgggtgcgcgattttattaaatatcaagaggataggttgcacctaagttcaaatgaattcatctcctatatctcaactcaaaatagaaaataatgcaagtcctattatcccaaaatgttaattgcagtattatttctgaggtcaacttatgatatttaattattatcttctcataatagagcatatcctgttacagtacaagcgaatatatctgatgacaggcccatgaatatccaattcatttccagaatggcattaataatcatctttagttcaataaaccaacctacaagttgtttgcatgagcatgattacagtttcgaggagactacatgcaggacaagaaacatcacagtaactgcataataagcgcgctgattttatgaaaagaatttcagaaataaataaatacttgcaaaatctagacaaacataagaggcaatttatctaacatattttacaagagggaccaatagcaagctaattgtctcaaactctctaagcagggaacttttgaagaagacacaaggcaacaatttctccccatgatatgacatctatcatggtatattgcttttgaccttggctccagctcaaccaagattgccagtgcttgaactgctttctgtgaatttgcagtagttgctcatccaagtatccaacatttctcaacaagctctggatttttttttctactctgaggacatatcacataaacagattgaatcatacttccatccccaatactcccctcttgattaacaacaaactaaattcacctaaactgtgcagacatatagttttcatgcaaatgttcaatcagccacacccttgctcgaggtgaggtataatttaccacacttagttcatacaactaaaccctctgggcagtgttgacacagaattcgtaccggtccccaaatccaactctaaaattagcatagattgtacgatgcagagctagctaaaattgccgttcaaaaggggtcgaccacgtgctatatcaaaatttttgaaacacacagaaaatagcagtcaagaattacaaagcacgccacaaatatggcaattatgcacacggagccacggaggataaaaaaaatcaaaggaaataaactgaagtttacctgaaacaccaatccggcaaggagcaagcgccacttctcgaaaagaagctgcagctccaccgctatctccgcacacaccttcctccatagctgcacaaaggcgggtaaaaaaaaatcacaaaccatagctagaacatcccaaccccatgtgccaacgaatccacaccttggtagcctcccgagcgatgtaaaccgccatggccgcaactcccgctcctcgcccgccgcctacaggtacaccctggagggctcacacccatgctccgatccgcgcatcactgctgggatcacggcatctcgtcgcagccaggacctcgccacctcctcgggaccgccgcgagatcgccgcccgccgagcggaggaggatccccccaagcagctagctccggggcctccaagagggggggggagcggcgagcggcgcgaatgcaattttccggcgacgaggcgagtgagggtgggggtggtcaggctcaggccgccgcggaggagagtcacgcggcgacggcgtcgacggtttgaatccgggaggggggcgtgcatgcgcggctttcggcgggcaggactttgtttaaccgggcccaaaggggggtaaaaatcccaacaacacaaggggggcgctttacaacgtgctgcgggaagatagttggggacagcttctttctcgagctcacatacactgggcgcgctggggctcttaaagctaaactggaccgccattaagcggagtagttgcgcttctctttcctttctttttcccctgtttttagaggattgcgctattttttttggttaccagtgcttccaatgttccaagaatccaagttccagctcatctagggttccattcatggaattaaatgtagtagtatcatattatagaaaatngatactagatcgatatatgtctcacgaaatactagtgaacgggaaattcaagaaaatgtgaggaacattcgtcttaatttttgtacttcctctgtttacaaatctttgatgtttttcgcaatatttgatactccctacgttccataataaggcacaaccacttttagtagatgttatataatataaggcatgcatgcaagcatgcaattaactatggcatcttctccattaaattattacttttttaaatcttccactctcatattatctgatcatattggatgtatgcattatatttattaggatgattcaaactacaagatgataataattattttttggtctttatgttaagagtggttgtgccttatattttggaatagagggagtatagtttttgatgaatttgttcatcaaattcgtgttaaaataactttgtaaaatctaataggtttataacattacgataataccctccaaaataaatcgagaaattattaatagtcatagtttgaaaaggtaatttgaaacaaaacagtgcattagtttttacaaccaattaccatagaaataccaaaacattattatttctgataggtaggaacagacacatccattacgtagggtgagatgactagaccaaccacgacctgtgacaccaacacctccagaaacatgccctagtatagcgtatagccaccgacccgacatcagcccattagatcaattaggtactaccttccgtcctaaaatatagttatttctagcacaatactttgtcttaaaataaagctatttttctacctatcttctcctctcaaccaatcacaaccattctttttcacctaatttctcttttcaaccaatcacccacatttttcaatcattctcacctactttcttaatacccgtgccaatcttaaaaatgcttacattttgggacggagtaatatttcatacacgaggtatcgatcatcatatgatctttgtgtatatgattgcttgtcttcatttctaactcgctcaatcttttttaatgcatcatcaagtggggtgattacgattcatgtgctacatgccgtgcacgagcacagctacgcatttgctttctgcggtttgccaatatcattgtagaagttctttggtgtttaaatgtattgattataatctgtttttatgcgattataatataaatataatatattttacagcaaaaataatataccctacaagatgtctttgccaatgatctccgtcgtcccatgtgcgccatacagttgtatgattgtatctgccactcggcaacaatggagccgcaaagagcttttggaagaagtttgcaatgtcctaatgacgtatttatcaatgttcaattagacttggctacggcagccaaccagagcctaacccggtttactcaaacttggcctgcacaaattatttagtttggcatattttactgttagtatcaattaacattatagggacatttaagtatttaactgatatatacgtctacattctggtggtgctggggaattcttttttttcatataaatcttcagtatttgtgattgaagatagcacgtgtacttgtttattccatgtattgaccgttgtccgctgtgatatcaacaaatgtacgtaccccgatactatacaaaacaattaatgtgtactctcctatgtagcacaccacaaattctttattgaaaacgaagcatagaacattatatagaggccggccggtgccatccttctctcgaaggatcaaactttgctaatccatcgttccatcttctgtgctaggttggcaccaagctagcgtacgctgtctatccgcggaataaccatccggtcatgcaaattccaccttccttgtaataccattccaagtcaaagctcggagaatacgaaagggaaccaagccaagtcttattttgtcattccgatacctattttccccatgtgaaattcgaatgttctcaacatgactcgaaactttgatactactacctgttaactgctttctcatgcagatcccagcgatccggatcggggttcataaaaaaaccgacacagctggagatggaaacatggagaaccaaacaaccccaagtgacgcgaacgtggtggtgatcacacgctgctacgggacaagccgatgacaagtgcacgtctgcgcccagcaactttgacatgtgccgttggccaagccaaatttaatactccgtatcatacacatctgtaccgaatcatctgcgtagcagtatcatggcgtatcatgcacacacgtggcggataagctggcttggacggctaaagttgtacgcgtccagagcgaggaggtgatgaaaattagaggagaaaggttgcagtcgcggcgaagcaagatggacaagcagacgccacaggggcacggcgagaagccgcggtatttgcccagatgggcgcctgttttgttcgaacccgacaggtgctttcagccggaaaggcgaggcatcatcatccgcgtcgaagacgcgtagcgatcggtagagccatcaacacacgcacgctgcggtctcgatcatgattcgcactttcacagcggttcgtttctggcgttttttttttctttttttgcgagcacgatcacgatctcagctagctagttttacatccaaaactagtactgtcgtgtacaaggaataaaatggaacggttttggggcaaaaatccttcttttccccaaggagagggagagttttgcacataataagccttcctctccgaacgaacatcaacatgagagggattgaaactgacacaagatatccagtttgcatcaggtttgatgaggatggagggcatttgtgttccttaaatgtaaggttgtcaggaaatgctggcgaattttgaatatggagcaaattcggttggatctccttgaaaatggggagttttgaaccaacagttcaagagaacaaactgaaaagataaaggtacaagaacatatgaaagtggaactatccaccgcagttgtttcgcctacatcgttagtccttatcagacgctgtatatcgaagagaaccttgtagtgctctgtacacatatcaacagacaatagcaactatcaacaggcgacaatcacccagtcgtcattattacttcgaggatcaggatcagtaaatcaacttgttgataaatagtccccaaaatagacgctcgtggatagcgagatgacgagagatttgacaccgtgacgaacagatgattccaaatgttcactgtcatatcctgttgtgtcgcccaactctgtcaaagaatattcaggtgtgatcagttgaactaactcagatttttagttgtgtcaaaaaaaaaagaacttagattttagtaggctgcgagggcccaaagcaaaacaaatactatgactgcttaatgatgggcctaaagccatcagtggtcatggcccaaatatggattcatgcagcacaaacgggctttagaagcgaatagtcctgacatagcctcctcaccactgggccagaaaatcagagactcgagcacaacgcccgaccttcccggaggcggacctatccatatcggaaagcatgcgtgcatccactcgaataacgtaaggctagattgcactccaagtttttatcgtgtgacttgggccccggaccagcctgccgggctgccggccgccggcggcgggcgacggaaggaataatcagcttcgggcacatagggtgcggtgcggatgcgtgcatgcacgtatccactgaaccgagccgcagccgcgcgcgcagtgggccgtcactccatcgatcgcgtggcctaccggcagcacgacccggcggcacatgcaataggatgaggagaagattgctcgcaaaccaggatcatccgatgaagtgattagccccggaccaaatcagatcaaagaggattgctgacgcgagcatgtagtagtgtagtactactcctctgttgactatagcatcgggtgatcgatggaacaccgtatctgattctgctgcactatgctgatcagctgatgcggtccacacgttggcacgttgctgtatattctgggaagcatggcgtgttctacgccaacacgacgacaagtggctgactttgtgtagtactccctacgcatttcaacggatgacaccattgattttttttatccaccttcgaccattcatcttattcaaaacttttgtataaatataaaaacatttatgtcatgcttaaaaaatatttaatgataaatcaagtcacgataaaataaatgataataatgtatatttttttaaataaaacaaatgattggtaaaaagtcaacgacgtctaaattatgtatgcaacacagcagccaaggagacacaagagagtcaaataaagctttggcatccgccaccaggacttctctaaactggtgacaggtgggaaatcaagatactccctccgggttgataatacttgtcgttttggacaggggcacagtcttcaaaaagtaactttgacaactattttctattataatatatataaaaatatcaacaaacatatgattttattgaagtacttttaaagattaatctacaaatatggttttcatatttttaagataattattttagaaattatttgtaatcaaagattttaaagtttgactttacccttgtctaaaacgactaatattatcagctcggatggagtatataattacctatgaaaatacttcctccataaaaaaaaactcaaccttctaaagcattcgcttacaattagaggagggccgccaaggctagagaagataagataattggacacaggttaattccagcaccaaatctatcaggcctgtaagctcctatcgcagggctggaccatggtcccaactcccaaacgaaagaaacagaaaggctcacgaattaaaaaccggattgtctcactagattctggttgtgtgcattgctgacctgttgtcaataccggtcccctcgcagtgagaaactaccaacaccaataatccatcgctccgtgcatcctggcctcctggggaaagagccgatggcccaaggtgatggacaaatttaaatgcaagtccgacagaaaacagctggtgcaactgtactctcgtactcgtacacatgcacatactcctacctaggagccaccttttccgctttgtctacgttcaggcgctcgtctcggctctcttggcgggcagcctcaaacgctccaaagttttttcacgtggttaacaaaataacgctccaagctagtatttgactttgtgagcaatgaaaaatgaaaaagacttggtaggtaagcacaaaggctccatttgtgttccgcagacgtaattcggcttttgttaattgccatggtagtcagtctgccaggcctccagcaatcagccatgagagcgtgacataagcgcagaacataatcaagtttaaatataaccgattacagttgactaaacacattggagagaattcttctattcccgcctctgccatttcaactttcttcacaatcacaaatattccaggtccgggtcttgtctcccaggctacggatagtaccgccaaaacattttgaattctccagtacacagagtgcccctaggatctccagtacaactccatcaaatactagcctcgtagcctgttgattcaaaaatatgtttttctactacttgagtcgtacacctgcattacgacgctccgctgctggatttgatctggagaacggagagagcaatcagaggatgcaaatgacgcaaccagcgcgacaacgagccgagaccaatcgatagagagaaagtggccgtggcaccgcccaactgctggctctcggcaacctgacggccacatgggcgccggttgcaccagctcagacgcaacgcaaaacccaacctttccaccgatcacgacagcctaacaatatgtgctcgcctagctagcctcctcgtgcacattcatcagtcatgacaccaagatccatcctactagtactatactgcctaccgtacggtgcagcaaagcaagggtacaaaggcgccttcgaacaggggattaggagggggattagtattagtagtagtatcagctttgctgtaaaggcatcgttaagaaaatccggatttcccaacaaggcgccgggcaaggttctcttttaaatttgaacagaacccgaggtttcgttcgacggcaaggtggtacaaaccgaaaacaaaaggacttggcacgccacacgagataatagctttacaaattgaccggtcagaggcctgcccggccacggccacacgacacgccgcaacaaaagacgacaggaaacagccagctgccgaaacggaatccacccaaaactctggccaaacgcccggcttggcaaggttatctgtatcctaatccacacgattatataccgagtgcccgagcctaaacgatatttttcacatgatcctatcaaattttagagagtatatccagatactgcgatcgctatgaaactatcaaatattatttaaaataaaataaattgaaaataatgggaataaatatactaagtttacataaaaaacaattaaatatattaaaatcaatattactagccacctagtcggacgttgcgcgactttagatacccattttaaaccccctatacaagaaaactcttatactggaaatgttataataggttggtttgttttgaattttgatcattaagcgtcattgatggattacctaagttgataagcatatggcctcaactatatgttcaaaattttattacacaattgatgttgtaatgtacaattccatgttcaatataaactcaaaacaatcctatatcccatctatctattcacatgcgaaaacatatttgtgctgcttgtagccaatatgctccttcctccgtttcatattataaaactttctagcattgctcacattcatatagatgtcaatgaatctaaatacctatatatgtctagattcattgacatatatatgaatgtgggcaatgctagaaagtcttgtagtatgagacggggggagtactgtttaagtaaatataacaatgactataaatcatcttttactaattcaggaaaataataataggaaaatattactttaacacttattcctttagctaggaagttcttcaaaccgcctccatcctgtaccagtgttatatcaagttcatattatattatactacctctgtcccaaaataagtgcagtcgtggatatccgtgcccaacgtttgaccgtccgtcttatttaaaaaatttgaaaatatttagtcacacataaagtactattcatgttttatcatctaatagcaataaaaatactaatcataaaaaattttcaaataagacgaatggtcaaacgttaaacgtgaatagtgcaaaacagcacttattttgggacggagagagtatatgcatagcacagagctcatcatcttcccttttgaaggagataaagccgaaagtagttaagatttagaacattaatatgtcacatataatctgagatgaattggattatacttgacttctattaggactgtccttaagacacccatcaaggaaaaaaacattttttatataatgattaaaaacccatattgtgaatgaagcatttaactatacacattccaactatttagaaaggcggagtatttatgcttagaaattctgaaggttggcatgcaggtcatgtagtcatcagatagaattcagtgacaggggaaacaaccatttttaatcagcatattgcagccatggtaccatcagagtattttgactgatgtttgagattactgctgatatgaaaccaaatgaacctagctaaaaattaactgttttaatctgaacaacttcaaaatttgttgcaactgcaatgacaaaattacatgatattttatctgagctttccttggttatattatgagtatcatgagacatccaataggtgtggttaaacatatgaacaatttgagcaagctagctgtgaggaaatgtaaaagaaaatgcagagacaatgatttggtaccgtagctaatgtttgcctgatttcagaatatatgtatggattgaaaagctactgaatcaattgcaaataaaatcacatatctggttatttcggaagaggatctttgacagctctcgtcattgatggagacaaagaatcaacgaaccagcgtacctcagcttctagcttcttgggtccagttatatcaaggaatcaagatcgtggaattcactcaactttttggcaatcaacaggaacatctctagtttgctatatgccctagagctcaccggcgaggcggtgcgtctcctcggagatgtggtagaagccggcgccccatttcatggcggcgagcgggccgggcggcctcctgccgcagcgggattcggtggctagaccgatctgtgggtggaggacggggacgaggtagtggagacagaggcggcattggtagaggggaagaggaggaggaagtggtggcaggcagaggcggatgaggaacttgcgccaacgacgtggatatggagggggcgagtgggcgcggtggaggaggagggtggaagtggaggtggaggaggcgacggcaatggggaggcggcgatggaagcgaggagatgggcaggcggcggaggcagcggtggataatttttttt

SEQ ID NO: 71354 - DNA, 31384 bp, Oryza sativa
  unsure (1)..(31384): unsure at all n locations
ctcctttcttttcttcagacccacaggattagtagtagccacaatggtgccaataagttatgtcatgttcttcatgaccttaataactgataggcagttgctgctttgactcgcagcaattttttttcttttttatgaggcgtggattgtgcactaaactagtcgaaattgttaattagttttcgagccatgtgatttacaccgatcctctgagtaggtttgatgtttttttaatcatataggttctttaatatatatgtgtgtgtatgaaaattgcttacttaggcttccataatcgccgaactgtcccgtttgtttatggcctctgaactaccgaaatcgcggtgattgagataaacgcgtgaatatgcagcgttcggtgtcatgcaattacggctggaatacgaccataaacgaactcgagctggcatttaatatagtcaattacaaaggggtttgcagttggaaccgatgaatacaggtcacatacgaagggcctttgttcacaatccaagccgaaattcgtacagaatggtgaatgccgctttcaccttttttttaataattattttcagggtttctttgctgatcttttttacatacagggaaaaggtaaggatcacttctttctacgttcaaaagattccgtgtgagaccctgtgccaaaatattagtagaaataatatgcgccatgttgttggcttaatactatatcataaaaaggggttttggaacaagtccatcactacaaaatttatacagagaaggatttctctctatttccactaataaaaattgataaatgtcatataagtaatactctccccatcccatattgatgatcatataatcaaaaatacaaaaaattctaaaatgaccctcatataaccattgtctcttcgttaatattattgcatctacgaatgcaaattgagcatgcatgcatgtatgtctttcaaggcaattaagcgcacatttgttatgcatatggggagttacagtctttaaagtctacctgtttcttgatactccaccacatactcgcactaaataaaatgcatggtagttaagtcttcgtttgtctaggtgaaaaaaagttatagagtaaatttcataaagctataaatttaaagtgttgtatcataaaactacggatttagtgttaaatttatcatgaaattataggtttaattagtactatcaatttaatcacaaaactataatgtttatggctctaacaccatggtagtgttagggatttgaaccctaaaatatgtagttttgtgataatttttatatcaaatatgtagttatgtgatacttgaccttaaatctatagatttctaataaatttgacactaaatatgtagttttgggatataatgttttaaatatgtagttttgtgatagcttggtcaacatatctatagttttgtaaaacttactcatataatgatcaatatagaacgaaaggagtatatcattagtataggagtcaacggccggagagaaaaagggaattaagaagacggttagggtgatgaagctataagagcatccgtaatggtaaagtaaggtgctctctataaaacttgtacaacttagcaatagactagattaatagtaaaccacctcaatagtatgtctacatgggtatctatagctctctaatgcattgcctcgtttttctctatagactatctccaggttagtagatagatttgctctctctcttcatttaatctcttccaagtaggaaaatctgctgacatggatctctggtagagagcctatagataaccattacgggtgtcctaataaaaggagcatgacttgcgttttttaatcaacttgcttacagtatttactatgcgatgtgatcgctaggatgatattgtaagtacttgttattaggggtttcaaattgttatatatatatatatatatatatataatctgaaattaatctgtgactaaagtaaagttggtctgcaatgactttttaatatatgtataaaaaatccccttgtttgaattgagtctaaaacttcatggagaaatctgttgatgtgcttattctcgatctctctcttcacatatcttaacattttatacagggtaatactaatatactataacgattctacagtcactcgtagatgccagcgatatactcaagaatttcctaaagtctgagggattaggccccttttattcatacgaatgaaaaaacgagaaaatagaaaaaaaaatacaaaggattccgatagaaatataagtttaaaacggattactgtaaaagaaaaagaaaaacacatgaataattatttgattggatcgcagaaaaaatatagcaattaaatgagagagatagacttaaaagtaatttctctaggaggtcggccctctggctaattttcctctaaaatctatatgtaatgaaccattttataggaatgtataggatttggaaaaatccaatcatttgaatcaaatgactacatagaaaaaaattctataggatttttatcctatgaaattttttatataaattctttgattcaaaggaacctaagaagatggccccatgatcgactattagcattgttaatcgtcaatgacatagcatacctataaacactgacaaaccaacgagtttggacggctccccatagtcattgagctcaagatccaccactgaatcatgcactctcagctactcgtggtcaaaaaaacgacgcaaagactgatgcaatgttctgattagttgagctacggttgataagtcctaagaaaaagcaaaacaagaaaagaatatttttcagtacaacttttatatttgtattattaacgatttaaaaactaagactgaaaaataagctatactgaaaaaaaaaatactcaataccgtttctaaattatgttacaaaatttaaatttttctttaactgataagtcagcaagaagataataatagcctttgtagttttgtgaattgtctgtaacaagtaggggtgaaaacggtacgaaaactttccggattccgaacctattttcgaaaacggaatctgtcggtcgaaatttttcggaaacgaaaacgaattcaaaaatattttctcggaaacggaatcgaaaatgataagggcagtttccgtcggaacccgaaatcggtcggaaactttccggaaattttctcggaatttccagaaatcacaaaatacccttgattctttttttaagcactgaatagtgaataccatggtgtttggctgttattttcttaaaaatatttgttacgcaaatctaaaattacataagaatattttttcctacattgggatttatcaacagcattactaatttattctatagattgtgtttcatgatgtactatttatacttagcaattggacttatatgattgtgttttacgatgaattgttaaccgttgagacttgagaattggatttatctgtttgaggaggttttttttattccgataaattttcgttaccgtattcgcgccggttcgttttcgctccgttttcggtttcgataatattcgattctgttttcgtatccgggatttccgattccgattctgattttgaaaaaaatataaaaataaaaacgattacgttttcgtaccgttttcacccctagtaacaagcagtacttcgcagtagacaaaactatacactttcaaatggttacagctaaaagtttagttttataaacttttatagagctaccaaaagtttttagtagtagcctctttgacactttcgaaagataaagtgcagttttgtaaaagctatagtactaaattttttttaaaaaacagccctttcggcgatagtagctcggcgcgcctgacgccttgtggcaatagagagaagtgcggccgttttcgtcggtcaacaaaaggacggcacaagtttcctgcttgaacaaaacaagcttcaaagaatcaatcgtgtatattgtacaaatttcctgtaacacgtcttacacaccggactccgtcaccagtgtgaggccgacacgcgggcccggcatgtcagcctcagaccactgactgtcgccacacacaaaccaaccaatcaaactctcctccatcgttttttacttttctttctccctccaacctttcaaactattactgttactgctactactctaacccgttgaatagttcaccggttctaacctgatctaccaaccccctccctcccaaaaagaaaacaaaaaaaatcaactctttcaatcaaagcattgacaaatgaagcgaggaagaggaagaggaagaaggaagaaggagaaaagccaaaggtagaatctttgggcaaaagtttcccgcgtgttgaatggttgaacggttcaatggatggattcagaggaggcggacggagccgcgccgccgctcctcgtaccagcagacgcagctgagcgcgacgagcacctcgacgagcgccgcctcggccttctccttgtccgcccaccggagcgtctgcagcgcgtacacccgcgccccgccgtcgaaccgccgcgtccggtccatgttccgctccgcctgccactgcaccgtgtcgcgcgccatcggccccagccacgccatgatccggtccaccgcgtccttccacccctgcgccagcccggcgtccagcggccccgggtcccgccaccagtcgcgcagcttggaccgcaccgccgccctgagcttcgccggcagcatctcgtacatctcggcgcgctccgcgttcgcttcctcctgccgcccctcggcctccatctgcagcagctgctccgcggacacgatcacgttcgcgtactgctggtccagccccgcgccgcccaccgtgctggccggcgcgtccaggagcttgcgccagtcgatggcggccttctgcccggacggcctcagcccgatgatcgggcacgagctgctgatcaccggcgggtggactcgcgacggcccgtctcgccgcgtgatcggcccggacgacgccttcgccctgaccgcccgcgggttgagcagcttggacagccttgtctggacgctgtcggtggcggccgacggcagcggcggcgggaggccggggacgaacgcgccgaagatggtacagatgcggctgaacacggcgcacgcggcgcgcgccatgaggccgacggccttctcgtagctctggttccagagggactcctccttgaggcgacgcaccttgatcctctgcgccttgagatcctgctggagcgagtcggcgccgggggaatcgccggcggccgacggggccaccggctgcatcgggatcggcccgctcaggcggttccacccgcggaacgcgagcttccgctcgctggcctccagctcgtcgagcgcctccatttcggagcacagcctggccgtggacgcgacgagccgctccatcttcttggccttcaccctgaggcccttggcgacgagcgggtcgagcctcgcgtcgggcgccccggccttgaggctcgcgtacacgccgccgaagtcgatcccgcacctcagcccgagccgcgcgacggcggccgcggcggcgtccagcgacacgacgagctcggcgcaggccagcctgaggaggaacgcctggtcggtggagttgaggtacgcgacgccgggcgaccgcatcgtgtcggaccggagcctggacacctcctgctccgacagcgaccggtgcagcgacagcagcttcgacatcgccgccgcggcctcgaacgcgaggatcccaagcgctgcctgtggccccgacggcagccggagatccacgggcatccacatcttctgcacaaccatcaatacttctctccaaatctcgcaacaacacagagcatggagcgatcgatcgagctaagcttctttttcttctcctctctctctctctctctctcgttaaggcgtcgacctcgttgaatcgatcagatcacctcagcacatcgacgcgacgcggttgcaggtacgggtttcggttgggctggtatggtggcaatctctttatatatagcacgagttattctcacttctcttgccggagggaaggtgatgctaagccagcacaggagaagtaaataaaagagacagtaaaacaatatacaatatactactactcccccgtccactagtagaaggggtttttacattttacttacactgtttcaccattcgtcttattaaaaaaataaattattatttattttatttgtgatttacttcattatctaaaatattttaagcacaacttttcgttttttatatttgcacaattttattaaatataagacgagtggtcaaacgctaaaaaaaaatattccctccgttttaaaatgtaagactttctaacattactcacatatatatatatatatatatatatatatatatatatatatatatatatatatataaaatagaaagttttatactgtgaaacatagaaaagcagtgaatatccggatggaggtagtactactttatttggttggtgatggcgacgcgacggtgttgggtgtgggggagagacacggtcgcctccccgggtgagaatgcgaggccaaaacggtaggcggatgctgcttaccggaagacgtagtaccacgacgcaaccgtcatcgtctgtagagagcgcgtgtgttgattccggtgtgggacacgctctctcgcctcgtttaatctaatctatgcgagaattttggccttgccttggctacttggctccggattagtccgaggatgtggcgagatcagctgcttaatctaactggctttgagagtgattatctgcgcatcccgtcgttgacagagaggattcaggtccggaatttaccaagagctttttagccttttactgtcgggagcttaaacggacgtaattttcgttgaccttagttaaggtgaggcgttttcgctacgtagtcacgggacagaatgcgtgttgatcggtgtttcttcattaatgaagctatagctattagtcctgaaagaaaaatgaagctacgcatatggctgcattttcagatagtattgcccatcctttctgcaaaaatgtctgaaagaactagctagcacatggccggagtcagcattcagtggcttgtgtacaaggcagcggcaacatgcatatgcatgtgttacttcagaattaagaaactgcatatgaactagtaacatgttgtatcttggtttgtatatattgacaattagtacgggtttctggaactgtcgctactttatctcaattcccatactctagcagaactagataattaaactttcaggaattaattacaagtgcatgattaagagatcaaatttatattgaactcaagtactcccctctgtccaaattatgctccaaaggaatatatgtaagccaaaaaaatcgttatcttttgttttcctttctgacacagcttccctttcctttagctaaattatggattataactttgtaaatgttcatcaagttctcgagcgacatatgctaagcagtgttctacgaaggattctttcacaacgaaggtttcttttacgagatttgctaccgtccagtgcttggtacccaagatacctgtatcaccgggcactgaaacaaatccaactatctattgttacaacgtaggattcgtaattagtaaaaggtcacttccaatactaaaacggtcatgcacgccccaatcttgttccttggcgccgctgcattcatattttcgtttgcgtccaatttttcctccctctgccaccactgtccatctgcgtcttcgcatgatcaacagtggtaccggcatgacagcgctacggaacaaggtcgcgcacagcgcaatcttcctcgcgcctgttttttcctccctttcccgccacttttcatccatctttgccggaccgatggtgccaccggcatgacagttaacaaatctacgaacacctcgctgcagcatccgccaacgcccagctgcaaccgccactgccacatcaccaacgccccaactacgacctttcttcgccacatcgcctaattcgaggatgcgacgaccaccgcactatcacatcagtgttgatgaaaaaacacacactgtcctgtaagatctgcttaactcctgtgcaggtccaaaatattgcttttaggtctgtgagcatgccagttaatttgatcctgcaatcaacaagaataaagacaagaaaacagcagttaaatctataaatgatagccaatcggttagttgccgatgacatatcatttatcttcgagccgatgtcatgttggaatcgatcggcaataatgaatgaataatataaaaactaaatctactcgatcggctgtagatattaacaacatataatctttacttcgatacatatttaaactaactgattaggatagatcggtcggcatgccgagacggtataaatcaaggggcagaatcaggcatggggcagctagggcttgagccacatgcctagccccataatccccattataatcttgaaaaatgctatgtaatttatgaaaatatttgagatcccattagctcagccctaggtgtggaaattttctggctccgccactgagtcgaaatatatactaaagtactgattatatagacgtttgtagcatagccgatcagatagatctagtatgtatcggctaatactccgataccactctatactaagatattgaaacaagcaagatatgtcaaacaagaatgcttaatatacttttgatgcaataagatcttaatataaagggcagatttagcataatagacgagcatacgagataatgatagctaaattagataagatcgattgaaactccgatactatctctattgataatcataaaatagggtagacatcataattaaggatattacttaatagatcgaactcaaccgatgcagcattaagcataaagataagtatgagatctaaacaagatgattagaatctctaagagatgatagatacatgatataatctagattaataatgagatctaactctatcggctactttctaacagtaaaaaccagccgatggaaagttatataacgaaactaacaaagattataaagtatatatgataactcgacgaattacataaacaagattagagtcataaggatggaagcactaatcctgagaacgcaaaccgccatgacaagtttacctctagttgaagatcgaatcgatgcagctcaacccgaaagcaagaactcgtcgaaatagaacgaaagtaaaaagggtggcgatgcgccgaaagtgttgttgaactgatgttaatgattacattgggtacgggccatatttatacccgagatacaaaatatgtccttaccggacacgacttttatctctaacaaactttaagataccataagtctttacgacagacttttgcccaaacatatctctaaggaaattacacaaaacatcctaattattagatacaattgcctttctgagagctttatctccatcgtggcaatccttgtgaagcacgttgatcaattctagaaacaacctcggagccatcctcatcggaatcggctataccagctctatcggctgtattagccatcctctgtccgatccatcttagccgatgcatactccaggcgataccttcgcagccgatgcatactctgttcttcgaatctaactttttgccgaatccgcttcgattccaatgccgaacctggttcatatcttaccaaatttggtcgttaacaatcagccgaccaatcgccgccaccacatcatcagactagaacagactgttgatggggttcaagatatggatcggaatgactaagcaacacactcatgcaaaaatacagtattgcccctttcacctctctcacaattgcccgtaccaccacatcagcaaagaaaaaggtactaggaggtgctgtatcttgcaaaccgtccgatcgggtagaatcaagggcccagatatgatattgggcccttgatgaaaatggtccgcgtaaagaaaatctctagcctctgccaaaaatacacacaactaatgagttgtaaaagttaaatatataaaaaggacttgaggttatgggatgaaatctcatcttatgtcatctgatgataagcagttgaaacattgaattaatagaactcacatgaattctacaacctacatcctcaatgtttggacaaaaaattttggccaaaaacgtcacatcaaatatttggacacatgcatagggcattaaatgtgaaaaaaaaaatccaattgcatggtttgcatgtaaattgtgagacgaatcttttgagcctaattacgtcatgatttgacaatgtgatgctacagtaaacatttggtaatgacgaattaattagacttaataaattcgtctcgcagtttacatgtggaatctgtaatttattttattattagtctatgtttaatacttttaatgtacgtctgtatacttcaaaaaagtgatggtagtacttactaagagtaactactaatttatctgttctaaaatataaaaatttaaacacgggtattaagaaagtagataaaattaaatatgtgaagactgtgataattggttgagaagaaaaggtaagtaagaaaattaaaatgtgcaatgttgtgattcgttgagacaaatgttaaagaataggaagttgttatattttgtggcaggagagtactatcttctcacgacaacaatatcgtgtgcccttaatgaacaataacactgccaataatagaggttgaaactcttcacaaagtttacaaacaaaaagaaaatacagaacaattcaccttggaaaagggagagatcgtcgttgaattatgagaggtttcttggttcggtttgttttttcggacggagtctttggcactttggctgccttggtccatgcacttctgttcttggcagagtgttctacgatctacagtatagttagttcagagctcatgtcgggccatgatcctgtgtcgacgagccaaaggggcctatttctatgttatcgcatgtttatcttctactcgctccgtttcaggttacaaacgttttgacttactctaagtttgactattttttaaagaaaaaagtagtactatttttaacccaagataaatatattataaaaatttatttaattataaatttaatgaaactatgtcggtgttgtaaatattactatttttttctacagagttagtcaaacttagagtagtttgattttgactaaagtcaaaacgtcttgtaacatgaaatggagggagtattgttttgcatggctatgtcgcatgtttatcttctattgttttacatggctatagtaagttacttttcactattttttattaccacgatcaacaaatttattacaataaaaacatcgtttcataattgaacttaattttttcatatgaacacgaattttgaaaaaaattatatggaaactatagctctcaacgagatctataattttacatgtgacaactttttatttaaatattttagatactcaaagcatgattcaaatctcagttaggtaggctcaaatgaaaatatatgtatttttgtaatataattgatgcatggataagttagtaaacgcgagcgtgtcttgggtttaaatcctaaccatgacaagatataaaaagaactagttaggatgatagtttaatatttaaacttttaatttggtatttgtataactaatgctgcacatgaagtggtagcaataattatatattacaacgatgtgaagtgttgtaatatgatttttttgtcatatctaatttgtggcaatatcgaaatttgttgccactaaataaaaatcgttgcataacttattaccgctatatttattacatcggctatcaataattttaaaatgacagcaacatttatctatcaccatgattttagcattgatgccacgatttttttatggtaacaaatcattttggtagttgtgattttagaatggagatagtaataaatatatttccctttccaaacaatattgtaatggttgtgtgcaataatttttattctaaaatggttatattcgcaatcaaagggattatttcttcccatctcatagccaccccaatcaaacaacaatacacgcgtgataataaacaatgttggaattgggtaattgaacaacgaaggctgaagcttgaacatcaggggctgtttggatgggactaaagatttttagtccctgttacatcggatatttggacactaattacaagtattaaacgtatactattgacaaaactcattctacaaccttggactaattcgcgagacggatctattgagcctaattagtcaacgattagcctatgtgatgctatagtaaacatgtgctaattatagattaattaggcttaaaaaaatatcatgtgaattagctctcatttatataattagttttataagtagtatatatttaatactccaaattaatgtcaaacatgtccctatatccaaatcaatgaatagtctatccatacgacaaatgacaagtgtcgcatccaaaaatcgtcgaaaatttcctcggatccccactgcagggtccatgcttcattgatttgacccgacttttatactcggaaccattgcgtggaggctctcgagagaagggaaagagaaagactggttactgatgacaactttggaagctgccggtactgagcttgacgcgcatcgcatggccggccgctggctttggctcgaccggtcgtacggcctgggtcactctcactcactgtcaaacccgaatacgtgtggggccctttcggccgggtcgtatccggatatggctttcactttgcactttccatctactgcggccagtcaggccagatacccaaatcggttactgctagttgtttacatctatcgacgtagatgacacttcatgagtcctataatcaactcctcccgtacaaaatttgaccggcgttccagtgctcgagttacctggacatttcagcgaatcgatcgacacatggtaatgcaatactctctaccagcactaaccgaggcaaaaaccgaattaaatttaaaaatatattctcacttttacacaagcattacacgaaaatgatgtggacatgacaacgcggacggtctcacacgacaacggcacgagatcgtgtggtgttgcacgataaaacggtgaccgcgtggcctcgcacgacgaaataggtgagaccgaatggatgtggccgattcaaattgtttaattatcatgatcacttactgtgataattaatcactaattaagcggcagctcaaaagctgttcgctctcgctcattccttgtgcaagacagttcggtctcgctgtttggttgcacgagactgcgcggtctcacattgtcgttccacaacactgcggggtctcgcaccgtcgccgcgcgagaccgcccacatcattttcgtaataattatgcaagacctacggtatatttctgttaaaaaaaattacttcctaaatatttttgagaaaaaacaaatcaacagtatatttttaaatttaattcggcaaaaacctgcgtttccgcaagtccacggcccacatgatacaatggccaccatgatactaatgatcaggtcgtcgtgattgacttaaagtacatcatgacacgacaagacgaacgtacatatgcatgcatgacatgacaaacatttgcgcgtaccgtgcaaggacccccaacaacaacagcgacggaccctctagtaaacggagtcgcgatcaaccacgggacagatgcacgcactcgttttctcgtacgttgatcatcagacagagaggcgacgtccacagtttctcctcctctcggcgcgtctacgggatttttttgttttcttttacagcttctggggacacgcaaaaacgagtgatgatttgtgtcagatcgatccttccgtggcaatttcaggtcagagacgcgagtccgcccatgttcagacggtgagagggacgtcgccgcacgtaagtactccctccgtcttaaaaaaaaaaaaaccatagattcccgtggtaacgtttaaccgtctgtcttatatgaaattttttataattagtatttttattgttgtttaataataaaacatgattaatactttatgcgtgacttatctttttaatttttttcataactttttcaaataaaacgaacggtcaaatattgaacacgaaaatcagggtctgtcttttatttggagggagagggtaggcgcacatcacgggatctggggaggagtgggtaccaaatccacaagtcaccgaacgggaaagcgggctcccctccaaatcggttaaaattacggaaaggcgagtcaagaggctgcaggtagagacagaatacaggcgagaatttccggcagattcgccgcgccaagcttacgaccccgtatggtggcttcgttttcgcgctgggtttactggtagctatagctgcttgtgtggctcccgttcagtccgcttttgaggtttgatcaacgtagacccgagctgggactgtgaacgccgtaaaacttattgtttctgtttctgaaccgtagactgatggcagaggccagtgtagactctcgacctgtacgccgacggcagaggactaattctcaggtaagtaacagttgggccaacgtatcgaaaaatgatactaggttttagtaaaaatgaattctttcgatgatttggaagcagtttcgctaagcagaatcgaatcgtatgcgataccacttgatagcaatgtgagaccagttcgtttcgtttgacccgtaccggcccagtttaaagcccataactacccctcatgggcgtaagttgggataaagtccgacttgcctcctcaactccaatgtgattcgcatacctcaaaagtcaaaaccacaaaaccacaaaaccagatcaattaacctcactcggttgtttaggctgtgattccgtcctacgtgacattacagtagttctgtctaacctgacacgttgacttggtccacccatactaatattgctcttaaatggcaattatagccacatgaaaaaaaaagagaatagtggatcagccagtgagttctacctcgagacggccatcgctggcgagctccaagatatcgcccacatgaaactcgagcttagtgaaggtgggcatcgggatgtgccgacaacggcacacatggaacgggccttcctcacgcaggggaagcatgtaggtggccataattcctttctcgcatcagcaaggttaacgaaggagggggcggtggagccagaggtgggggcaatatgatagcggcagtggtatcccctcaaatcctcatatttgcttccaaggcgattagcaaagaagccttggcgtcgaacaaagacaaggagagagatgaggcactgagttgcagagaaggcgacaacctcggattcagctgccgattggctacggtgacaacccacggtgcagatctagctcatcgcctggaggggaactgtcgggtctcaaaactaatgattcggtaaccgacatgtttagactgtatcaagccctggatcagtagattgatacaggttcaacaatctgaatcttcattgcatacatttgaacaaggttccaaaggagatattattataaaatacatgggtatttacaaacttgtagctatctaatacaacagaagctatagaataaatcaactctaatgttttgctatagagttaaaccatctaacaatactagacttcaagactaggtttaaagtgaactaacttatgtgattgaactcccggcttcgataagaactccaaatggactctgaaaaaggtgaggttgaagcaagggtgagtacaacgtactcagcaagctattatattcaatatgaatgtatgaaatagcagtatttgagtagggctagatttacttgcagaaagcagagaatgtagaagaagaaagcttgtaatgactttaatgcaacaatatttagtaaaatctcgaattaggtttctaaccaaataccatatgaatctcggtactcaattccgtgagcacggctattcgaatagtttgatgaatatcctactgcagtagatgtacgctttacccgcagtccacgacttgccaatattcattagcttagtcatggcccagtattaggttattaacaattgtggtacctgttccatgaacttatatcctcatgcgctctgaacgtgacgttaactgcagcgagaggagttctggcgttaccggggtctttagagaggactgattgtatgacaccatgtcatcgcaatcagggttcacaaacgtgatcacaatatatctcaaatacatatttacctgtgcctcggtaaatatcacaattgccctactcggcgtaaatttgcctcctacacgaggactttaaaatagaaccactgtacagaggtaccacattgctaattaacataatagctaggtttgtccctattctagaagctgcggtcgtactcgttcgtttgacataagtatttggtataaacttatatcgactgagacagtactagccacccggaaatcaaccatttctaccgtactgtcccaatctaagttcattaaattttatgcataatctaactaggcagggctaagcaaaagctagcatatctggtttgctatatgttcaggttatgcattgaaaatcatgaatggctaatgcatgagatatcagagatatagaatacagggcatttatgctcaaaggagatgaataataacttgccttgctccaacgcaaataaatccgagataggcaacctgattatccgattctcgaaataccaaaggttgccatccaaaataaaatagactctactaagaaagacgaagaaccaatttcaataaaatccatagaatagcaagaaagagataaacagttaggagggctagggtttagggtatagtctatctcttttatagggtatatggattactgtgctaatatcttatgcggaggttctagagagttggaggctagaggggattaagcaactactatcgcttatatttcatatgtgggtttgattagtaggaggatgggaagtaactagtttggataatggtattggttaaaagggtatgtggttggtattcattggcggtagctaggtttaggtcgtatggaaactaaggtctagttgtcctcgagtcgatactgaaataggatagcatatcagctcggctctataattttatgtgtaggttctggtaggtggagagtaggtggtggagagtatggtggataggcgatactggtgggtgtggaatttggatgacaactggaatttgactgggaaggtattagttagggtttggttatatgctagtcaatgctagagcataacgactagatttggtaccttctctagccggtgtcaaccgacaacatattggctagaggaataggaggttggtgtaggtttggtggggcggaagtgttactccgacaaccgtgggtggcggcggagcggctaggattacacagagctcgagagctaactgtgcggcgtgctgtggaggtcgagggaatagtgaagctccgactgttatacgcgtcgaggcgtagggtgccaggagcagcactttgaccttgggtttgggttctgccgggctttacaaccaacggttcaacgtcggggccagtagatcgcgcgaacgtccccatgaaaggcgtaaatttttaaccgggcggcttttaagtggctatagggtattttggagtaaaaaggaaatatttgaaagtcaaatataaattcaaatggcatgaaggaatttcaaataaaatagtaaaatagcaaatttgatatcaaaatgtagcttttgaatttagatgaatttaggtccatgtttcattggaatcggatctacggtttaggagatatgggcttctaaagattagatttgaaatcaaatctagaaaatgtgaaataatactgtaggggcccacctgtcagttcccttttctttttttcttctctctttcttcttccttcttcttcctcccgttctcttcttcttttctgttgccgagtgagttgagaggagggagagaaggggcgccggctctccggtggatggaagactgtgactccggcggcaaaacgcgttcccgagcaacgcgcacttagggagggtggttgccgatagagaaggttagggaggagaccggaacggcgacggcaagagcttgctccggcaacaaaggaggtggctatgatggttggtttcggaagggaaaaggaagggtaaactaggaaaatgagttcgcctcgtcgaggcaaacccgatggcgcaagggcttggccagaaacactccagtgagggagatcgacgatggccggtggtggtttgacatgagaagagagagagagagagactgagctcacggctcggttgtggaagaagagagggggcttcaccggctatttataggtgtcgagaggcggtagagtaggtcggttcggatggagaacaacgaaggatgcacggcaatggcgacgtggggaagagacgacggcgccggcttcgttctccaattggctgttagtggcggcgcgtacacgcggcgaccgcgggaggagttgggcagctgggaagggaggacacggcacggcgtcggcgcgacttggcggcgaaggaagggcagcggcgacggttgcttggcggaggaggagggcaaggcaccgcagcggcggcgcaagttggcggctcggctgggtgttgggccggcttggactgaggaaaggaaaagaaggaaagggagaattcggcccaaacgtagaaggaagaaagtctaatttttcctggggctgaataatttgatttagaggagaatttttatttggaaggaatttgaatagaagattttgaaaggaaaatatatttggagataatttgaatagggaaggttgaaaggaaattatatttggatctaatttccaaaagagatatttctaatttgagtgcaatatttttggaagtggaatatggtggaatttaatgcactcaaatgagaggggaattaacaatataattcctcaatatatatatatgtttggaggagaatggttggaggtaaaataaataggatttgaatcctaaatttgatagtagaagtatttgaagaattatttgtggctaatagggaaagttgagtgaagaatataaattggtattttcttagcacaagagcaattattcacaatatttgcaataatactattcttgtgccgaagaggaaatcaagccacaggaattaaatcagtggctagatcaaaaggaagaatttggatcaagaatcaaaggatgggtttaagatcaaaggatgggttaataattaattccaataaaattggaattactttggttaatttaggttcaagggaaaattgggaaggtttcttagaccataatccataaaaaaaatagaaagggttttcaaactaattttgaataaagaaattttagtcaaaggaaggttttaaattaaaaccaaatcaagaaacaccttaatttaaccaactatatttttaaatgaaaaacacaaaagagattaaataccagagaggttttgtgtgagttagttttaggagaccccactaattatattgtttaggaagttattaagaacataagactcagcatgatgcagaattagaaaatggttagttttcggtatgttacaggaacggtggggatcggaaccaatcttcgtctatggtgtcctgtatctagcacaaaagcgtcgttttaaactttcgatgtcacttacatataggcttactagttatttaattatttttatttgctgactataaatgtcacataatcaccacataaataccacgcgtgatgaatatcatgtcaatgtaccatctagttggcatgtaggatgaaaacaaccatctaaagcaccaagggaagtaattgactcgattttgacagttggaaggcctatatatgtgattttgtggttgagggatgtgaattagacgatgaaatagttgaggagaacagatggacatcgttccataatttggtgctattatataaaggagcaaatggcttgcgtgaagtccgttgcaattggtgagatgcataatgatggggaatttttttcggttttagattttttttaatatttacagaaataatctatcgaccaaaaaaattgcaaaaatagcccctgccgcccacctctggggtggcaagctgacgtggcaaacatgggaggaacgggcggtgatggagggagggttttttgcaggaaaacccttgccgccctctggtggggcggcaaggggcccgaatgcaaaaaagtcagtcggggccggctattttgcaggcggccccttgccgccctctggccgggcggcaggcctcgctgcctataaaaggcctgctgcccagcccccagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgttagattttattgtatcagaaaggggaattgatagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactcttgagtgtggagatggtatttggaaaatgcattgcaacgcgggtggcctctagctttggttccgtttgttcacccaaaggatccaggtgtgcagacgaacatggatgatggcgagggaccaagtgctaaagtaaacgagacttctgtggaggaggtcaacgcacgagaggacgggggcgtagtagctccagtgggcattcaaccaggtggagtagccgacgagggggagactgtcggtgccattgtggatgaaatggagagggacgattctgacaacgagcgtgtagaggaaggtgattcgtcagatgatgagacagatattaatccagcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcaatgtcacttcatagagagttttgggttgccaagtcgaaccggtcgcaatatgaagttcggtgtgttaaggaaaaagatggttgtccctggagagtgcacgcgtataaggggaaatggaaggattattggacagtgtcagttgttaccaagcatacatgttttctacctggtgttcagaaataccacaggaacattacatgtgcatttgttgcatctgagatgtatgcgcatgtcatcgataatctcacatatgaaccaaggtcaataatccgacacattgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacatcctggcaagagtgtgctgcaaagggcgttcttagctctacatgcatgcaagatggcattcgtgaactgtcgtcctgttctctgcattgatgggacattcttgacaggaaagtatcggtgccagatactaacagcaataggggtagatgggaacaatcaggtattgcccttggcatttgcttttgttgagagtgagaataccgacagctggtactggttcatgaaattggttaaaacaaaagttgttggtatgaggccaaatgtatgcctgatacatgataggcacgctggcattctgcgagcgataggagagttgcagtttgggagtatggaatgaggataccccggtgtttgggaagatgtacagagtaggtggtgcatgcgtcatatgggagctaatttcttcaagcaattcaagaacaaggagctcatgaacatgttcaagaggctgtgcaatcagaaccaggagaaaaaaattcaatgagctttggaagagattagatgagttgacagccaaatgcagtgatcagcgtgcagcggctccatcgaccgccgttgctgaccctcctcaagctcttggacctctcccaacggatagtccaacattggttagaagaactggattggagattcggaaattttctcagtggattctgcatgaaccaaaagagaaatgggccaaggcgtatgacacaggtggtgctagatatggaataatgacaacaaatttggcagaagtttacaactgggtgatgcgcggtgtccgtggactgccactagttggcatagtggagttcattttacatgggacatgcaggtattttagggatcggttccaggcagttcttccctctatgccgaacaacaacattttgtttggagctttcatgcagaaaaagctagaggagttgcgtaaaaaggccatgaaacatcgagctctagtgcaaggtacccaacagcacaggtttgagatactatgtcaagataaggcaggcaggggtatctaccgcaagagagtgaagcaggagtgtgttctcaaagccgacggcacatgtcattgctcttgtgcaaagccgaagctgctctacaggccatgcacccatgtcattgctgccgcagcggagtgtggcataccagatgcagtatatgtgtcacagtactttagtaagcaagcaatatatcatacatggagcggcgagatttatgggttcggcatagctggggagttcacagagactaacgatgaagtactcaatattcctgacccatcgaagctccgaggcaaggctggaaggaggaggactcgtcgcatccgcaacgatatggacgagtcggaggctggcagggtgaagcgttgcagcaaatgcgatgaacatgggcacacctacaagcattgtcctaaagacaaggagaaaccaagtgcggcggaggcaggactatcaggatcagcagcagatggagctcgccctacgggtgaaggcactacctccactcgaccacgtcctaggcgtcgtcgtgccacgtctggctacgtggtgtagttcttatgttctatgtcggcatgtggatttgcttgtaattcgtttcgaacttatcgatgtgtttatgtttcgtcatgtaatgtcagacttcggcatgtcatgtctttaggtctcgtgatataacgtcggactaaggtgcctaacgtctttaggtatgctgatgtatgtcggacttcgacacgtaatgttatgttatattattgaactctacatatatgttaaattgcacgtcatcgttatgtaccattagtaacgtttgctatatttaaatagcctgtactcttgttgtacataattaatctcatgattttattactatttcataattttgcaagttatcttttgttttacagtactattttttgaattgttctaacacgaaacactatatttttcagagatggcacgtcaggatacacctcagttgttggacccggcgatagatcaccgacaccggtctcaccttactgcggtgcagggggctcagcttgggacgttccgggcacggacgtgcggtgagctactcacggttcacgactcctttgtcgagaggtacgaacagtgttttactataagttagttgcactgtaatattttttataatgacatattaatttgttattgcaggcttcactttccagtactgtatgcttgtgtaatgactacgttgttgttatatgtgcacgatacctttcggcgcatgcacgactactttctgccgcaccgatacagtctcctttattcgcgtatgatacgagtatttgcccgccatttggcgcatacgaccaatgtaactttcggcgccgatcatgcatgtatctttcggcgccaatcaggcgtacccaccataccccaccacgttcacatgtcaggggtatcactcgattttttgcgcctatataagtcgccttaacgagtgaggcctcacaatctttcaaaactcagtcacattcagtactctcttctccacttgcttcattacaaatccgaccggctttcgtcaatggctagacgccgaggtgttgaggatccaaactggcgtagcgatccttgtgtatacctactaccaccttggtgccagcgtcctctctgcctatgcggtgatcgatgccaactaatggcttcgaggaatcctgatattcgaggaaggcgcttttttaggtgccctaactatgaccgtgaggtattttattatctgcatatgcttattcattccgtatgggcaatcgctttattcttcgtaacactactctattcggcagacgcgcactacggcttgcgcatacatcgagtgggtcgatacagaaaatcccgttctcgacctaaccacttgtttacaagaaggtcgctggtatttcgcatccgaaagtactgagcaatacttacagagaaaagcggcttatgaacaacaatgtcgtgaacaacagagcgactggcgggtgttaactatggcactccctccatgggaagcccgtccaagatgcaggtgtggtgatcgttgtcaggttcttcgttccataaatcctacaacattgggtcgaaggttctttgtttgtccaaatattcttgacgacgatttcatggtaagaatattttgattacatgaatccttattttctcacaacatttactaactttgcttgctttacatctattctttcctcccaggaaccaccaaggagatgtcaatacacagaatggatagacaccagaagggttctaactccacctagccgtgttgtgcagcttgaactaccagagaaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaggcaaattattatcaggtattaacatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcaccccctcaaaaaccagaggcatggactctccagcgacccccgtggacttctcgccacttctcagtctggcgcactataatgaatcacgctatacaaaagataaagccgttgcccacgctggcttgtggttggcacggtaaatgtctcacaacagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccactcggtgacattcgaaaataaatgcacagttgaaataaatagagaatttaaatataggatcaacatgctcaaaggattgtgtttaggatctgtgtgacttgccttgcaataatcggccttcaagtaatcttcttgatcacttccgacgcactcacgaaccttcgcaacgacggaaacgacaagctaacacgcaaaacgaagaaaaagactaataaaaaccaaataaacagtacatataaagtaaacaaacatgtagatcatgattttagatgaatttagcaacttgaaccactcaaaaccgagttacgatgatttagttatgaatttccgaagatttaatctattagaaaaaactggaaaaggagaagatgatgacgtcatgatgacatcatcaatggccggaccaagatggcgacctcgccggagatagagcgaccggctgcggatttggaggacatgaacacgtagaggacgacgagacgaacccaacgatactcaccctcgtgccaaacgacgaccgacgacggccggcgacgaggaggcgacggcggcggctcgggttgcacggggcggcggagctccgatgaccggcgacggaaaaggaagggtggccgagcttcccctcaccacggcgcacccaacggtggtgacggcgaccggcgacgacgatggagacggcggcgcggcggcaccggagatggccggcggcggcggtttgcttggcggcggtggcgacggagctacggagcacggcagaggacgggagagggggcaaacgaaagaggaggactagggggtcctatttatagccttggattgaagagatcggactcctcccgcaagaaatcgatccgggaaatcaaaaactcggttttggagataaactcgaaaacgagtttgattcggataagatactcaacgatttgctccgatttttgggggtaaagatagaggaggataagaggaatatttcccctcaacaaaattggagaaaaagagcaacggggaggcgagaattggaaggaagaggcggcggcactgtgcacggcacggctggctcgggctctgcctgagttggaagatgaacagtagcgcagggagggaaagtagacttttccggctgagctgagaggagaggaggcggctcaggttgggccggcggaagagagaggaaggaaaggaaggaatgggccgaaaatggcccaagctgaggaggaggattttattactttcccaattaaaataatcacttaaatgatctttgaattattaaaaatacttccaatgctcaaataatttcaagaaaaatcctgaaaatacttggacactcaaagtacttaaaaaaattacaattagaccatttaatgattaatttaatatgtgggtaattactgaaatgctctttgtatgattaaaaattaggaattgagctccgaaaaatccgagaaaattccagagagtataattaaccatggagaatttaataaaaattaaatccatccatgctttatatttaggaaattttatttcccacatttaacttcacttgtaaattaatgaacatttaatataaattctattattaatttattaaacaatttataaatcctgaaacgaaaatcaggatgtgacaatctatgtaaccgcaatgcaaatagttgtatcatgttcaaattgtactactatttcttcatgttacataattctcctagtttaagtccatataatgtttctacgacccagactgcgataagcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtactttttcatctgggtcctttgccgcccagggacccagatgaaaaaagtacggccgcaagctctttatgggcggccaaaattgcaattagccccttgccgccctctgtacgggcggcaagggcctaatcgcaattttggccgacggcagcagacggcgcggtcgacccaccgtctgccacgtcagcttgccgcccaccattagggcggtaggggctatttctgcaatttttttggtcgatagattatttctgtaaatattaaaaaaaaatctaaaaacgaaaaaaattctaatcatgggctgctcagtctaaaagtacaaaataatgggctatcgaataatgatgggctgctcagtctaccgccccttgcattcttcattgaaacaagttcacttaacgttaacgttccttatctttgtcatcaagttttaaaatcgtctctgaactggaatatcagataaaatacagctctaatcttacattcgacccgcatttcagtaaaacaatatattcttctttatctctatcctcatcttttacccttggcggcggtagatgtggtggaggtgcacgggcaataggggggccagaggtggtggccggtgtgcggtgtgccccacagtggacgagggccagtagtcggtggaggcgcacctcgtgcaggacgatgtaggttgtacancagagnngcncgggcgccncggngcnatnngggggnnacgccatcggcgggaaggggggggggggggcgggtgacgcctgctctctcgtgcaagacggcacgggctaggcgggcacggccgcacgggggtgtcgtcatcggtgctagcgttcaatcgcaagccacaggtcatgatccccagcatgatgtcgtggacgtcaccgggctcgagttccaggagcggatgcacctacttgagcccttgagcaccttgtccgtgccgccaaggaggactacgagcacttcctcctcaagctcaggcagcgcattccgtggagtcattgctgacatgcggctcatgcagttgacaggccatgagccctgacttattgactggatcatctctctcatcttattacgcacatattatagctatcatcagatcgatcgactccgatagtaaaaagaggttgtttggatgaattccatagtataccacaaaatatttagcaaagtgtggcatgccacacattttatggctaaaaatttgttggccacaattgtggcaagttatggcaaaaaaaaaacgctcaatgacaagtggaccaacttgctaaaaaattgtagcataactcacttgtggcatgaaccaaacacagacctaattggtcaagcttcattgccacaagtttggcaaaggttggcactcaaccaaacagccctaagttgcagcatacaagtcacaagttagagtcactacgatatgtattctaattatcggtccaagagaaaccaattaatactccctccgttccattttaagtgcaaccatggttttttcatccaactctaatcgtccgtcttatttgaaaaaaattgaaaaaaaatttaaaacataagttatgagtaaagtactattcatgttttatcatctcataacaacgaaaatactaattataaaaaaattttaaataagatggacgatcaaagttgggcacggaaacttatggttgcacttaaaatgggacggatggagtatcatataatcactgtcagtgccatgccatcatcagcgtcgttggtgttcgaggcattcggcaaggatggcgacgacaaggtttccgtgtccgagttgtgcggcgacatggcggcgacgctcggtgaggacatgcccgaggaggaggaggcggcgatcctcactacaatcaacaccgacgacaacgggttgttggaccatgacgagttgctgaggttccctgatcagttgcaggaggcggacgaaaagaatacattgtttcactgatataagggtctcacactctcacatggttttttctatatttttttagtgtcacgttatccaaaccactctcaatactgccttggtgtctaatgtgacccggttttataatactagagcggttacgcgcgctacgctgcgcggctgctaagagatgggttttatctggtacgtactggtgcagtatatagaaaacgtatttttggtagtggaggtatgtcaagctgttattatgggctgatcgtgcaatgccatagaggagttatggccttttccttttatgtttgaccttgggcttttaaagatgtatagtcccataattagtgggctggttttgggatttatgatgcatggcctttttgagttaagctcggttgtcccagggcaacgtgtcatggtgggattgcatctgctttgctgaggctggtatatatgtggtataactggctgcttctttatgctgagtggttgcggcggcgctgctactgctttgttagatcttgttgctgtaagagggactatccagttggtatggaggaacctgcacaaggtatgtgtattagtgtatttgtatatgctccgattaatcttggggacctaggtatactcttataaatttgtggtgctagttttgttcggtctcttgcatcttgtttggtctgaaggagctgtgtatggggcgcaggaa

SEQ ID NO: 71355 - DNA, 743 bp, Oryza sativa
aacagtttatgctaggtcttaggtttgtgaaatgatatttgaaaactcagctttacgcaaagtaaccatagccactccttgtattatcctgtacattactgcattttgtgtggtggcttgctgagtacttttgtactcattgttgctctatatatcttttagcagagtgttgaagagaagcccttgttagtatgcttgcgtacctaacaagatgatcggagtgtggttccattctaggtctcgttcccagtcgactgcttgtggcatgtcaaccgggcccttgtattattttgtcttccgctgttgttctctgttagttgttggcctgcctggccctaatgtaagcatttaactctcttagcctgaattcattcgtgatatgttgtgatttggctatgtatgtgtgtaccaactactgatccagggattggtactgataaacacagaagatttccgagttccaaaatcgggggtcgacagagctggtatcagagcatatcgactgtagttcgagaacctagatagaatggtcgttagtttaaggactctatatttttcaaagctatttttaaatgctaaaaaaagatctgtgaaaacattcaaacaatttttgacgtcatcttacctttcttggaaaatgtctgattccgatgcaccgaaaagaaaaattattttgataccttacatctcaacccttcctttgaaaaggcaatcttacagctcgatttgataaaaagggggat

SEQ ID NO: 71356 - DNA, 18381 bp, Oryza sativa
  unsure (1)..(18381): unsure at all n locations
acttgtgctgaccatgttggagatgcaaaggccagccacttttaatcagaattttaactaaagttgacaagtccccatttgatccctttacaatgtatccataccacaaattaaactcttggaacacaatttggaagaactaaagaagaatcccattagcactgaatcacatggctagattctctctgcagtccacaggtcgtgcagaaaaatcagcaaatccgtgggtcttaagtcttatctaatcctgtgggcgcccattggttttgcaacaattaaacaaggatattttggtcagtacttcactactcggaacggattcaactaagccacacacaactatatataaaaaaaagatcaaaacaaaaggtaagggtttgcaacaagaccgaagagataaatagaatgcaaaagaatgacttattttttcatattttacagatgaaccttatccgggaccatgataattaagccgttccattcaattcaaagatgaggttgaagttgcagccacccagcttgctactgcagaagctgactgcacaactaatgtgcatttacatagactaatactgactcactgagaccctgtttagatgggactaaaacttttaagtccttatcacatcggatatttgtcactaattataaatattaaacgtagactattaataaaacccataaataatcttggactaattcacgagacgaatctattgagcctaattaatccatgattagcctttataatgctacagtaaacattctctaattatatattaattaggcttaaaaattttgtctcgcaaattagctttcatttatgtaattagttttgtaagtagtctatatttaatactctaaattagtgtctaaatacagagactaaagttaaatccctggatccaaacaccacctcagtcttatttccataatatcgatttgacaataaattgcgtacaactttttatctttcttcctccttttcttttttgtttttgttttcctttaagacgacattgttaattggcataattgcacaacaaggttttgccctgctgagcaatcaatgtcagagttttagctgtgccacagccccacaaggctcatttttgtatatgagggttttttatgtctctaaaaagttttttttaaaaaatcagcctatatgaaaggactgatttagtataaatgtgagtttcattttattttcttgtatttgtgtaaaacaaactgaaacgtcaaatggttttagcaaaacaatttgtcaaatgcttcatcgttctcctcctattgtgtcaccatgtcaagctcttcgcaaaaatgttagccacttgtgttcgttttgttttcctttccattttgtattgcaaggagagtgacttgccaatgattccttactccttggactctaggatattcttcttttttagcaatgagcatatggtgtattgtgtactacgtagggtgtcacacgatatagcaaactgggttttcttttattcttttacttgtttatacatgggactatcaacatatgtcatggcttgcgtaagttcgatattttaatgcacataattcgaattagactattaacttgagtccaaaataatggagtgttgcttttgtgcatacagacaaataaactgaataaaatacaaacgtagcatgtccggtggaaagttctaaaacttctattatctttatgttctttttatatttggattggatattcaaaatggtttaatgaaaggtgtaacatagtatgtaggttaatcaataatgtacctaaaatgaaaattagttcaacttagctactctttccattcccaaatataaacatttttgatatttaaattttgtacacgctcgaggaatggtaatttttggtaacgaagaacaagcactatacaatgcagatcagtttggcaacaagaagactgcatacattattttccggaagaattatgtatggttaaaagacatgaatattaaggaatgacctaatatcaaataattagatgaagttatgcttcgaacccagattatctagctcactatcttgtgtagctagccagaaaacccctaggcgtttctcgaattatgtttggttaagaaattcattgggctaagactgaaaaaaaagcttacattaattaataagacctctaaatctatctacacctatattaattagacactctgaaagagcttatgtgttaaccagaaagaattaattgttgattaggtggatcgtgctatcacaacctagataatctgtgtaatgcatgggctggtgactttatgaaattaagtcctaaattcaacaaaattggctcggctcagagcagatactcgacttttctcgtccgctcagaggaaaatattattctctgaagacgtaattaacgatgagtcgatgactcatccctttgtcatccaattaatcatctaactgagttaattgattatccacttgttttcttctctaacgtaccaaagcgacatgtatggtgctggattcttgattccctgagtgaccaaaaaaatatcatttcgtttcttgcaaattctttttgtgcataattgagcgtacccgacgggaatggggaattagatgttttagtgcaagtcaattttaagacagatcattacgaactaaagggatgtttaatggtgtggacgaatttggggtgctacgtcagtcgttttctctacaacactacaacagtgtcgtagttcatgctgtccacttatcagcttgtggaggtggattctcctccgcttattttgcgattgctcaatcagcagatctggtcatgagatgctgcatagattattggggaatttgcaaattttttgatctttttttttattttacaagaatgccattcgaatgacaattccggtcataatttcctaatgacgattcaaatcgtggtaaatttgctgttgcccctagattatttgaatcatttttgcggtttgagtgaggaataattttcggtttgtggaaggtagaggtatactttggcattaatagggaggaatttaactatttaccatttttaggtttgttatttatccaaatgcccctcttaggtttgcgcttaattatttgctcccggagagagatgatttcttaactatttgccatttttgcctacgtgatatgcccgcgtggaaagcatcgtagaccccacccgtcatcccctcccctatcattcttctccacctccggtcgtcgaggtctccgtgctggcgagccccacccatggccaccacctggagcacccggattggggaggcgcactaggagagaccgtcgaggtcgaggaagaaggagagggcgcgggggtcgatggtagtcgtcggcaggatcagatgcggcggatggagggcgagcggtggcgatggtgacgacggctcatcctgatcctcccatcgcgaggacggggatcggatgcagtgggtggagggcgagcggcggcggcgacaacggctcgtcccgctccccccattgcggggatggggatcggatgcggcgggtggagggcgagcggcagcggcggccacgagcggcgagcgacggtggagaagaaggataggggagggctgacgagtggggtccacgatactttccacgcgggcacgccacgtaggcaacagtggcaaatagttaagaaatcatctcttcagtggtaaattattaagcgcaagcctaagaggagcatttagataagtggcaaacctaaaagtggcaaatagttaaattccccttaacaggaggaattatactctttgaactaaaagatatacctatataaatattatgtagtgacacatatttgatgactgatattgcattaacagatagttggggagggaaatgttctatcagaagatttggaagtaaagataatattctttatcataatacacacaatttttactaataggcaggtacgtgcaaaatttcctggtcttgaaataagtactgcatcatcaagcgtgccacgcaatatctgctccggtaggccaaaatgccggtggccgtttctgtggccgcattagattcccacatggaaacaaagcacacatcacaacaagtgtcactcacaagaaatcgtgcaagatgcatccaatatattccatcaccatcctcacctcatctccttcgtccttgtttgcttccctcgcttcacctatcaacttcttcaccatgcttcacctaatcaaattagcagctactggcttcagagttctttttttctttgaacgaattagtcaatgtgatatgattctctagaaatatctcggttccgtttcttccattctcgcatccattttttcctgacggcccaattgttgattgtccagattagtaacagagtttaaaactttgtttcagaaaaaaaaatcatttatatatttttcttgctaggaagaaaaggtatcaaagttgtaacatctcgtgtccaacatttgcactcaatgactcttcatggactctttatggctgtgttaacctttggagcagagggttagggagtattttacccagaaacgttgatgatttagtctgggttcggcagctgtggattagaagaaaaactctttcgttgtgtgcgtgcatgcttcccaagcagttaaatggtacgtttttcataaaatatttatatagaaaagttattttaaataatcatattaatttattttttttaaatttaaaatagttaatactcaataatcatgtagtaatatttacattgttttgcgtattcttctcgatcttctcctctcatcttaaacacaacatatagtctattgttaacattctttgtaccttctttgattataaaatttatttgtaagtatgccgtatgttttgacgttatgcatctaactatggagacgtccaaagtgttctcagcgtagttctacgattttgatataattgactaattaaaacttacactccattaaaagtacagacataagctggtgtttttgacacgcccatgtgcacgagacgttttgttttagtcaggagaaaaacaattaaagaagattaatcggaggttaacacacaagaaaacgtcagtgcggcccccacgtaaacagagctccattgcttgggtttgtggctatataaagcagcttctcctcctccatttctccatccatccagtgtgagctccgtttcttgctccatccatctatccatccaaggagtgtggaacgccacacgtattttttttttatctatgctaatctgatcattagcagaggagagttttagcagtaggattggattaaattggagtagtttcatagtttgtgtgtagtgatcttaattagctttgattagacagacagtacagtagagtagaggatgttggctgtgttcagcggcgcggtggtggaggtgccggcggagctggtggccgccggcagccggacgccgtcgcccaagacgcgggcgtcggagctggtcggccgcttcctcgccgccgccgagccggccgtgtccctgcagctcggcgaccttggccacctcgcctactcccacgccaaccaatccctcctccgcccaaggtatactagctgctgcttctactctgcttcagctgaaattgctgaaaaaacatctgccgttttctttaccctgaactccccaagtcctggatttcacgagatctagctaagaacagagccaagaattgattgctctctgtggctagatcagttaactgttcatcctgagaggctgagacagagtcatttactctgaatttgttcttcagttagtgtctcggtgaagtctcatggtgatgagatttaatagttagtctctgcaagaagacaatctaagttggtggttgagataagcttttgcaagttgcaacaggctcactgttcttggcaacactagtcactgcgtggtgggcgacagcttttcatccaaggggaaaaaaaaatctgaggacatgttgctgaaatgattttttgtgcccacctgaaatggtttgagtgatgaggtgggctctcctagtaccataggtcatgtggacatgtctcacaactcacaagatctgacaaaaaaaaattctcaggtttggtaaaaacatatgcttaaaatgaattatcgatctgaaaaacaagtttatgtacagtaacttaaactgttattttacataataaactggtttcttcaataacttaagcctggttttttggttgtggcttgagtcaataattggagaggtacaaaggctttttgctttcggaagacagagtaatagatacaactctctaatccatttctgtaggtgaggaggcaaggctaccaaacctcctccttcatctatagttttttgttttatctatagaccacacgactgagatcatcgggattttactgataattaggtgattaactatggcatacgtttatttatttcagaaggtagaaagctaatcgaacaagaaaatggacgaaaaggaactgtcaaagaggtgtagtttgccatgctgctatggtacctagatctctttacggtcaaatgattggtgcttccataggaaaaacaagaggagaacaagacaggaaagaaagttaaatcaatgtttacatgaacattgccacatatatttcgatgaaagaaggccaccgcatcaccttttgttattttgcatgtccacatcaagccaccttccacagatacaaaggtttcaattgacttcacaacaaacgggcctcatattcttcatcaggcggctaatgattggactaattatagttttaagaaaatggacaaacctgttttgtcaagcctatttcttaattataaaaacttaaaaaggataaacatgacagtatttggcaagctactaggttgcttttaaaaacctctttgtttatgcctttcctttagttgttgtgccattcacatggcttagttcatagtaggagtgtaggacacttagcacttggtggctactgcttaccagaagactctatccggttttgatacccacagatctgaaagaaaggaaagctgaacaagggggccatgctgtcaattcagcactatgatttgtggggcctgattacccttttttcatatcttatctagtactactaggcagattcactgaagaagtatcatccaaggaattccactcctttactccattcattataccagtacaaaatatatgcttccttttcagcaagtttaggtatctaattcttgatgttaggtgcatcttgcattaagtcatagatgttccacctaattttgcattctgcactgaagtaccatgtccttcaggcattcaagaatggctgaactgataacaccaaacatactaattttcttaaattttgttgtggatgccagtttttttttatcatagggttggaaagcatctataattttacagctgctcactgagaacatacaactgcatttgtgcagatcctttgcatcaaaagatgacattttctgcctgtttgagggagtcctggacaatctgggcaggctgagccagcagtatggcctgtccaagggcgccaatgaggtgctcctggttatcgaggcgtacaagacgctgagagacagagcaccttaccctgctagcttcatgctctcgcagctcaccggcagctacgcctttgtgctcttcgacaagtccacctcttctctccttgtggcctctgtgagttcttcatctcgaggcaaccgacagttacatgctgttgctcaaacacttgcattgacagtgcttggtgatttggttggtttagcttactgattatgacgtgatcttgtgctggcaattgttgtctcaggatccagagggcaaggtgcctctgttctgggggataactgctgatggatctgttgccttctctaacgacattgacctgcttaaaggatcatgtggcaagtcacttgcacctttcccacaaggtaatgtttgaatcatagtccttttatgttgccaatcattgcaaatgacatttaaaatggggcatttagtataaaattgtgggtcagttgaatcttcactgctcaaatatgtgcaaagagccatttttggttatgctcactaattacatgcattctgactgcaggttgcttctattccaatgctcttggaggcttgaagtgctatgagaacccaaagaacaaggtgactgctgttcctgcaaatgaagaagagatctgtggtgcaaccttcaaggtaaaaaggaaattgatttcttgccaagaatataatgttgagggaaactattttgatccctcgaggggatcctaattaacttgactcaataaaacagaactccttttttcatcatttgcatttgatctgaactcattcgacctttctggatgcattgctaggttgagagcgccactgcaatcctcacagctctgcactaggatgatgtttcggtgtccggtcgttgtacatggtggtggtgtaacatagttgcaactgatctgtatcatcttttcataaaagagaagtactgcctgcatggcaagtgcttcagtgttctgggtgtgtagtatgatctctgtacctttgttgttcaagcaggaatgaactccaggccggctgtgatcagttgaatgtagttctgttgcaaataacctgtccttgtcagttgttactatggatgtctgtttgatgtagtgatgttgtagatcactgcatttcatgaactttggtcaactagtagcaagaacagagtgcagaaataagcaatgttcagagtagaggtggccaaacgggccgggccaaacgggcggcccggggcacggccgaacctgtagcaggcacggcccggcacggcctgctacagtaacgggccgtgccggcacggcacgagtagccgtgccgtgcttgggccgctggccgagcccgcgggccggcacggcacggcacggctactgtagcggcacggcacggcccgcggcacggcacggcccgtttcgccggcggcccgtcaggccgaaagcgggccagcggcgcacgcgccaggccgaaagcagggacagggcgggcggcggtcgaatgggaaggcgccacgtggcactaacggctatttgaccgttcaaatttgaaaataaccgttgggaggctaaaaaattcataaaaatttcgaaaaaattccaaaaaaatctcaaatttcgccctataaatagggcatgaaccccagccatttctcctcatcccacactcctcatcttgtgctctcaagtgttttaagtgctctctttgttctcaagtgtgcatttttttttattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcataatggatccgaactttccataccagtcgccgtcgttcaccttgggtgatttcgaccccaactacatgtcgaggtttgacgatacctccggatcggctccaactccaccatctgtggaggaggtaccggttcatacggctgtcgttgaggaggtaccggttcaggcggcgacagcttcggaaggattttccggaaccgcgagcggaagtgtttcgacacacaccggctcgaagagatcgagaacctccggtgtgtggcaaaacttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagatatatggagtagtagagctagagaggattatcttagcgtagttgttcattttgttgatgatgattggcaattacaaaagagagttttagggcttaggttaatagatgtctcacatatagaagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtgaaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaatttcaccaatttctagaaactttttatgattgtactctaactttgtcacaagtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttgtatgcttttgcttttgttttagatcctaggtgtaaattaaggggattatctgctattttatcacttgttggagatactataggtgtagattatagttctttttatactgaggttagacgtaaattatatgaggtttttggaagatatgaagtaaagtttcaggaagttcgccagcagagaccccctcctatccccactacaggtaagaagaagatacagtggggtaggatttggggtggatcgtcttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccagttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattgtatcctgtaatgatataaacatcaataaaggtcattactatttttaacaaattcttttgcaatattttcgcaagtgtggatttatctttaaattatttcaaaataataaatcacaatctatatttttaaatttttcaacacaacaaaaaaataccattttttcttttttttaacattagcaaatcattacttttttaaaaaacttttatttccattttttaaataccattttttaacattagtaaatcattacttttttttaaacattttatttccatttttaattttttttccttatacatttcctttgctttttttttaaaaaaaaacactgtgcactggcggcctggcggctggcggcctggcggcctggcggccagtgcagctcagctgccggcctgccttcacgggccgccgtgccccgaacggcccgtgggccgcaggcgtgccgtgccggcacgggcacggcccggccatccacgggccgtgcttgggccggcggctcggcacgtgggccggcacggcacggcccgtttcatcagccgtgcctaacgggccgtgccgaaacgggccgtgccggacccgtgcccgtgccgggccgggccgtgccgcccgtttggacacctatagttcagagtagagttctaaattctgattgtgaagtctgaaccttctgttccttccttgctcctctatttgcttccttttgtatataacctctccttatcagttgttactttgattgtgtgtttgatgtcttgatgttgtagatcaccgcatttcatcaactttgctcagctagtagcaagaacaaaagtgcagaaacaagcaatgttcagagagagttattctgattgtggaatctgaaccacctgttctttccttctgcttatatttggttcagtaaatcggtaaacaaggtctgattcagtttgagacactggatgactggaatcgggagctagcaagctggagctggatgcacgtcttgggacatgatatccgtatgaagaaattgccttggatgtgatcgatcgatagaccacctgctctttctcaaaaatcaaaatttctgcttcatatattcgtcgctggcatccgcagcttgcaccatatactgtgctcgcctctgtccgcttgattgttcaaccgcacgttctcgatcggacggttcccgtgttggggggggggggatccaacgtaagtgcaagggggactcgagtcccccctacacccacaaaacccatggataccctccggagcacccccttcaattttttcatcataaataataaactaaaggtctctagatgactggaggttgaaaaaactgtgtaattgagtccccccaatttttttgttcctagatccgccccggggggggggggctaatgcgcgacacgcgactacctgctactatgtactgtactagtctattactagtagtactactactacactcctattactaatactactactataatactactactacattatggttatgatactactaatattactactataatatatttttgatgtataaaaaatatacacatatacaaactttatatacgtacgtatacaaagttcgtatatgtgacgtatataaagtttgcatgcacgtacacaaggtttgtatgcacgtctataaagtttgcatgcacgtatacaaactttttatagatatacgtaaatgctaaaaaatcgaaaagaaaaaaaacggaaagaaaaaaactggaaagaaaaccgtaaaaaactgaaaagaaaaaagtaaaaacagaaaaaaaaaacaacgggaaaaaccgtgcgccccacccctacgcatgcccgcgcgcgccacatgcctcgccgcgggggagggggggtggtggcggcggctgatcgctcattagcgattttggttcccgtgagcccaagagaataattccccgaaccccatgaacagcaatttttttaagccttgcttttgttacagacgacatttggcctttgttcgaacactgagtcattcatagttcagataaaaattgtactaggagattagccatagtggttgataccagttttggggtgtttgctgaattcgtgccacttgggggtccgttagaatcagctgaaagaactgagctgattatggctcgtgaaatgaaacaaaccagtatgagtaattaaatattactaactattaccaatataaaaatcgagttatttgatttttttaaagaattttttacatataaaatatttgcatggaatgcgccgtttaatattttaagaaacatgctaacagaaaacggggtagccccaccatatcagcacttccgaactatcacactcaagaaatcaaaatttctgtttcatatttgtcgctggcatccgcagcttgcacgatatactgtgctcgagtgctcgactctgtccgctttgttctcaaaaagaaaaaaaaaagatgctccaatctgttcagattgatggtggatgcgatgaagtgatctggccttacactaaacataagtcctttactgccaagtcaatgtacaatctgctaacctttgggggattaaggattcagacatgtaggctgtttggaagagtagaattcctctcaaaatcaagcattttctatatttatctgggagaggaaaacttccttgtgctaatcaattagttaaaaggaaatggaagggtgggaatgagctttgtaaactctaggaaaactgaaacttctgaccatattctgtttcactgccctttagctttgtttgcttggtgtgtgattgaagaggccttgcatttgagaaggagacatatttcattctgggattgcactgggtttgtttgggataggggggagaagatggtttggatggtcttattggccagtgtatgctgggcttcgtggctaataaatgattgggcttttaaggactttccggtttcttctcctttacagggttatttacaggtcactctcgcttgcacagaagtggaaggtgttcctaaggggagaagagcaaaaggtgctggatggctggcatgaagccattctggacaaattgtatcaagtgaagccgtctgttcttcccgcagccatttagctctttcttttttgggctgttgtttttgtgtagcgaggtgttttgtgggttaaaatggtggtcgtttccagggtgtaggagcaaagctctttccgaagctagctgttgcatcatacctatgcggtctagatgagttaaaaataaaaccgctcccatgctatatcaccattcgtgcgactataacctatctcttctctttgtggttgataatacttaatgaaatttatgccatttgtgcgactataacctctctcttctctttgttgttgataatacttaatgaaatttgtgataacaatataaatggcaaattactgttaatgaaagtcaaaaggtcaatggtaaagtgaaatagtaagtctagtgagaatacaaatagatttttttcccgaatacaaatagatctttctttttcccgattagtcagatatttgtacttttttaagaactcacacataattacgcatgcacactatacttacacacctcacacgcggtatttgtgccgtgttacaatatttgttgtaccattttgtaatttagtgttaatatttttttttcggaatgatgtaaatttagggttaggcctagttagcctatcaatctacttaacatgcgggatgacacccctccagcagaatgaaatggtgaccggagggagttagggataggattttctgttctaatcggtataccatggtcctctctcatctgcccatgtaaaagtgccgtagctgaaagataaaactaataatatgctaagctaaatttgcatgatgtgtgtctaatacttaaaataataaattgtattagtcatttgatgaattatggggtttgtgaaattctgttttaagtaattttagtgtagtcccgtacgactttaggtaaattaaaaggtaggtatataaattttggtaggttttagttttcagacttccaccacatatgtggtttttgccctacatattttcgcagaaatcgaagacccttatggtccaggccagtttacaacttcatctttctacaaggacccagccaagaattgagcccaaacttcggtctaaaattataagcttctggacaggccgaatacggggaggcctaggcccatgctttctctgtccattatgtgggccgtaagattgccaacataggattgggctttaaattagttactgtccatcgtgctcatgcacagaatctccgacagtgctaaaatgcttccactccggttgctgttcaggagatctctctttcatcccggaactgtagacgtgtactagttctcttgataactgaacaaaaaacatcgaacattgatcgaattgattactgaaaatactggaaaaatctgggataaaactttcgccgaatgaaagggagtctgttttttatcgcctccattctatgcacttgcactgggggtgccaactgccaattccattttctgctgacacagtgaagaggaaaaggaaaaatctgccggctccacggcatccaaaatatccgcaccctgcaccccctttttgcattctgatatctgaatttgaaacatcacctcatcagctttagctctttctgacctctattatactaaaccattgtcataaaatgttcttctgttttttattttatttggaaagatcctgatcagaaaattatcttttcagttaattaatcctatgcctgccgaaccaaagaatatgtttcgggactcggacatgggagcattcagcatcgccttcctcgtaatcccgacactttctttcgttccggctgcgagaaggattttgttttgtttcatgtgttgacgagttgcagcaacattggagcaagtttaacggtatagccaactgccggctctaaatcatctatagtcaatttaatagctaatttataccatagttagctataaacatatactccctccgtttcgaaatgttagacaccattgactttttagtacatgtttgaccgtttatcttattcaaaaacttttgtgagatatgtaaaattatatgcctacataaaaatatatttaacaatgaatcaagtgataggaaaagaattaataattacttaaattttttgaataagacgaacggtcaaacatgtgataaaaagttaacagcgacaaacatttcgaaacggagggagtactcaaaatatttgacaccgttgactttttaagtacgtatttgaccattcgtcttatttaaaaaatttaagtaattatttattcttttcatatcatttgattcattattaaatatactttcatgtacacatatagttttacatatttcacaaaatttttttaataacgaacggtcaaacatatgctaaaaagtcaacggtgtccagcattttaaaacggagggagtaattaatatctggtcttgtattttagagtccgtgctatagctgattataaaactatagcgcccgctgcacctctctcctcttttatctcgtcaaaatgggttacctagtagcagcaccgtaaaatttgacttgtaaacgggggaagagagagaaggagagagagcacagcatggggcagcagcaaaatggcatgtgcgggggccacccgaggcagcagacgccatgtgacccctgtctctactcttctcaggcccaaactcctagctactcgctctcaannnaaaaaaaaaaaaaaaaaaaaaaaaaaaaaaaaactcctagctactctatgggctatggcgtactagccacttcagcagccaaaaattccatgctttcccacgagcatactgcaagccattgcaccaccgccgcctctcgaatggtaacaaacgggtttctaccgcaactttacaatctcaccgcgtgtgtttgttgccattcagccccaatcagaaaggttttcttgtcgtagtctatgggtgtgtttgtaaattagggactaaactttagtccctctcacaaaaatataagtctctatcttagaaacttatatttttgagcccctctctcccaaacaccctcatatatatatcttgcttctaaactgttaatactccaccatccgttataaaatataaacaatttttagtatagtgtcaagtcaaatatttatatatttaactattaattgcaaaagaataaaaaaatcaatcatatcaaattgatgttactagatttatcattaaacaaactatcacaatatgcgactctttttatttaaaacatcttacttttataaatgtcattggttaaagtagtatctcgaataccgtgtcgaagatcaaaagtgtttatattttaggacggaggaagtaataaagatgtaagaattttatctataaataaattatttgtaatagctcaaccaactagacatgcactattttgggccttctggatcaatattttcccaaccactccttttgcacatcgatatttgcatgttcaagcttgaaagacatatgatggtagggatgaaa

SEQ ID NO: 71357 - DNA, 18421 bp, Oryza sativa
ccgatgtcgtgtacaagtcgtattgtcggaatcggctgtatcggcttacttagcccgactcagacccagccgatcctaaccgtagccgatctggactccggccgattcctgctctgtttccgaactcgatctccgcttccgacttcgttttgatccaatcctctttcctgacatagatgttaccaaatttggttgttaacagacatcaaagttggcacaggagttggctgggtcttcatttcagatcaacaaaaggtgggtattaattccttgatttgctttgtactgacttattttctgttgtgtcaacttccactacatctgtctgattaaattttgcaattctgtttggtatgcagggtatccttaatactgtggagaaatgggtacctgaggctgagtataggaactgtgctaggtacatttatgccaattggaaaaggcatttccatgagaagcagttccaaaagaagttctggaggtgtgcaaaagctccatgcagaatgctatttaatcttgctagggctaaacttgcacaggtcactcaagctggagctcaagctatactgaacacacatcctgagcattggagtagagcttggttcaggttaggttctaactgtgactcagttgacaataacttatgtgaatctttcaacaaatggatattagaatctagatttcatccaattatcacaatgcttgagacaattaggagaaaggtcatggttaggatcagtgatcaaaaagcagctggtgctaagtggactactgttgtatgcccaggaattctcaaaaaactcaatgtttacatcactgaatcagctttttgccatgctatttgcaatgaaggtgatagttttgaggttaagcaccatgagcataggtttacaatacacttggacaagaaagagtgctcttgtaggtattggcagctctcaggattaccataccctcatgctatatcatgcatattctatagaacgaacaagctagatgactatattgcaccttgttactatgtggatgcatttagaagcacatatgtgcattgccttcagccattggaaggaatgagtgcttggccacaggatgatagggaaccactaaatgcacctggatacattaagatgccaggaaggccaaaaactgaaagaaggagggagaagcatgagccacccaagccaaccaagatgcccaagtatggcactgtaattagatgcactaggtgcaagtaagttgggcacaacaaaagcagttgttcaaagcatcagtctagtggttctggcacagtgggttctcaatagcaaaatccttcaccaagccagcagatggtgttatcaaatacacaaggcagttctgctcacagcaagaagaggaaatctgtcagcctaactaccacaaacactacaagccaatccaggaccaaacactacaagagcaaggtaaatgcaaaaatttatccattccaaagttatctattaaccgaagcaaagtttaacatttagcacatatatgttattgcaggcaccaatggagagccaggagctggtcagggttgctgcaagtgccaaagtttgcacagaacatggtggatctgctcaagttgatctgcaagcaatagttccccattccgaaagcttcacaactgcatctgtgaggctgacatctggcaaggaaactgtgtctgtctcagctgaagagcctacaaaaaatctgccaaagaagaaagctggaggagctctcattcttcttccatgggaaaccaagaagctctgaatgtgcccatttctgtgtgtcatgttatgttgaaacatgctctttgatgtaatggcagacttttaagccaactatttatgtatgtgatgtaatgacagactgcatttagccaactatatctgtgtgtgatgtaatggtagatactagacaaccaactatttctgtgatgccatactatttggcttgcttatctatgacttaagacataagttgtgatgccagactgatttggctatctatgttacttaattgagacttaatggtgtgcaacttcatttgctattctcttaatggtgcaaatccaattatttcaggaccatttgctccctaactggatgtttcctgcaggaatttacatgttggcttacatatgttgctacaatagatgcactagatccattctgttgaattcaaccaacaatattgcacttaacatccatgtaatctttgcacagcttgaaacatatagcctgctgtattttgttgtcacatttgatattgcaaccattcatttagaactcatctttcaattagcaaccattcattgacataactcattccaaattgatagcacaactgatacatatatctcatcaaacacattgtctttccagagcatagctaacacataataaaggacctcattacatcatattggccacacatcacactgtctcacttcttgccaaagaacaccacaaatagcacaaacatacatgacaccacacatattacaaagacttttctttccttctctaacttatgattcctggccttcaagcacataatttctgcattcttcacagcaaccacaccacgagcatcatctatcgctttactctgtacttccaccttatcccgactctgttcgacctcctttcgcatcacttcgttctccctcctcaacgaattcaccctgtcccgcaaatcattcaagagctccctgatgaagcttgacgtcggcccgtcgtaccatgcccagaaatcacaccccccttgctgcaagaaaaaatcccacattcaaaccctaaaaacgcaaactcaacaaatccaacttgtaataccaaaatccctcacttacccgagcgttttggcacttgtaataccggcgcccagggttgtccatgctccacgagatccacctcaccgccttggctagtggacggcatcggcacatcaccgcgggctgatattctagcggaccaacccgataaggcacgggagatgccttcgactcacgggtagacgacaagccatccctcatcgagctcgacatctccgcgccaccgctcgctgccggtcgccaagtcactgccgccgccgccgccccgctcggttcccgcttcgctagggtttcggtgaatggggataacctaaccgtgcgccaaacatttcgcccattatatcctaactaccgccctgctgactcagcgctgaagaccatggtcaatgtgccacgtaggacaaaatcgggcacaatactgcccagggaccaacactgacccggttttgatagttaggggacccccgatatctggtttgtcggtttgaggacgttttggtaactcgatgacaagttcagggaccttcggtgtacttttctctttctagttcgctcgcgccggtcaccgcgaacactcgaagcctattcatcagacttaccccctcagatgattttttcccagaaagaaggggtcgttccgaaatgtggttaaattagtttctggcccaacccaggagtacgtaaagtctgtcagcattcagcaaactgcccagaagcctagaaaatatgggaccttgggctttacggaccatgtaatttctggcccatttcgctacagaagggcagtactctctagcttgttgtaactagattcaggatcagagtattgggagttcacaatgtttaatgtcttggcatctgtcgtgtgatttttgagaaaaaatcacctaatttttttctcccctcagatctgcatccaacggtaaaaaaataacagtacagagaatccattcaaatagcctgtgattgtgcttgttagcagagtagtatttagtaaagattaacacaaatgttgaatttataactaaaattacagtgttttataactaaaattacatttgtaaaaacagtagatatggcatgtaagtgcactgtaattttagtataagtgcactgtaaattttggtaactagaatatttatcgttttagaacaaatacattacttgagaaaccgtgcagatatttgaagttataaatgttgcatttataactaaaattacagtgctttataactaaaattacatttgtaaaaacagtatatatggcatgtaagttgtcagggttatggataccatatacctaatagtagttgactaaatctcggcaggacccactacatactatatcccatacggaagcaatctttggatataggaggagttccagataaggaaagacaaccagaattctacatgaaaacgacaaggactactcggattgtatccatattggtttccctagttctacttggacaaggggacacctatgggtataaatacaagcctcctaggaggacagggggacacccaccatgagacgatcaacacgatcaacacccactatgggacagaggatcaacactcaacacaatcgacatagaagccacaacatagaagcctacatacgctaagacacgccgccggatatcgactttagagataagcacggctagtcccctacggtgtttccggatactgttaggagagacgaaagcgctatctctgatctcgccgggcacgaattcaaggaggaaggctaccctgttgtcgactacgactcagatcgtcagaccgccatgttgacaacagttagataggctaccccaaatattgtactggtatgattatcatgaataagagcaatatcggcttcggccaacaggatgtagggttattacctgacaattcaggggcccgaacctgtataaaaatccctgtctccgtctcttttacctcagtcttgcgtatatcctagcaccaacgatccccatcctgtccaaataccgtagtcgtgacatcaaacgtcgacagtggcgcgccaggtagggggattttggtgcttcaggatttcgacgagataggtttaagagatggattttccaacaacaagctactcgatgacttcgactgtggggagatctaatccgaccggaatatatcctccgacgagatcaggatcatcgccgccgagaaggagacgccgacctccacccggccgtgcagctgctgtcccaagtgcgacgcccatccaaggaatgccaagcccgacttggtggcaaatcaatctgtatttgcttcgttcttgtgtccggttaggactggaattaggcaaacggaatacgtgcatgcatgacaaccgtgccgaccaatcaggactcaggagatatccatccgcaggcctacatgttgacgtacgtacatatgccgataggtttccaaaacctattcggtatatgcacatcaacacatgtctacacggcacaactgcataatattcaaacaaatcaacaaaagtatttagtagtttgatttttataattgatctactaattccatagatacatccggcatgtatctacaaagatacgcaatattttatacacaatttatcgtacctattttttcaatttatacagcattgtcagatcaataatttattatgtttacccagagcatgttttttatacaatatctgttgcgcggttgtccccgatgttaaatcgactacgatctaacgctgggggctcactccgtcttcttctgtataaatcatgcttgtttacggttgtccccgatgttacatctgctcgttatatcctgataatactagaagatccatgcagtttttagtacatactcgatattctctgctatatatcttgccttctagaaaatatttttcaggaacaattgagcactcgagtaggatgtggtcgagtacaccgtattatcgaggtcattcttgacaaatgcagagtcgtcgcgtccaacttaccaacgaagaccgacgacctatctcatagcaccggccatggctggactactcgagaaaaggttgttatcggataattcctcgcaaatgtcgtcggcttgatcacccgacatgactgcgaacggacatccagatacgctataagttgggtatgtgagtcatgctggccacatgagatacacatataataaaccaactttagcacctccattggtgtccgagagataattctacacgttcgctggttcctaaaccagtacgtagcaatctctcgcaccgcaacctccattggtgttcgagagattctactcgcttgctggttctcgaaccagtacgtagcaatctctcacaccgcaacaccaatgaaccagcacgtagcaatctctcacaccgcaacttccattggtgtttgagagattctactcgctcgctggttctcgaaccagtacgtagcaatctctcacactgcaacttccattggtgttctagagattctactcgctcgctggttcccgaatcagtacgtacaatctctcgcaccgaaacttcagatggtcgaggtacgactacagcaataacacagcggtcctcgcaccatgacttcagatggttgaggaacagctacgactagtcttcgaccaacagtgtagcggtccttgtaccacgactccaaatgatcgagagacacctactcactggttctcaaccagtcaatggtagcgatctctcgtacatttacttctagtggtcgagtttagcctacacctggttctcgatcagcgatgtagcatttctcccactacttccactttaagtgatcgagttacgactactgcctggtcctcgaccagcgatgtagcatttcttccactacttacactttaagtggtcgagttacgactactgcctggtcctcgaccagtgatgtagcgtttctcccactacttccacttcaagtggtcgagtcacgactactgcctggtcctcgaccagcgatgtagcgtttctcccactacttccactttaagtggtcgagttacgactactgcctggtcctcgaccaagggtgtagcgattctcccattactcctgcttcaacaaagttgatatcaggtgcacaatatcgccaaatgttttacccagagatcccttaccacgatgacacctggcgttgaaacctatcctactgtccctttatgccgtcttgacaaggcctccgaggaacctaagggaacttcggctggggacgcccagagccgataaggccttgtcggatcctttagagacgaaagaccatgtaagatctggtcgtgtaagagttctcgccttgcgtattaactaagccgtgtaatcggaaatggactttccaacttcacggctggggactaagatcagtgcttgttcaaccgaggtaggtcaaaggtccaagagccttatcctctgagaacgattctccgacgacaaggctgggggctagggagagtgtatgactctacaaactgactgatcggagtcggtaagagagaggacgctcatatacaaaacactggtctgtacattcaattcaccagtctgtcatattataacatgtcaccctttgagcattcgctcgggggctatttctatctaatattttttctgagtattgatttcaggaaaattctattcgacattatcgaagactccatgtctctatggttctacaccaagatcgactaaggcgagtatgacaaatgttgacaaggctccgtcgcagactctacgcctactcgattgctcgagaacggttggtagatctcgacaaggaataccgaatgaagaaatggtgtacccatcgagataaaatttcttgacttcaatccaaattctcaattacagcaagacaggaaacttagtcgtacgctctgtactttctcggtcgacatcagagattgacttagacaaacccgttcggtgcctgcacgaggctgataaaggaagtctaacgttatctctaaactcacctagaacggtcacgtgtgctcgataacatttcctccaaagtctgtggttgagaatatgaactcgttcatgtgcattgaagtcgggggctattgtcaaggttatggataccacatacctaatagtagttgactaaatatcggcaggacccactacatactatatctcatacggaagcgatcttcggatataggaggagttccggataaggaaagacaaccagagttctacatgaaaacgacaaggactactcggattgtatccatattggtttccctagttctacttggacaaggggacacctatggatataaatacaaggcccctaggaggacagggggacacccaccatgagacgatcaacacgatcaacacccactatgggacagaggatcaacacccaacacaatcgacatagaagccacaacatagaagcctacatacgccaagacacgccgctggatatcaacttcagagatacgcacggggtgtcttcggatactgttaggagagacgaaagcgctatctctgatctcgccgggcacagattcaaggaggaaggctaccctgttgtcgactacgagtcagatcgtcagaccgccatgtcgacaacagttagataggctaccccaaatattgtactggtgtgattatcatgaataagagcaatatcggcttcggccaacaggatgtagggttattacctgacaattcaggggcccgaacctgtataaaaatccctgtctccgtctcttttacctcagtctcgcgtatatcctagcaccaacgatccccatactgtccaaataccgtagtcgtgacatcaaacgtcgacataagtgcactgtaattttagtacaagtgcactgtaaattttggtaactagaatatttgccgttttagtacaaatacattgcttgagaaaccgtgcagttatctgaagtgttaaatattacatttataagttgtaactaaaattacagtgctttataactaaaattacatttgtaaaaacagtagatatggcatgtaagtgcactgtaattttagtacaagtgcactgtaaattttggtaactagaatatttcgttttagtacaaatacattgcttgagaaaccgtgcagatatctgaagtgttaaatattgcatttataagttgtaactaaaattacagtgctttataactaaaattacatttgtaaaaacagtagatatgacatgtaagtgcacttattacaagtgtatttacacttgtaaatggctactgacatgcgtgatgtacaggaatccatcgatatatacaaagtcagattgactcggtcatgtactcaactaatcctgctgttgcacaaatcttggaaaacatcatgtggctagaaaaacgtcatagtttgactatggaagaaatcacccgacaaatatttagcaaaatcgaattacattagccgctagcacgaggcaacaaattatcaatgtctagtacacctagctagtggaatagtggattaattactggtagttacttctagaaacggaatcaaccgtacgtcaatgtcacggataaacttgtggcgtggtgcctcacgaagatcctagtaaagctcaagcacgatgacttatagataatctatcatatgcgtacggcacgatgacttcttcttttaggaggcatgatgacttttggacgcacatactaaccttcttcttatctactctgatctgatcgtcagtttattttaggctgtactgcgctgcatgaattgttatcctatcctaattataaccagcctttctaacatgcatgttatagtgtaacttaatcatcatgctttagctagctgtttgttgattgcttcagttaattactaattaatccaatccatgggagattagaggttgttgctagctagttagagccttgttgctagctagctactccgtagaggtgggccggagacacgatgatttgaaaaggtcagaagcataaacaaattgctgtctccaatagggagacgtggtttagcaagtggatgagtcagtttaatttttgcttatctagtgggaagatgtcatattatttcacgcttgatcaatactccgttgagcaacgtgctctgccgccgtctttccgttgtacttgaacgacataaacaatgttgttttataatgggagaatctattttataccactttgttcgagttcaatgatttgcaatcgacattatcgttttctataatataccgatgactttatcaattgttctacaatagacattcttttcgaaaatatatatccaaaatacccttatggacatacaagattaacaattgattaatctaatttgaagtttcaaaaaaaatataaaatcttttatgtggcgttctaacacatggaattttttaggtaaattttgctacaggacactacgatttcgtggttttagccgtaggttaccgcctgaactcactttaaggggaagacactccataaacgtggtaatttgctaatgtacaccatgccgattataataataatttccggttgaagaggagagagaaatcacgtgaaatgtcaaaaatacccttgggactacatgtcagctctcctatctctgctctctctctatcccctccttctagcgtctgatgtgcggcgtcgggtggtcgtggcggcggaggacgacgccaacaccgcgatagcgacggtggacatggcgggcttccgcgcctcctcctcctcctgcgccttgagcgccgctaggatgtcgagcccgatccctcccgcgtcgccgtgcgccacccgcgatcgatcgggcttgtcggcgacggaaggccgccgctgccatactcttgctgctgcggctactagggtgagcagtgggcgatggagacgccgagcttgccttctccaccatggctgagatgagtagagagagagaggaggagatcccgttgacccatcgcttggtggacttcgcggcattgaggatgatggtggagatggggtcggtggcagcggacccgccgttgctgtcgctccaaccctcacccgcgcgtcgccgcggcccctctgctccacgcatcaaacgtcggaaggaggggatagagagagaggagagacacgagagctgctgacatgtgggtacaaggacatttttgacatttcacgtgatctctctcttctcttcaaccagaaattattattccaatcggcgcggtgtccattggcaaattaccacatttatggagtgtcttcccccaaaagtgagttgggtggtgtcctacggctaaaaccacgaaatcgaagtgtcttgtagcaaaatttgccaaatttgtatagaagtttcaagttttttacatttctattttttataaaaaatataacttatttgttatatgctatataaaatactttttattgctatttttaatataaatcatctttcatacactacataagatatttttatgctattatgtcttgtataagcaaattctttctcatataccacataaaaaaatactttttcctaaaaactaagtatacacaaaaagacttgaaacttgtatacaaacttccatgttatgtaaggtggccacataaaaattttcatttttttgaacttccggtgataatcttgtatgtctctaagggtattttaggtatttttgaaaagaagtttcagcctaatggcgtattgtagaataattgataaagtcaccggtatattataaaaagagacactatcaatggcaaatcattaaactcgagcaactcaggggtatagaattaattctctcttgattaaacaggcaccattgcgttttcggatactggtctggctatctgaagtgtaggatagaatcacaagaactaagccaaccagaggggggtgaatggttagtatacccaaaatccgaaaacttttagcggaaataaaagttaccctcgaaatcgacgagtcacggtctaaccgaaagtgttgcgccggtctgaccgatgtagatcgatcggtcgaaccgccgaagtcgcctgtcgcgcctgccgccgccgccggtctaaccgcctgtatgccgccggtttgaccgctgcttgccgccggtctgaccgccggtgtatcaccggttagaccgccgaaacccggtgaaacacaaatcgaagaactcttaaagtggatgacgactttatttattctctctgtgtttagaaagtgcaccaacagcactccttacaaaaatttcgactaaactcgaaaccctaactcaaaactcaactcaattactctcaaaagcgataccgggaagcctcacgctccccctctatttatacccgaggtaagcagcctaaagccacgaaccaaactcatactaagagtcctaaacaccttagaaaaccctctagtacaagaaacaaactttacataaccaatcgtaccaaatttggactccttccaaattcgactccgcattccatacgcacataatacctccatcgtatgccatatggaatctccatcaaccacgtgcatcaacactagcctaagtatcctgcatgatctctgaccaccacgaacgtcgtcttatccccaaaccgactcccggtccatcaccgcaaatactctcccgaggcatcgagtcacctacacatgaaataaacaaagaaaccatattccgagaccaagctatctccaacttgactcattagtaacaaacaacggtattacgtacgtatagtatccatctagaagtcataatcatgaaataatcacggatatccaaacaaacaacccgaaaccgaaaccgacagagtcggccggtcagaccgcgggctggccggtctgactgcgcgcataccgccggtctgaccggcaacacctgcccggtctgaccggtcacataaaatgacaacacctgtaattcacctataaatccaatcatctccgaaaccacttcgtgaataaatttcaaataacaaaattaataatctccaatgccaattgttcatcacagaataataataaaaacacctttgattttacatgaagcacagttcttattcctagctcagtactgatcgaattgtggacaagacgaccattaatttgtcatttagttagagtcgtccaaattaattgatcagcagctgatttgtcctgaagtatttgacaaattgagcaagaatttgatggtgtggtttgtaattaattgagagtactatacatacaagtggtgttatgcaagctagctgggcactcgatcgatcgtttggctccgatgatgacagccatctcgatctacacgaaggaatcataagaaggtaaaggtatattccaacctccactgtacaactttgaagatgcaaagctagcccagcaactagtacttgcatagtacaaagacctattatatatcagcttatacagggacaagaacaaattgtttaatttgtaaggtccaatgaatcaacgacaaagtagcatgcttctttcatgggcttgataccagaacaattaagaaatatgcataaatatctattatctattatatactaaaagtccaataaaattcctacaaatactctcaagccgtcacgtggcgataaaatcctaaaaattcaaagaaaaaagcaaaatatatatcctttgattttcacttaaattgatgggtccattattataccccgttagatgaaattaatcttaaaacaaaccaaatactatacgtcccagctctcccccttctcgcgcgcataggtaggtatatgtacgtacatgggtacgtacgcttccttcccttcttctttttttttcatttatataatggatatattttttaaataatcataattaaaaaaaaatctaccatcatataactcaggtaactaattagctctatatttttttttgaaaataaaatttataccattatatgttacccattaaatttataatataagataatttccacttaaaatagtgtactcataatattattttcaagtagtgcactattttaaaataaagtttacacaattatattgtgtacctatcaaataaacaattcaagatctacattaactaatttatacgtgtacttaaaccgatgacctattatttaaatcatcggatctattttttattacattatactattattctcaaataatgcactgtttcgaaataaagtctacaccattatattgtgtacccattaaattagcaagttaaaatctatattaacaaatctacacgtacactagaattggtggacccattatttaaatcatcggatgtaatatcctgaaaatccctaataataaaaatcactaaaatttcgaactttttaaaacttttgcattatgctggatgttatggttgctattgcttgccaaactataaattgtcacgattgaagattaagctaaagccgtacaactaagaagtaattagaataagataattattattaatcctataaatatttgtgtacatgatagcaagccaaataaaacacaagtcaattattaataattacaaattgtatgttaaatacttgaaccatgtcgacaagtgtcatgacatctaagtaaccacgaagtagtcgccactacaatgattttatatatataggagtgttccactagaataattaaattaacatttataactttcatcgagtctctcatgggatggattcactcatgtaaaataatttgtcatgcaaataaattgaactttatatataaaataggtttatgtgagtgtttaattaaacatttaggtcaatattgtaccaagtatcaatttacttttatggaataatcgattaaatgtgtccttgtaaaatacattgttatacaaataaactcgaccaatgtgctattgtattattaaggtcacattagaatatttaattagtttttaagaaatatcaaagcttataggttatattggataatttttggataatttaatggaaagcaaattcatttgggaactaataaataaccaaataaatattcaaatcaaacatttgaattctcaaaaccaaaatatattgattacatttcaattcaaattcaatcccattcacttttgcagattagcccctccctttccttcctttccctttttcttccttttctctcttttctcagccgccactattcaatgtccgccaaccgttcgatcccgtctactgcgtgcaccacatcgcttctggccgcgccagtcacgcccgtgccgcaccgcaaccgcgcctccttcccctcagctgcgtccgaccccaaccctagccgcaccgcacttgccgctccgcaaccgtatcgcgttgtatcgcgccgtgcgtcgcatcgcgccggacccacgcccgcgcccgcgtcatcccttccgtgccgcgtcgtgccagggcccgcaccacgccaagccgcacctctaaccgctctcctagattctctccagaaaacacggagctgcaccatcgcccatgtgcgcgcgtcgccgtcgccacgcctgccttcatcacccagacacgcgcgtcccatcgcccccatccacgcccaatggataaaacggagccctctcctccagctagcgcccagacctgcagtctataggttataggtgtgatgattaagccacagaaccttaatggagaaggagatgaatctcagccgcgtcatccacctcattgctcttatccgatcaccattagtactctagctcgcctaggcatgtgctggtgatcttatccccatagtttgcttgcatcctaagcgaagccctcaacaaaatccccatccctctcagccttcttctcgtatgcatttcatcgaacaccttgcgatcaccctctcaccaccgctagagatcaccattgtgaggctccccggccggagcaggaggttagagggagtggaggaagagccgtgctgccgccgtcgccatgggggaagccgggtagccgctggacatcaagaaacgccgtcgagcaccttacgtcgctgccgtttgcccctgtcctgcaccgcgtcgagctccacttcgctgcgtttcgccatctcgccatctcgcggtacaccctcgcgcccgtagcgtcctccatacatctaattgctagcgccggcttcaaaatcgacgattagcgcccatggccgtgccgccccagccgccgtttcatcgccggcgagctctccgtgggtaggctatcccgggagctcccctctccatatagttcgtgaaatcgaatccccatacctcgtagatgctcccgcacccttcaattcggccgaaggatgtccctagcaccgaagccccttgtagccgagctcgggcatggcgtcgcctgatggcgccgcgcgcccccgtctcctcgcgcgccggctgccatcggcgggagatcaccggagctcctccgcgcctcaccctggccgtcgccgagccgcccgccgccgtcccggctcgggccggcaacgccggctgcgccgagccgcgcctctgcctcgctcggtaacgggcgagaggaagaagaagatgaggagagagagaaaccgtgtgggacccacatgtgattagcgcacagtaatcctatccctaacggtgattatcccactcaatggcaggtggggtccctatagttaaaatctaagaaaacacaattatatattttgttcctatgacaggcgggacccaatggtaattaaacaagcaggtttgaccctaagtcaaccagggccggtcccacatgtcaaccacggtgggttttggataatgtttccgattaaaaataaatcatttatgaacagtgcatttttacaatttctcggattaactcaaatttgaatctttaaattagtataaattattcattttagctccgattcgagtgaaacttgaacctaaattcatctaaattcataagctttccaatggtatataactcactatttaataaaatatattaatatcaaatgattagattatggtcaacttaaaaatgtgctaataaataaaattgatattgtacagtagagtagatgtcaaataaatatatttaacatgttttgtcactgtagcaaccacataaactaagtataagtaatgtctcaaatgaatggatgtataggaaaatactagtgcttatttaatattcgatggccatataattaaattcatgacttaaaaattagttacataaagtttagcttcatattttgtaactaaaatattaatactcatagatgaatctttaacttgtttatgagaaataataacagagctagtgtgattaaatcacctatacgaaattaattacttaatgtcatgttctttggaatagtatcttttaagttggtaatcttaagttgataaacagtaccaactcgccaaatccacctgcatcacatatactgtatagcttacagtaaatagctcatgcttagtaaatgatctaatactagtatgttattgcactcacaactactgtacagtccatttaaatcatacacaagaacaataacctacctttttcatatattaaactgaggagtctatgataagcgtgtatagtagataaaacactaattataaatcttgacctcacacacaattatagtttgaccgtgacttaggattatttatggtaaaattatgcattgagataaactttaactataatattatggaccacactaatctaacctacatagcatgtaattcgttggaaccctaatacagtaatatttgtagagccatgcttagataatccatcctgttagaactcttgttatgattaaattatccactgagccttggtaaatctcctgtagggtgtcaccatttaaattacaatcaaagctagtttagccatgaactccacatagcaatagttcatagataattccatagtcctgagtattgagttctgtatgtgagcagccatagtttggacttcgtagcaccttacaatccattagcaagcacgagtgatatgaatagccctaggtatattccgaacaattatattttgtttgtgcatatttgattgttgcttgaatattggttttctcgcatattatagaaattgtgtatcgattagtggtgaggcaacgtatgcagcttccaggaggtgaaggttgatcaagattataccaagaataagaactatcctgagcaggcaagtcatcactaatctttgagcatgttgaacctattgcgaaaattatgttgatttaaataaaattgcatgctatatatatgaatatgaatgtcctacttgttatatatgccatgccttgatattgattatctgtatgaccattgtaaaccctgctatcgtgtgtacttagtcaatattgaacaaatgcttagtcatgctaattagaatcatgcattctcatatttatcaagtgctatatgcttgggcaactaccttagggaaggtagttgagatgcggcatgtggagacatgagcgccacattgccatgacaaggatgacacgaactgtgaaaggagaaataaaattaaacactgttttcgactggggcggctggggtacttgggtggagtccggaaaaggctagtacca

SEQ ID NO: 71358 - DNA, 537 bp, Oryza sativa
tgtggtacaatccaattttgctagctaccctgtggctcatttttttaagccacaacttaagacaagtgtggcacaaaaatatggtgaatggtggcaaacttagtatagcatctaaacagcctagagcgccatgaacgccgagttgacggcccacttcttcaccgcgccgcagtcgccgtacaggatcaccagcctcggcacgctctgcagccccaccagcgtcgccgccgctagcggccacgcgttgtcccccttctccacccactccggcgccgcctccgccgccattcgcggccacgaccgaggtgaggcgagggaaatggatttggaaatggcgcgaagtagaggcggagagcgagttatatatatatatatatatatatatatatatatatatatatatatatatatatatatatatatatatatatatagagagagagagagagagagagagagtgtgtgtgtgtatatatatatatatatatatatatatatatatatatatatatatatatatatatatatatatatata

SEQ ID NO: 71359 - DNA, 607 bp, Oryza sativa
  unsure (1)..(607): unsure at all n locations
ccgacgtgtagtcgctgctgccgccaccgtcgccgtcgtccccctccgtccccgcctccgcctccatctccgcctcctccgcccgccgcctcgtcgcccttgcctccgccatcgccgggggatgccctagatctgagcgccgcgggatgcggtgggccgcgcggattagggttttggggcggcgccgcgcggattttggtggtggcggaggtggagagggtggtggtggcnctcgccttccgccgctgctgcttccctcaccgcggctcgaggggggtcagttttattatggcaaaatttatcggtggggacgcaactaatttaattaccatcttaataaattttaccaaacgacttttaaatttggggtcgatttttatttttatttttttgggtgagaggacaggctaactaaatatcctccgtgaatctacacgctttgagggtacattatagtaatcatagtaataaaaagcaaggttaatagtatagctaactactaactctaaatcatgtataatcaatttagtagccaatttatatataaatagttacctataaacatatgctacattattaatggaagggcccacctggcatacaatca

SEQ ID NO: 71360 - DNA, 17305 bp, Oryza sativa
ggccccggcggcgccgccacgcccatcgcctcctgcagccgcttcaccgccgccgtcgcccccgacccgcagaacagcagcgcgacgtcgccgcccgcggcgccgccggcccccacgcaccgcttgatgtagctcgccgccttcctcgccatcctcgtcgtcctgctccccacgtagctgtcctccgtgtgcgtgttccctacaagcatcgcatcgatcacctcgccatcgccatgaacgtcgtgatcgagctcgcatatcgcatgagatgagaagcgacatggtagatggtactgaccgtagaaggggaggacatggtggaggacgtagtcctcgacgtagcggaggccgcggccggaggcggtgtggtcggcgtagacgagggggcggcggccgaacggcgtgtcgaactcggcgccggcgccgacgagctgggacctgacccactccaccttctcctccgcctccgcgctccgctccgacttggctcggagcaggctcagcagcgtcgccgtcgacgtggccttggcggcggcggtggtcacgccggcctcgccgccgccgccgccgtccctggctgctccaagcgatggcatgcttagctttcttgcttgcttcaaatgcttacaaaatgctgtcaattgcgtctctctagtctctatatataggagatgtattctaatagctcgagtggacgtccacccgtttattgcatgtcaactaaatggctacgaaaaattttcaaaaaaattggcaagatagatcaatatgtaacactccacaaacatgcaagttaaaattcaacttctacaagttgtaacaaaaataacaaatttaactataaatatacatatagtaatttgagttttgtttgttatttttgttacaatttgtaccagttgaattttaacttgcatgtttgtggattgatacattacatattgatctatcttattcatattttttttttaatttttttcataactatttagttgacatgcaataaacgggtggacatccactcgagctgttaaaatagtttccctctatatataggagtatatgcacacaatgttatctactaatttagtaatttatgaatatcttttttggagactttgtgagcttgtatatcaagttactccaacatatatctcctgtttcatgtattgattcgaaatgaagatatgctcaaaattcaaagataatttattgagggatgttaatagaataatctatcatggtttcatgagatgacttatgggccggggattgcatggtaatgtgatttgcatgccatgtgtgttgccaaattgcagtcgtctatcgattgttagttctgccgatttgttgaattaactatagaccttgttgcatcagcttggcgaattttgtaaagtttttaagcgaaccaagtcgtaggtagttgtttgcatacttccatttggttggttttcagtgtagccgcatcgccatgaaatttcgtcaagtgattaattaccgacagtgccgccggctgtcaattcatccgtggataaatgtcgtcaaacaaatctaatttgtgttggaaagcaacaaaattggtgaatttctgggggctttatgcggcgaccgggatatgaattttaatctgagtagattggtcagatttgaggagacctaagcacaacacggcttgtaattttgtaagttatacccgctttgaaatttgctcatgcatttcagaaaatatatgaaaccagaaaagaaaagaaaagggcaatgcacaacaatctttattagcgggctctttccgttgtcacataagtaaatttggtgacgtaaacgagagagagatgagaaaaacaaaacatcgttgctatgcatgacatatggttagagtcgactcttagcatttattaaaagaatatttgttatatgggttggagaaaagggaaaaaaattagtaacaaatttttttggtgtattaatagttaaagatagtgttgtctcaattgttttagctaagagcctatcttcaccttaatttgtaactgccctaaggcaataggaggattatataagaacccaatgctaataacttgccgcaaccaattgagattgggccaatctattttgtccatagccagcgttgtttaggatcatggacgtcgtagaggcaggggagaaaatggtaaggaaatttccggttgtcatttttgatttgcaccgactgtttctgtttcagttggtattagtaattgttagtgtcggaaatggaaacgttaatgtcttccgaaaatggtagcggaaatgagatgatggtttttccgaccgttttatcagtaaccgtaattatccaataatttccatcaaaattccgaaatttccccaacagaccagccagcccaacccatcggaagcctatgaatgaaggaaacctggtaaatttgtagcccattaagaggaggaagtggccaagggaaacactgtaaccttaggacgtaccatatagtctttgctgaactttgattttctcaacttattgatgctgaagttagttgaattttgtttatattgttcaccaaacttattatcatatcattaataatcatataacggtgttatgtggagtataatgatgtaagaataaagttataaaatcatcttcatgcatagttaaatgtctgactatgccacgctccgatgtttccgacatgaatatttgacttccgagttccaaccaatatcagtagattccgttccaatgatcccgtttcctatataccaatattaccgatatcgttcagttctaccatttcgattcctttttgagaaaaaaatgaaaataaaaaatggtagaggatttctccgactgttttcatccctacgtagatgtccaaatcagggttttaaattttgaaattgctatgtctgccgggggcaccgaaattaccgaaatttcagaaatataggaaattttgaatttttttggctgaaattgtttgaaattttgactgatactgaatgaatttgaataaaatatggccaaattcacaaaaaaaaatgcaaaaaaccgaaaaattcgggcgagatatgagcttgccggtggtggggaggggggaaaaatttcgaaaaatttgaaacgaaatttcaaaccctggtccaaataaaacatccatcaatttttttaacatgtcaaaagagtcaaatcgtttcaggtatattcattccgctaacaaggagcaaccaggcaagagtgacaaagaaacattcaaagttgagattcaagataacttcactcagagggcggatctacctattaggcagggtgagtcgatcgaacaagctacgagcctacgacccttgtcgcccccacatcctcaagaccctctacccccttatagtagttattggttatcaaaataaggtataataaggtgtaaacatccaacagattattccgactcttcacaaagcacgcacatcgcaaacaatgattgagacagttatgcgattgaactataaatatgatatgtgttgtgttcaattctttttatcatgtgagcatatccgttctctgccccatctatatttgtctgcattgtataaaaaacataaaggattaacgtccaattaaccagatcatcaagcatgcatcgtcatgaatatatataggcattgatattggaaaccaattaacactcacgatacgcaacggataaaaaggctttggcgctctcaccaacctggtacacgtcgaaaaaaaaggcgctgatcgatcagcttgatgcaccaatcgcaccaacagattggcgtcaaacagaaattaccgagggcccttcattatattaacattcaacactcccagttcataacaaataagcatacttggtggagccagaagatatatgcaaagttagaatgcaactgtcatacatcagactttctgcataagatatctaggaaagttaagtaaacaatttatttcttacttagcaactgccaaagttccagtgaaatgtttagtgagggcagaacatgcaaataacaaacttcaggggaaaaaaaaattataattgtaagttcatattgcgagtttagtttactgctgttacagatacaaaaccggttacagctagcaggagcaggaaaggcttctatgatctacaaacattcttaagaatttctgagtttgaaacaggaaaccagggttgccggatcaaggaatcgaatcacttccatctccaacaccacccctgaatcaacatcttgaatcccttgatgttaagcaaactgcaattcgatgcaagtagagactctgccggcaatagggttggtggtgcttgctattctgccaacctgtttatgaatctcatgtcaattctccactttctttcatatctgggcattcatgcaacacagcatcgcaacatcctctgagagaaattgcaacctactggaatctgtagctctctttagtgttgcatgtggttcctctaatgaatggctactctgaagaatgctctcatgaaacatctgaagtgtgtcatctgatgaaacttcttgcgcagagttcttcaggtcttggagttgtccaatttttctttcaagctgtctaggagaggcgttgggacttgagatcagaattgtgtaaggaaaaaaaaatattcttgcacatgagtaagaaaaatgactcaatagtaccatgcccaaggaatatatgtatttggcaggtgagtatcaattgcaccatcactaacatgaaaaaaaaaagtaatgtcctgaatggctttgttagcgtcaaattctgcagttccaatttgtgtttctcccagatttctgcaaagcaaagaaataagatttaaaaagtacacaaaaatgtctacttcgattggttaaacattccatctaactgtacaagtatcataaaaggcaacctaacaaaattaacatggctaaagtaaaagacatttgaagtacttcaaagaggtcaattaaattgcagatgcattaattagacaggactcagtacctagctaggaaaataaacaaaatcaaacatttactaatttggttccatatcaacttgagccaatcttgttgcttataagataacatgattgggactttttacttatctttatctttttttttcaaaataatgccagttcagtttcagaatttctcatagaaaccattgcataaaaaatgtacatgaaactacgattaatcatggtaataattcaaccgtacttcaatttagacggcactataatgtatgaggaagatctccataggtcatttattagtttacaaaacagtgcatggatttccagcttcaattttccacctgtgtgctgacaaaatgcaggaaaaatctctatataaaatgtggagtaataggatcatgctgatgacttaacaattttagtaccaatttctgctttgtaagcactgagctcagctcatccgtgttgttactgattacattagtatttgtttatatgctatcgatggctgtttgcacgtgtgccacttatacttttttagtcttagaagttgttcgcatatattagtcttgtctaaaaaatatatcagattgactcaggaggttcaaggttttatttcaaaaattggttgagtaattttatatctctgcctaagatgtgacatagtttttggtataagatttacccttttatgcagatcagttgaaggcagcaagacagtgagttcatggacataaattggaattcgaatttgtgcgcataaattctgaattctaatgaaccaaagtaatgagactacttatcttcattttatccctccacatgactataagaactgaggaaatatctttttttcaataacttgctcttcttattctttaaagatagcgttctaagtgaggaagcccgcctatggagtttggtgggagctaagggactctccctgtttgtggaccccagctagggccttttcttttgttctttttggtgtgttaccgcccatgcagtgacttgttttgtggtggcgtgaattcttgtacttcttgctgttttttggcgtgtttgtacgcttttcttctattaatgcaatgatacgcagctctcttgcatattcgagaaaacaaacataacgttcgaaatgcataacattaaaagttcagtttacacaaggaaggagactaaggaattgattattcctttataaatttggtatagcgtttacctcaaggcaggagcagaagatgctggtgcctctttatcctttttctactacttgattctgtcctggataaatgattgcaaagaggcatggtcttacgtattgcacattgcaacttgtatatgcagccggactgtcaagtgtcaactgtgtgagagctcaaccaaatctcttgtgttctgtcttgtagaaaaaaaatgaatgtgctgtgctactgtcactgttctgcaagctgttgtacttcaatccaacgttagatagacatcggcctgagttgtgtagcaatggtagctgaatcaagtgaagtctgaactgctgtgcaattctggtgctctctagtttacagatccacatgtgtccaccaatagtaagagctataattttttgaaagggaaactattgagatcctccaaatggccgtttttatctccaaggtttcggatgaacaaaaaaagcagccaggaatttctacctacaccctggcaatggcaaaagcacaatgaatcagctccatcaaccgaaatcgctgattttgagctagtcaagaccaaaatacagattcctacatgcaattagcagaaacatatttgcacatcatctgcatttgaaaactcgaggaatatggagtttatgaagtactggtgagtagaggctttaaaaactttaaaagtataatcagtctatacttgattccttgccctcctattccaggtatcccttgaatcttcagccaaagctagtagcaagtataaaagaaccagcataaatctgatgcagtgatgctatccaattcacctcttctatgctctccttctattcagtagtatgtaaaacatacaagcatacacttgactgttttgaacttaaaacaaatcaatatagatgcctcaatttgtgggggaaaaaacataataacctgggaggtaaaacaaaatgaatgaaatgagagcagacagccatgctattaaattcaatgtagatggctgaatttgtggactgtatttccttcattttggttcatgacggcaaatatttcatatttcaattaatatggtttcaagtagaacgcaaactgcaccaatgtgttaattattgcctagttttagacttaccattggcagaatcagtgtggggcatcaaaatgtagacttaaccgtggaattacagcctgaaaattgaattgaacatgctggcaatgaactaaccttgataatgtatcacaaactgaattatttgaataaattccacagttctccgccaaccagtttaggcaaatgcgtatgtatacatagacttcaaccttatacaacaaaatacgaaacaagaatttttgctacgaatcacaataattcataccattagttagttcgtagatggaattgagcttatatggtgaagaagtaagatttgggagggtgtagagacctgaagcgcatggagtcgtgggggcgagcgcctgccttggatcttggccacggcggcgcccttgagctcacaggggctgcgaccctcgatcccagggcggaggcggacgcggacggggggaagcgccgtcggggcgggcgcgccctgaccttatcgatggtgacctccacgacggcgttggttttgctcctcccctaaccccccgcgcgcgcgccgcaaccggggtactcgcccggggaaggcggcggagagggcggccgccgctggaagagccccattgccgtgacgaggaggaggggatggcggcggacagggcggtgtgccggcgggtggccgcccgtgtgggcattcggtttcgtttattcgtttttgttttttttttaagaaattcgggtgtgtcgtttattcgtttattagaactcactcaagacggagggaataactgaagactgaggccttctttagtttccaaaaaaaaaaaaaatcacccaccacatcaaatgtttcggcacatgtacagagtattaaatgtggaaaaaaaaccagttatatagtttgcgtgtaaatgcaagacgaatcttttaagcctaattgcaccataatttgacaatatggtgttataataaacattttctactgagtcttaataaattcgttttacaattttcaggtggaatttataatttgttttgttattaaacaacatttaatacttcaaatatgtgtccatatatccgatgtgacacccagaacaaaaaattttgctaactaaaccgggcctgaaccgataagtacaatagttggctatactacgggtttcgataagtactctatacagtttttaaatctaatagaaaaaatacccgtgcgttgcaacttgtaaaaatatttttggatcgctatacattttactctttggttttggactaaaatctcattccttacttactttccagtcccatcctagcccgctaccttcttttgcttggcatgtctctctttgacgcaaccattaagtggagctgtatgtccagctcgcaaaccggcggcatgctggctagaggcagagcctaaaggagcacacgctactgaaaagggtgaggtgcagtaatcggaataggacagcactagcgagatgcgacgacgcggtcgtcaggactgaagaatgcgcgtgcatcgcaaatagggattagcgcgcaagcggcgggactggaggcggcggctgcatcggtcggcaggtttgctcttgttaattgttggacattgatggctataagggctgttgggctttccgtcatatttggctaaccgatgggtataaccgaataaaatttggttagttgagtatgaagaggtctcggttccaattagttcagtatcggtctttttttttgacccctgcatgtgggaggtgagagagaagacaggataaattttactctaaccttgagtggctgatatatgcctcctcttactcaaagataagaggagcttgttctcggtggtggcggatagggattgagcactttgaaaaaaaacccctcaaaatttgtactttctccattacatataagtcgttttgacttttttttatagtcaaacgtatttaagtttgatttgactaagatataggaaaatatatttgcatttttaacataaaataaatacactatgaaaatatattcaatgttagatttaataaaactaatttggcattataaatatcgctaattttttctataaacttggtcatactttaaaagtttgactagaaaaaaaaaatcaaagctatttataataggaaacggagggagtatattacactgaggtccaccgcagctatctctcgccataaatacatgatccaatgactgcgagcgagggggcgaaccctaaaatcggcggcaccacgtggtagggtttttcgccctagaacgagccttggattcgtggattatgagatggcacaagaaaaaagtcgacaacagtggcagagctggcgatgttatcgagcctgtgcagctaatagtgtttttcgatgatcaactaattttagaacgtaggtggttattcttattggaggtggggcccaagcgatggctcgacctaccttggagatgcctccaccgccattgatcaaggggaaacaagatgcctaaataggatgtcatgcatgtttagatagtgaggtggaggatagaaaggaggatatacgagatttctaccaagcaaagcaataagattatttttatttttcctggtagaattgctaccgacatgtggatccactaagttttaataccacataagcaccatgtagctgccacaacttatgatgaagaccatgttagcgtgtcgtatacgcacaacatctagcgaaatcaccaataataccgttctgaaagtcgttttacaccagttttaaatagttgaagaaatcaatataccgattttttgattgaggaatatagatcagatttgacatatatgaaacaaattgggccttttccgagtctgtttgtactcaaatccattttgcaggcccaaacggtataatctcagcatgcttaactgggcctcgttgactccaataatgggcctaatggttgttttggtccagtttttaaagtctgttcacttttgcgaaattaatttagttttgtaactggagatgaactattttaattaagtttaaagttggccaaatattggattttaaagttaaagccggttattctgaaaggataattctttagatacctcaaatgtacttttgcgagattttttaatattactagctaaaggcccgtacgtttcaacgaatattataagagataaaagtaaaatcaaaagcaaacattataagtttatagcatagttagttgattaggcatataatgatatattaaaagcaaaagcattcatgtttgtgaccttataaccccacatatcagcttgtaacatcggaggcagaactggaatatcatcattagtattatttaaagtagtataaatttgtggttggagttggagggtagtcgaaattgataatttctcctagagttgtaagcggttatttgtattatgtttttgtttttttaataaagatgattgttgttgttttcacttaaaatctgaattcatgcaagttccctctcgtgacaacaacaacatcacggtcgcttttacgagctgagctatcatctgttccaatcacagtgatactgatacacactgtactgacactgacagtatgaaatcgagctagagctttagctccctttcgatgacagcgccctggcaacagattaccatcagtgtatactcgcaaagtcacaatcacaatcagttgctgtttgtcttagctagctagcttctcacttaattaattaactaacagccgccttctcggctggagttcttctagatatacttacatgcatttatacgtcgtctagttagtatatacaccctaaccaaggacctaattaaaccatcattcattagttgtacaaatcagatcacatatcacaatcgcataccgtgttgtgacagaaagctatacatatactccctcgtttctaaatatttgacgccgttgacttttttaaatatatttggtcattcgtcttattaaaaaattaagtaattattaatttttttcttatcatttgattcattgttaaatatactttcatgtatacatatagttttacatattacacaaatttttttgaataagacgaacggtcaaatatgtgttaaaaagtcaacggtattaaacatagaaatagaaacagagggagcaagatgtaacgacatgatccatttttggtgatggctttcggcatggtgatcaatttagtcctccgtttatttgagcctattttcttgctagggcttttagtagggagtatattcattaatggtgcacacaagtttccactggtggagaaagcgtttgtagtcccggttcgtaatccccctttagtcccggttttcaaaccgggactaccaatccgggactaaagatcgctatctttagtcccgggtgaaataaccgggactaaagatcgagctgaccttttttttgcatggccctgttgctgcatggtttatatatatatatatatgtatatatatatatatgtatatatatatatatatgtatatatatatatgtatatatatatatgtatgtatatatatatatatgtatgtatgtatatatatatatatgaccaaaatatatatttacattaaagaaaatgtgtacatacatatagaaaaatagacatatattaattacaatccattatgatgtcctagctagctacgatttcgacgtagtagtagtcgttatctcagaagctaaggacctatgaattgtatttccgtcgtagtagaattcacccttgggatcaaggatttgttcgttgatgaatcccatgagttgttcttgaaccgccacgataaattccttgtgtgtgatcaggttatccctcatacgaataaactatatgaatgtatgaaattaattagtaattaaacaacaaatcgatacgtacgcaatgaaattttgaatttatttgtacgtacatcgagctctcttgtggtgatgatttggtctgcaaggcagtggcaatactcgcacacgtagtagccgcacaagttagttccctgcttttgctttgtgcactataaataaatgacaaacgatgagagatctaattaatatacacttgtatgtatttgaattggagattgaatataaatgtagagcatgtgtactcacaggaaaattgaacttctgcctaagtctttctctccatttgtcgcggaccaaatgacggaaccgataccaagccctacatggagtttaaagctatgattcgtagtagcaattaattataacaagattcttaattaacataggaacttatgacagtacctatctataagttcgaaaaccttgtcaaacgtagactcttttttatccattgagtcatatacgttgacggtgcaggcctccaggtcaaagagtaaaaggacccagtggaatctgcaatgtgcgtgggatgcattacatatgaaacacttagcatgttcgtacgggaatgaaatttgttataggaagacactaaaaactctgtgttgtacggcaatagtatgaacgtcttgtaatgctgtgccttcagcagatggacgagattgtcctctgtggcttgcggatactggtcgagcattgcgacgtttactttccgagggtcgatgaatccagtatcaaaaaccccccgccgtcgggccctttgaatctccattctacaacgataaaaggaagtatatattatatatagtctacttatatataaggacctaattaattaaaggaaacgtaataagaaatctaactgaacgatacttacaaaatccagcaactcataatagagacgtcgagggcgtccagctggtatagttcgtagatacccttgaaattgatccagagaatgtcatctccttgcaagaagtccgtgtccctgatcctcgctccgatcatctctctactggtggcgctcatctccatgtatagttgatggaacttgtacatttgtgtgggtagggactacagctgctcaggcttgacaagcggtttaccgagttcgtacatgtatttcacttccgccttttcgattggtgcgcctcgtagcaattgacccgtagttagcccggtgtcattaataaattcttgtattccaaaatcttcaccggtcactaacggctcgatctcttggtttggttgctctccaagctgagggactggtttggactttccagaagatgctttcttaagtgttcgctcatagtccgatagctttatggcctccttggcaggtgcagacatacccctgaagaatttcctggcactcgggtctataggaatcttcttttctggacttcgaggcttcaattgtctcctgacttctgatgccacataagcgtcaagctcctcttgcgtgcaatcgtaccccaggtccttgttttttgcggcgtcaacttttgccttcttcgttgcccttgtgggggcaggcggtggagcttggggggcccttgacttggaaggtgccggacgaggagcttgcggaggagtctgtgtaggagcctgaggaggagtcggtgaaggagcctgaggaggagtcggtgaaggagcctgaggtggagacggtgctggagcatgaggaggagacggtgcaggagcctgaggaggagatggcggagccggaggagatggtgcatgagacgccgcttgtcgcccagggaggatgatgtaccgcttgcgccatagtataatggcgtggcttgtgtctcgtagatgcgtctcaccgtctcctccaaggtaatccaactcgaggtcctcgtatgtgccttccaccaactcaatttcgaccttggagtatcctgctagaatcggcctgcagtggtaagtacctgaagggtccgttggtatggccatgcccgacgccaccttcacgtggtgagaggttatttattagtaatcaacatttataagcagcaacttgcggaatggacaaatctaaaatctataaactacgagcttacctttattgataagttcttgaagggaatatgcagctcacatggtgtccgctgagtgatgtcatcaacggggcaggtggtttcgtcctgggtttgcatagcgtccatgctctgtgatcctacctgccccgttgaggcgcagctgctacgattgcctgaagggctcaccattgcaggtggaatggtcggctggggatcatgggaccgatgtgcggccatgcgttcatcaacctttcttgccacctctcttgcatgctgagctcgtagctcgataccctgtactcaagatctgcaatcttcgcctcggtatctctcttgctcctcattcgactcctatacgtgtggatgtcctccttgaatccaatcttccaaggaatcacccctttccctcgtgttcgtcctggatgctctagagtctgcagggcgagtgacagctcgtccttctctctgtcgggtcggaacgtgccctgagaagaggcttccactgtgtccattagtcgacgcgcagcctcgcgtatctgatcgctgaagaccagggagccatcaactgggttgagcgttccaccgtgagcatagtaccagaacttcgatcgatccggccatttagcggtggccggttcgatacccctctcaagcaagcttgtttccatctcctcccactttggcatcgcgacgctatagccgcctgaccccaagtggtgatgatacttcttcttggtggcattttttttgtttctttccatcatcgcctgcccttgttgacctgtcttatatgcaacgaactcgtcccagtgatcccttagctttgggaatgtgtcgaagttcggtgtctgcccctttaggatatatttctggtatagatctcccttgaagctctgaaactgttctaccattttctttagagtccaccttttcactgtgtcctctatacccgcgggaagggtgaatgtctcgagcattgtggtccacaacatctctttctctgaatctaggacaaagctctcatgatctctgcgtgcccttgttctgcgctagtacaccgtactgacaggcacgttatcccgcacaacccaaccgctgtgtcgtacgtagttcttggctgcttccgccggggcactaggtcggccgtcttcgtccacttccgttatgatgtgctgaccctctagcttctttgcggcacctcgttgcccgcgtgccctcttctgtccagcaaagggttgacttccactagcctcctcctcctggttcccctccacatccctctccacgttcccctcctggttcccctctgcatccctctccacgttcccttcctcgttcaagtactggtttggatcctcgttcccctcttcttcgttccagtactggctgcttccctccgcgattgtatcgtacaatatctgttcctcatcacgatcagccatctgttcatacaagacatagttggtaagtctataggtcatttttgctttaacaatcttatatgctaacaatcatatatgctaagtctaacttgcgtatattagaaccctacacaatcttatatgctaagtcttattacaaatctaataatcttatattaaaactctaataatcttatattaaaactcaaataatattgtattagaactctaatagtcaactatgctaagtctaagtgtcgtatattaggaccctagacaataattatatactaagtcttattacacaaatctaataatcttatattaaaactataataatcttatattaaaactcaaataatattgtattaaaactctaatagtcaactatgctaagtctaagtgtcgtatattaggaccctagacaataattatatactaagtctaattacaaatctaataatcttatattaaaactctaataatattgtattaaaactctaatagtcaactatgctaagtctaagtatcgtatattaggaccctagacaataattatatactaagtctaattacaaatctaataatcttatattaaaactctaataatcttgtattagaactatgctaactcaaacaatcttatatgctaagtcttattacaaatctaataatcttatactatgctaagtctaagtgtcgtatattaggaccctatgtaatcatatatgctaagtcgtctaagtgtcgtacattacaaacctagataatcatatatgctaagtctaagtgtcatatattaaatctaatagtcttaattgcattaaaaatctaacaatcatatatttacatcacttgcctgcgcgaattccttcgagggttagctaccactccggcttgagggccgacgacgacaacgtcttttccgcaacatacaaaaagatgtattaggataaacgcaaagtaacatatattgtatttcacgtttgcgttctcgttaagttcacgtttcgttcacctacgttcgttcgttcacgtgcgttcacgttaatgtacgttaagttcatgttcgtgttcttgttaacttcacttttcgttcacgcacgttcgttcgtttacgtacgttcacatacaacgttaagttcatgttcgttcacgttcacgttaggttcacgttcgttcacgttcacgtacgttcgttcgttcacgtacgtttcgttcgttcacgttctttcacgttctcgttcacgttcgttcgttcgttcacgttcacgtacgtttcgtccgttcacgatcgttcttcgttcgttcacgtggcggcagcggagcggcggcgtggcgccgcggctgtggcttggcgcggcggcggcgtggcgccggcggcggcgtggcggcgcggcatcggcgtggcgcggcggcggaccccgaacacgactccgccgcgccgacgatgccgaacccgaccttgatgcggccgccaccggcgacgacattggcggcggcgtctctcaccccagagatgcggcggcggaggaggcggcggaggcggcgacgacgacgcgcgcgagacaacggctagatacgacggcggcgtcggcgcggggatgtcctaggcagtggcggcgaaggagaagccgagagagattgatcgg

SEQ ID NO: 71361 - DNA, 40098 bp, Oryza sativa
aggagcgcagagcacgtttgggggaagatggcgcggtcatgggaggcggtgtcggtggacgcggcgccatgccgcgtcgtgctcctcctcaccgtaccatggccgccgagagagaggggggttagcaagcctcctccacactaccactgttgccaccaccgccacctcgcccatcctccgcgccgccgacgggatctccgtgcctagcctcggcgccgctaccggatatccgccgtgctgctgtcgcggctgccaccgccacagctctactgtcgcggctgccactgccgccactaccgaacgccgccgccgtgggatggcaatgccgccgccgccggatgccgacgccgctcgctctctttgtccctgcgcgccaccggccgaaggggaagaaggggagagaaagagagagaagggagagagggaggaggaaggtctaacatgtggaccccacatgtcagtaggcctacatttctttttgtgtgaatgactaatgggtcccacgcatattttttatttctaccgtcacgtaggtgccacatcaactccacatgtaacgaagactcggtcaatactgccacgtaggcaccacgtggcaccacgttagcaaaaccgcctcccaaaaccgtctagggagtcaaattgcaccggttttaggagtttgggggtcgagatatccggtattgtaatttagggtcatggattagatttcgatcacatttgagagtcatgaagtgaacttattcctaattttgatccatgagctatgacgtatgggtgccaccgtctcttttttttttaactgtaatatgtaatgctccactctagtcagcacgccgtgcgaaagtgttgtacgataaaatcatcgtccaaacgataggcttgttcattttgttgtcaattttaaccttatcaaactttggaaataccaaattttgatatgttttgatattgtcaaattttgttagcgttggatgtatttagtttgatatactttttaaaattttgatagtgtttttataagaggaaagtttcaaaactatcaaatcatggtaggatggcattggtagaatacttttagcttgttatcttaccaaaatttagtaataatatcaaatgatggtagggttgaaacttgaaagtggcaataaaagtgaacaggccttatgacttgatttacaccaatttactcatttttaatagttgaggacactctattcccgattcggttttgtgattaagggatgtttcagtggactttttccagcatgatttggtccatccaaactaaggcgaaccgaccatgttccgggatgaatttggcctcacaaatggatcatctaatattatcaatataataatgatctttcctctaaaaaaaatggatcatcttatagcattagattatggtctggcccgtatgcacataacattttgcagcatcacagggaagtaggcttgtccaaaatgaacacggcctgagctgagccaggccacaaacacgtaaataaaattcaaaaagtttgtagaaattcaatgtttcatggtttaatcagcagaaaactccaggtacgttctcatccacagatcaacaaacatgcccaaaatacattacaagatgtgcataccattaaacatttgaggcggagcaatatttacagaccttggatatgctattgctaaaggttagcagattcatcatccctgagttaatgaatctgagttaaccaaagagtccaaaagacatagcatagcatagttggtatgttaggtccaaccagattacctgcacttctaaatccctttttagggccctgcaattacaaattctgactaggccattttgtcagttctaaaccgtccctatgacgaaaactgacgtgatacctgtagtcagaatagggcaccattgtcacagtaacagcaacttaagcaccaacactctgaatagtaatgagtagtacatccatggacagcccaattcttaaaccctactcgaaactgaaacctgccaaagaaaatgaagggtaagttcgcagtctgagcagcaactaaattgttcagttacttgacaagaaacttaaagtaccggaacatactacaaatccacaaaaaaaaaaatcccatgttcaacaatttgtttcatataacactatgctttaaggcaaaatgtttcatagaacatcatatttctgcaaagtatccatgccattatagtagtatatggtagccccgaattacacattcctaggctacaatgtgagatggcaaagatgataatgtgaatcccagtagcagtcataaaacacatgtctgccggtaaatacatttctcgacttctctttccccggccgcaggctgtggcagagagtcagtaaaggtctttcccagcagacagttagccagcaaaggcaacttttcctggcagaacgagcgtcctaaacctatgttatggcgcagcaaccaacgcttgaaaataagttcaatacagtgcattactgctcacagtcattaattatcaaatgcagaaagaaagaaaaattttgctgctgtttagaattaaacagcgagccaataaattatcagcacaagtaagatattcaaaactattcgacctatgagcttaccgcttatacaatgtacgtacttcacaataaatagatactatacagctttatgcatactatctgccaacataacataaatcattagattgagtttcacgcttccaccaaatgcagggcatgatttttcattttctttacaattcggtactctagtcttatctcttgatcttctgacaaagtaggagtttttacactatttgctttctttcacatatatgaagttgaaggaaaaatccagaaatatagaaagaatgaatagtgtcaatagttatcttacggatattaaatgtagataggaacttcaaaactttgataactctctcttcaatcgctccacattttactaccactaacttaagatgttctgatattgcagatgacttcttcgtttggatataacttcctttcatttccaccttatttttagtcccctgaaataataacagtaacaaaataacaataaaacatttggccaagataaatccgcgttatgtaataattgtaaccaggaagcaattttccatttagaatatataccatgccacgaaacttgagagtgagcttctctagaataggtgagtgctgaaggatgcagctaagtgcctcaaagtcgatatccgcagattgacaaagtcttcaacctgctaaatatagggcattgctgccagtacctattggaattaaactgcacaagatgcaaacagaaaatatcaactaatactcactgtaaacagatggttaaagatattacatgtggtggcagtgcattggaagtgataaatgcataacatacatcctgtgcttgtaatgctcgtgaccgtgacagaacaatcaacaccaacgtcttcgcatgtgataaagcttgcggaagcgtgcagttgttactatcatcatatcttggaggagtattccaatctccaaattcaccagtgactccaacaaaagcctcggttaataacggcataccctcaaacacaggattccggttcatactaaaacggttttgctatatttgtgtcgccacaaaatctcatcgattatagtcgatttttcagctctctgatttgctttagattagcactggatattatgatttgcgtatgcgttgtttgagatctgcgcccgactacctgcaatctatcatcaatgtattactgatccagagcaaacacaaagtaacgtgctcaactgatcgatgtattactgcccaaggtcctatcattaacgtgttcaactgagcaaacaggcaactttattgctgtaattatatatttatacaaatttacacagtagttacaccccacttacatatgtaattttgaacttacatatgtaattttaggacttacattgtaaatacactaaaattacatatgtaatttagggacttacaatgtaaatacatgctgactatattttggtgaaaaatatggcgccataaatatagttactccctattaaaaaacatacgaagtgagaggagattcggtgcacaaatatgagtgtggaaagtacggctgaaaatgcaacggaagatgttgaggtgtttcaaggatcgggaagagatcttcttggcatcaaccaggttacagaaggatatatcaagatgctccagcaccggacagctcgagaaatcaaggaaactgtgcatcagcttcacaccagtaagctgtagcttctccaaatgccgggagacgatggccaggttatccagcgctagttggacgccactgggagcgagtcgcagctgcagcacacgggcctggcacatcaccgcggcatggcggaaccagcggtccacgcggcgggcgtcggcggcgaagtcggacagcccgcccaaactgaacctgcactcgtcgatcggcgcgccgcgcccgcggtggagcagaaggcggtgcacgaagtacccgaactcctgcatcgtcacctccttgtcccagttggtgatgtgcagtctcgccaccgacttccagaggtggcgccagcgccgcgcgagcacgcacgtgagcacggcctccggcgccgggaggaaaccgaggatgtgttggacgacaccatccggcagatccctatcctatcgacgccgccgccgccgccgccgctggcgctcggacgtggggctttccccggaggcattccgtcgaacaggcggcgtgcgtcggggccacaccgcaagaaacagctggaactcacaatggaggatgcgagagagagagagagagagatggaggcctcgccgtcggcagcctcgggcgccgcatcggagcaggagtcgaggcgaagtggtccaaccctagtgctgtgaggattggggagtgaagcatcggccctcgcggctggctgggtagaggagccgagcatgaaagtcagaacacgggctgggccgtcacggcccattggactgtgggctctgagcccattatgaggcccatatccacagatatttccggcctaatttctgtggaataagttcatctgagatcccttaacttgtcaacgaattcaattttcatccttcaaccggaaaaccagacacaacgtgtccctcaactgtcaaaaccggtgcaatataggtctcatggcggtttagacgatggttcctagtggctaatttgactcggtcttcatctgacgtggcagtgacgtggtgcttacgtaggtacgtggcaatttgattttggaaaataataaaatttgtgggtccatatatcagttacactaaaaattaatttaaaaatggtgaaacccacgtaagccacacatgtcatcctcaccacctcctcttcttcctcctccctccccaactcccctttcttcatctctctctcccctctcctccctacaggcgcgagtgaggactgaggaggggtggcactgcgcggcccatgtgggccatgatggacaactcggtgcgcttggaccagcgagtgccaccggagccgtgcgtgacattctgccttgctgagcccccacgtgtctcccacctctccgtcccccggccttaagtcccacacggaagtcgcctgcgtcgtcttcaactctcttgccggctagccgctccacctcccgaaggacccggacaccgtcggcgaggaggccggcgaggcgtgcggggagcgaggaggcagagcctggcgatggcggtgcgccatgggtgggtcgccgactcgccgtgacgctcgcctgcccaccactccacttcgcccgcccctccgctccattccgccccgccgcgacacatgcccgcccctccatctgctctgcccacggcccgcggccgctcggtcctccctccatttgctcttcccatggcccgcggccgctttgccccgccgcgacgctcaatttgattgtagcagccctgaaacttgcttatttctttctgaatgttaccctaacggtgctcaagagagtttgcattcctatcagactcaaaatcacggttagcatggtagtggtctgtgatcctttgccaatatgacatccctggttgctcattgccaataataggatctaagctaatgctctgccatgaaatgcacaattaaaagtcctccttacgagtatagttgctttatcttttggctgatccttttgcaccatttcttgaagtatgaagatcttcatttggcattagcacttcgacatcagtgtcctcggacatcatgcgcacaaaggaatcacctccacttgccatttcaatctagtcactgcaataaatatataaattgatggcctttctaatcgatctcagaaacatcaacaaatgattgtaatgtacgtcagattatactgtttataacatgtatttatttaggatatatattggttctgcagtattaacgactcagtacaattgtacaaacagttggtcattctgaagaaatttaggacacttgtacaagattagtgtctgatatatcctagtttactgaatgtgaactgcttatatatcatgattacgtatgtatggttgtacgtagaattcagataacacttacaaatctgaattttgttagttctgcaccccctccattgagtcagtgttatctgaataacagaagctttcacgttttagatcggtattaaacaatacatagatcacataaaatttttggagcaagagatgcaatataattaaaatagactaatactccctctgttttacaatgtaagtcattctagcatttcccacattcatattgatgttaatgaatctagacatatatatctatctagattcattaacatcaatataaatatgagaaatgctagaatgacttacattgtgaaatggaggaagtagcaaataacaaatgctcatatactgtacactgctgccgctttttttttatgcatcagttcagtaaaaaaaaccttgtttttcagtttctagaatattgacccaacctgacactaactgatgcaattatcgatgagtaatgcacatcggcaaaagaaggttgatttcagcatattaaaggccggtctgaccgtcttgtggccgatcagaccgctactatgtggccggtcggaccgcccctgatcaggccgagacagtgaatacataagtgattgtgtgtgtgtgatgaaaatgtgagcaccagtgaaaatacaatgacctaatgtggcaatttaatcatctctttgctaggtcattacccccttgatagtacgacgaaactaacaaataaactagcaaatttgatcgcccttcacctcgatcaattttaaaactaaaacactagttttaccgttttcttttcttcgcttcgtgccatcaaattttaatccatcgatagtcatccatgtgcatacatgacgtggacctaacttaaaatatatctcaatagcaacggttagtccacaattagcacttgtcattaattaccaaaattaacaacggaggcctagatgcttcactgtcgaggaggacgaggctggcgaggagcagatccatcgtcactatcaccatcttcgtctgccgaagagactaaagaggggcttggagaaaaaggggagaaatatgaggaagaagaaagggttacagaggctgacatatgggtcccactatcataaactcagaatagtgagggtgaatggagaggctattggagtaaacaataagtttaacttgcaaaattagatagagagttagccaaataaatatttagagtcaaatttggagagactgttggagagtagtattggctcacatggcacattaaccatgatagggtgaatgaagaggctattggagtaaacaacgaatttgacttgccaaattagatagagagttggccaaataggcattttgagagtggtattacttgacgtagcacattgaccatggtcaaaagcactaagtcagccaaaaagttaggaatatttcgtggaaccgacatatgtcatcctcactctccctcacttgttcatccttctctctcctgtctctctcctccctttttccctttggcagtgacgagggagcttgggctatcgaccacgacggtagcaaccagctaacctcgacaacagtggcaacgaccgagatggcagcttgcggaagccgcgggtgaacatgaggagctggtgcagggtagatcatggtccagccacgccacctcctccatggccgcaatctgggagtcccatttctccgccttcctcttcatgctcatcgtcccctcaactccatccagttcggcttctcccccaagacgccatcctctctatctcaccctctttcagcggggaagaaacggggcagagaaaggcgacaacggctatggggttaccggctggcgacgcatccaaagctcaggtagacgaggtggcacccaatccaccgcgatccagatctaggaggcaaagaggcagagtggtgtagcgaggtggcacccaatccaccacgatccagatctaggatgcaaataggttgcatggtgtggagagaaggacgccctccatgagctcgattgccgaatctattagggagggggtcgccggtcccgcggccatggctgacgggcgggagagaagggaccgacgcggggagaagagacgggcggcacggcccatgattatgtgcatccaaactaagcgaactgacttatgacttatggcctggcccgtatgcacatacgagattcctaattggcgcgtacgcaccccgggcgcgcacttccggcccacagcccacgcggccgtcgatgctggtacgatcataatttttttttctcgtgacgctttttctttaagtaacataactaactatattagttaaggataatgatataattaaagaaagatttttttctttttgagagattttttttactaataggttgagaatttgtaagttacatttgaaaatttttgacttaaaatttaaactttgaagttaaattttaaaaactttcaactcagatttgaaaactttcaattcgagatttaaaaattttcaactttcatctaaaattttaaaaaaactttcgacttagatttgaaaactttcaactcaagatttgaaaactttcaactttaatctcaaatttgaaaaactttcaacttaaattcgaaaactttcaacccagatttaaaaactttcaactcaagatttaaaaactttcaactttcatctcaaatttgaaaaactttcaaacaagatttgaaaactttcaactcgagatttgaatacttgcaaatcagatttggaaatttttaagttaagatttggaaatttttaagtcaagatgtaaaaactttcaactcaaaacattcgaaaaaatattcgtgctaaaaagatttaaaaaataatcagaaaaaaccgaaaaaaccgaaaaaaaatcatcaaaaaaaggaaaaaaaatagcgtggggagccagcgcgcatgccagcaacattgctggcgcgcacgcgcggactagcaacacccatgcacataaattattttggagcatcacagcaagtagacttgccgaaatgaagacggcctgagctgagccaggccaaaaacatacaaaaaaaaatccgaaagttgatagaaattaaatgtttcatggtttaatctgcagaaaattccaggtcacgttctcatccataactaaagaaacatctcgcacagcgacatgggctccacagattgacgagcatgccaaaatacattacatcatttgtcccaaaatataagaaccaagacaagacaacttcgaatatggacaagaatatcacatatagtactataggtttttatattttgggatagagggtatcaaatgtgcatactactcccctcattaaacatttcaggcggagcaatattgacagagccagctatgctcaaggtagcagattcatatcttcccagagagaatgaatccgagttaaactagagtccaaaagacatagcatagaatagttgggtggtatataaggcctaactagattacctacacttccacatcccttttagggccctgcaattacaaattctgactaggtcatttcgtcagttctaaaccgtccctacgggctatggctggaactgacatgatacctacagacagaacacggcaccctcgtcagtcactgcaaattaagaaccaaccctctgaatggtgatagagtagtagatccatggacagctaaacttttaaacgctactcgaaactgaaacctgtcaatgaaaatgcagggtaagttaaaagtttgagcatcatctgcagcaattacaatgttcagttacttgaaaaaaaattaaatactagagcataccacacaatgagttaatttcagaaatcccatgctcagcaatttgtttcatataacccaatggtttaaaggcttttttttttaaaaaaaaaacagcatatctatgaatgtgcatgtgtattactcctacatataaacaagataactcaaggaggtgaccaaatgcaaaatcaactaacatactactatgaaggtaagcacttcactggccattcatgtgaatgcagttagcctgagtatatgaggtaagccaccaaaaaagattggacaaaaaaaaatattaaaagcagaaagacagacaatccttctattgttcaaactaataatcaacgagccaattatcagaacaagtcaaatattttaaactatttgacagatcaatatgtaaatgcacttcatgataagtaaacctcatatagctttaggcgtaccatctgccaacataatggaatagaatgatttccccactcccaccaaatacagtgcaggattttcaatagcttttcaatagaactcctatatcttgattttctatcaaatcaggaatgcaactagctttctttcatgcatacgaaagctgaaggcaattttcagaaatatagaaagaatgaatagtgttgctagttagcttacgaatactgaatgcagagaggaacttcaaaactttgataactaaatcatcaatctcatcaaatctgactacaactatcttaagatattctgatattgcagatgacctatccattcgactatagcttcctttcatttccaccctatccggtccatgtccctgcaataataacagcaacaaaaataaaaataaaacaattgaccaagataaatcagtgttatgtaaaaattgtaacgaggaagtgattttccatttagaacacacaccatgcgatgaaactgaagagtgagattctctagaactggtgagtgtcgaaggatgcaactaacagcttcaaagtcaagaacagcagatgcgcatgcactgattaacaaagtcttcaacttgctaaatgtagggcaccgttgccagtacatttcgaaattaaactggacaaaaagcaaacagaaaaagattaaccaatactcacagtaaacatgtggtctaagaatgcacatgtggaggcagtgcatgagaaggcataagtgcataacatacatcttgttcctgaactaacaacaccaacttcttggcctgtgataaagcttccggacggtataccctcaaacacaggagactggttcatataattaactagaccaagtgagaggagattcggcgcataaatgtgtgtgtggaaagtatcgctgaaattgcaaccggagatgtttaggtgttttatggatagggaagagatcttcctggcattggaatcagacaagtcgcaaccagcaatctctagatgttgcagcaccggacagctcgagaaatcaaggaaattgtgcatcaatttgacaccataaagatctagcttttgcaagtgccgggagacgacaggcaggttttctagctcgagctcggatcccctgctcacacggatatccagccgtagcacccgggcctggcacatcactgcatgccggaaccagcggttcacgcggagggtgtcccggtcggacagctcggcgagatcgagctcgaattcgtcgataggagcgcgcccgcggcggagcaggaggtggtgcacgaaataccggaactcctccatgggcaccaccttcctccagtcccagttggtgatgcgcaaggccgcgacggacttccagaggtggcgccagcgccgcgcgagcacgcaggtccgcacggcctcatgcggcgggaggaagccgaggatgtgttggaggacaccatccggcagaccccctatcctatcgccgccggtcggaggtggggcttcccccggaggcattccgtcgaacaggcggcgtgcgtcgaggctgcagcgcgagcagcaaatagcttggaactcacaatggaggatgcgagcaagaagagatggaggcctcgcagactcgcagtcggcagcctcggccgccgcaccggaggaggagagtcgatcgacgccaagttctccaaaccctactgctgtggggattggggagtgaagcaccatcgacccccgcagctggctggagctgtggagcatggaagaataaactcgagtgagacgtaaagtacggggaataagttcactttaggtccctcatcccgtcaagttttaaaatccgcactaaaccgaaataccagaaaatcttagacctccaagttgcaaagccagattaaatttgctcctccagcagcagtgtagatgtctggattcactgatgtggcaagttgacccggtccgctcgtatcgagtaggtcgactaggtgcttacatggcaaaaacaaaaatgggtcctacatgtcatgtcatccttacttttctcccatcttctctctccttcctctcagtctctctctttccttttctcttcatccatcacgcaagagatgggagtgtcaccgagcggcagggaggagcggcggccggcgggagaggagaaaggtggttgcagcgtcaccgaggagtgggaaggggatgcgggccggtgggagaggggcaaggcggctgcagccctctcatattgggattgagatcctctgcagtcaaatgtacggtgtctttatcactgacatgtgggcttcgactgtagagtattttgatcccttgtgttgtggggagtcgcctatgatcgcagcgctcagcacgacactgatgcatgtaatcttgtagctggtataatctaatttccatttttcataaaaaaataaggcttgacttgtgttgtgttcacgaggagttcggatcgtagaaggagtatctaactgtattttcagttcttgcatcaattaagtcatagctgcaagatcgctcaggtcaatcgtgggatgacgcaattcagtaggatctgggcgggttttgtggatctttttcaattgtaacaaaatcctggagtatggagtattataatagaaggaaccgagaaaatgctgcaagttttacgcagcgccaaatactctatctctgttattcttcagttctccagtttactgttgtgaaacctataagtgtcagaaaacaaagtgaggctgcgcatgagaattttgagtgttaggttagccaaaccaaatcaaattacaacaagtggtatccgagcggttcatcattgattctgaggctatgtcgaccgacgatcatagtcgaaacaccccactgcggcggcgtggaagattggaggcggaagtggcaatgagggtgaagggtagatcgttatgcagccggtgccacgggaggctggcgtgccactatgctaccctaccctcacgagaacaaactatgcagattgggcgctactgatgcgggtgaattttgcaggcacaaggcctgtgagctgccatcgacccggggtatgccaagttcaggaaggaccggcaaacaatggcggcccttctccaagccgttcccaaggaaatgttgtgccccctatcaaagaaggacaatgccaaggaagtatgggacgcgatcaagacgatgagcgtcggtgtggatcatgtttgagaagtgcgcgagcaggcattgcagtctcagtacgaggccatccagttcaaggacggcgagacgcggaggatttcgcccttagtctgcacgcacacgtcatcgacatccgtgacatgggtggcgcccttaccgacgatcacatgttgaagaagctgttgcgagtggtgccattccactatcatcagcttgccttgtcgattgaaccgatgcttgatctcaagaccatgccgctggaggagctggttggtgccatgctgccatcgaatcctataaatctgttggtgcgtctggcgaggcgctgggcgacctagttctactcacagaagaggagtggtccactcgaatgaagaagaaggagcagtaggacacatgaaagggactggctcctcgtccagcctgaagaaagcatgcgcgggaagcatggtggctaggggcgctcaggtgaggatgcatcagccaaagaaggtggcgcgctgacggcaccgcgtgacaagtcgatggtatgttgtttcaattgtgacaattatgatcactacaccacggagtgccacaaaccgcggcgggagcgacgctaggaggcacacgtcgctgaggctcaggaggagcctgtactgctgctagcgaccgtgagtgtgctggtcaccgtggccgcacgaggacaattgtgctggacgagcccgccatgctagctcaacttcattttgggcgccgagaagaactatctccggatctctggtaccttgacaccggcacaagcaaccacatgtctgtccgcgaagagtttttcactgaccacgacgacacggtgcgcggcgttgtgcgcttcggcaacggctccatcatcgacgtctgcggttttggcgacgtaacgctggaatgcaacaacggggcacaccgtaccgtgtccatggtgtattacatcccagactcaagagcaacttgatcagtcttagctagcttgatgagaacggctgtgcaatccacattgaagatggggtgatgatgatcagggacagggcgagtgctctggtggcgagggtgtcgaggaacaaagggcgctcgtacctgctggatttgaaggtggtgcggcccatgtgtttggtggcgagctgcgccgaggtgccgtggttgtcgcatgcgcgctgcgggcatttgaattttggctccctatgtcggctggctcagggcgccatggtgtgcggtctgcctgacatcgaacaggtggatcacatctgcgattgttgtcaaagagcgaagcagctgcatgcaccattcctgtcggaggcgaaataccgagcaatggagttgctagagcttgtccatggtgatctctgtggaccgattagcccagccacgtcgggaggtaaatgccattttctattgctagtcgatgatatgtctcgatacatgtgggtggtactgctagcaaccaaagattaggcaccgacgacaatcagggagttctaagggaaagttgagctcgaggctaggaggaagatgaagattctccgtacagacctagggagggggggtgtgaattcacctcgatagaatttggtgaatactgtgcaggacgtggcgtgaggcggcacctcaccatgccctgcacaccgcagcataatggcatcattgaacggtgaaatcagatgatcgtatcaatgccgtgaagcctgttgaaggcaatggaaatgcccgggaggtttcagggtgaggccgttgtcactgcgatgcatatcctgaactgggcaatgacgagggcgctcgacggccagacgccctatgaagcttggtacggccagcgcctgaatgtgcattactttcgcacctttggctgtgtggcgtatgtgaagaatgtgataccacacttgtcgaagctggacagaagcgaggcgatggtgttccttggttatgaggacggaagcaaggcgtatagggtgttcgacccggaggcgaaccatgttcatgtgagcagagacgtggtgttcaacgaagaggcgaagtgggactgggcggcagccgtgactggagacgatgaagctaatcctgggacgaagaggcgaagtgggactgggcggcaaccgtgactggagacgatgaagctaatcctggtgaaatcttctctgtcttgtacacttttcactctgtttcagatgatgtacagtgctctgggcacgccccgccgcatacgagccacaggatgctgttaccctagtgtgggactcattgccgggtgtgcactcaccagcatccctcttgatgccaatcaacaccacgcagacaaaagctgaggtggagtttgcaattccgccgacggacgcattgcaaccatctgacgaggcaccgtgacgcaattacacgcttgcaaacatcagcaacactactagcccagtacgggagtttcagtactctgggttgtgccttttggcggctgatgagccagcaagcttcacggaggctgaagtacaggcctgctggcacaaggctatgattgatgaggtgaagagcattgaggaaaacaagacttggagtctagttccaccgcctactggacatcgaccaataggtctgaaatgggtgtacaagatcaagcgtgatcatgatggctatggtgaagtacaaggccagattggtagctaagggttacatgcaacaacatggcattgattttgaggaagtatttgctccggtggcaaggattgaaaccgtaaggttgttactggcactggcggcttaggagggatcgcaggtgcacgcaagtgcgcatgcaatccggcgccgggaggaaaccaaggatgcggtggaggacactgtcgggcagatcccctatcctatcgacgccgcggcggtcgatcagatgtgaggcttcccctagaggcatttcgtcgaacaggcggcaggcaagaggcgacaggaactcaccaatggtggatgcaacggggcgagtgtggaacggtggaaccctagtgtggacggggagtgaactgtgaagaatttgcattgcaggggtaaaggcctgaactctgggccgttaacccggcccattcagtcgtgggcctgaacagtatcatacactgggcccgtagggaccaattgttactgattaactgagatgggccgcaatccaggcctaccttacactgacatgggttatggttgaggcccatgcaaggtttatctgtcaaagctgacgtgccaaaatgaacctggcatgtttactgtagcagatagtagtagtactttgtttagaacagaaacatcatgttcaagagttaatctgcagaaaacgggaacgttctcgtgcatctgcgtaagatgcactgaccacaacgaaaaggaaacacccatcactggcttacaatctccacagattcagaaatatgtccagatacattaccagatggaagcactctcaaatatttccagttttcaagcggtgtaatgttgacaaagctgggagaaaattcccaaacatatgctatcacctgtaaagcaaattttgacaccaccaacatgaaaggagtactacaaaacaaaatcggaagggccaaatgcagcagggcaacaagctcctatagtatgggcactgtacagtaatggtaatgtacaaacatcatcttctacttttgatgctaatttgggatatcacaggattaccaagacaacaatcgcgcaaacccagcctttttgctgtcccaggtgactccccaactcacatagacagatacatctataatttacacttactttgcggcttgtatggctccatcctctcctagatcctgtccaagctacgtcaatcaattgtctgtacagcaatgcagctcgggggtcccgaattccagtaaaatgggctgaaaagcttcaccagtagcaaacctcctagtatgacctcaactagataactgccgacgactatacaattctcaacctcatcaaatgggagaaatgctatgcaagttgcattgcaggcgccaatagcctgtgtgtttcacaggggactccaggtatgcgaaatgcaaaacacaaaggcgtgtttcgctcgtagaaatcatggtggctgtacctggctagtcagccccagactgacctgcgctatcccggagattttcacgatgatataagcaaattgatttttggaaggagccagaagctcctgaagggtatatcataaaatcccattcaatactctctggtagtaatcatactgccgagtacgccatgcatccatgctgctactgataagtgaaagcaccagagacacgcattgctgcaaccataccaagatagcattagaactgtaaaaccccctctgcaaatgatgagttacaagacagttgactaacctcttcagtaagactcaagtgaaacctcttcctcaagttctgaatagtgcgaggaccacctttaaagcaagggaagccggaatcctgatacatggaaagttcggcattatacacatgaaagatgattactgtattgatggacttacattgccatgccaatcacagaaaggagaaaaataagattaggtacatagacgtaacccccacccccccaaaaaaaaaagaaagaaaaggacatattaaaatgatgtgtgtgagcaacatgaaactcggagtatgcaaatgaaacgttttatacattgatataccatatggcaaatgagttttgacctaactgaaactcgttagaatggctcttccgcacattcaagatagtctgacacacatggatgataaatatgaattctgagttatgctatgcaatgttctatacccttgatatatttatgttgagtttttttttaactcagatcaaacccattagaataactattctgcacccaaatccattagttgcaacacgtcatgcaataacccacatgccaacatcatgcaaaaccaaccgcctttgcattaacaggttatatcaagtatgcggtaaaatattctgcagacatgcagtagcaagtttccatttcaagtattgcatgtatttctggtaccactggtgtacaatagctatgctaaatttgtatagttcgattcagggtgtgcgtccgaaaatatttttcagaaatagggtgttcgcttcaagagaacaccttatattaggatgggttagtctattttgggaaaaagcacatgattttggtggaatggcccgaccaacatttttttcagctttgttctagtaagttattttataagagatgaggtggtgatggaacaaccagtttcattcaaaccatacagtggggtacattcggatttaggataagatggtgcattacttcaatcgctacttgtgtgaagcatgcaagcatagacaagtgttatataagacgaacactatctgataggctcatctaatacatctagacaaacatctaaaattttagatagaaagttacctgcaacatttctactagtagtataatacgctctgcatgcttccggcaagtaaggaacccttgaatgcatagaacctgaagcgtacaaatttacatggctaaataagaccattgaacttggagatgtcacaataaccaagagagtaattcactactagtccaaataccttgaagtagtcaaagaactcactgggtgttccctctgcatcagaatccatcacctaccatggtccccacaacaaaatttattataattcaacattttaatctaccataaagtttaagttacaagctaccatcttacttcaagaagctcccttgtcagtttaaatggtgcactttcaaaattaacccctccaggagagttggaaagcataaagccaaaatcaatatgaattatatgcccttcctcatctatcaagagatttccattgtgacgatccttgacctgcaatattttaacaaaataaaattcagcgattatttaggcccaatcatgatgacaaaaaagagtatagcactcacaatcgcaaagttaatttatttctatataataaatgaaatatttgatgaaaaataagaacagcatcaaacagcctttttaaattttggaagtgctacaagtatagttgtgtattgcaagttacagaagttcaattgaaactttaaagtaatcttatgaaaatgttgcagcacaataattgcactgcaaattccattcgaaatggtctcgaacttccagcaaattaaatatccagtcacacaggtcactactcactagtttccccctttacactttaacataaaggctagaaaactttctttatcagtaaactttggctggccctcaaaccttttgtacttttaataacattccacaaagaatctgtataaactggaaccattggatgctctgctggcccaataaaacctcagaaaaatgatgggagatttacaggacaaagcagaagatcaatagatctgtaatctgttctagtagtgcacagttcattagtagctaaattcaaaatacaaggggtccagaaggtaagccactgtcatttgttgagatggccccacagaacaataacaaaatgatctccagaatttgagaaatattatagaataataattgcaaacctagatgtatcacgcatataaactatgatatttggttttaatacctggagcaggtagcacaggattgagtatccagccatgctttccacaaagtttctctgttagtaacacaaaataaatcaataagtggttcaaatacattgttactagtgtgaactgtttttatgattcgtttagtggacactattggctagtgccttaaagtggtttaaactgaaacatgacattaaaaccagccaatcagctgttgtgaaccatatctctgagccacagaacagtcaaactctacctgggcaagtttgaagttcggagaattttcttcatacttggctacatagtagtcacggagacttgtgatatcggggaaccgactcttgatggaatgaattgacgcctgcagtagcatgacaaaaaaaggccaagctaataactttcagtatgcacagaaattcagaaagctaacttaatcataatggagagatgactaccgtatcaggaatagtctcaattagcgctgtatatgcagatgtgacgataacttcatagggtcgcaaccaaagtggtaaaccagcttcttgatatatatctgagagtacaacaaattttcaaaacaaagcaaagttacctgttaagagacattccaaatggagagatcacaaggtaaaggcaaatcatcaatgaggttctttcagaatcttgaccaaaagcaaatgattccagcaagcgttgctggtagactacagtacactcacattgcaacaaattcaactatggtaatccccactgaagtgggttcgtttgctggacataatgagggtattttatgtgcaaacaagtgttcacatcatgagtaacctgtaaataggacttaacatgataaattgttttcctatgtcctatatacttcagcaaacagcacaatgacatgctcacgtctgaggcatatagttgctaatctaccaagtggaatttaaacatatccgctaaatataaatttggtatgtaattcttcagacatttggtcagcttagatcaaaactaaaaagtatagtggtaagattgatttttttaccatataagtgtgcaacaagctgtacagctaggtgttcttgtcggcaatcatctccactcttgacaataacctgcaattggttgaaacatttcataagcctggcattaactgatggcatttcatttctataagaagtctcaacgaggtacaggatacaggatgctcaatctgaagcatgcaacaaagatcaatagattgtttacagcttaaatttaggtgcaaaaatttagtgaaaccaattccataaaataaatctgattgtctacttagttctccacaaagtttagagatgcacttgatagtgcagtggcaaggggtgtggtttcaaccccaaggtcccgtgttcaattctcaacactcacaatttcttctaattatttgataaccaagttcctccttggttctcctcttttttttcctccacaaagtttagatagattatttcgactgtaatggcagataacatcaatccaaaagattggaagaactacatttgctgatgcaaaatatacaatgagcatcggataagttgatgatgtagctgtcaatataagggagtagggagcattggattgaagaacagaagaatgggattgggattgggatagaagggtgaagtagatcctaaccctcaaatagtttccccaccaaatatcctaactaattctccatctttccccaacttctataccacaatccctatcacacactcctattcttaaataacacagaaatattcatttgggatagagtactgcaaaaaacaggatgttatgtaacttacagaacgcagatcccagccaggtaattttccatgaacagaagaccgtcgtattctctctctcttgacagcccagatttcaccagccaaagcatcagttggtttaggatctccaccatcagttgcctacatgaaacagagttaataatttaatgaagatcaacagaagaaaccagattgttagtgattcgaggattcacattcaccttagattctatattttgagcattctggccaactcctttcagtggaagaccaggtggagcttctccttttaatgctgcagcctagtcaaggaaaacaattcagcaaatagttgtacaagaggtatcgaactgtaaattggatgataatgcaataaaccaccttgtcttatttgatgactactaattcctggtgttggttagctaaacatctaggatattcgatagtttaaaaaagaatactctttagcaagattgaaaattgcaaaaagaaaagccttggagaaggaatctaaaaattttcagctcctaattaacttcacttaaaaatcaactcataaatcagctgcaccttgacttcctctatggcaattgtacttggaacgcggcgatggtccttcttccgcgttggttcattgtcatcaacatcatccatgttaactcctggaaccgcagataaagtaacctttacccactcaataggctgatcagcaattggttgggaatctcctgaaggctcatttgaatctgctgtagattgtcgtgacctatgtcccgaatcagaaattgcaacactccttgaacgaccaagtttctcaaccgagaaactaacgtttacaaattttactttggcctcccacaattgagccatagcttggtcaataacctgagaggtagacttcagcattctgtctgtttcataattttgtgtttcatgccgactccacaaaggatatgcccatggaggtggctttggcaactgcacatctccattagccaagggtatcccaccttttgacaatttgttaacatctgatgaccctttggagtgactacaaaaaggaaagaactgagtttacagaatgaattctgacttaagatccaataataaataaaggtaatgaagatcatcagttctgccatttagcaggcatatggtacttttagacaagtatataagaaaacaccacaaacaaaaacaacaggagttttaccataaatttcatcaagattgtagtattgtacaaagaactgcataccttggtgcttctgctttcaaaacttcaacacatataagataaggagctttttccctggagttaagaagaacagcttcatcttcaggtatatgaaccactcgatatatgccctttcccatcggaaagcatactcctgtgcaaaaagaaggcagacgaaaagaatttcaggggacatttagctactgcgttcatcttcagtgattgatgcttaatccaaaaggtagcatatgttttattttcttaagattaactggtactttctttgttactagagataaaacaaagaaaagacagaacaagacagtctttttagatgcatgacaatgcatagtgtacagttttgctacctagatttcaatatagtcaaaaccagataacagtttaccagcttcagcaaatggagtgaaagataggcagcggcactacataaagaacataaagtggagaaagcagcccatgcaacaaaactacaaaagaacaagtcagctcattaaactacacaggtgattttgctcaattatttggtcatcattgggccatttttcgttgcacaacaaccaaaatgaacaagggtggccatagaacattcaaatctaattccaaaagggatattttaacttgtgagcaagaaatatttatcagtaaaggaaggtggccagagctcaaactgcagccagaaaaaaataatggaacagtaaagcataggccatctgggatatgtctaactgtcaactcaagtagcttccatctaatgattataatgtgatgttagagttgcagcaccaagatttgatgctgaaaggctatgtgtaagaacataggaagacaatgaaatacagtgatatccacaggatagcagaaactacctccatttttctcagtagaagcaatctgtgaattgatctctgtaagagactgacacgggaaaagagaacccaatgggataaattagaatagtgtaactattataaaacaaaaaatataaaatatgaccgaaaggggtgaagcaatttagcatacctctcgaagggcaatcttacgatcttccataggaaatatgtctacaaggccataagatgtatcacacaaagattgcacaagctccaatgaagcatagtaacatcctttccgaagctctgctattgcgttgtttggtaaaggtggtttgccactttgcttatcaccgtttccagtgggaacagagtttttctgaaaaacatacagcttcagttaaggtcttagcagtcataaaaagaaggcacaagacaaaaggtatacaagcagtgtaatcagagcagcagatgctattgttatcagacctagaacccgtcaaactaaatgtgctttcaggacatctacaccataaaactgagcaattggctagataatatgtattaatacataggaaatacatacatgcaattgcaatggaaggaaatttgaattaaagggtgaaccaacaacgatctatacaagacagcccatatatgatgttagcttctttaccaaaatgatagactagtagtggtgttgtagaatcctcttttttcttttacaggtgaagggaaaacaaaataggaacatacttgtcataactgtttaagaaattcacacctaagctccaccacgtaaaacactacatgttgtacattgcactaataagtaataagtcatgaataaatagtgttgataactatccataaaatgccacacctaagtaataagtatatgattctgctgaaaccagaaacggtgagtactcaatatggcgatgcatggtagtactaatatgcacaagcctaaagttcggaagaaaaaaagaacaacttcagggaactgatgtcttgcctctttcaataactttgaaccaaaaagctcagagtcttcaagtgagcgatctctgtctcggaatagtcgcttgaaaaagctctctgatcctgggctaccctcagaaataccgttaggctgacaactttcaatatgcccactcttagcatcttcagggtgcactctaaacaacctgcggaacgacaaaaactctgaattttcctcgtcatcaataccactagtccccttaccatcatcatcatgtttatccagcccatcgcttctcctctcctcatgcttgtctttaaacaatttgcggaagaaattttccttatcaccttcctcacacttatcatcatcattcctgtcatgagcagctccctttttctcttcattcttatccttgaaaagcctacgaaagaaattttcatcatccatggtcctgtgtcctttgtcgtcctcctctttcttgtttggtgtggtgccttcctttttctcttcgtttttctccttgaaaagttgccggaaaaaaccatccctcttgtcatcttcgatgttcccagcagtcttttccttatcatcttgttgcttactatgccctccgtctttcctctcctcatttttatctttgaaaattttgcggaagaacccttctttatcatcatcctctaagctcttgcccactctttcctcatccccatgccttccatgcaggctctctctcctctcctcattcttatccttaaatatcctgcggaaaaagccttccttttcttcatcatcaccctgcctatcttccttatcacggaacagtcgcttcaataaaccctctgagcttggtgtcaattccatgtcctcgtccttgctgtccctaagcaacctgcggaggaaaccatctctatctccttcttcctcctcgttctctttctccttactaagcagcctcttgaaaaatccttccttatcaccatcctcttcctccttgtccttgctgtctctaagcagccttttaaagaacccttccttgtcctgctcatcatccttctccacggatcgcctaaagaacgatgctgcatcacgcaccttaggtccaatgcttagtctcttgagtagcttgttatcctctgacgagggtgtcgctggctgcttcactccactgcccccaacatcctctgcagcagctgcattgctcgcacctgcggggggactcaagccgagtgagggtgatgatgcaagggacagaaggcgctgcttcgatgagcgtatcctgctaagcatggggttcccgcgtgggctggcaattggcgacggcggcgcaggccggacgaggggtggccactctccctgaacggtcgccgcagcctggcactgctcctgcaccctgtcgatcccatccaaatcgtcggtgtcctcgagctcgagctcggcggctagcagccagtgcaccttgagggcgatgcgcagcgacttggagcaggtgtcgatcacgaagcggtcgagcgacgggctgggcttgtgcaccatcatgtagcagacctggaagaggtaggcctcgagccccggcagcggcagcgtgtacatgcggttgcagaggtagtcgcgcaccccctggtggtcatgcttgtagaggtagctgacggcgatccactcgcagaagaaggcggagtcgaagaagcgaacgagccagccgctgctccccacggggtgcgccgccgcgtcgccgccgccgccccccgccaccgtgatctcccgcggcgactcctccggcccgaagctcaggctccgcagcccgagaagccgcaccatggccggcgacccctcaacacgccaatcaaaccgtcactcacctcctcctcctcccctcaccaccatcacaacgaacaagctcgatccagcgcagcaaaccctaggatccagagaaacggaacagcacgcgctccaccgccgccgccgccgcccaaaccctagcctcgccggcgagggggggggagaactcaccggggcagctcgatccggggccgccgcgcgagccctagcctgggaatcgaggcagcgatattcgcagatcgaattgggaagaaaggggggtagaacacggaagcaagcgggtggggggaagggggggagagattcgaacgaattgggggaggatttggttgagatttgaaatgtcgcggcgtcgtcggaggagactttggtttgaaattcgtgtgaaaatgggaaagattcgtacggttttttcgcttgggttctcttcgccggcgtggggggtggtggtgtggtggtggtggtggtgggggccgtggaatcggcgagagcccggagcaggtgggggcggtgatggccgtggcctggatcctctgtgcccctctctctgctgtgcccaccatgtgtcgtgtacttcgtgtgttcatcgtgttactccgtcatatcgtttggataattggttattgtttcgcttttgcttatatttataagtcaaattttaaagtttaaaattaaattttaaagttgatttttatgtttcctcattgtagtatattttaccgtattctcttttgaattgttaaaacactaatttaaaagctttactcatatttttttaaaagaaattgctaataataagtgttttgcataaacatgagcgaaacaatgataccgttgtgctgctgaatagttttggctgataaatcataaaaaacaaacgagactaggatatgtgtggttaatagctgaaaaaaaagaaaatggtgaaaagtgcctaaataaattaaaattaactttgagaatttaatttttttatggcttatatgagctagcaagcaaataacgaggattttattttgcaatacttaagctcgatcgtgtatatgcaactattgtaatgatacaaaaggagataactgagagagtttttttaatattactagctattttatcaacaatgtcttttgttaaatagatttataatgttgtcataagtttattgtatgggatgcatgacttgaactaggtaagttgcaaggtttgatggtacataaacctattagattctacaaaacagcatatggcagcctacatgattccacatttacctaacccaatcatcaggagtgaaaaaagaatatgttatattcggtcctagattcatttttatgggacggagggagtagatatttgtgattacggcctatttttaaaatataagattcatcgagaattttttttataacaaatgcttcaaaacaagctaaactatggaaccattgaggatttttgtctcctttgtcacatgatttgtccatatgcataattttacaacaaattcgaatatcgataaaatgtcacaaacttgacatcatttagtaacgaaaccaccaagctctacaaaatatcatggagagtatgtggcagcctacacggtacccattaatccaaccggttgaataaaaaaattgaggacaagatacacgtagcgtaattatatgcatgtgtatcgtcgaatatcacattcatggctaaagtctatatttagaaacaaagaagattcatcaagaatttacttgtaacaaatgcttcgaaatgagctaaactgtgaaaccacttgaaaatccatccttctgccacacaatttgttgtatgcataattttaccacaaagtcggaaatagtatggataaaatgccaagaacttattgtaaacgagggagaatttatagtcaatttgcagcccaaccttttggtgatagctaatttgatcatcatctcataagtacttgtatccctttccacgaagaaaagctgaaactttggtacttcctccgtattttaatgtatgacaccattaacttttttataaacgtttgaccattcgttttattcaaaatttttgtgcaaatatgagaatatttatgtcatgcttaaagaatatttgatgatgaatcaagtcacaataaaataaatgatagttacataaattttttgaataaggcaaatgatcaaacgttagataaaaagttaacggcgttgtacatgtacaaaatcaacgggaatatgcatatggactgttgaggcgtgcggtccaatcaagtaatcaactggaatggaccgggcctattgctggcccattgggccgatcgcggtggccatgagccctccgtatctgatttccatcctactgccattctgttgccttttcatttgttttgtcttcattttatttttcttcttcttttcttttttttaaaaaaaacttgttttgaaccagcgtgccggttaatcaattgacggctgaaacacgacgccgacgtacgaagcagtaaaactacgtcatctacgtgtacaacagccaggaaaggaacaaagtctacatgaaaaaaaaatactgcatattccagttgatcagtttacttcgtccacagtctacacctacccctactatttattactccctccgtttcatacataagtcattttgatttgccttttagttaaatttatttaaatttgaccaagtttagagaaaaataaagtaaaatattcaatacaaatcaaacatatcaaaatatattcaatgctataaatttaataaaactaatttgatgttttaggtacgttgctaaacttttctataaatttaattaaactttaaaatatttgattagaaaaaaaaattcaaaacgatatgaaacggatcggagtgagtcctaccaacgctgtgttgaccttgccaccacttgacggccaacgaccacaccactgccagcgaaaggagcgaagtcaacacgtgaagcattcagtttgattcagtttacttcggtcttgtttagttccccacttttgtttttaaatttttaactttttcatcacatcagaactttcttacccacaaacttctaacttttccatcacagcattctaatttcaattaaactttcaatttccccacttttgtttttaaatttttaactttttcatcacatcagaactttcttacccacaaacttctaacttttccatcacaacattctaatttcaattaaactttcaattttaacgtgaactaaacacaccattaaaaagccacaattcgtccactagtactatttctgtttgttctcgccaaaggttgttgattttcgatcgctggctaactgcaagatgcacaccagctagctctgcgatgatcattgactgcatatcgccgtatatgtatgtatatttatatcaacttgatgaatcaatttgacagtaatgtgatcgacggacagaccatttttcgtgcgtattctttgtggtccattatttttttctaaaaaaaaaagtactactccctctcgcattggataataattctcgacgttataagatattagaatttgattatcaatttattttattatcaataactttataagattcaataactttataagatatttagtttgaataccctaagagattagtcttaaatatactacaataaaactaaatatatgtttatttattaatagagaaatgcccaggggtcttctgggtagcttcacaaggtagggctagaagatttggttccgaatcctcacactttctaattatttgatactaggcacttccctaatattcgtgtctttttttatttaataatatattataataataaagcatagtcaaatgtatgtttcgaagactatatagttgttcaaaacgttaagaattatggaattggagtttgatattaggccctctctaatatttgcgtcttttttatttattaatatattataataataaattatagtcaaatgtatgtttcaaacactgtatagttgttcaaaacgttaagaattatggaattggagagaaataattcacatgatttatgagggcacgtttaattatttgatattaggtcattccctaatattcacgtcttttttttatttattaatatataataataataaatcatagttaaatgtatgtttcgaagactatatagttgttcaaaacattaagaattatggaattggagagaagtaattcacataattagggggtgtttagatcaggggtgtaaagttttagcatgtcacatcgggtattatatagggtgtcgcatgggttgttcgggcactaataaaaaaactaattacaaaatacgtcagtaaaccgcgagacgaatttattaagcctaattaatccgtcattagcaaatgtttactgtagcaccatattgtcagatcgtggagtaattaggcttaaaagattcgtctcgcaaattagtcgcaatctgtgcaattagttatttttttagcctatatttaatatttcatgcatgtgttcaaacgttcgatgtgacagtgtaaaaaattttggagtgtgatctaaatagggccttatgaggacacgtaccgtatggattgatgcatgcatcctctaaggaattaatagggaggctataaatagttctaattcggatttatccacatgcacaaatacaccagcaattggaaagttgggagagtagaagtgaaccagggtttaatatttcagaccgaaatttcctggtttataagaagattaagaacaggcatatatttggtcaatggtcatggaaaactctggcttagctaggctaagccattcgatattcttccagctttgacaaggtctagtggcaaatactagcactccaattaattactggctatctaattaatttacctctttcttccctgcaaaggacgtactgcctgcttggaatggatcctcagttccagcttgttcttcaagaagtaattacttctcaccacttgtgccattttagtcaagtttctcgggctctcagaacgaaatggccactctctgatatacacatgctctgacttggggtgactacaacaactctgaatttgtcatacgaaaatgtgatgtcttgcaagcaagatttatcgatttagccagtacccaatggacaattaaaatgacaaagtggaatggatgaaatcctagcggcgataccatttctaaggccttgtttctttcaacttgggattattataatccagattattgggagtaagctgaaaaaaacagacaacttattaaagtagcttattataatctggaacccagcttattataatatgttaagcttatttaggtgagcttttttcagattattgggtgaaaaattacccaccatgccaccccatttcctgtttagacttgcaaacccaataatttaggctctaataagctagaaaagaaacaactaatcgcttattctactacagattataacaatttagcttatagtaatctgactcaataatctagattataataattctaagctaaaaaaacatggcctaagataagttggttcgtattatgatattttctaaaatttgcaaatgaatgatatttgttggattttctcagtaaacaagctagcatggcatacgcttgatctctgaatatctttttgcattaatcaggcatagaattcgatcgtacgcgtggctacctctgcgtatgcttgcttgccagccaatgcctacctgcttgcttgtttgacatggtctctctctgaagtctgaactttctgaagatcgatctgaagttattaaagttcgaagcttctgagatcactgcaggaaatggagtcatatgcatcgtgtcgcctctttgatccatttacacatggagaaattgatggccttggatagctactagctgtcgcgtgttgatggttgccggcaattgacttggcacgcagcgctggatggctctgctctttcggtccagatctagggaacaagtataatatggaaaattgacagtttcttttcaacaaaagcaaggtcctatttagcttagtaatcttagctaaaatttaaatttcagaaatttattttaaaattgtttttgaggtttttttatcatagcttatttttttacattagcttttaaattactaaggacacatatataatttttttactcataaattatttttttagctgttaataaaccattttacgatttgtcatctgtaggccaaacaattacacttcggatgacatatcatttttttagtgcaatgaatatctatgtttttcctttgcaattatgatatgtattttttaagaaagaaatatatattacacatgcctatatgactcctactaggaaaatcaatatcctaggatgggcacaatcagtcatgctaaatttgaccgacgaaatctaaaaacacgtcggtgggggcatatgaaaacatgttttcccctgaaatagatggcacaagtatgccccttttcattaagaggaagtatcaaatcgtacatgcatgtgagcccatcacaaatatttttattacagggtgtgaagccaaatggcatgggaagcaagctattaccaccccggcagcccggagctttcactgtagctcgtctgacaaattcgagtgtcttggcctatagccatgctctgctgctccacatcaagtaggtaattgttgttgctgcagagctctcttgaatgagacatgcaattagcctttaatagtcttaaaaaaaatattgagatgtgtaatcttgtctgaggcatttaactcaattttgaaggattcttcgcttgcgatccttccaaatgtaccatcaattgtaaaattatcactccttacattgaactcttctatcttttcatggcacctgtactaatcttggactgagatgtagtatgttggatgtagtgtattacttagtcccctcccctccaagagaaaattgataaggaccaaacggtccaagcatcgatacaatcttccatcaaattggagtgattccaattgtcaaaatcgcacatacatagcatgtgtcagggagtgcactcaagtgagtgggtgcgagtgtgtaactgtgtatgtgtcttccgtgtaaattactcatagatacccctccgtttcaaaaaaatttaaacctatgtccagattcaaaactaggtttgattttttttttgacagagtagtagttcatataacatggtagcatatggcttatttttaggattttatccttgcaaaagagtatacgatccatgcgaaagaacttgcatttatgtcccgtcttcgcttgacaaagatggttggcaacaacagtgtgttaggacatgtggatgatttcgtacaaaaactatacatacatttagataggatccattattctaaaaaatgtcctaaaatagcttctggtttttatctctaatcagatttttttttgttgtgaatagattcatctctccaacaaataactaagactaccaccgataataaaaagtagctccacctcatcaggtaactattgtcgccgatttttcaagaaaaatccaaaattttgggattctgttggccatggtctcgaagtatttttattttcaaaagaaacttagcgacacagctacaaatcgggtgcaaaaaatcgggcgcctcctacagcactactctttaccctgtatgcatgttagacaacatttatctcttttcctatgtacataactaacttttcacaaacttcaaaaaatttcttatgcctaaattacttatctaatccatgaaccaattacactattatatttgtcgcaattaaatctctataataagatcccactcaaatatattttgatgaaaaaaaatgtctgttgtttcatcccttagaaaaaaaatgtttcatgatttgatcaaatgttttattttactgtataaaatatttcagagagatgccacatttaaagtatactgactgtaacaccggcaatgattgtacgaaacattgagtctcaacaggtaaaacataaaaaaataatacgaaagatacaatatatttgcaaaaacttgatatcgttgaataatttttttgtcacgtacaaacattaaattgtaattgttgaaatattattaaatatctactaaaaacatcatatgcaatatttgcaaattaactagtgaaacatcatatagatattagttgaaacatttaaataaagcagcaggtgcaacatttaaagaaatccattaaaaatctaaatatttttttattagaatataaccatgtgtggtcttattctgaacatttaattgcaactaatttaatggtgcaatcagatcatgaatcgaatgaatagtttaaaagaaaaaaatcatttaatgtttaatagtaagtttgttatggatatgttagaagagagagaatagtaggaaaagtatgtttccgaaagtcaagacgactacaaatcaggtgtccgattttttctaaaaatttggcgttgtttcacccgttgcatgaaaatgttttattactaaaaaaggtgaaacacattcaaatcacaaaatgaaatatttttctacaatgtatgaaacaacggtttcaaatatattgaaccatgaaacacatttgagtacgtcaaaaaaaaattaaacaccatagaaaaccccacaacaacatttcaatctaattaataaaacatcaaggtacatgagttgaaacatcaaaaatattcgaaagaaaaacctagatctacctcttcctccgctacagtggttagccaccacatcgaccgatgttgaacttggtgcaatgagctcggccacaaccacgtggccaccttcatcgacaccgcgcggagctcggcctcatccacatggccaccatcgtcgacactgcgccgagcttggccacatcgacatggctaccgccgcgctgagctcctcgtgggctttgacgcagagtagttgatcgccatgtggagatgatgcaaatagagaggagaaaaagtgtggagagagaagaaaggggagagagagagagagtaagggatgagggaacggataagaaactagtgaggagaaaggctagatacttaatctccctatcggtcgtccggataggatcgtttccaaaagtacatgcatggaaatagcaaaaaaaaaatgtatacaactaagcaggcaacgttgaggaaaaaagcgcctcataatatagacttatgccatgtttgattcagcttaggattatgataatctggattattaggagtaaactgaaacaaacagatagcttattatgataaattattataatctataagccggattactataatctggtaatccactctaaaggtgctttttctagattattgggtgactaacagctaataatccaaaactcaaacagctaacagcttattttatgtcggcttattataatccaatttatagtaatctggctcaataatccagattataataatcttatgctgaaacaaacagggccttagaccaaatgcctaaagggcgccccaagcatcctcggaaactttgtcagcctcatatacacatcactttcttgcatgcgtctcctaattagtttcagtacaacgttatatttgtcagtatatatgcttttttttatgaaaaatatagcggtataaatatagacagtcccctcacttatcctccaacactatactcgatctatacatgctattcctctaattttaacctgagcacaattaatcaacgacacaagattgattaattactaattagtcacactcgaaaaagaacaatgtcagggtcaattccctctggcacagtgacagtcgcctgccacgtgtccggcagcgaccgcgcgatcctcctcgcgctctccaagtagccctcgaacttgtcggcgctgacgtcaccgccaaccttgcccgccgccgttgtcttcctcgccgtctggaactcgccgccgtcggagtcgctgctggtggcggagctgctgccaaggtggcagtggagcagctcgcgcgccatgagctggcgcttgagcgcggcgcggcggaaggaccagtcgccggtggcccagtcgaaggcgtagagcgggaggaagcggtggccgtgcgccgcgacgaagtcgatggcggcgaggacgtagcggagctcgtcgccggagaggtagtaggcgaagctcaccctcgtccaccccggcttcacgccgtggtaccccctgacgatggcggcgcggatgcggagcgagagctcgtcgccgacgccgagcagcgcgtgcccgtacggccccgcgcacgcgcacccgcccctcgcctgcacgccgaacaggtcgttcagtagcttcgccacgaaccgcccgtgcagcggcagccgccggtcgtcgccgtcgccggggaagacgaggaaggagaagatggggaggcgcggggcggcgacgttgccgagcacctccacgttggggttgcccagcagccacgccatggcggcgtcggcgtgggcgcgctcccggagcgcgacggcgccgccgcggccgacgcgcgccttgacccagaacgcgagcgcggcgcggaccttgccgacgatgggcggcgtgccggcgtcctcccgctcctcgacgccggcgaggtacaccgtgtcgcgctcgctggcgccgttcacgtaggcgacagtgccgccgccgcacgtcgtcggcggctgcgacgacagccggtacagcgagcggctcatcaggaggatccccggcgtgcccggcccgccgacgaacttgtgcgggctcaggaacacggcgtcgtagccgtccacctctccgggcctcatgtcgatctccacgtagggcccactgctcagtgagacacacacgtcagcttcagacacacacatgtacaccccatgcatgcatggttagttagctagctaggacatgcatatgcatttactcatgaatgataaactaattaatcaaccatacgtatcttttttcatatataaacagattaatactcaatccgtttcgtattataagttgctttgatttttttctattataaactttgctaagtttgatctagtatatagaaaagttcagcagcattttaaacaccaaaaaaacttcattaaatttaacattgaatatattttgataatatgtttgttttgtgtcgaaatggctactatgttttcctataaaattggttaaacttaaagaaatttgaatagtaaaagtcaaaataacttatgatatgaaacggtgagtattcatcaattattaacatcctttattttttcagaaaaaaagttcaattatatgtttgcattaaaatttctggttatgcaatgatatcagtatgaacaggagtacagagcagagagataataataaagcaatcacattgtttctgaatggcacatgaaaagaaaataatttcagtgtcttcacaagctagctagcttgtgattcagaagttcagatgggttaagacttggaacttggaaggtcaatggctttcactatcaagatgagctactaacaagactcttcgttctaattaattaatgtaaaactagaaaaaaaatggatcaaggaattggttcgagattgcttctgtcatcatcagagaagaaaacatctacaaggactgaataaatctccacatatagtttaattaatgtgtgtactaacacacacattctttatcattcttgcatgttatgtattgctttggtataccatttgctaatcttaattatcaggtcaaaatgacgatgtcatccaatgcaacatgcatgcagcagctggcaggtggattgaaatgcaaaaaatagccagattggaagtcaatacagtggaacaaatcaggaaaaattacctgtttctgaagaggaaatctaagtaatcaagaaacgcgctatctaactcccctctctagttaggttaagtttttgaataaatatgctgctaaaattaaccatcaatttgaccaagaaaaaacaccacatgtatattgatttcatcagcagattggattgtatgtacagtccgtactaattaagaaatgcgtcaactgtcaaactggtggatagcataggatcattatcgaagaaaatgagagttccttgcaccacttggaaaccctagcttccaattcatggacttccgatacttgtagatcattgtattcatacttcatcaaaaacccattataaaatcatgaaaaaaatgaaaatgtgatccatacacatttcatcaaatggcaataatcaacaattaatccaattaatccattagttaaatactccatccattttatattataaatcatttgacttttttcctagtcaagtttgactaagtttatataaaagtttagcaacatctaaaataccaaactaatttcataaaatctaacatatgtttttttaaaatactaatatgtttttataaaaatttagtcaaacttgactaggaaaaaaaaacaaacgacttataatatgaaacatatggagtatttatttaattaagtaatgcatcgggcagtgtgattattagctgtgtctgtgtgcatgtgccacgtgtacctggcggcgaagtcgaagcaggcgaaggcgccgtgctggtggaggaggcgggcgacggcgcgggtgtcggtgagcacgccggtgacgttgctgcaggcggagaaggaccccagcatggggcggtcggcgtgctcgggggcgcgcagcgcgcggcggagcgcggcgaggtcgaggagcccgtcgtcgccggcgccgacct

SEQ ID NO: 71362 - DNA, 15620 bp, Oryza sativa
cccccccccccccccccccccactcgagctgcctatctccaggtaacaacgctggatacacatacaaaattcatccattcacataataatcaaatgatgctgcagaaccaaagatgcatggagccaagacagccaggctccattggagagcttctgcctgcagatccagacaaattgtttactactaatgcatcgatcgaaaaagatgagccaatctactgcacagaccccaacgaaaattattagtgtaacagaggccagttagaggttaacaaatggtcaaatcatggtttgtccaagctttaggaggctacccccgtctaaggatacaagacatacttagaaaaaagtctactaacttagtttaatactgctcacccaaagaaggcagaaaggctaacaaaacaggctgaaagataaatcctagcaggtcttattctacagcgacaaattgaagcttcagctactttagtacatttggtaggatcacctcactttttggccataacatcagcttctttttctctgccagctaagcccatttcgtcatcacagtacaaggattaatctaagcatataacaaatggtacacaactttactgccttgggaaggtattgtcaatctctctatagcccgcaaggtgtcaaatatttgacagcatacctggatctacatgaagggaagatcaatgttttttcaccctccgaacaaattgattcagactgatcatcaagccatgtcgccaagtgattgacttatataccatcctaacatcatactagcagtacattacaagtgcatcaccagcaacctgaggcagcagccacaatcacccgacaaaatcatgcagcaagtgaccaccaatctccttcccgaaatgccggtcctgacctccaaatgagctcatcacataggcgtcactgacttcctccagtccgaaacggtgagctaggttggccgggagagcagccgggagaggctcggcgatgcagaccctgttgttctggtgaagaccaagggtgagggagacaccgccattgccgcctccgataccaacaccgccgacctgctggtgctgatgatgtggtgatgcaatgttgtgctgcgaggtcagcccgttgtatgcgaagctcacctgtccctggatggactgggacatctgggagagctcatccgggaagccctgggaggcagcggtgttgtggttccgagttatgctgctgctctgtccaggatgggagtccgaaggaacggagggattcccgctgcactgcgaagaatgctgggcctgatgatgcacgctatgctggcccttgtcaaccaccgagtgcttgtgcatttgcctcatctctaggttgtgaatttcttccaccattggcttccacaacctaacccttgcgttgataaaccagttcgatacctgcaccagcatcacaaattcaatcaaaatgtcctgaaaacaaaacaatctagcctgatatactgtgcaatctattcttgaacacacctagaagcatttctatttacctggttgcgtgtcaagcctgtttgttttgctagcatttgcttatcaccatcggtaggatacctgcacgattggaatctgaaaatgtcactgatgcaaaattatagtgttttctaaaagaacaaagtaccagatatagcgcaaaatcaaataatcaagaaatttccgctattacaaaagacacttgtgatgtgcatgcttaacgatggtttacaggatcacaacaaatattttacatggcgaatatccaagcaaagatgtaggcaaacacatcttccaagtcgaaccttacaaaggatttgatcaatacgggaactaataacactaggaccaacatctgacaaataatggatttcagtgactttttttaaagatgatgactgatcctttttttaaagtaataaacagacagacaaaccccttactggatgaaaatggctagcactaaactactgtactaattatctcaaactgaatatctcgagcacatgtcaatcaacttgatgtaaccaccagtagggcttagctacagcctttagatcatatatataatgcaaaatgatcatactacaaaaactaaaaagaatatgccaaacaaactacattatgatgatgcttattatagcctaaggtatgtacttttaagatttagttcgaagtaatgcccatctggcaagttaattccagcattaacgtgttctaaaagccactctacttatgagaagccgggccaccacattcatacattacagccagaaacaacaaatccaggaagttaatacgtgattaagaatgcatcaaacaagcagcaggaatgccactatttagatcaccaagtcgaaagtatgatctctagtagtacagctcaacacacagttaggtacaggtttaaaagttatgttaatgatggattggaagccatgcctgcatgaggccatagccttctatcagacaggcagggtcgcttgctatcaccaaaccatcaacggatcaaccccacggttccagtgtcacgtactactgatcatatcaaaaaggaacaaccacactcaccacaaatgcttagggactactgttatcctcatctaaagcaagcaactgtagcatcatcatcattgtcttggaatgcgtgcagctaatgaacccagagttaaccataaagcaataagaagatcaaagggcttacgggtgcaggaagtgttcgaacagccacgcgcgtaaaacggacacagcgcgctcggggagccccctctgtgggcgccaaatattgtgcggctggccgaacgcgctcgcgctgttcgctcgctggaggccggcgccgccgctgctacccccggcgagcccgaacacggcgatctccttgtttagcccgtccttcacagcgaccttgttgctcgtgttgcgcagctggttcagaatcatgctcttcaagcacttgaagtgcttcgccatcgccctcagcgccaatgccgcgaacggcgcggcgttgctgaacccggcgacggtctcgaacgaggccatcacagcctgaacctgctggtagtactgccggtacctcttgcaaacctaaaaaaagatattgctgttgggttagaattcgatgagagataatctaccaacaaagaatgattagataaaaagatatccatgttaggaaaaggaagcagtgtgcttttgttttcatgtggatatgacacgaacaaagcaagcgtagctcccaattatgggagagagatgttattgaagaacacaggcaaacaaaattgccttacagagggttccaaaaatagaagctttctacattgtactcctacgtagatgctcatgtagtatactcctaattgccatgctccgacatcgtagaggagagcgcatttcaaagctcgaagcttttagcagcgccactattctcaccagaggacaccaacaagagagaattaatggcatctggcatcgcccatgggtcatgtctcaagactttgaaaggacggttagttctaatttcatgtggaggactatcttttcaagcactcacagtagtgctaaacagccgatcaaaatacaatctttggtgataagacgcggaggaacactactattcatcatgaacagtgcagaactgtacaagctcaaaccactcgaggaaaaagaagagagagaacaaatcaaaagatgtatcagcagcaaaggaaatcatcatcaaatcaaaagcacatgcaaccacagtaaataaaagcaatccgcaactgcatcggtgacatgaccactatgtgcaagattcttctccacccaggagtagcgataattgtaacgccgaaacaaggtgaaaaagatggtcgccacaagaaacctggaaggaggaattgaggcggctagcggagctcactcacctcttccatcatggagatgagcttcgtcttcttccactgctgctcggcccccgagatggggccagcgtcggccgctgcgcggtcagcgccgccgaggtcgtgatcaacgacgtcatgatcgacgccgtccatcggatccgcgtcgagcaggccctcgtcggagatggtgcggtcgacgtgcgaagcagcgccgccgacgtcgcagatctcctcgaacagcttctctgccgggccgaggaaacgggaccggccgagcacggcggcgtagccggtgaagggaccgaacggccccgtggcctgcgcgaggccgccgagctgcctcctcggctgcgcctgcggtggtggaggattcgacgacgcggaggagagcgacagcgagaagttctgcgtcgggatctgcgggagcggcggcgccagcccgtgcgccaccagctgcgcctgcgctagagtagggctgtgcggggagtacgacgacgacgaggacgcgtacgagtagaacgccgggggcggaggccacgacccgtgctgctgctgctgctgcggggcatgaccatgaccatgaccatgaggcggtggcgagtccccggcgtccggcgggaaccggagcttctcgcgccggctgtgctggggcacgtggtacatctgcccgcccgccgccgcggccgctgccgcaacggccgcgccggccacgtgctgcggatggtggtggagcaggaggtgaccggcgtgcccgtggtggtggtggtggtgctccgcgcctccaccctggccgccgccgtacccgccgcccccagcggcggacgacatggcgcgcacgcacgtacggtcgtgggtctcttctcctcggcgcgcgcgcgggtgggcacgtagtacgggtggtgcgtgcgaagaggcgcagcgcagtgagcacctggccctggagagagtggagatagaggggaaacggctccgcactttccgagcgcccgggcctggcttggctggcctggtctcactccctcatcactctcccgctctgcttctgctgctgctgtagtgtagcctccctctcccaccccgacccctcgcgtcctcttgttgttttcctcctctttttccccgtttcgcctttgtgctgggtgttgttgctgggttcgtggcgcctttctttctgcaaaggcgagacacggagggggagaaagaggggggtggcgggagggagagatgggaaggaaatggtaagccgtgaaactgtgaaagcgaaagcagaaaggccgagcgcgacgggggagaggagtggagactggagagcgcgcatcgcgtgtaaaaataggtgcagccgcgcttgtcatccgagtgggtgggtgggctgtttggctgccaggacgtgtccgggcctgcagcgtacttgcccttggcgcggcgcgatcagcccttggctggctcgttacgagggaaaaaaaaatgattttcatcttcccttgttttactgcggctgcccgcggttggtactcccacctgtgggggtttgaccattccaagctacgagtagaaaacattccatgtgcagtgcgattaagtcccccattataaatgttgtcctaactggctttcgtacaaacacccatctccctgctttcgaattccacctctgctgcagcaacaatttttgcgtgttaaccccagtactctgtacagggctgtcaaacgacaccaaaatacggtttttatcgcaagcgtgtccacatcactacatctacatgacccaatcccttggctgcttgtgtatagtgtagtactggggtagtacaatactggtcgacccgcactagtagaagcggcaaatcatacgcgccctttaatgcgctgccctccccagagcaagccctccattgggcgagtcctgacgcccgggcccacgactggtcaccacccgtaactgggcccgcaagtaagcaatcacccctctgggccccacccatgacaagacctaacatagcacaccctctggcccacggcccgtctcttcctccctccgctccgagtcccccacgcgcagctccacaccgtcgtcgacgcaccaccgacaagcgggacccacgtcccctacccggttttccatacagcggcgcgcaaccagggatacgggggagagaatcccacctctctttcgccgcggctgttggctgttgcgtcgcgtgggacgtcaccgggggacacgtgccggctcctccttgggcgcggcatgattagcaaagctacgctacggcggagcccgtgacgtggctgccgctgccattaacttcaaatccacccgtccattcatctagccgtagtgcacagagagagaataagtgagcaaaagatacgaggagtacgagcagagtactggggtgtgaaggaactacacctccgggcttatgcctttgttgttactgcagggaccccctctgtagactatagtgcagctaagcacggctaagctactgcctagtgacctctctctacatggatcaacagaacaggtgaaagtgattctcactcggtcagaacagtggcaggacagtgccgccctatcgccgcgggtcccacctcgcagtgtcgacgcgcactgctttgctcaacatttcgtgcatgtgagcacatgaacaggtgaaccgaggcagctgctaagctttggctacctatccccacgttaaatatcttcacgtttccaccgcttccgcctcttctgcaaacgcgatctcacagcgttgcatgcgaccgagcggggctcacgctaagccaacgtgtgcacagcgaacccacgaagcactgctagcacgtactactactacgctccgcccgcgcggtgtttgccacagaccgtcctataccactacacatattttcccgtcgccacagcgcgttggaaatcgtttcacgggggcagacgctgtgtattggcagcggcgcagcgctgtggcgctgtgctaatcaggcaggcagagacacagaacagaggcaggagtacgcacaccgtgccgatgacacgccgcatgcacgcgtgggcaagggccacgggcgcatgcacaccgcaacgtgtatcttctccccagctcgtgcattaggccgtcgcccaagctggatggaccagcttatcaacttgtttatccgagctttccgccttgccgcgagagtcgagacgaagctgcccttggcgccttggcccctcgccgtcctcaccttttcgcgtgtcgatggtacgcacaagtgtgcgaccggctggagtggctggaccggggacccgcctgtattttcgcgcagttcctgtttcgctggatcgcatgtggacacgccgcgttttccctgtttctcgcagcgcacgtgttggctgctgcctgccatggctgccgcacacgccaaaaacgtacgtgcgtttcgtttcgtgcgaccctgctgctagctcatgtgtcccgcccgggctcccgggtgcgttctaaagccaaaagcaattatttttgacgtaaaaagaaggggtagaaccagggaattacacggagcgaccttccagctgctgtaccatagcatatttacagtggagtgaaataaggagaccgaacttttaccagtgaactgtgtgaccttgagattctttagcattaatcaacaacggataacactacttaaaaaatcttcatagggaccggtattataagagccaatttatttaaaatcgacatctatgatctttttctcaccttcccacgatgaaaaaaatatagaaccggcatatttaagcactatagatatcgattctgtttaaaaaaaactcaatacatgcactatagatgcatatttttaatagaactgacatctataaaatgaatatggatgctgatttttttaaaaaaactgacacctgttaaaaaaaacttaatccgtatatgtttgaccacccacagcacccttatcttatctatccatcccgcttgccatccatgcatctctcgtccctcctctccctttgccttcctctctctggtggagcggcggcggccctctcctaacccgggggccctccccccttctctcctcctctagggcagcgtggcgatggagaaagccgaccgatcgggcagggtgcggccggtgcggtggctgacagatagatcttatcagccccgtcctcaagtgcggcgagatggcggtggtggtggaggaggcctggatcttgctagccctctctctcctaggggacctccccccttccccttctcctcctctagcatggcgtggggtggcggccgggtggcaaggtggcggcgtggtcatcagatctcgtcggctccctctcacccaagggacctccgcccccctcccccctccaccaatgcggcattgggtggcggccaccggcgtggaagccagcgttgcgttttttttaataaaccgacatgtataggattggagcaaacgtaccgaccatagctagttcataaccgttacttatggggttttctgtcttagtgtaaaaggctcgttttaccgtccagttctagctgggctatgccaaattttcaataaaactagaaagacttaattaaaaaaatattattaattaaattattactactaattacgtatcatcttgataattgaatatttaataattaattttaatagatactaaattaaaaaaactacttccttttacatttattctactccctctgtcccataatataaagaattttaggtggatgtgatacatcccaatacaataaatcttaacaaacggtctatcctggatttattgcatgtgtcacatccacctaaaatttcttatattataacggagggagtatataacgataatgtaaaagaaagttccttttacatttcaacatcataatgtcgaagcaagaaaaaaaagaaactggtttacttcctctatctcataaaataaccaatacttagatgtggcacattctattactatgaatctggacagagaatctatcactgtccagattcattgtactaaaatgtgtcacattcaatatggaacggaaggagtaccgcgaggtactgtagaacttgggagtatgtttgaatgacacttcgacagcatccgtgccaacgtatacgatgatgcgtatacacgaggtttttgcccttttggacatccatgatatactacgcgcctcgtagtccgcaagaaatgagtgcggagtagatcgctgatcgcgtcttcccgtcgaaattttttctcatcatacggccactcgacgaccagctgcagtaccaggtaccgaatcactctactcctactagcaacgacagtaaggtcaattcagagaagcctgcatgccaccgtttctttccctctctctatcttttctgactgatggatgcttgtcgttgtacgtatctgttcggttccttctctcttcaaagacgttggctaatcacgccctgcttaggggtgttttagatccacgggcgtaaagtggatactattaggatattgcatgaggtgttcggtactagaaaaaaactaattatataatccattagtaaatcatgagatgaatttattaagtctaattaatttatcattagcaaatatttactgtagcaccaaattgcctaaccatgaagcaattaggcttaaaagattcgtctcgaaaattagtcgcagtctatgcaattagttattttttagtatttatttaatactttatgcaggtgtttaaacattcgatgtgatatggtgtaaaattttagggtgggatctaaatacccctttaccacattccatcaaaaactttacaccctgtcacatcgaacgtttgaatacctgcattaagtattaaatataggctaaaaaaagaaattacataaattgtgactgtcgacgtttgatgtcgcgattgcggtatttgtatagtatgtggatcgttggtactaggatatacgcgagactgaggtaaaagagacggagacgaggattttatacaggttcgggcccttgaatcgtcaggtaataaccctacatcatgttggtcgaagccggtcgttacttttattcatcataatcacaccagtacaatatttggggtagcctatctaactgttatcgacatggcggtttgaaagtctgactcgtagtcgacaacagggtagtcttcctcctcgagttcgtgcccggcgagatcagagacagcactagatccctatggccggcctttgtaggtaccaaatagggctgatccaggcatatctctgatgtcgatatccggcggcttgtcttggcgtatgttggcttgtatgttgtgccttctattgttccgtgttgtctatcgtaggtgtcttccatggtgggtgtgtcccctctcctcctaggaggtcttctatttatactcataggtgtctccttgtccaagtagaaatagggaaaccaatatggatacaatccgagtagtcattgtcgttttcatatagaactctggttatctttccttatccggaactccttctgtatccgcaggttatttccgtatagaacatggtatatggtgagtcctgccgagatttagttaacaactattatgtatgtggtatccataaccctgacagtgactaatttgcgagacaaatcttatgagcttaggccctgtttaggctgtgtttagttcacactgaagtttagaagtttggttgaaattggtacgatgtgatagaaaagttgtgtatatgaaaggtttgatgtgatggaaagttgtaagtttgagaaaaaaagctttggaacaggtctccaaacttcaaccaatttcaattaaactttcaaacttcagtgtgaactaaacacaaccttaattgcttgctccatgatttgacagtgctacagtaaacatttgctaatgatggattaattagtcttaataaatttgtctcgtattttgctaacgaattctgtaattagtttttttattagtatacgtacactctatacgacaccctatataatattcgatattacacgctaaaactttacatatgaatttaaacacccctcagtctcatccatgttaagagtataggattaggaatttaggagtactccacgtacctgtatgtaattggagtgtactgtagtatctccggatacggtggatggcgtggctctcagtcagctgggactactggcattcaaagcacaaagcgactcccaagtctgaaccctctcagatcagagtatcagacgctagctgctcctacccctactcctagattacgtgaagtacttctacgtcggcctcctctggagctagccgacgcagcggtagtagtagtagcatctgattgacgtgcgtcagggagcaccagatagcttgggttaacgtggagtacaggctccaaaatctctttgcttactgcctcactccttccgcatcatccccttgtcattagaccagtgatttgacaccgccctgcatgaattctcgttctccctccgatttgaacaacatcggtttcagcaatcggtgcatacagatacaataggacacggcacatactgtaggggtacgcaattgcagtatccgaaacggatgcatatacaccgataccgcgatattatctccgtactaaaatgtattccctccgtcccacaatataagcgattttaagtttttcttacaacgtttgatcactcgtcttattcaaattccttttgcaaatataaaaaacgaaaagttatgcttaaagtgttgtagataataaagtaagtcacaaataaaataaataatatttttaaatttttttaataagacgagtgtgcaaccgttgcaagcaaaaactcaaaatcccttatattatgggacgaagggagtagctatttctagcacattactttgtcccaaaattaagctatttttctacctaccttctcctctcaaccaatcacaaccattctttttcacctactttctcttttcaaacaatcacacaccttcttcaatcattctcatctactttcttaatacccatgccaacataaaaaatgcttacattttgggacgaaggaagtatgtcatatttttagaatatgggatatgatacggacgtattgtcgacgagtgatactcgtgaaccggatgagttgagtactagggtatgttggtaggagggtctacgtaatacgacatcaagcagacaaaggacaacgattatactggtttaggccccttatcaggtaatagccatagtccagtttatatgggatttatgacgagaacatattacaaagagagtagtcgaaatagataataccgacgagaccgtagtcgaaggtttcgacgaaatctcccggcgacttggctccgcgtactccgacttcgtaaactatggtgggtgtgttggtgattgaattggatgatccttcagccctccctcaggggttccttttatatcgtggatcagctcaacttgacctccaagaaaggtttgagtatgttggatctggtacggaataacagaaactatatcccttccgagtaggattttgaaaataacttgactcgtagtcaaacaatgcaagcaaaattttaaaatcgacggagagagtattataaaaaattgaacatgtttttgccggtattttgatacgtcatccgtgtatgagtcagtttttaagttcgtttgtttttgaaaaatacaaatctgtatttgagtcgatttttaagatcgttaactttcggtaatacagaagcaatcatataaaaaatctgtttaaaaaaactcgcatgctaacttgagatgatcggactccaaactgcagctcatgattttctaaaaatatatatatctaagcgaacacccacagtgaatttcatcttaactaaactatataacaataataagattaaaatagacttcatccgttgtaacgtacgggcattttttctattaaaaataaaaggctgaggttttacatataaaggagactcggctactgatcaattcgatcaataagacgttagcatattatttccatagtaaaaataattttctcgctccatatcgaaataaagcaacctacagtatcggatgcgacatatcatagaacatatacgaattcgttctactaggatatgttatatccggtataggttcttatatcgtggggacgggccaggttagtccgtcataaaaatataaattatattagtttttgcatgatctactttgaaaatcttttttttcataatataacattaacaactacactctccgtttaaaaatatactaacctaaaaccggattaaacctaacctaatactaacgaatctagatatgtgatgtatctatacaatccatgtctagaatcgtggtactagatcagatctaatcttaatcctagatttctatattttgagtcgtgtgttgctgaggagtatattcatagtactagcatcacttgaaggtattttcgaatatgaatttatgccattacttgtgtctcattaaacaaatgctcttacattagcagctcaataattagtcaaaattacaaatattaattaatcgaaatacaaacctatgatagaatgtgatatattctagtaatacaaatttggacagatggccgtctaaattcgtataactaaaatatatcatatactattttaagtttttttagacgaaggaagtacatctcttctatatatactattataaaaattgagaatgtttttgtcggtattttcgtacgtcatccgtatttaagtcggttcgcttttgggaatatttattcgtgtttgagttggattttaagcttgtttacttttgaaaatacaaaaggagtctgacggagcgtggggctcctcaccgggagaccgcgcgggcccccctttgccggttcggccgggggcgctgggtgaggttctaagcccttgatctgtggaatggttcgcgagagagcaaatgcgcaagacacgggcgatgtagacaggttcgggccgctgagaagcgtaataccctactcctgtgttctggtggatctgtgtatgaaggagttacagagagctggagagcaagaaagttcaaactctagagaccctctcactcctcttttctccagtcccccctttttggtaggcatggtcctccttttatatctcaaggggataccacatacaccatttctacctacccttcttttgggtggggacccatcctactttgaccaaaacttggctcgtaccttcgcctgacaccgggataaccctgtcctccctcattaatgggcgatttgcaatggctgctgtccgaatgaccctccgatgggatgggtcataccaacctccactccgccggaagcaggtgcaacatggaagcacggttgtttgctgatgacgtgaccggcgtcagtccagtcacaaactggtcattcttgtctaccacgtgtcagtttagcatgccacacgtcagcccttcttcataaaatgacttccttgtaatggttgcgatgaagcctggtatgaatctagtcgggaccgacgtgctaactccaggagttcccacgccggctccgtctagggacgagtgcctagaggctctcatcattctgacgggacggggcgaggcgtgcgaaaggccgcctgttgccacctaacccgcgatctgaccggtctgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccacacacgtggcgccaaatcctcagggggtcggggcgccccagccctcggggacgaaacgggagcggcccgacccctcggggagatagagggaggggttccctttttacctttttaaaattgtattccttacttggactatccttttattttctaattttgttttattttatttttatttttattttgaattttgattattgggttcttatatggaaacttttttcaatattgcttatttttaatttcgaatttcagctattttaaaattgtatttttacttgggtctctttttttttttctaattttggattttattttatttttattttgaattttgattaatcttgtattgggttcttatatggaaacttctttcaatattgcttatttttaattccgaatttcagctatttttagattgtatttttacttggactctccttttatttttttttctttttctccgattaatgtgggaatttttagtctttacataaaacgttgtttcttttttcaaagctgtaatttattattaattaaattctattttttaaaaattaatatcatttggttatttattttaaatttaattttttttttattttgaatttttttgctttccatgaaaaaatttaaagtttaaagtttttttttttatgaaaccttctttaatttttaacacttcttttatttagtttttaccggtaaagatgttatttattaccacttccttataattttttggatcttttttcttttttttttattccaattttcaaaataatttgcctttttaaactttattttcttggttttccaattttttttgcacctccctttggtttgcattctttattaactttatttttcgattgcatcctttattggccctttctgggtttatataagatattt

SEQ ID NO: 71363 - DNA, 38653 bp, Oryza sativa
  unsure (1)..(38653): unsure at all n locations
taatgggaatttataaaacccggtttctacaccaacgggggtggtatccaaccacaaagtgtgatgttatattcttgacctatataatggatgtttgttgctgcgcacgtgcttccctgaacaggtctaataagggataaaataatgtttctatgagtatcctggtattgacgttccaaaccaagtactccctatgtcccaaaatcccttatattttgggacatagggagtacttggtttggaacgtcaataccaggatactcatagaaacattattttatcccttattagacctgttcagggaagcacgtgcgcagcaacaaacatccattatataggtcaagaatataacatcacactttgtggttgtatacacccccgttggtgtagaaaccgggttttataaattcccattatctaaaataataataatataacaacacacagtataatgaaatggatatgtaggttcaaggctattgtaatttgtaatatctcagcaatgctattattcacctttgatctctggttattatgttgcctgtctcatttctcattacatgtgctataattatattcatctattgtcacgtgatcttgtttggtttttatgtcgcaaccactggccttatcaggacaattttgtacatcttatgccatgagctattttatttgccatcaaggcatcaatcaagtatctcattatcttgaaccccttctactaactcataacagtgcaccagttatttctgatgttcttgttttatgatgttcaggttaggcttctcaggggcgacgtcattgttaatccccacagcgtttataagacccatgaggagctctgggacggcgaaatttagatgcagtcagcttacgttagtgccagtcactctcactgaacattattttttcacgaatttacgcttatctaatgtatggtgtttgagtctcttgagctcctattcaatgtaatgaacctgcttgatcagcagcatcatgttcccttagaattcgtattagcgctcctctgaataatactggatcatgtcatttgtatgcttcgcctctggcatcatttatcccatgctacttgtttgtctatttgtcctttggcatcatcattttttcttgtaccgaggcgttagtttgatactcatgttcctcactgaaattagtcaaattacttagcaggctaacagacatttgatagtcaccctgaattattgttggtagtaggtattcagccatgccttttgctttgatttgcaccttattcacgaaagatttcttgcaacattttttctctgtgagaaacaggtcaattctagctttgttcaggaatactatttttttccatagcaccaaaggcgtgccacaggcatagtatgattgtgctatttccttatcttttgagccatgatatggatgtccgtatgctctacaaacatggcgagaatcgttacccatcgcttgtgtttgtgttgcggggcattcctgcagaaattgataccagcaactaattaatggtactcctgtggagtcctggttcagtaagtgtttaactggcactcctgttaagtcctggttcagtaagtgtttaactgctaagggtatgactttaagtacacagggagattaagtgattaacaccgactagtttcagctgaggtgatggtggaggtaggatctatccaatgggatcaattatgacttgttatttacttgacgctatttttctattttgtttatagtttcccataaaattgaagatctatagattgtttgtcccttcagataagcgatgatgctactggaattctacatttgcctcgacgccggtgactctcgaactctggcagagaacccatgaattaatgttttaggggttggaggggatgggaggctgtgggtggcggtaagagcaactttagaagaatgactggagtgacgaaagaccgacgttgagcgacagagatggacggatggtgagacgctgacggcaaaatcaaagctacggggatgaaagaaagcggtggtcgggatcaacgacgggagcgagggaggcctactcccaccgtcccataataaataaataaactagatgcggcatattatactacaacgaatctgaacaaacgtatatctagatttatagtagtaggatatgttacatccagtattaggttagttttttatgggacggagggggtatgtggttaggaagttgggacaatgataagatagaagagtggaggcgtggcgaggggaaatgacgttagactgaaagacgtactccctccgtcaaaaaaagctaacctaggcaaggatgtgacgtccagatttcgttataccatgtgctcgatttgttacaccatgtagtatccaattcttacttaggatggttttttttggatggagggggtagtggaagtagacgagctactatgtatctagctagggaaaaagaaggaataagttaggggacgaaagatgtagaaggcaacgacaacgatgtggttggtcggaagaagtgaggaggggtaaggattagaattataaagggtagcacagatcttggagtaatctcaaccgttaaaacaagtggctacattttttaagaaaatcaggtgatcaataaacaacaagaagccccttagaatccagtatgagaatttactatttatcattcttccaaatatacatgtctaaataacactctcttaaaattttattctcatttaccatcgactcgagtggcgaatgagaatgaaaatagtaaattcggcattgcaaggaatgccaatggacgggtggagtcattattttcagctgctgcccagcctacggttccagcttccaacagctcgagaagagtgaagagatggcaacacagacacaggaaacggtcgcgcgcgccacagcgacagcgatagagccgctccgcgtcacggcttacgcttccgttgcgacaagctcgcagcctcgcacggacacaacgctatcgacgtggtgtcgcgtcggcctcagcctcgacccgaactcgtggagcgcggagcggaagcgcgggcagtgacaccacggggcggccggcggcggatgctgagagtgtgtccccatgcgttcggcatctcgcgctgcgcggggcggcgggggtcaaaactacaccgtgtgcgatgtggacaaaaaaggtttctccgttttctcctttaggccggagattcccccggccgaatccggcgaatcggcaaaagcggccacatgcggccaacagttggtgcacgttattgtcaaaaaccagtccttacgcaagacgccacgaggtcaacccggagaggaactacatgaatgaataacaaagacgtgattgaaacaaatacggagtagtacgtggttaggacctctattatcgagtaatgatactcgttaggacaagagacaattgaagcaagtagacgcaaaaacgtactcctcctagaggtcacgctagtactccctccattccataatataaggcaccctttgattcaaagaaaattcataggaattttaaagaattttatttctatagaaatttttactatatagccctgtgaatcaaatgaatgaatgaatcctatagaatcctatgaaattcctatggaatgcctcttcccatgcaagttttggagaaaatttagcatgaggtaaaacctcatgttaagaattctttgagtctttatatctcctcaaattcctgtgttttttctacagctcaatcaaatggtcattcctatgttttttaaatggttattcctatgtttttcctgtgttttgtaattctctgttttacacttgtattcctatgagaatcctatgtttttcctattcctccgtttttttcattcctatgattcaaagggggcacaaccactttttttaaagatgtttctaatataagacatgcatgtaagcatgcaattaactatgacatctaatcctattggatgcatacattatatttattaggataatccaaattacaagatgataataattatttcttggtctttgggttaagggtggttgtgccttatattttgtaatggaggaagtatctactacctccgtcccaaaataaacacaaccatgagtttctgcgctcaactttgatcgtccgtcttatttaaattttttttatgattagtatttttattgttatgagatgataaaacataaatagtactttactcgtggcatattttttttagttttttttaaaaaattaaataaaacaaacgattaaaattggacacgaaaagtcatggctgttagacggagggagtactaataatgcgcccataatgggctgtccttgtcacgggctaagctatccacacgatggcacatctaagccaaagcccccgctattaatttgccaaaccacgtccacctggcgcagacaccacaccaccaccgcaacggaaacacggtgaacgcctcgtcccgaaaccccggaaagccggcgagagctcgagaagtcgagaccaacctcgccgagcggatcactcgcactactcccacctcgccgcccgccgccgccgccgccgggttcccgtgctgcgcgcgcttcgatctccttctccttctccttctcgcggccgttcttgtgcgtgagtgagagacagtgaggtggtgggagacccgtgggaagggagaggggggcggaaatggcgaagcacttcgtgctcaacaccggcgccaagatcccctccgtgggcctcggcacctggcagtccgaccccggcgtcgtcggcaacgccgtctacgccgccgtcaaggtttcccccattcacccgcgcttcctcctcctcctcccctttttcgtttcttcccccatttggcttattatgtctggcaaatcaatgtaatactgttctcggatcgtgcaggcggggtatcggcacatcgattgcgccagtgcgtacaacaacgaaaaggaggtaacttggtttctccaaagctctgaatcgttcacgaattactggggcatcactctgcgtgttcttgtttgaaacgattggcgtatgaattttgcattagtaacatgggtgataataacagaagaaaggcacaaaaaaaagtatttggaaacttctactccttcatttttatatttggcaaagaagattcatccattttatatatatggacagtgaactattagtactttagaagggagtacctatacatctttcgaaagatttttataatcgtatcacacagatttttaatctttggattaaaatccgatagatataataaaaagcaaaaagcaattaagaaacactataatggacactaaattaccatatcctcaagaaaaagaccaaatccaatacaaaatttaaaatttacatgcgaagattcaaaaattacagtgtaacttacaaaagttacagtgtaagtttcataaattacactataacttacaagaaaatgcactgtaaatttgagtgagaaaatcgagtgagagataagaaaaaatctttcgagtgagatatagcaaaatcgctttagaaaggttgatgacaccttcacaaaaaagaaggaagaaagtaggggcagatccgctctacttttagggcatgtataatccgcactactcaaaactaagtagcacttacccttcttgcttactaccacgtgctttacacctggtccaatattatctcgtttcaagacaagtaatataacaaacaattaacaaacacattttgggttttcaggtagggttggctctgaagaagctatttgaagagggtgtggtcaaacgcgaagatctgtttatcacgtctaagctatggtaacctcaaatttatgtgtgattggcctgtaattatgtctttgcagttgaattggaattccagtgcttgcttggagctttacttcaactgatcagaggtgatgggtatgtttgtcaggtgtgatcatcatgccccagaggatgtgcctgaggcactagatgctaccttgaatgacttacagcttgagtacctggatctttacctcgtacgtatcttcttttattaagaatttggttcaatatgtgacttgcttgattctgttctctccaccatcaaggtcttgctttggaatcattggcatcatcaacctatagcaactagctctatttctatatgctgcagaataggtctccccatttgtcagtgcgcattgatagctaatgttacattgtccagcaaaatttctgcaatctgctatggaatacacctgagccatccatatcagaatcatcagcattctgttatatgtgctagactgctagtccattgcatatttgcatgacaatttccttttatcattcatccatgcaaccacaataaacaaagtactccttgttttggtatcagttcgattgttcaccttgaatgacttacattgaagtatactctccacataaattggggcatatacctgtggttaacttttaatttagcagattcctttgttaaaatgtttcagcatcttgttacactaatcagaatttctaatcaccattatatttatgcagattcattggccattcagaaccaagaagggatccagcattggcaaacctgaaagctacttaccacctgacatcccatctacctgggcagcaatggagaagttatatgattctggcaaaagtcgtgccattggtgtgagtaacttctcatcgaaaaaattgggtgacctgcttgctgcagcccgtgtacctccagctgttgaccaggtggagtgccatcctggttggcagcagatgaagctgcataacttttgccagtcaacgggcattcatctttctgtaagtctacatactaaaaaactgagtcaatcctctgactgatattagtaatgaacaaatgacacctgtggtttttccttttctgaaacctactgatccttttcttcctccttttttaggcatactcgccgctaggttcacctggttcaacatttatgaacggcaatgtccttaaggaacccatcattatctcgattgcagagaagcttggcaaaactcctgcacaagtggcgctgcgctggaacattcagatgggtcacagtgtactcccaaaaagtgtgagtgaagaaaggataaagcagaacttagatgtttatgactggtctattccagaggacttgcttgctaagttctcggagattaagcaggttagttcaactttctttgagcacctatatttgtcatctatgttttcacttttcatacatgtgaacagactgtttcttaacagcgagtgtttgcttcatatgattgggataaaattacattgatacttggtaacaattgataccgggctatatatagagagcaagctgatgttgcaaaagttctccataaaatgtttcttaattctatatgacaacctttatccttggaaacaaatttgcttgtaaatactctccaaagaaatttgtttacctcgaagcatactagattgtagaaacttagtgtattgtttgttagcatctgcttgttttggaacatcagtgccaggatactcttaggaacattcttttatcccttattacacctgttcagggaaacatatgcgcagcaacaagcatcaattatatagttcagagatcacacatgataatgcagtgacgtgtatgctcaaggctactctttgtaatttgtaatatctgagcaattttttactcagcttcgatctctgatgattatgttacttgtttcatttctcattacatttgctgcttttctattgtaatgtcatgtgacatgacaaactgtctgttcaggtttggctttatgttgccagtactcactagtggccgcaggacaattttgtaggtcttgcgcagtgtggtagtattttgtttgccatcaatctagtacagctcactcattaattcaatatcttgcaccccttccagtaactcatatagcagtacaccagttatttctgacgttaattgttttatggtgttcaggttaggctgctcaggggcaacttcattgtcaatccacagagcgtttacaagacccatgaggagctctgggacagggaaatttaggagttccgtcagtgccaatcacgcttattgaacattgattgtattagcaaatttacgcatatttaatgtttggtggttcagtgctctcgagctcctctgtcctatgtaatgaagtgcttgatcagcagcatcatgttcccttggaaatcctttttactgctcctctgaataaaactggaatgccattttggtgcttgtgcttcgcatctggcatcatttatcccgttattcccgtgctacttgtttgactatgtccttggatcatcaaattccctcgctgaaattacttagcagcctagcaggctaatcaacaaaaagaaattatatatgtaccctgaattgctgctggtagctggtattcagccatgcctcaccaacgattatagcttctttctgtttttattcttagcaccgaaggtgtgccgtcgtttgtgcacttcccttttctattgagccatgatattgactgtatttcttctgtctcataaaaaacaaatctaagatagaatatgactatcttaatactacaaatctaaacagctcctaaaactatgaatttgaatctgattgtctagattcgtaataatagaatatgttccatcatatctaggtttatttttaagagtacatttattaaattcccatgttttaggtgtaattgtgattttacccctacttaagtagactttacaattttacccttaattttctcgaactgaataatctgtttacccctggtttagatgtccagtcccacataaagtgagttcaagaaattagaaaattgactaagaaaatatgtaaatactctactaaccctcacctattcaaacaaatccactgcccccactctaaatcccctcacaaccaaaatcgacatcccgatcccctcccgtacttggcggtggcccgtgggccatggcggagcaagcggtgatggcggaagcggcgcacgggagcggggcggagcaggccgaagaggggcacttcacatcttctaacctgttcccccatccaaaaccataaccaaggggtggtgctgccgtgatgcgttgccctggggcgacgggagttgtatgtcataaaggaagaagcttaatagtaagatagcaagtaagatgtaaaatgtggtgaagaagacaccatataaagataagaatcgactttgctacaattaccgatcaaaaatacatattggtaaaaaatctatcttctattatataataaaagtccatgaaacttcctacaaacgctctcaagccgccacgtggcgctctaataaaatagagaaaatcctagaaattctaagaaaaaaacaaaacatctatcccttgattttcaattaaattggtgggtccaatattacacaccgttagataaaattgatcttaaaacaaactaaataccatgggttccacctatcctcctcccgcgcattggcaggtggagtatatacgtacgtactgtacgtatgcttcctcccctttttttccttttttcttcttttttcaatttatatatataatggatatattttttaaataataataattttacaaacaaagaatctaccatcatataatttaaaccggtgtactctttactttgtactattattttcaaataatgcactattttaaaataaattttacaaaattatattgtgtacctatcaaataaacaatatcatattaacaaatttatacgtgcacttaaactgatggccccattatataaattatcggatctacttttttacattggtctattattctcaggtaatgcactgtttcaaaataaggtctacaccattatattgtgtatccattatattaacaatttaaaatctatattaactaatttacacttacagtagaactggtggacatattattataatcattggatctattgtttgctaataaataaagcgtccgaaattctctttttgcctgctgcacaacgcacgtctgcaccttggcctttcgcacgtgtgacaaagcgtagtgtctaagacatctaaggtgatcacaaccgctgtagcgctaccgctttgccacatatcaaatcatatatgaagatgattaattttgttaataacataaaaataaaattaaaggtgatgcagcgagagaataattaagcaccatgggttgtgtttttctcaacactaattagctctgtttaagttgaaaccgagagttgattacataataattataatgtatttgtgttatgtcgtatttggattttgtactatttatccgtacaggtgaaaggaatcattatgttataaatgtgagtgcaatattgacgaatatcaatagaactcttagtacgacaagggtgataaagggagtttaaggccctctctttttttcccgattccatattttggattttttttgcacgctttccaagtttctaaatggtgtcttctttaaacaacattataactttttagaagtcaattcattcgtttataccctcaaatagctatcacataaattatataattcatcaatttcagctatcctaaaccttaagtactacatatttttttcatgcgagtcatggtgatcagtaaattggtgatcaacggatcatcgaagtcgtaagatgaatatgtaagagttactctgaacaattgtaaataggtgtcaaaattaattgctattaattagacatctaatggcttgctagccacaaaattaatttctctctacatatatataaacatggacgaagttggaacaaatattaccatacgtcccatacatatatattgcgcagttaatattctaattagtcatttaaaattccttaaaatgctctcaagctgccacgtgatactctaataaattagggcaaatattagaaattctaagaaaaaaaagacaaagtatcagttacttgattttcacttaaatcggtaggtccaatattataaaccgttagattaaattgatcttagaacaaactaaatactacgaggtcccacctcatcataggtatgcacctacgtgcatgggtacgtatgcctcccctcccttttttatttttctctttcttctttttttttcccatgcatatgcttccctccctttattactatatcatgcgtcttcatgagatgatttaatcaaaattctagaattttgagtatcatgcactcacattttttatttattacacgtatgtatatagatggactgtatgataattaactagcaatacttttttatttactcgagaaaaaaaacatgattcaaaagttgtaattacttaatccatcccctattcaaaagtttgtgaatggttttctaagatacctcgagaaaaacagaacctttaatttattataaaataacattatccaaactttagtttgccctaaatttatgagacaaaatttctgaacaaacaataatcttatcttttaaaaatataagtgcacacgcgggccaccttcctagttatcctaatagtaacattcttaagccgaacctttcatttgataattgtcacttgttcttgattgcaattttagcatcgcggaaagcaattctcttgcaggtggcaggtgggatccgccggctgacatacgctgtcactgacatgcgggacccctggttgagcacctcaatgtgcttcggatttcatttcacactataatcgcgacaggtcctcgcctcctcggtcgtttgcgcagcctctgttgaagagcttgttccgttttttaaaagacatggcatctcaacaatactcctgattttctactactgattttcccttcgtcaagcgactccaaaacgtgccccatatctaatctgtctcgcacgcggccggcggcggaagagcagagcatcaggcgcgtgtggatagccggaggacatggccacccacttcacgctcaacaccggagcacgcatcccctcggtgggcctcggcacctacaaggccggcaccggcgtcgtcgccgacgtggtctccgccgccgtcaaggtcggtctctctgaacacttgctgtttacttgtacgcccgtatccatatgcatatattgttctaagtttacttgctgagttgctgtggcaggcagggtaccggcacatagactgcgcgccgctgtacaagaacgagcaggaggtagtaaggctattccctgcaaatctttgaagtgttgagtgttctatcctcgattggcatgaattgcaccggtttaacttgtgagagtgatttttgtgtgtgctcctagattggtggtgctctgaagaagctcttcgatgatggggttgtcaagcgggaagacctcttcatcacctccaagatatggtgctgactgctgctgtcttgttccttctattgaccgacctcaacttctgaacgctactagtagtgcaagtttattctgctatttcgaattatgttctatcccttcctcttgaagacgtcccaaactctgcaggtgcagcgacctcgcacctgaagatgtcccactcgcaatggatagtacactgaaagatctgcagctggattacgttgatctgtatctggtaagctcatcatgatcagcgtaaacgtagacagtgaaaggtttgccattttgctctgcttctgacaggtgcccaacggtgcaatctctgcagattcattggccgtttcagatcaagaaaggcacggagctcagtccagagaacttcgtcaagcctgacatacccagcacctggcgagcgatggagcagctgtacgattcaggcaaagctcgcgcgatcggcgtgagcaatttctcctccaagaagcttggcgatctgctctgcgtcgcccgcgtccctccggccgttgatcaggtcgagtgccacccgggctggcagcaggcgaagctcagagcgttctgccacaccagtggcgttcatctctctgtaagtcctgcatgtttctgagctcatcgatcacttgatatgtagtagtagcattgtgctgtggttcactgctcacatgattcttgcaggcgtatgctccattgggcaggatgaagggcatcgccgttgattcggtgttgccatcggtagccgagatgctaggaagaactccggctcaggttgctctgcgctggggtcttcagcagggtcagagtgtgcttcccaagagcgtcagtgaggcgaggttgaaggagaacatggatctgtttggttggtctattcctgaggaactgtgtgccaagctctctgaaatcgaacaggcaagtgcatccaacctttcagctgtctcaagtgcagaaaacagtttcacttctgtcttcatatcttatgcaattccggatgaataaacttcatacagttctgaacttccgataagttagtaaccagtacagaaaaaagtactattgaacaaaatgcaagtatagtggatacgccaagggtttcttgtagttgtaggccttgtattggaattgtaataactgaaaatgcattgttcatgttggacaggttaagcaaatcagaggagatggatttgctcaccccgagagtgtctacaaaacctacgaggagctttttgatggagaaatctaaaagaatggaaatcacctatgtgaaacaaaatgtgccattactgtaaaagaacgatgaaaaataacaggcatttcacaacaatatcttttttcttctcttcaggatagctgtctcttttacatgctgttccttccccaatgtatcaaaatacagtagaagttttggaccagaagctaaaactatggagatccatgtggtgggggactagaataatccacaatctaaagccaaatccataaactggagaaaatagcatgcctatttttaatctcccacaattaaagagtcgcaagaggcagcagagatatggaacttggtaacatttttaccacataaatctgcagagaaaatcaagaaattcgaaagcacactgaagtaggtccttctacattgcaccaccgcagagacatccaataagcagctccacaatgatgcactgacagaacaggtagcactttaagcccttcgctagattcaattttcgaccataagacagcgatgaaggcactcacatggggtagacaaaaagggcgtttaaaactcgctataattccgccatactgctcgaaattcctccctgaatgtgttcaggcgtgctttcagattaggtgttctgaaactggcgtgaagcaaggttgctgcaaggcacaaacttatatattaggcacacatgcacaattttaaaattttaaacctcaagtttggccttaccaagcagaccaacaattagtgcccacagaaccgtaaggagactacatgaggtcatccagaggaagcagcttactgcaaaaataaaataaattatatgttgagttcattatttatttagttgttttttttataaaaaaaaaactatggtctagaatagtatgtatggaggtcagtgctttatactaaccgacagaaaataatacaacaaaaacccatcgaggccggccacaaatatgaattgatctttttgagcttggtcggccacgaatgacaggtctgcaaatatcagcaatgttgttagcccgttcttctgagactctttaaaaaaagaagaatgttatagaagaaatagggggagaggatccccaccttaagggtggcctcatctttgctgctaaatgtggtgaaaattgtctgactgtccttgtgactttctcattgaatgtaactgcaaaactgcatatcaaacatgaatcatttgaaaaagcagttctagtgggagtatcactatttctagtggagtggacaaacataggaattgactacagaaatacacatatgagcataaaatctgtcagttatctaatgagtgttaagtttttttttctcaaaaacatagaagaacagcgtatcatttcattaaggggaagaaaaaacaaagtgttaagttgttaacatataactggtgcaagagtgctgatatgagcccttaagctaaaatatgaaatgcagatgtctcccaatctatatccattgataataataacagcagatgcttagcagattcaaaatcaaacaacatttatgtgttggaaggaatgcgacatgcgaaataggggttaatgtcacatttgcaggttaaaggaagaacagcttgtaaagtgcaaaatatctttcttcccaagagcactaacggtgccttcaattgaatccaaacttacctgtcattgagaaatgcaatgctgaggcctgttgaaaaagctgcaaggatggaaactggtttccggagaaagcccatccctgcaaaaagagagacacaagatgactatatgaaagtcaaaaaaatagtagggatgggggggttgggggagtacagcacatagaggtctctctgcctaccaagaatgaacatgatcaagatgaagtagttcgtcctgtagctgcaaaccagcaaaaacgttggaaattaactttgttgaaagatgtaacatggtacaaaacaaatatgtatttacaatataagttctaatgtaaaatggtagaggaacttccaggttctattcctaaataatatcgatatgctgccttcctatttacacgttaaaatcaaagtacctgttcacatattctatgattataggttactgttgatcatcggttccatacaaaatattgtatcacactcagaggataaccgtgtggtttactataatatggaaacatcacggaagttttgattatgcaccttttatactcccctaagtctcacatataaaattccatgatgtagccaagctaccaataaatttcaagtcacgatttagtgagctacacctaactagaattatcagcaaacgtacacctcacagaacaagttataatcaaatctagattccacgtttaactccaaaagtagaattcagatcgatgccctacacacattaaatgtgaaacatctctgcagcagctaacgtatcgttccaaatgaatctaaacagttggcacctcatgcatcgccccctattccaacccgatttaacccaaatcacagtgggccaaccaatctagctcactcattcttcgattcgtgaggagaggcacagaggtgggaggtagattcgagatagaagccgtactacttactagtagaggttgcacttgaggcggctggtccacttggagtaggatcgcggggcggtgaagcgggagaagaactcggagacggggcgcggcggcgtcgaccagtccacctcccgcagcgcgtccaccagatcctccgcagtcacggagctccagtccatcgccgccgccgccgccgcctgagccgacgagctcgccgccggctaggaaatccggtgacctagagaggagatggcgagtcggcggcgacgcttctagatggttcgaaaccgacgaggagagggcgtgaggaggggcaagtggttcgtggaagagctgttcggattcggcgacgtgtggcttggtcggatcggaaccgatcggacaggcgcagttggcacttgggacgaagggttggtacatgactggagtactggacccgttttttgaccgcccattctatagatcaacgggtcagatcgagtaatatgatcacccgagatgatagccattttttggttgattcccgcaatccagcattggttcctggcagcggggaactggagattgtctgtagcactactgatgtattgtgagacactgacacgcaagtttagatgtaagggtttaattcaatccatgtcattgaaaatataacattttagataaatattattacagtgcgtctatttgtagccgtgtcactgaaattttacaaaattataatcgtgccactgccgttatgttttctatcttctttctctataagtgagacccacccgtcaaatacatttttttcttcatcatctctttctcttcttttttttttcatcaatctccaccacttgttgagccaaattcggcggatggcaaggagggcgcctgcgagggaggcgacgccggacagcagcgggcagcatgtgtcgctggccttggtgccgactaccgtgtgcaccagcccgttcagcatgttcacttacgccagctgttgtatttgtcttttacacaagtcatgtacgtgtctcaattttttggagaggcagatgaaagcatgaattatgctgtcattatccttgacaactttacacgatcaagatatatttttttccactttactaagtcattgtacttagtatcttgctaaatacttatattttaaggattaggcggcatcggaggcttaggcgtcgggcagtaggagaaagcaacagccggtgctgtgatttcgatcgggcctaacaggtgcgagctgcgcggacagggccaacgccataatgaggaggatgacgacgtcaatgcagctgttcttggcagcggtgcccatggcgccgatgagtgaggagctatcgccacctcccttaccagcggtgaagggagataggaaaataaggacatgttcagattgtagccaaaataaatcttaccaaattttggcattgtcaattttagcaggatttcttatggacaaagtatttgttaaatttagcagcaaactaaatgtagacattttttaagtaactttgacaaaaaaaaatggtatggttgaaaatgacatcaatctaaacagaccccaagaaaagaggggagaaagaagattaatctaacgggtgggtcccacttataggaaagaaaaaaaagatgaaaaatgtgacggtagtggcacggttctaattttataaaatttcaatgacatgactacgatttgaataaacgaattgtaatgacatttatctgaaataacatatttgtaagggaaaagtctgaattacccttgaactattgtgtgcgtatgaattactctcttagatccgaaaactagaaatctttcaccctcaagtattaataccagacgaattaccccctaactcaatatggagtggttttggtcctacgtggtagtccagtcagcatttttttcttaaaaaagggtgacacccacatgtcatattctcttcctcgcccctcgccccgctctcttctccctccgattctctcccaaattggtggctgggggcggtgagctacgagtggcggggtggaggcggctccacaagcagcgagccggaggtggagggcgacgaggaacggcgtggggtcctaggcggtcaacggcatggcccaccagatagacaacgagggatacctccgccactcgctgcctgaagccgcatccgccactcgtcgtgtcccctttccatccgccgatgaggaacgccgcctggcggtgtcccctctccatcctttcagtcgtctctgctggaggccgaggaggaggcgcctccaccgcttgccacttgccaccggcggtggttcgactggaaaaaaagggaaccagagcccccgccagtccagtccccttaaaagatcgggcatgcaatcaggccggagaaaaccagttaacttgggtagtttttatataaaccggggattaaaataccaagaaaattggtggagaaaccagttaacttgggcggtttttatataaaccagggattaaaataggagaaaaccggttaacatgggcagtttttatataaaccggggattaaaatcctaagaaaattggtggagaaaccggttaacttgggcggtttttatataaaccgaggattaaaatctcaagaaaattgaccgattaacttgggcagtttttatataaaccagggattaaaatcggagaaaaccggttaacttgagcggtttttatataaaccggagattaaaatcccaagaaaattggtggagatgaggattcaacctcaagtcataggattgagagcaccacacggtagccatgccaccatcgtaccgcttgtgctattatataaacatttattctatattactaatcaaaccgtggttggaccggacaaaccagtggtccgaccactaaaccagtgaaccgagagctcaatcggttcatttatcggtccggtcttaataactatggtcccaacgcctcccaccgctcaccgctcgctacccctagtagccaatttggatgagaatcagagggagaagagagagggtgagggagagaatatgacaggtggtcccacctttttttagaaaaaaaatgccaactaaactaccatgtataaccaaaaccactccggattgaattaggagagtagttcgtccggtatatattaatagttgaggatgaaagatatctgtttttcgagtctaagggggtaattcgtactcacccaatattttatggggtaatttagacttttccctatttgtaatggtatggatcgaattaacctatcagttatgggcttatggctactgtatctacggcagaggatccnnnnnnnnnnnnnnnnnnnnntagtagaataacttcgtagccatttcttcaatgaggctcctttctgttgcattttggtttagctagactattgcacgttgagtagcatcaccatctaccacatgctcctactccctcatgtcaatatatttaaagtttgagacaacaaaatcatattaaatcactcactaattttatgtcctaaaagctatgtaaaagtgaccatagggagcatctgttaggcggagctgtgtggcacattgattctaggcttctagcatatctattgtcgtcagattatgctaagtgccccaaccactgattaggaggaaaaaaatatgcggaagttttaaaattttgattgggataacaaccgtcacaaaagataaacaagtctcttgaattgataatggggaatacccactgaaaaaacatcaaatatgtgaatacccgtgaaaaccggatttaaaagttctctaaattcatgaaaaaaaattactagaaatagttgtaggcgtaaaatacattcacaccaaatcaaagttcaaactcaactttgtttagaagtaacaaaagagacaaaatttggatgaatgacaatgtagaaaagattaagaaaaatgaatttgcttgagaaaagaaataaatgaattgccaatgtataaaagagaaaaacacactggcaatttggtgaagagagacaattggtaatatacaaaactcatagctatagagaggaaagaagaaaaaaaatcattttttttgccaatgtacttgaactcaccctccgtcgagcaaagaatgtaattctaaaatttgtccaacaaagagtgcagaaactcatatgagaaaatttgtcagttttgccaacgtacaaaactcacgaaaaaacaattacaaaactcagcaaaaaaaagttatcaattttgcccgtgcacaaaactcaatcagtaaaatatttatcagttttgccaataaactcgccctatgtccaacaaagaatgtaattctaaaatttaaaatttgtcctacaaagcagtggcgaagccaccgcccagataccacaggcagccgccccgctcgctgtcaaacgttccattgaatttttagctcttgaaaggattgaccatagaactggatatagtttgagttttgctcagggttaaaaatctttctggctcagctatactatagagactgcagaaacttataggagaattttaactcagcaataaattttgaaagagtgcaaaaactcatagcaaaatttcaacttagcaaaaaaaaaaaagaattgtcaatgtctcaccctctgtccaacaaagaatgcaattctaaaatttaaaattagtcctacaaagcaacggcaaagccaccatccggctaccacgggcagctgcccatgctcgccgtcaaatgttccattgaattttcagctcttgaaaggattgaccatatttgaaagagttcaaaaactcatagcaaaatttcaactcagcaaaaaaaaattgtcaatgtaaaaaactgcaatgtctgagcgtgcaaaaactcatgggagaagttttaactcagtgaaaaaaatgtcaatgcaaaaaataagagaaattttgcaaatacaaagaagagaatttttgcaaaaactcataggataaattttaactcagcaaaaaaaaaattgtcaatgccagaagagaaattttgcaaaaactcataggataaattttaactcagtaaaaaaaaagtcaatgccaaaaaactcataggctaaattttaactcgagaaaactcatatcattggataaattttaaatctcaactcaaaaaaaaaatcataggctgaattttaactcgagaaaactcataactcttctcataggataaattttaaagtttaactcaacaaaaaaataatgtaattgcaatgtctgagcccataggataaattttataaagtttaactcaataaataattgcaatgtctgagccaataggatgaattttttaattgtgtctgagccaataggatgaattttataaagtttaactaaaaaaacattgtaactgtgtctaagtccaggttcgaactggagacctttagtgtgtgagactaacgtgatcaccaactacaccacccagacctttttgtttatataagcatgcacattttaaatcaatgttaaatcaacaaattgcagaaagcaaagatcacggatacaacgcagacgctgtcaacagtcaaaatctgttttcatcgttcatctaacagccgcacttttgccggagtgcatcggccagttgcttaccttttctttgagacccagcggagagcatgctccatccataaatatctggattgcaacagtaattgaagtctgcaacttcctcccaaccatgcatgtgcatcgatctctgcacgatctgcgcgccgcgacctgacaagcaatcggtgcatgcatgcgcacgcatctcggtaagagcaggacctaaatacaaggccacaatagaagaaaacaaacgggaatgcgtcttttgtgcatctgaggctggtccgtgcatgttaggggcttgctattggtgcagtagctattttgcctatttgatgtgttatcacacacgtctctataactgtcatgtagtagtagtagtagtagtattcatttttatacagatcgactgggcaaatacagtgcagaaaagttcgaatcaagcagcgaaagtatggtactccggccgtatacatactactgaaactgactcaacactttggacacagatcgcctaccttcaccctgcacatgttgcagcgtgcaaacgcaatatccattgtgctgaactgctgatctccgttgtctcagctaagatgccatacatactagtaggaactactgtatcaatctgaagtgcatagggggcaacatcatttacatctggtgaacacaaggcgacaactcaatcacatgaaaacttatcaggtctttaaaaaacttggcgatactgtgacggtgtgaccggagtaggagtaccacctggagtacatagctgtacatgtattcccgtaccaaaagaacacagctgtagcttttcttttttggcaaaaaaaacatgccatgtataaagcgatacttgtcacaacttcatatacaatttttaaatctagtatctttagctcaaattttgttttttttagaagtaatcgggaatatactaggttaccctattttatgcaagaatctaataatcccatcatttcacttatgtttatacttatataagccaaattttgataatttttttacttaattttgtgatatttttgtttcatcgtagtttattttataacatctacttttgaatcgctaagaacatgtctgtaaaacatttagctatagattattatttttagttaatgataagccaagtgaataagcataaacataaataaaatgatggggatgttattattggagatttaaagccatgccaaacagatcattaaaaattgttgattgttgaaatgcccagacttcaaactatgtatgcgctaccatttatttttctatcaagagggtaaacactaatgcactttacacgctcatgaacttctggcccataataaccttacacttcgtaccacgatggtcttaatccaattctttcaaattactcatctggttagtaaaatggattatttattttattctttaaaaaaatgcatttttaaaaaaaacctttattttatcgcaatgctaagattattgttttacactatttatcaagtttatttcttaaaatatttaacataacttataatcaaatcgagcaatataatccactcaaatcaaaatcaataaaactatagtattttccctatttctcttgggattcatctcgggattaatctcagatgtagatcgaaatgctatacaagctaggacgtgtgtgattttagtgcgaccgtgtgttaaccgtgtattggaggtcgatctgcggctatccaattttcttaccgtggagcacgtgtgctatgaaacgactggctgtacacgtttcaacattttgtcttctaccctgaaaatgtcccaagtattacagtatttgatattgatttttttgtgggaagtgcgtgttatggactaatgattgcattgtggagacaacaagcaccatccgtcgtccccgtccatggctgatcagataggacacacctacgtgacacgtatggttccaatgatagacggcagcagcaagtcaggaacgtttgatcctctgcacgcagagggtcttacgaatggtacggtgtacgtgtgtgtgggagaaacagagaggagacgaggacagactggagcaatggagtggatgaatggagggtagacaagtgtgtatttatgtggaacacacgatttgtcaatatccacgttagctagcaaaagcaccacgaaataaacaccttaaaatctgtcatcgtcgtatcatgcatgtcgaatgttttggttgcaaccgattgaagtaaatgaatttaggaatttgtacgtgaaaacggtaggaataatcttgttaagtatatctccatgaaacattctttatgtccactatctcgaaaataagtatatttttcattcgtgctatacatatcaaataaaaaatattatcatcattttatcaaatttcaatataattatttcatattttatctactcccaatgctttgccccatgcttttataaactctaatacaacgattgtttaaaaataaacttattttagaataaacaggagcgaataaaaataatcttatttcgaaacagtgatgtactagtttttaggaatttggtcagtatttcagttcacagtttatccacaattaaaataagtggttactgtggctgggcctgcgtgagctgggctgactagagagagggagagaccgcaacacagaagatggcgatatttttgggagcaaaccgctgattccacagatccgggagcccatgtggaaagcgcccgttggcggttcggcgatggttacgggccatcacggggtccgctcgccgcagacgatcgcggcggcgggcgggatctcgccacacacgtaatccgacgcccgcgcgacgggacgggacgcggctacgggctaccaccacccatccccaccaccaccaccacctcccttcctctcccccttttaaagccgtcgcaccctggcggtgtgtaagcctccgcccctccccgtatctctcgcgtttctggtctaagttccacgccacttgttgccgcattccttctccctccctgcaaatccaatccaatccaatcccaccccaagctcgcggaggaggaggaggaggagatggggagaggagggatcggcggcgcggggctggtggcggcggtcgcgaaggcggacgtggagaacaccgactccacccgcggcttcgtcaaggacgtgaagcgcatcatcatcaaggtgagtgaacgagggcgacgtgatgcgcgggttgacgatcccgtcagcggcgtccggcatgcgactgtgtcctcccttcctgtgaaacctgccgttctgccgttgttgttgtttgttgtttcctttttttttcagtgacgatagtttgtttgcgcgatctgtgatcggtgaaactcgaggctctctcgatctgatttgcgaaggatcggagaacctgacaaaaaaaatggccttacaaactgcaatagatttatttcattttttgtttttgggagctgcagcatgcgttccaaaggagtggttctaatctattcttgtgtgctgttcatgttcgtacttacgtttgatagattcatacaacgcgtgaccataagaagaacagcagtagtaggtaatttttagtgaatttttatgagctccattatgacagcatatgctgtcacccgtgatttgtcctttttttctattttttttaatttaaaatcactatggctatatttttatgtttaactctttaccattcatacgttttttaggtttaactatttaccataaatatgtttttaggtttaactatttaccactcattaattagtaccattctctaatgaaggatattattttttttccctctaaatatatgttctgttggctggcttaattcgacaggtcggcaccgctgttgtgactgggccgaatggccggttggctatgggcaggctcggtgctctgtgtgaacaggtaaactttccccccaaatttttttaccagaggttaatgctctgaccaaccgagcttgtgctaatcagtgtcagttaaccggtgtgataaatttcccaggtgaagcagctaaattttgaggggtacgaggtgattctggtcacctctggtgctgttggtgttgggaggcagaggctcaagtaccggaagctcgtcaatagcaggttgcagagagttaattggctctgaacagtaaacagtgttctgctgtagcattcatttctgatctctctcttgcttgcagtttcgctgatctgcagaacccacagatggacatggacgggaaggcctgcgctgccgtcggtcagagtgtgctgatggcgatctatgacacgttatttagccaggttggcgtgccattcctgatggatttttgtgtaaaaaatatgatttttttgcatatattttgacacgttaaacttccttcgctgcagcttgacgtaacatcatctcagcttcttgttacggatcgtgattttatggatccaagttttgggaaccagctccgcgagactgttaattctctgttagatctcaaggttataccagtatttaatgagaatgacgccatcagtaccaggaggcaaccatacgaggtgtgtttcctaatgtgatttgtgtgcactgggagcttcactgatatatacgtattccaaattccattaacaacaaacactaaccttttacactttactgattgtaatgatcaaccgtgtgtaggattcatctggcatattctgggataacgatagtttggccagactgttagcgcaagaacttaaagctgatctccttatcatgctcagtgatgtggaggggctctatagcggtccacctagcgatccacaatcgaagattatccacacatacgtccatgaacaacatgggaagttaattagctttggggagaaatctcgtgtgggaagaggtggaatgcaagctaaagtagcagctgcttttactgcttcatcaaaaggaatacctgttgtaattgccaggtgagtaaagcttgttttcttctatcgttgcatgaattgtagcacaaatgttaaccaataaatatatgtctaaaagataatatactgcaactgcaacaacgatttatattatttttcagtgtataagaactatatgttctacttatgatggttagttacactgtcacgtggtgttgtatttgtacacaagtgtttacacattgactaagacggtaatattttgatattttggaagcactttcctgataataatagttgagaatggagagcagctgcatgcctgcatcacaattttgttttagaaaactcgtggactgctttagttgctactattaaccacctgtacgaggctctggtagagacagtattcaatagtatcaaagtgctgcatcttaattcctacatttggtgtgttattatgaaactagctgggtagcccgcgcaattgcgcggctagcacctaaataaaatcatataattttttagtatgattttacttaaaatttattaaatagctatctcatgtcttaagagtttgaaagattaaaccttatcatccccgtgtttctaattatatatattttttaaaagtcacaccagttgctaccccttatgacatctccttctttatttgcttgctcgatataccactatttctattcattctccttgaaacctttaaaaattagatcttatagtttttagagtttattgtcatgttgggtttcgtttttataatttctagacgtcccgtcaaacgttgccattatactcctctatggcccgtctactgtctcttttctttattgtcattgagattttaaaaatcgaacataattatcgtttcggttcatttttactttctagaaatcccgccaaaccatcagcggcttttccattgtacttctctacggctcgcccgctgagtcccttctttattgtcattgagattttaaaatcgaacatgattatcattgtttttttttaccttttcgaagttcggaacctttaaaaattgaaccttgtagtttttagagtttattgtcttgttgggttttattttttataatttttagaagtctcgtcaaacaatgccactatgctcctttatggcccgtccgccgcctactctttctttattatcattgtgattctaaaaattaagcacaactatcgttgcaattcattttttattttctagaagtcacgtcaaacatcaccggctctaaaactatactactatacaccccgcccactgcttctttttattgtcattgagattttaaaaattgaatatgattatcaatggggttttttttttactttctagtagtcccggcaatcacattgctcgtttgcttcacggcctgcctatcgtccctccttttaatcgttattaggattctatttggtgttttattaacagtttttatatgtcgtatcaaccgccaccactctactcctttataggcctcttacttaatttatctcgtcatgtgttttagatggtctttctttaaatagtctttatttttatcacaaattttagttatttataaattgtattcctaattgaaatcttatttttctttttctaatttcagaatttattttttttcaaattttaattaatatcgtattgtgttattttagtatttttattttttattttcaatttcagttgtttcaaaattgtattcctacttgaactctcttttagtttttctaattttgaatattattttattttttattctgaattttaattaatctcgtattgggtttttatatggattcttatttcaatattgcttatttttaattccaaatttaagctaattttaaattgtattcctactttaactcttctttttttttgctaatttcggattttatttttttattcctaattttaattaatctcgtaattgggttcttatgtggactctttttttaatattccttattttaattccgattttcagctattttaaaattgtattcctacttggactatccttttattttctaattttgttttattttatttttatttttattttgaattttgattattgggttcttatatggaaacttctttcaatattgcttatttttaatttcgaatttcagctattttaaaattgtatttctacttgggtctctttttttctttctaattttggattttattttatttttattttgaattttgattaatcttgtattgggttcttatatggaaacttctttcaatattgcttatttttaattccgaatttcagctatttttagattgtatttctacttggactctccttttctttttttttctttttctccgattaatgtgggaatttctagcctctacagcgaacgtggttccttctttcaaagctgtaatttattataaattaaattttagttgttaaaaataatatcattggatattcatttaaatttaattttatatgattatgattttgttgctacaatgaaaaatttaaagttaaagtttagtttttaagaccgtactaaatttgaacacgccttagcgagttggacggagagatgtatctctaccaatgcataagttttctggtctattttctctttttttcatccataggtaaaaaaaatcacattttaattctaattatactggctccaaaatatatatgcacgcactgtgtttgaatcctaatcacctgatttgttgattgatccttagtgtccatctaggataagaaaagaatcaaagcaggagtacgtccacctatttggacttgtattctagtacttgatcagtgtcgtccgtttgatctagcagttgttttctattcagacttctattatcaaagttaatctacaccatcaaattctagtcccagtataatctaacggtctagatttttcttttttctccgattaacgtgggaatttctagcccccacagcgaacgtggtgcctcctttcaaagctgttttaataatataatagatttcaagttgtcagtaagacagtaagtaggaaagcttgtgtgtattttcccaacagcagtcttgtgattcaactctgctttctaactatttttattatccatgaagtggatttgcaatcgatagcattattaaggtcatgcgaggagagaaaatcggtacgcttttccatagggaagcaaaccagtggggttgttccaaggaagcaacagcgcgtgagatggccgttgctgcaagagattgctccagacatctacaggtattctttcctttcacttccttttgtgaaggaatcaggcaatgcaattttcaagctataacttcaaaaaacaatcaaataattgcgtgttttcttcatgtcatattaaattattacaaaggcatgtcgtcgtctttaagtagtataaatatcaatattgtttattttcttgctgcctttgctaactacttgtgttgcatgtggtcacctaaacagaaattgtcgtctgaggagcgtaagaagattttgctagacatcgccgatgctctagaagcaaatgaagatctaattacatccgagaaccaagctgatctggatttggcgcaagatattggttacgataaatcattggttgctcggatgaccataaagccaggaaaggtaggccagatacatgtgccatcttctgagcggtgtcatctttaagttcattatttgttgaagtgattcttggctgttgtatgaaatgtcctcactatatttaatatctattcgaagataaaaagcctcgcaggatcaattcgtgaaatcgctgatatggaggaccctatttcccatacactgaaaagaacagaggtgaatgcatataccctattctaaaatccaaacacgatgtgataagtactacaatcaatcaatgtgataagtactacaatcaatcatagcttcatgtgatttgtaaccaatgaaggacttgttttgtaggttgctaaagatcttgtttttgagaaaacatattgcccattgggtgttctcctaattatttttgagtcccgtcctgatgccttggtacaggtaaaatgatttttttagttggaaagaaactgtatcagttaactacaaagcaacgttatttatcatattaacataacattgtacagattgcatctttagcaatccgaagtggaaatggtcttctcttgaaaggaggaaaagaagctatgagatcaaacacaatactgcataaggtattatgtacttaactaactgatttagtagtaatgattaatgaagcaatagtaggcttcagtaataccaacatgctgtcttttattaggtcataactggtgcaattccagatgttgttggtaaaaaacttattggcctagtgaaaaacaaagatgaaattgctgatttgctcaaggtgagtatgtaaagtgattctttgggtgataaatttaagaatttaatctaaaccagaagtactctgtgcagcttgatgatgtgattgatcttgtaataccaagaggtagcaataagctcgtttcccagatcaaagcagcaaccaagattcctgttcttggtcatgctggtaagcttgtttttgttattgaattcttgtcactaaatattactagtatgataatggttatttattttgcataaactaagcataatacatttcctttttttattatgatatacattgaatgaatgttttttttcttctacagacggtatctgccatgtttatattgacaaatcagctgacatggacatggcaaaacgtattgtattggacgcaaaggttgattatccagcagcgtgtaatgccatggtacttctctaatttacaaatttattagcgtgtgcccatatggtgatacctctctatttattgtacttttttttaaaaaaatgtatattacgaattgtatgtgtgttctacatcgttgctggccactcatgctaacttacaagtattgttgtcgaacttctggctaaaagcaatagttcactgtggaagatgccattctattcaagtctaactttctatatttgtccacttaatttatttcttggaaaattttatcatttgagcacagatatctaaatattttttatattctgtgcaggaaacgttacttgttcataaagatctgaacaggacagaaggccttgacgatttattggtggagcttgaaaaggaaggtaaaatccacacccttgtagttgaagtattgcagccatttgtatcttgacatgtgttctgcaaaaagtgctacttcctccgtttcacaatgtaagtcattctagcatttcccacattcatattgatgttaatgaatctagacatatatatccatctagattcattaatattaatatgaatgaggaaaatactataatgacttacattgtgaaacggagggagtattttattttattatgagaaatgatgaacagttatgtagctcaacatcaaagatttgatgttcttaattactttcaatgcttctcaagggagcatattacagattttacttattatgttgcagtcaatccaaaattgctttgcaacacgagttcttgtgcaaatcagcaaaaggggatcagaagagcactaatggattttaattgatgtcatgttgcaggggtagttatctatggcgggcctgttgcacatgacactttgaaactaccaaaggtagattcatttcatcatgagtataactcaatggcatgcaccctcgaatttgttgatgatgtgcagtcagcaattgaccatataaatcgctatggaaggtatgcagtttttctccatactatatcctcatcactttttttttttggaagtatgcagtttttctccttactatatccccatcatttcttttttttttttttgaactaaacttgattgtgttaaatatatgttcatttcagtgcacacacagattgcattatcactactgatggaaaggcagcagagacttttctacagcaagttgataggtgtttaactaatttcctttgcacaactattatgtttgccgcttttagtacataccttaattaatggagttattcttctataaattgcaacagtgctgcggtattccataatgcaagcacacggttctgtgatggggctcgctttggtctaggtgctgaggtatgtcctttaaatttgtatcactttataacttggacattttcgttaactagttatcaaaaaaaaatagttatcgaaaatatatgttgttactattgaatggtcagcgtttcattcagtcccctattttctttcctttatcaaatataggttggcataagcacagggcgcatacatgctcgggggcctgttggcgttgatggactcctaacaactcgatggtagggttatcatgccatattgtcttcatgtccaaacattaaggacaatactattgtgcaagatgttttctgcatctagcattttatcatcatacaatattttttcagctaaatgttattatcatactaaacagatggaaaaaatcagtagttttgtatttactactagtatcttcatgtaatatgtgtgcattggtttttcgttatatatagcattttacgaggaagtggacaagtagtgaacggcgacaagggagttgtttacacccacagggagctccctttgcagtgaggtaggtagtgttcttttattttgaaagatggcatactactgattactaaccttcaacatctctggtttcaggtgaagtggcttgtgaaggagctgttgtagagcaattttttgcagacgctcaccgtgctcctccttgagagctgcttctcttcatgacatgcaatgggagcacgaaagcatgtcaaagcaggaagtaatgaagggcgaagtaggtcagaaacttatagtactatgtactatggtgttgctacgtagttgtgtggtattccttattattcattgtaccatgaataatttatgccaatgtcgtagtagctacatgtaactatattggctttcatggacacgtctatggtactagatgtaaaactgctagatggctttagatgaacatctcagatttattttccatagaatgcacatatgaaagtacctgagcgtggcgacgctggtgctttccatgataaagatctggctggtgtagggcggtctgctgctgaagccggagacatgcacatcgcagaagcctaatcatcagactggagcctcaactgaaccatcccgtatctgatctgtttagataaagacagttatattagaaatcgccaataagtctcggacgaaaattcccagcatttcacaacttaagaagttcagaattctagcagctattcgtaatgcatcccattgcagtattgcataacaaattacagagatgaatatcaatctcccagctcagggcctctaaccatgacagatggtagatactctcgtatcagtgtcaacattaggtggggatattacaatattacatccatgtctggtatccacagtaccatcaccattccaaatgtgtcaggataccgttactactactgatgtgttaaacagggatccatcacaaatgtatcaaaattgtctggcagagattccaattctctccaaacaaacaactcagcaatcttttgaggtacctcctgaaagactgagtcatgatggctagtctaatcaatatgttaggctatacaacaattcctacgtcttcagtggttattctgtataaatcagtaaagctcccaaaaaacattaatagagtccgcagcatcttcaccaataatccccacatgaacaaattccatccctgaagtggtgaaaccgattcacatccctcacaataatctctcgctctgcatatttggagatgaacttggtgacggaatgacagtcctcacatagcctgaggttcttggtgatcctgatgacttctcccctgccagtgttgataagcccgaaggcaacagctagcttctcactgtgcccaagcaaaatcttctccttctcttcttcttcaatatcatacaaaacagctcctgtgtcaggcacatagccatcattcttcatctgtgtcacaaactcacctatcagagcttggagctcctcaatctgaggattcttgttgtccacagagacaaacatgtgcaatctcttcttcacctctatccagctgcatccaggcaccttctccaacgcatgctcctcaagaagatcctttagcacaccaacttcactatgcaacttagctcgagcatagatatcagcaaggagtacataatttccagcatttctaggctcaagatcaaagagttgtgagcaagccatctccgcatactccacatggcgatgaatcctgcaagcaccaagaagtgagccccacacttgaggactcggcctaatgtgcattccctgtatgagctcaacggcttcgtccaaatgcccggcacgaccaaggagatctaccatgcaggcatagtgctctgcacgaggggtgacattataatccaccatcgactcaaacagcctcttcccctcatccacgagtccagcatggctacaagccccaaggacactgataaatgtgatgatattgggtgaaacgcccatttgggtcatgtcttcaaacacctgaaccgcttcatggccaaatccatgcatcccatatccagatatgagtgtattccatgacacaacatccttccggtgtcctattaaatcaaagatatgccgcccagcttcaagacatccacatttcatgtacatcgccatcaatgcgttcagaactgaaacaagtgagtcaaaacccctccggaggatatacgcatgcaacaatttgccctgcccgagagcgttaactccagcaaaagcatgcaagatgcatactattgtgactgaattgggtacaaggtcttcatcagaagccaccatctcctggaatagcaaaatggcatcacctggtctctcgttcttggcatagcacccaatcatggcagtccacgacacaacattcctctctggcattgtagcaaacacactctcagcatagctgacgattccaagctttgcgtagcagtcaataagagtggtggcgacatgtgtgtgcaatccgtagccacgacggacagcatgcgcatgtatctcgcgtacgagggccgacgccggcacatgagacgttgatgcggcaatgcaggccttgagtccgtgcgcgtagctgtagctgtcgaccggaacgcggagccgccccatgtcagccaggcgcgcgagggcctcctcgccatggtcggcgagcgcgagcgccttgagcagcgcgttccacacgaagatgctcttcacgggcgcctcgtcgaacacctggcgtgcggccgggagctcgccgagcgacgcgtaggcgtcgatgaggcgggtggagaggaacgggtcggagcggaagacggggtccgccttgagccgccggtgcacggccgcggcgagcgccgcgtccccggcccgcgcggcggcgaggaggaccgacttgtaggtgcgctgcgtgggcgcggggaggccctggaggagcgccgcggcgcgcgcgaggcggccgctggcgcacagcgtctgcacgaggtggttcgcgttcgcgggcggcggcgtcggcggctgggacgcgagcgacgccacgcacctggaccgcgacaccctcgggcgcgccctgggcccggccgccgggcgggagaggtggaagagggaggcgggcggcgaggcgggcgcgggggcggacatggggtggaggaggcggaggcggagcgtgcgcggcgcgagtggcttcaccgtgttcgggatatttttccggtgcggtgtggtcggagttcgggcagcggatggggagagaggcggaggcgcgccgcggcggtggagaagcgtggggatttttgctgtggtagtgacaggccgaccgttgatgggctacgcaatcttttgcagtttgttgggctgacggattgtggcatgggccggaatggtgataggccgcttttgcaccgtgttttccaaataaacaggtccaaacagaaaacacctcggcaatgataggataggatcatagtagtaggagagaagaagtctggaccgctggtgattaggcaagtactataacgatgccgatagcttttgccactgtcatcgattaatcattattcctatttacaggttctagttttggtggctggctgtctcttgtacaagaggtactgtctacggattttttttttttagtgccatgtcaatgctagtagtaacagaaactgtactgaacatgggcatagagcagcatgaattgataaaaagggttgtgcctgacgggaaagccagggtgccgcttcccatgaccaatccccctttgatgctctcgcactgcgctgtgtgtcatttccgagaaaagcaattattctatgcagcaaacagtatgtacatgtcatttccgagacaaaagcagcagatgtgccactgccactgccactgcaattgttggatagtggtgggagcagctgcagctgagagagagccaccggattgggcgagatatcgacaaaaccaaacaagcattttgaaaagcgttccaaatccaatgagggatcaaatcagccgtatcttagagtggaaagaacatatgcttaacgagaatccatcatcacagattagattaaggaaaggtctctagtagtccactgcctcaacttttgctcatgtgccccctgtgcccatcctcacaagaaaaaagtaaagttagaaacaaaattgaagctttgctttcaacaggcatgtacctggagaaggaagcaagcagaaggcctgtgtaccgaagctttctacagtgccagggtgagaactcagaagaggccatactatctgcagagcttattgaattgggataccatagctaattttataaaaaaaaataaaccagtagtactatatagttgtatttttgtcatgaagtagtaacagtgagtaaattagcaggagcaaagttgcagcataacaggaggaacaaagtagatattactattccgtaatgcattctttgtccaaaacatatattccgaaattgacttgtgctgatctaaagttgacacgcacacacattccgggcttttccggcttgctttgatttcgttgcgagatgagaagtgtaatactctctcctgtttcataaattttgacgttttagatgagattaagataaaacttttatttgatcatcaatatctttaaaaatatttagtttaaaagcactataacatcgtagatagatctgtctttaaaaaaaatgtaattttttttgttatatatatattgtaacaaaaaggtaaaaaaaacataatcaaggacatacttctaaaaccgtattatatattgtccaaaaatatcaaaagttaattggagggatactagtacgaatactggtagctttgagttactccatgcctcacacgccacacatgtgtagttacagtggtcattgcatgacatatcgaaagaacaattatgcgcctcatccaccgcctgacgcccaagaaaagaagcagcagtgcctcttttcaaaacatgaacagtgcttgcagtacctgctacaccttctttttttagggagttgttgtttgttacagtaccctgtgacgtgcatggattcccctccaaacgaaaacaacgtgcatggagccatggaagaggggtccctcccccccccccccttttttcttctttacttaaaaaaattttaaccttaaaattctttttacatacaactcctcaaactttattctttaaaaaaattttcaattctcaacccttcctttaaaattatatacaccttttatattatctacaatata

SEQ ID NO: 71364 - DNA, 1094 bp, Oryza sativa
ttaaagcaagaataatgtatcaaacaaaggcctaacatatttagatacagcaatatcttgatataaagggcagatttaacatatcaatgaggcatatagaataaatatagttaaatcagatacgatcggctgaaactccgatgctattctaatcagcaactagaaggcaggctagagatcgatattctaagcacgacttaatagatcaaactcaactgatgcagcattaagtatgaaaaaaagaacgatatctagacaatcaagccgctagaagtttcatagaatggtagatatctcatataatctagatcaacattaatatttaacctaatcggctaccctctattaacagatattaaccgatggcaggttagatgatgatattgctagtgattatataagacatatgataactcgacgaattacataaacgggattagagtatcataaagatggaagcactaatcctaagaacgcaatccgtcataacgaattttacctcttgttgaagatcgaaatcgatgcagctcaacccaaaagcaagaactcgtcgaaacaaaactaaagcaaaaagggtggcgatgcgccaagattgtattgaacgtgtgttgttaaaaattacatagggctcggggtctatttatacccaagaattacaagatatgcccataccggacacgactattatctctaacaaactctaagattccataagactttgcggcagacttttgcccatatttatctataaggaatttacataagatatcctaattaatagatacaattgccttcccaggactctatccgtgcttggcaatcatcttgaagcacattaacttgaacccgatgtcgtgtacaagtcgtattgtcggaatcggttgtatcggcttacttagcccgacttagacccagtcgatcctaaccgtagccgatctggactccggccgattcttgctctgtttccgaactcgatctccgcttccgacttcgttttgatccaatcctctttcctgacacagatgttactaaatttagttgttaacacatgccccccaagtccgagatattcgataatgttccgggtttgctgt

SEQ ID NO: 71365 - DNA, 868 bp, Oryza sativa
agagcttgttcaacggatggatctagggtaagcagatcatcggttggcttggttttctttgtcttcttcttcttagttggggctacgaagcttacagccgacgatctggttttcctctttttgccggcatcggctggttctctgacgagcccttgaagaagagctgaggtcttgggggcatcatagccgataaccggaggagatagcccacctccatttggaattaaacctagggtatattggatgtctttgccattgttgctttgatgaggaggggaggattctgttgtctgcaagtcaaaaggaggattagttgagattaattggccaaacagttatttaaatgaaattgagcaaagttgaagacttacttgagggacaacatctggaaagaggtctgtcatatacattgaaactggttggtggaataaatgcagtttccattcaccccaccacctgtcaaagcttttgcttctgaacgttgccagttctatgttgtcaatactacccagagggggtccttgaaggctaagcagccgatccatcatcagggtcgatgaaattcctcctcggcattggatcttgtcggcaaagaataagccgattgggagttggcccattccaagttgtctacctgagctcattggatgatagaattcataagaagcttcgatgtttcttccttgatgaatgccaacaggaaggatgcatgggctaattgcagttgagaaaatttccctggatgattggtatagttcatggttgatgtcttcaaatctgaagtccactgggtgttcaagttcagcagagttctcacaaagaaaccaaactcaagcatctttttgaaagccttcatagaagttgcaaa

SEQ ID NO: 71366 - DNA, 585 bp, Oryza sativa
ttgtaccactgcataacaatactattgatgcttcacatatgttcatttaacactcataattcaaccattactgcatagatcgcctgcacagtgccgaaattaatactaaatcatctgggaattgggaatctgtccaagatcaatccacataggagtacataggtaaccaattggatgcgatccgcaattaaaagttttgacatcaagaacatctacttcatctccccataataattgggctgtagctcttgggagtaaaggccaggatgctatttcattccattatctaaaaaaaatctccccccacaaattaccggtccactgttcccgcatcgggcatgacttcacgcatttatatagggaaaaaaacgcagaaacgagaagagctcatcgaagaagaacaagagcgcacctggaggcggatgacgtaccactcctccctctcgatgtagaagtcgttgagcttctggagctccatgtcgaggaccctggcgaaccagttccccagggcgatgcccccatccccatccccatctcccgcaggcacctccgccgccgcggcgacgggagggggatctccatcgg

SEQ ID NO: 71367 - DNA, 538 bp, Oryza sativa
catccactgggtgccgagcaccatgtcgtaacctgcaagtggaatgacaaagagatcgacggtgaagagcgagccgtcgatggagagcacggcctgtcggatgacgccaggacatgcgaccttctcgccattggccacagtcgccgtcatgcgtgggcgtggctggaccggcagacccgtgcggcacgctgcctcctcggcaatgaagctgtgggtggagccgctgtcgaggagagcggtgagggtggtggcgccgacggtcacctgtacctgcatggtgtcggcgaccggtacgccggcgatcgcgtggagggagaacaccggggactccaagtcctgcggttcctcagccgcgtcggtgtcgtcgtcgtcatccatagcgcagtccaagaggaacaagtgcttgcagattttgttatggccacggctgtacttctcgtcacagttaatgttgagattatgggtatataatgatttaatttattccataaataaatcatgacattacagatgaaaactagcatgaacgcctcattag

SEQ ID NO: 71368 - DNA, 5138 bp, Oryza sativa
caaaatgcaactcagtgtaagctaaaatgaagggttgattacctaatggattttggattttcatttgcacatttcccaagttcctaaatgatgtgtttcagaaaaagaattatgtatatattgtttcctaaagcactttttccagaacaggggtgaaactagaacgaaaattaccaagtgtgccacacttgtataatattatgtaattaatgttctagttacatgtgttaatgaagaacatgctttgggcaaatcattttagagtctacgaccatgcatgagaaaggagcaatgtggtgttgccctttaggtaaactaaacaaatagacaaatattgtctatatgattatcacaagatgattggtgagtggaagacactactgagcaatgagtggacatagagtactgataaatagcatatagccatatatcaactatggcatgacgtgttacttttttctttgattccgagtagacaaaggcaccagtaaataaggagaaaaaaaaaagcgaaccatagttttttaagtagtcatattttttaaataagtttcattaattatgatgatataaattatattgaacttattgattataatttacatgataaaactatattctttgatataattggactacatgacaaaagcaaactttactgtagaacacttcaaaatttataagtacactacacacactaatcaaatttatacactattgatcttatttcaaacaaatgttgtttcaaagaaaacaatcaagcatgaaaaaacaaagtaattagcttgaaacaattgctaatattttgcattaccagccaagcaattgtgtgggtgttatgtgttctaacatacctttaaagttcttcaaaactgtgtaaaaaattgaactagttgaacttctacgtagaaaaaaaatccaacatataatctatccttaatttggttgtcactgtatcatgtgccttcatgaaatgattcaacacaaagaactttgatttccttagtctcacaagttttgcttatagccatattacactctatgtgtacagatggtagaagtgataatgtaacaccctgaaaattcgaccgacaaaatcaaaactctaaaaatacggattttcaaaaactttttaaattaattgcatcatgccgatcttattcgtctattttatctggatttgatctcgaagattattaatcgtgagtaaagaatagttaattaggaataaaccttacaaacaaattggtaaaataaatacaaattaaaataaagattaggtgtggacagaaataaataaaatattatcgcgaccatatttggatcaattaaatttaaatacaatggaataagaattaaccctaattaaaactcaaataaattatataaaaataaaatatgagtaatattaatctagggtgaattcattagttaagataacacaaatattgagtaaaatgcacatatgcaaaattaggaattgtggaatcaaatttatatggaaaatacactaaaatcgggataaatagaaaaagtcactattcatcggccgccaggtgttcgacgtggtcccctaacccagctcctcctctttccccctctctctgccgccaccttcaccacgcgccgccgcctcgcgccccgagccaccgcgggccgtcgccatcgtcgcctgccgccgcgccgccgtcgccatcgccgcctgtcgccgtcgccatcccatcgccgctgccgcgccgtcgccgtcgcgtcccgcctcgcgccgcgcgtgcgtcccatcaccgcctcgcgcccagagccaccgcgcgccgtcgccatcgtcgcctgccgccgcgccaccgtcgccatcgccgcctgtcgccgtcgccatctcattgccgttgccgcgccgtcgccgtcgcgtaccgcctcgcgccgcgcgtgcgtaccatcgccgcctcgcgccgcgcgccaccactgccgcgcagtcgccgtcgccatcccgtcgccgcgcgcgcgttccatcgccgcctcgagccgtgccgctgctgcgccgcgtgccgtcccgtcgcctcgcacccgctgcctcgcgccccgcgccgctgccacgtgctgcgtcgccttgcgccccgagccgcgccgcgccgtcgtcatctccgcccgcgcgccgcgcgccgtcacatcgccgccgtcacctcaccccccctccaccgcccttcccttctcttccctctcccccttatcctctctttcccctataaaggcccaccattctcccctctccccactccatcccctcctcctctcccttttccctccccatctccacgcgtcgccgttgttgtcccgccgctccgccgccttcgagccaccgcgccgccgccacgaagccgccgcgctgtgccgcgccgtgcgccgtcgtcgccgccgccgtcgtcgccgccgccgccgtcggtgagtcgctgccttccccccctgtttgtcgccgtgccgccgggtagagagagagccgagggagagggaggaagggagaagccgagggagagaaagaagaaggaacgaggagagaaaccgggagggagagagagaaggaaaaagaaaagaaaagggatagtgagaaggaaaaaagaaaagaaaggagagagagaaagaaaaaaaaagaaaagaaaaagaaaggaaggaaaaagaaaaagaagggaagaaaaagaaaagggaaataaataggaaattagagggagattagggaagttttaaaaatttaaaataattagaatttagttatagattagttatagtcgtagaattgcgaaatttaatataaattatggattattcttggtaatttctacaagaaatcaattcgcggtagtagtttaaatgtaattaagaactaaacgattagatgaattcttatagactattatagattattttgggtaatctctataagtaattgattcacggtagaaattcggacttaatcactaggaattttagacgtatattatatttagtcgtttagtcctagactaaaattaaatcgtataatattataagataatttttggattccgttcgatatttagcttgcgatagaaatttccaacctattatatggatataacgctcgggtagattaaattaaaaacttatgataacaaaatatttatacccacaaaatagttaggatatacaaaaagaaattgggtttgccctagtacgcgaatagtaaagttaatataaaagaatcgactttcgcgttcgacttccatttggatttatttggatttttatttgaattctaatcgaatccaaatcaattttcgcaggtaactatagagcccgagggagttgcggatccaagtgaaggccaagacccccaagaccttgagcaaggcaagtcatcactattccttgaacatgttgatcctaattgcgaaattattttgtttataaataaaattgcatgcaatgatgcacatcctacttgtgattatgccatgccttgattattgtttatccatgtttacgtatgagtccctagtcaattatgacaattgcttagaaatgctattctaggatcatgcatactcatatttatcaaatgctaaatgcttgggcaattacctttgggaaggtaattgagatgcggcatgtggagacatgagcaccacattgccatgaaattgataacatgatttgtgaaaggaaaataaagcgaaaacaactgttttcaactggggcggacggatgatttgggtggtatctgggaaaggctagtaccgtccccggtcaattaaggaccgagccataaagttaagcatgaaacgacccccgtacaaccgtacttctcgaatgggtatagacctagcggattagatagccgagcggaggcagtatccctgcatagatggttcacccctgagtgaggcaggtgcgctacgatgggacaaccgttgaggtagagccgagaggcgtgccctacatcggtgtcgccgttggtagaactgccatgagtgtgtgagagagagaacttaacttgaaccataatttaatatgtgtgagacttctctttcccgggaccgccagaactcctcacactgctagaaacatggacgcctagagtgcatgaggatttaagttcatagagcggatactgccaatgcgaggttatcgaaaagctttgccgtgacgcgcctcatgtgttgagacgaggctcatgtgttgggcagtcgcggagtgcgagtaaagtgtacatccactgcagtgtgagtgaacgaaatctattcgaatagccgtgctcgcggttattgagcaccgggacatgtattacacttggctagtctctaaattcttaacttatgtgggatgggttgttgcatgacgaatttttatgctgttggagccacttcctgagaagggggaaggtgggcgtcctcagaaaaccataacgactcaatggcgggaagctatccttgggatcacaatggatggtggacagaaccgtcgttgtttaaatacaaacactggtactaaaatttgatcagtcaatgctaggtcttaggtttgtgaaaagaattacaaaactggcttagcgcaaaagagccatagccatcctttgaaatacccctttcatatgcattgttgctgtggtaacttgttgagtacggttggtactcacccttacaaatataaaattaatcagaagcggtagatgaagcttcggaggatccctatgcctactaccaggagggagatgaagacgatggcgctcagtaggtcttagtacggtcgttgcctgtggcaatggcatgccgctgcctgaattccgctgccttatctatttctgcttttggatgtattccggaccgctcggtccgatgatttaagacaatgcctgcgggcttatgatgtaataattagcactagactctcatgtatgtgcttttggtatttcagctatgaactcgtgtgtaccagactacttgatccagggaaatggtactgtttacacgaatgattcctgttataaaaacgggggtccacagagctggtatcagagccatacgactgtaggaaaagaccaaaaggcgccccaccccttttctaagttggccaagggagaaattcccatttagtaatactttcaaaaataaaaa

SEQ ID NO: 71369 - DNA, 4948 bp, Oryza sativa
actcctaggcggttaggtgtcgttcctgagccaccaatctacttgtggttggccgggagaagtttgtgaaggttggatctcacctccgaaagggaagagatacctttagtggaaggaggattgcttagtgcaccctctttaggaaaggggtagctaagacccggctcttagagagctcctcaacggagagtagaatcccctcaaggattcgaactttgagaagaacttcttgagcttcatctttggtgactttacttcctccctctccactagctttgcttgtttgagccgctataggtctagtggctgtttgtgctagcatattcttgttgtaggctcatccaacatggtcctcgccatctcaatgagagtcctattcttcctctcggctactccatttgttgagatgaatatggagccgagaactcgtgcttgatgccttcttcatcaaggaaactctcgatgcacgtgttcttgaactccttgccattgtcgtttcgaatgttcttgatcttgaggtcgaactcgttttgtgctcttcttgcaaacttcttgaagatagtttgtgtctcactcttgtcatgcaaaaagaacacccacgtgaagcgtgaaaagtcatcaacaataacaagaccatatttgttacctccaatgcttagataagcaattggtccgaagaggtccatgtggagaagctccaatggtcttgtagttgtcatcacattcttgtcgggcgatgtgctctaatttgtttgccggcttgacatgcactacacaccctatctttctcaaattgaacatttgttagtccaaggatgtgatcgtgctttagaagcttgtgaagattcctcataccaacatgggctagccttcgatgccaaagccactccgtgttggacttagccactaagcatgtctcatgtttggctttacttgaggaaaaatccacaaggtaaagctttcccttgagaacacccttaaagactaccgaggaatcattccttctatagacggtcacatccacatcggtaaaaagataattgtaacccatagaacataattgagaaacggacaaaagattgtagtttagagattttaccaagagagcgttggcaatggaaagatcattagagattgcaatcttacccaatcccataacatttccctttccatcgtccctaaagactatgttatcttgtgaagtgccatttggatcaagagttgaaaatattgattcttctccggtcatgtgattggtgcatccactatcaatcacccaacttcttccaccggagacatattcctacaagagatcaatttctagttttaggtacccatacttgcttgagtcctctcatgttagtaacaagtgccttaggcacccaaagtactctcttgatagaaatattcttgccccttagactaacatacttagcaacaacacgaccactagcattcttcctaagaacataagatgcatcaaaagaacaatgtgaagcataatcattaggaaggatacttttggccttaacaaaattgctaagaccttggggcctcttgatcatcacactcttgtccacctttccttttggtggaggaacatacctaagaccctcatggttgaagttgtccctttgatagcctaggtactcctttagggtcttactacccatatgccacttaagtaggccattgtgaaggagtcccataagcttctcattttgcttttgcaaagcactcaaagaaatagagttagtagcataagcttcaatatcaatatctttgcatctcacacatggttcattgcttgggacaattttggaacaagatggctcgctagggagagagacactattctttaaggtttcgaacttctcttcaagagtgaggtatgctttgtccaagccatccactctctcttgaagttgagtgttcgccacctcaagattagcatgagactctttggtttgcttgtaaagccgtaccaatgcctcatttttttctctctctccttagcaagctcactcttgagttcatgggaccgctctttctcacgaatgagcaaagcctcttgcctctcaagagttgcatattggtcttcaattctcccaagcaactcactcaagtgtggtagggattccttagttatggacttgaacaattcatcatccataacctcatcctcctcatcactaacaagatcaacattaaatgacttgagaggagaaggtaccttaggctcctttgccatgaggtaaacgggagcatcctcatcacttgagtagtcgaagagtctcggtggtgatgaaggcttgacggcgaacgtggcgactccttcttcatcacttgagcttgactcggagtcagagccgtagatcatcccaaagtgagctgggccataatgtaccctcttgctatgcttgtgcttctccttcttctcatccttcttctcactcttcttcttatcttccttgatgtgggaaccatccttgaggtgagggcaatccgcaatgaagtgcccgagctctttgcacacgtagcacactcttgcggagtgtcttccacttgacttgttggagtagtgcttggaagatcctcccttgaagaagccgcttcgcctcatgaacttgccgaacttcttgatggctctcttcatcatcggtctccaccttgctcttacacttgcggttctcttcttcttcttccattgccttcaaagccaagtcatccttcttgatgcttgcagttgagctttggttgatgtattggatgacatccttggactcttgcacgagcatgtcatgggcaaggatgcgtccgagcaaatcatgaggtgtgagagtcttgtagtccggacgctcacgaatgatggtcaccaaggtagagtttcttggagtgattgctcgaaccatcttcttgaccacaacctcatcggtcatgtccttggagccaagtccttgatctcattgacgatcttgctcaaccggtcgtacatgtcgcttgggctctcaccatccaacatcacaaatctctcaaattgcccctttaggatctccaccttggactcacgaacactatccgtgccttcatgcaagttccgaagcgtgtcccaaatcactttgtcactctcaatgccatccacacggttgaactcacttccactcaatgcgctaagtattgcattagcggcttgagcgttcttgtgctcgttctcgtcgtcctccttggtgggatcttcgggattctgcaaaacatagcatttttcgactattctccaaatagatgagttaatagacttcaaatgcatcttcatcttatgcttccaagcggcatagtccgtaccattgaagtacggagctttgccactataggtactcacataagatgtagatgtagggggatagtcataagggatcttagctcccttatcactatcgatcccctcccccgcttggcccgacatgatctctctaagcggttaagcctaattaggagattaggctctgataccaattgaaagtgtcaattaggcctagaggggggtgaataggctaattcaaaaattcaattaaaagcggaagcagtaattttcggatatttccgaaattttcggatatatccgaaaattttcggagtcagcacaaatagcaaagtaaatcctagatctagttgcctacaacaagaatatgctagcacaaacaacaactagacctatagcggctcaaacaagcaaagctagtggagagagaggaagtaagtcaccaaagatgaagctcacgaagttgttcccgaagttcgaatccttgaggggattctactctccgttgaggagctcactaagagccgggtcttagctaaccctttcctcaagaggttgcactaagcactcctccttccactaagggtatctcttccctttcggaggtgagatccgaccttcacaaacttctcccagccaaccacaagtagatcggtggctcgggagtgacacctagccgcctaggagtccttaacctccaagagtaacaaatgtagcaaagaactcccggagatgatgcaagtgctcacaaatcttcacgaagtcaacaacaagcactcacacaaactcgaatccacaactctcacacacacacaccaaatccaaatcgaacacgggtgagaggggaaacaagaaagcaaggctcaaaagtgctagagagagagcaagccaagggcacaaatgattggaatggaaccagcagccctcacaagtgagggggggggctatttatagccacagcccaaattctgcccgttatgcacaataattgagattttcggatattccgaaagattttcggacttgtccgaaaattccagctcagcaccaacagcaaagtcaacgaaagatttttcggacattccgaaaattttttggataagtccaaaaatttccaccaccaaaacatggttctggatgttttcggaaaagtccgaaaatcactttcggacaagtccgaaaatacacagaagcgatttctgcctttgctgaagtttttcggaaactctgaaaatcaatttcggaaaagtacgaaaataaacagaaccacatttgccttcacagtcattttcggaaagtccgaaaatgtctttcggacatatccgaaaatttccagaagcaaaaattggttctgtgcattttcggaaagtccgaaaatgactttcggaaaactccaaaaatttccagaacatatcaaactgaggggaaacacttttaaaaaaagattttgagcactttgatcactcctcatatgtcaatgcatcatccctcttaatagtgcggcattcctattgactcaaatgaaaagaaaagttacaatataccatttgctcatctgccgcatcgcatcacatcaacgtatttggcgggatatgcattatggtaactcattgaggacataacaaactt

SEQ ID NO: 71370 - DNA, 22140 bp, Oryza sativa
  unsure (1)..(22140): unsure at all n locations
tcctaatcatttcctgcgctttccctgccattctactcaggaaagcgaccacaattcagcgctggaacatatattacactcggtataactcacagcttttctcgttaaacaactgtataaaaactagagtataagagcaaattttgtaatactaatatatagccagacgagaagcgtatgcgagtgtacgacctgtgccacgcaatgccttgtcggtctgatggtggcgaaaacgacgtgaaacacaacaggagaaattgagatgagatgagatgataccggtgttgtgaagatcctccaggattattccagcgatgtagagtacctgaatgacagccaagggtgaaagtaaagggtaagtaagtttctggggataaacagcaggggggcaacttgtattggttattgatgcaagaattgacttggaacagaatgataacctttcattagggttagtagctttagctcggatttgagtagtagaccatcctgcagtgatcaaacgaatcagaataaagtagcaataaactgacctccacgtaccgtatatctatgctggatccagtcagcctggagtgtaaaataatgaaaagtgacaaagaaaacaaagctcttgaccactgagaaagtcaccggaaaaatgctcgaggagcagtcagatggagaactactgcataatcaggcatacatcaaggaacaagccgtagaaatgcaacagcatcaacaacagtcacagcacagaacacaagtttaccaaccgacaggactacatcataactgcagagaccaggcaggccatgtactacgaaatcgactactctaaaagaaagcaagaaaagagtgtaccatgacatcggcagattgccacaaattaagcaaagggaaccaagtttgcattaaggtttagtactcaatcaaagttaacaaccgaccacaaatacagtgttccaatgactgaagcagtacgaggaaaccattacacagatggattgctgatatatgaaaagcttgactaaaacctacacggtaactaggactcatcacacaaaagtccagtttaaactaaggatgctcctgtcctaatcttcactctttggaggacttgttgatcagggacttgtggatgtgaggaatgacacctccaccagcgatggtacccttgatgagagtgtcgagctcctcatctccacggatggcaagctgcagatggcgaggggtgatacgcttgaccttcagatccttgctagcgttcccagccagttccagaacctcagctgttaagtactccagaatagcagcagagtaaactgcggcagtagcaccaacacgtccatttgcctgagtcctttgcttcaactggcgatggatacggccaacagggaactgaaaatatgaacaggaaaaattatcagagtccaaattccacaattcaatatagtgaactctataccaacactaatagtagaaccattaatatcacattgacaaccaaagttgttttctttatatcacagaaacataaaatatagcaacgccatacaagcagtagcacataaagttgatttcataaatctgaaaaatactagtatatcatggaccaattgactcgctgacatgctcacggtggactgaaggatgtgacaccagatagcacgtacaaagaagtcagcctcaattcacagaccatgaaatatattgtacatatgttaacaaatgatgtcaacagacataattaacacatgatgacaaacaagccgctgtttcacataatctgacaagtgacaacaatataacaaagcaacataacgttctagatgctggaaatagtttgcacgaaaaaaaataatgtgtataaatcaggtgcatgtttatcttatctatcaagaggtaataagtcaggtgcttgattgtcattgtatccccatcccctcaggaaaaaagaatcaacaagaaaaactactttgaaaggcacacacatgcaacataccgcagtggcagacccagaggaaaaactaaaaagcaaaatcaaacccagtatcctctgccagtggtgtgtagcccgacatagatttgcccctgcctaccagagtcctatcatggttggcttccatggtagctgaaaccaccacagttggtgccactggcatactaccaccttcctagatgcacaaattacacatctactccctctgtcctagaaaaaaaacaattcctaactttaaatctgaacaattgtttatccaaatgcaaagctaggaattgtttttttctgggatagagggagtaaatgtgtaaattgcactaatcttgtttgctacctcaacagccacctcaaattgtccacactatggccacatgcatctagtttccattttccaaccatccatcacgaccagaatagcaaaaaaataaaatgtatcatcacataaactaaaatctccaaacgtatattgttctctcatttaactaaaatctccaaacgtatattgttctctcctctttattaaaaaagaaagagaatcccccagcttcaattcttattgaaacaaagtatcagtacactctagatcgtttaggcaatacaaacaaacgatgtcctgcaatcatcctcttctgtaatgttagcatgttagcatcacgaattctaaagcatatctccacagcaaaatcagccaatcttcattgtgctaacaccgcctgaccaaacaaactaaatcgtataaaccaatcaacataacacaaccagatagaccaaatgcttccatagatctaccaaaacctcctccgaacacgacgagtttccaaacatctaaaacccaacctcgctagcgtgcaaaaccttctacaaaatactaacaacacgcgccatacctacacaaatctaatcaatgcatgtatatcaaaactaaactaaacacacatactggcagaagaagcaacctctcgatacaaacgtgtctaaacctgacctatccatcgctcccccacgaagcgaacaaagcgaaagcagaggaagacgagagatcacctggagaccagcgcgggacgagcgggagacgggggccttcttccccttgtccttctccgccgacttggcggccgtcgtcttcgcggcgagcaagcccttacctccttttcccgccatcgctctctctccctctccctctccctctcctgtctcctccccttccgctccgctcgaacgcccgcgcgaccccggcggcggaaaccctgcaaaacgggggccgaatccggcgaggcgagcgccgggtcagagcagatcggggcgcgaatcgtgcggatctcgccgcccggcggcgaaatccgcgcgggaagcggaggaatttgggggcggattcgggattcggataaggcggaaacccttacctttcgcgagctcgcggagcctcggcttcctcctctcctaccccctgacgcgacgcggacgaaagcgagattttttttttcctcttctcttcctttctttactcccacgaaagggctagctaggatgatataggaaaaagtgcgctttttcacttaacccctcagataataatgatattattattacatataatctggggcgttggggagagagagactctgtgtatagggagtttttgtgggatttgtgaatagggtagggtggtatgtgggaaactaccagccgtgcgccacttggcgaaatatttcgaaatggcgtgccggtttccatatatgccctcnnnnnnnnnnnnnnnnnnnnngatgggtgggagaaatcagcagctgagacgggagacggaggggcatctcggtgagggtatttttgggaaggtggagcggtggcgggatgccgggatgtcgtgcgttttggggtgcagttaccaaactgcccttgccagaggggtcgttgacctgtaacttgaaggactccagtcgagttgtgccggtgtgactggtgtggtggtgcaaatggccaaatgctttttggatggcacgccgccacgcttttcttttgtcttttatattttcaccttgtagtacaaattcgtacaaaattactctattcgtatgatcaaattgttatcttaggctgtgtttagattcatgggtgtaaagttttgacgtgtcacatcaaatatacggatacatattttaagtattaaacgtagactaataacaaaacaaattacataatatgtctgtaaccccgcatgtaacaaaaacaaattacataatccgcatgtaaactgcaagacaaatttataagcctaattaatccgtcattagcaaatgtttactgtagcaccacattgtcagatctggagcaattagacttaaaagattcgtctcgcaatttacacgcaatatgtcttattagttatttttttcgtttatatttaatactccatacatatgttcaaacattcgatgtgataggatgaaaaaatttgcagaaaatctaaacagggccttacacatgttcttttatgattaagatgtagatttgcctcagttttcgttagcttagttttcaaaatgctaaacgatatattttgtgcgaaaactttctgtataaaaattattttaaaatatcagataaaactatttttctcaagtttggaataactgaaacttaattaatcgtatctaactagtaatatgcccgtgctaaacgctacggtacaattctatttctctttaataacttttaaaatcttgatttttctattcgtcacataagacacacgccgaccgctaccctttgatcacatagcatgatggcgtgaatataaacccaaataacagtttaataagaagtagatataaaattaatagttttaccatgtataacaagataacaagtggttgtcatctcgctaacatcttctttcatgacccgaatactaaaaagatatctgtactgaaatttattgatggcaaaagtatatgttcagaaagacgtgttaacgtatagtcatgttatcagcctggtgtaaactgaagcatgtatcatggtatggtatggagaacataattacacgatattccaactgaatggtgatgtcgtgttgtacaaagtaagtggacattggtgagtaacattcggatcatcaatttactatcttctagattatgttttcgaattaattttaatcatgagaacctacctttgctcaccagtcgagaacgtctttatacacgatattttattgccaggtcccataaccaacactacaatctataagcaaaactaattccgacacactgcgggagagatgagaaattgaggaattttatggactgatgcatttgttgctattaattattatacttgcccatgattttttcattaaagtatgtgtctgtttttcattagtatcataaggtcattacatcacaacttttatattacgtgtcgactgtaccatgtaacgaatagtgttcccatagaccctttgtctaataagatgtacactcccctgaatatgttagctatagcatgtgacaatccaattattgtggactgtgtaagtttattttggtcatagattcagaaaataaaatgagtttgaatgaatattgtttacttaaattgctcctaagttggttcaactgtctccaaaaagatgtgaggcaatgactccagttagttagttctgtatacagagtgtatttgccaccctttgaggggcaatacttttatgaagcttaaaaaatgaatttcaatacatctgccctggcttgaaagtaaacatgattttattttcaagattgcattttagtttacagtagatgtacactgtagctaggtctgtcatttttatttgtaaaactcaataggtgtaaccgctggtccgctgctattttaatgcagatttcaaaaccatgtataccacaattggtactgttaagcagttctgcatcaacactggttattattatacaataccactatgttaattagtgtggaatcacttacccatgtcctcttaataatttatcctctgattgcactaataaaattagggtgctatatggcataagttatgcacgcaatacttcttatcaagatattctaaagtaaaacgtctcaaatacagctacaaacattgacaagcgggcatattacatccacacaacagtgtattgtttcaggtccctagaaatatacctaatgctatgagagctattcattcctaatttagatggtgaaactttcttgaaaacaagaattaatcattccatatgtgcttaccttttactttggagcaattaggcacaggcaaggtgattctttctgttccctcaaggcattctgtttataccccttggaattggttgggcttgaatccaaaaatccagagcataaaacaatatataaataaactcccaatgaaatgttgcaaaactcccgatcacaatagattcattggtctactttataatatcttcctccttgccctctaccacatgcaaatgtagtaggaccagcctagttgaaacaaaaatgaaattaggaactacatgaacaatctatttaaatccatggctatgaaagtaccgtaggttaggctcgtataaaagggttaactcaaatacatcactcttcagttatttgccatatgggtggcatgctaacgctacatacaccacaatttagtaaagcagtgttcttttaaaatttgacagcatctttttagagtaaatgtgacacacatgcagaaatagatcatgtgtgaaacagagatgtatacaattgagtaaccggagtatctctagagtaactttgatagcttgaataactggagtgaagtagtcaacagcagagcagatttttcctgattcatgcaaaactgttaacgtcggatacaaggaagtggacataaactattttcataagataagacgcatagattattttcagtttattggcctgatctcttgcagttaagtgccatatatattttagtatttgacatgtggaactatagccacgaatccgcttactgacagatcaaatcctcctagcataattgactataataaagaacacattggatttgaatccaaggaaacatatcacacatgcacgccatcaatcacgggtgcatgtactccaaatatacaagggtctaaatatacatttcactgatatagtacacaataaattttatttgtaaatatacatgtgtcaatcaattggacaatatcaaagacatttatttctttggagcatgtatattgtacctgattggagccggcctatgtaacctgacgaatgagtttgaaccggcaacggcgcttccaatggaaggggaggttggccacgatgaggctgcgtccctgactggacggcgatgaggctttgctcgataccgcgacaggaatcagggaatgcggcagcggctgagaggccggatgagagtgatggcacctatagaaccatcttctcaatagagtaacataacaatgtatagtagtcaataaaatcagtttaggcaatacatcagtgcttgcacataaccaatgcagcacattttacatattcaggtgtcattatttgaaaagcaatattatgacgtaactcattgaatccactgccacacggataatagacccaccctggatatttctttaaacaaatagacaaaagcattatggaattttcagaaagtacatagtttagctcatgtaaattttatgtggctggaattagctcaaggaaagaacgaatcccatcatcatgacatcataccatctcattgtcatgttacattttcaagggaaaaaattatcactgcacaaagcagaacttggatataacctaaaagtaccagaagccactctgaaagttggattaattccattgttgcagcagttgaacgatataatacttgaaggttgtatatgcacgctactaattaaagcgcttcatctgaattacagacataaacatcctgatcataagagaaattaaatcatttgcattatataaaaagttgcagatgctaatcaaattgtttaaaacatgacgtcatcattgataatttagtgggatatgtgcacacacatcagaaacatggcactgtcaatccgcaagtaaatgaattgccattgcttattaaattttggaccaatcgaggaaaaatcaagaagaggaaagagcaaatgaaataagagaaaaggatctccatgtaccaggcagagagggccgatgacactgatcaggtagaccgccggtgaatcgggtagatgatggacgcaacctagcggcagtgaatcagcgacggagctacggccgagtcggcgctttgtgtggcagcggcggcgacagtgtgagtcaatttggaggcaggaatcgaatgagaaacacatgcagataataactttttgtgtcataaacgcacataataatttaatttcaattatctcactgatgtattctatagtgggagggaggaaaattaaacagcaagtacatattcatttgtattcactattttatctctatttcagtaactttgaacagatgcataatagccattgataatttaatattaggatgattcatagtagaacggagccgctccctaatgatgaagctcgccacgttgatccaatgaaaaaaaataaaaaaaatagaactaaacaatcaggcctgaaatgttcagactgttcatgcttatgctctaccaactgctatacaattaaagaagaagatccaagaaaacatatgcgtaaaatttgagtttccacctcacagcaagtttcttctctgacaaataaaattatctaaactcatatcacagtaataaaaagaccacaaccaatatcaaatcttaaatactgaaggacctaaaactaacttatatctggattggatcgtaactgctgaaggcaatactattcaacacaacggtagaaaatgtacattatcgttaaaatgcctgctcatgatagtgtaacctataaagagatggggatttcagtgcattcgcgtttgggaggggaggaaccggaatatagatttggattttgctgtgaataaagatgtactaattatttgacgaggcattaccatcgatccatccaatctgcaaggtgctctctaccattgtgacgttctcgctcccgctgtcctgcacacacacgcaaataacaaagaaaaaaaatcagagaagggggattggagtcaaggaatggagataaaaaaaaaaagaaaggaccaggaagtctgggcttctccgttaaaattcaaagagttagggataggaatttaggagatcggggatggagaccttcaagtgtacgatgcaggcaaggaggcggtctacgtggtgggacgggcgtagaggagacggccgacagcgacggggatggcggatgtagggttggcgcgatggtgtcttggcggcacggacctcggtgactcatgtgcagggtatggcgacggggacggagatcccgaccagcgtaggagaacgtgcggagcggatgaggactgcggcgacggcggcgtcggcgtggatcgtgggtggctgggtgtggctgctgttgagggggagcggctgaggaagaggcgttggaccatcggcggtggcagaagggctgaggcgcgatgggagagaggggagcgatcctgcaaagagatgggagtgaggggaaatcgcgaaatcacggatgaggagatcacgcgaggggggaggtgggagcgacgggatggggaggagatcgcgattggcgtgaggcagcgtagtggttggcgtggcggcgtccggtttttgggggcagcggcatggtggcggcggcggcgtccgtgtgcgagagagaagtgagagggttgcgcgcaggttgggggcggcgaatcagagtggggcccacgcaatcacgcgattgatggaggtgggaggcgggggatcgatctagaccgttcgattttacacacagatgatctggaccgttccatgaggaatgaaagaacgagtgaatgagtgaaaccatttgttacaactataggatagataactttctcgttttacatgtctataattaatctttattttcatcaaattcaaatggggcgtatgtccaaaataatccatgtgtgaagcgctagaactactggtggaaacacaagatacatgagaaacttacggtgattagctgacgagaatctaatatattgacgtgcaatccttttgcgtgttcgcgaaaaaaaaatagccgacgagaatataggaaagatacattttctaacctttcactttcaatttattttctaaattctgtaacttgtataaaagtatagaatatttgaaaagttgcagtttcctgaaactcctcgagcaagggctatgtgtacatacactgagtggacccatcgtattcataccaagctcgtacaattatacgggtagcagttaatcgcagccccgtcctcatcaatataggtgaacagaacttctattgttttgcattggcatggcaatacttccaggggctcccggcgcacatgtttcaggctttcagcagtaaagcagtttctcctaaccttggaagttggcacctttgaagtactgtcaatttctagaactcttggttttgtccaatcagggccctgagagaatcctcctctacaaatataaagcaattatagcgtttgaaatttgtccagctacccctcgttcaatttcctcacctactccccatcccaaacaatcaggtgatggttgagggattcaaccggaggcatgaaaatatttttatcccaaccataatttatcttaaaactttcaggagtgcttgtatttgtcgaggatggagggagtggtatgcaaagaatgaaaattcagcaggacatccgttttttcaactgcacggatgcatttcccaagaggcgatgccagcatgatgatacctgcaacagacagaggaacatgttggaacataaatcagctaccccacccaagcaacagcatactgtgaagtaattccaccctcaaaatgcagcttacatgcactgttaataatctggcattgatgtttgtggtgcctactgtacatgtgtgagctcagcaaggctggggatgagtgtgcactagttgtcatggcacaagaatgtgcacagttggtgcagtggacctgtggttaaaaatggataatccgaaacaaggattgtgtgtaaatgcttgaatcggggaaaccattgactatggggtgcagccgtgcaggcactcctttcatatgccatatggtgaagcgtggtgaacgagaagggatggcatggctcaaggaggaaatgaggtaacaattaaatattgttattcataatattagcgaatggtgaaactatacttacagatggtgagagcagaaatgcatttaatatgctcaggtggtgatgaaaaataggggaaattggtgaccattgacaattctgcttaaatataataaaatagcagcaggaaaaaaaatcatctatgagagctggaataaatttgcttgtatggaattcttgttctgaaaaaaaaatactggaacaaataaacactacctgaaacctgatggacagttaccagcacattatccattgctgcactgggactagtaatcttgctgattgtagcttgataagaatgtggtattgttgccggccattgtcacccaatcacccccaatcttgtcaacgttcatgaaactgcacctgccaaaagatgcatttacacgttacataagttgcaaggtttgtttgtagtaaaaacatcattagtttattttactatgcaagaagagaaaattcctgaatcttctagttcggtatcttcaattttgcactgctgaggaagattcccacttaagacaaccccctcaggcatctacaagattttgtttccagttccgaaccttcgggcatttagaaaattccgtttgcagtttctcaaaataaggtttacgagtatactttctttgttgccgtacttgatcagcatctaacaaagatatggggcttcctatcgaatttattctgggccaattggctagctacagttcaaagagttaagagattttatcagagaaagcttggatatcatggctatacattatattcgtgttaaacattgtgtggaatttcttccatacttttacctttgtactttgcagtctcagtgtctggtagaatcataataacatttgaaatcaaaagactcaatgggattatgggattatctcatagatctggtagattttgatatcaagtttcttttgatcagtaaacacttaaatgctagtgcaaacattgcaggcttcactcaaataattagcgatgactcacttataaaaaaataataaccagcgataattgtagaagcaatctctagtgcatacagaatttatgactagaggtatagcttacatagaagtgcaggattttttttttactggagaagtgcaaaattgttcttaatgaatctagatcatgccctgaaatttgatcttttatgaataaaaatgtctgcttcaattcctgcatgctggaagaagagaaaaatcaatatgtattcagaatatgttgtgtgaataaagaattagaagaaatcaattaaagggagcgggtaagcccagatactgttttagcatcaaagttttcaccaataacttatagctagtggtttatgaataatactttattccccagattgaaaactgcattcttccaggttagaagaggatgagtaaatgacatgtgcaccagtaaatgtgtttattgggagaaagaagtgtgcaattgaaaattagtactgcctacacaattgaaacatactcctacctagcatatgaagcaacagaatcagctgccaaaagtactagcacctgctgattttctcactcctttcctttccatattctcccttacttcattgctgtagttccactgaccttcagcagcatacatgttggaaagcaaaacatatccaccctcctctgcgggttcaagacagaggagttcctttgaagcaatctctgctacttcagtattctgacaagctgaactcgcacttaaaatggaaccccatatagaccgacttggcttcattggcatcctcctggccaaatctactgcatcagacagcctacctgatcgtgcaaggagatcaaccatacagccaaagtgttctactcctggttcaatgttgaacctttgcttcaaggtatcaaaaatcttgcacccttcatcaaacaggccagcatgactacaagcactgagaacagcaaccaaagttaccccattaggttctgtaccctcagcttgcatcttccaaaaaagatccaatgctacatctccatggccatggaatgcaaggccagatatcatagctgtccataaggtaacatctttgtccacggccttctcaaatacggcatacgctagcttgatacttccacatttgcaatacatatcaacaagagcggatgctaagaaagaatcttgagtaccatgctccttaaccacccaaccatggacactccttgctgaatttaaagtccccttgccggcaaccgcagagatcaaagtaacagcagtcaccttatcaggtattacactactagcaagcatatcatgaaatagtatcattgttgcagagaattcttcatatcgagcatatccagccagaagcgcattccaggatattatatccctggcaggcgcctcaccgaaatatttgctagcaaggtccaacaagccagcattagcgaatccggcaaccatagtgttccacgaaatgccatccctctcaccagcttcatcaaagactctcatggccgtgttcatttccccgcatttggcatacatatccaagagagcattgctcaagatcaatcccctatccgcgacaccgatcctccgcacgacgacgccatggacggacctaccaagaactgccttcttcagccgcccgcagcaagcgaggagagcaacagccgtgtactgatcaacaccgatccccctcgacgccatgccgcggaaaaaccgcagcgccttcccgctgcatcctcccttgacgtacccggacagcatgatgttgcaggacaccgcgtccgccgtcggcgcacaccggaacatcgcctccgccgcctccacatcgccggcgtcgaggtacatcttgatcagcgagttccggaggtacacgcgcgaatgcaggccagtcaccaccacgtgcgcgtgcacctgcttcccgacggagcggcgctccgcatccaccgacttgagcagcgacaggaaggtttgctcatcggggtgaatggatgacgccagcatcgacatgtagagagcagccggccgacgactaggcgaggaggaggccgccgccgccgccgccgcggccgaagagagcatgaggttgtagatgtagaggttggggcgaggggtgaagtgctcgaagagggtctcggcggcgcgcgcgtggtgcgggaaggagacggtggcgaagtggaggagcctgctcatggggaaggtctcgaaggcgaggcggaggcggagcatgtgggcgaggatggccttgaacggccgcgccccgccgccgcaccgctcgaggaggacgagcgccgggtggcccagccggagcgatacggtcgggtcccacggcggcctcccggcgccggcggtggaggccatcccgccgccggcgagacgggagcgcgcgtcgggtcgaaggcgcctgccgtctccccgggcggcggtaccaccgtcgctgtttgggagcggcggaggccgtccggagagggccgcctcgccgccggcgcccgcagcgcctccgagccggtgccttcgcggcggcggcggcggcggcgtacggcgaggcggcgccgcgtggcagaggcccaacagctaaagtaaacgttcgccaaattatgggccgcgaaattacttcatgggctgaatattatgcccaccctctaattgcgctacgctggaaggaagcccgagaaaaaaactcactgttgcaacttgcaacggccatactagtctgttaaaaaaacaaaaaaaagacaattctagttatgaacctgagcacatatatatttagattcgtagttaggattttcttttatggaggggtaaggcttatttggttcgaagaatttctaaatcataagaatatgaaaaatagaaaaattaagatgtcacatgtaatccaattcctaggattttttttctaaaatgtctatctcatactaagaatcatatacgataaggttataggactatgattcttaagaattttgaaacgaataatgtatatataaaaaaaatcctatggttttaattagtacaataatcttttagaaatcctttaaaccaaatgagtactaagctaaattgtgtaaactaaagtgtgtgcgcatgtacccatatagtgaaatccgtttatgctcaagcaagatcgaaatcagacgagaatcatacggtgctagctcagtttgttctagggataccatatttaccatggtcgattcacgtcacatgaaaaacaagggtctttctaatccatccaggaaagcttgtccagttctaatcactttcagtcagtgtcccctgataaaagtttagtataaaaaagagagcaagatataggcccctttgaattgcatgattaaaaaaaaagagaaatagggaaaacacttgattctgataatagtgcaagtgtaaaacagatgattgcaaaacacaggaataaccatttgattggacagtagaaaaaacgcaggaatcaaataagagagataaattcaaagaaaattttcaagagattagagacttagagtggatgttaaatttcatacatttttcaactagaatcgtagaaataagaaagttttctttcctatacgaattaaagacataaataattaaagacatgaatagtgtaggatttcaattcctcttttttttttgaacatttttcctccaattcaaaaggggccataaagttttgtaccttcacctgctcatcatatgtcgtcacctccatccccccatctcatcaaatcaaacaagacaatgaaaactgatcacattcccctggttaagtatgccattggcaaaccattatcgctcgatcacaaccaacatgatcttcagtttaccagatcaaaacccaattgctcccgaggaatattaccagcagtgtagtactagtagcagatacatgtcatctgcttttcgatatgagccgttcagtcccgtccatgtctgccatcaacttgcttcgtcagagttcatcagactaataccgaccaaccatcatgcatgtgcagagcgatcgatttctctctcgtctataccgaacactcgaatcgatcgatcgacaaaagcgtaatccggatcttcgatctgtcaggaaccttggcgacgaggagttaatcaacgggtgatgagatcgatcgatcgatcgatggatccctcctctcatgtcggttaggcgacaggaaagattgcgtaccagcgatccctgctcctcatcgacacaccagtctgtacattcctcgatcgatacggcgatatatatctcgatcgagcgaattcaaaagaaaaattgtctggtttatcaactctgcatgcagcgtttgatgtgattcgagtggcactttggtggtattttttttctcccgaaaatgaagatgaagttctttacgcaaaatgagacggtattaacatatgattgattgagttttaattattacgaacttgaaaaatagattaatatgatattttagcgcaactttcatatataaagttttcgcacgaaacgcaccgtttagcagtttgaaaagtgtgccacaaaaatctttatcttcgtccaactcttattggagaatgaatgggacctttgtgtgatatggatcctatctccagcctccagggaaccgaacaaaagaagagaacaagtaagagacgcttcgatcgtctgatcgacacaggatcagtggattgcatgtatgatcgatatacatccactggccacatggttccactgttatttctgcaccatgtttgattacgaacaagtagctaattagctatagctagtagcctagtactatgtactaatgcaaagtacgtacagggtacagcccaaattaattctatcttaagccaagtactaagtaccagttagttcggtacgcgtattagcagctgggaatagtcttaagacagcggtacaatagtccaagtaggcactaattctgggtcgcatatgcattgcagtgcagtgctctgatgggtgtgaagtctgaacagccggatataatcgagcaaagggaagagggagggggacaagtgaaactgctcatgtcgtccgagtgtctccggatgccacggttcgctccactgttgttcggttgagacccaacagggacacgcacggcacggccactgtttgtccgccacgcccacgcacacgcacgttgcaagagctattgctttccgtccaaaaaaaaaagatcaatcctatcaacgaacatagactgatccgtagttaggagttggtttattttgaaacgaatggtgcagatggttggattcggcttgggcccgggtgcggtggctggtggctagctaagcatcggtcgatcgatcggtgaacgaattctatgagtttgtcagtagccatcggtgtcatatgttattatcgtcgtcgctgggtcatatggttgtgacttgtgagttgtgagttgtgagagagagcgtcggtgcctagataattagctgttgaatacccatgccgttcgtgcgtgcagtggggagggaccggtcggattgctgcgagatcgatggagggagcaggtcccgttcacggggccccggttaagttgtaactactgtactgtgtaagcagtagtaggatgcagctaccaaagaaaagcgagtggccatcactacaactactgcattaggatggatcagtaggaccagcgtcgtctcagcttgctggtatttggtccattgctgcgacgcgtacgtacggcgggaagcagcgtgggttccctccaccaccgcacaacggccgagtttagtttcaaactttttctttaaactttcaacttttccatcacattaaaaataattttttcacacacgtaaactttcaatttttctatcacatcgttctagtttcaaccaaactttcaattttaacgtgaactaaacacacatgggatgggagagccaaacgggccacggctctgcgcgcgtgtgtgcagtgtgatcgtctgatcgatcgatccatcggccgcgcgcgtacgggatcacgcgcgattcgcaatggattaatgggtgttggatcgcgtgtggtgtagctgcttttgtagctaggcgagacaagcgccggctggccggccgcccgtcgagatgaccgtcgtcgtcgggcacgtacgtcgatgtctacgtgcgtgcgttccggccggccggtgagagcagctacaataagtccacatcagtaggctatagtgtttcatatagtaaatttttatctagttggaagagagagagagagagagtgaaaggagagaggcgctggctacccatgctgcaggcctagcttttttccctgcatgtgtgtgactttgtacatcctttgtgagcagccaatcaaatggtactacttaagatttttttaaaaaataaaagttgtacatgagaaataggtagagataactatagagctcattactttatttattagcttttgaaactagctataacaggatgatgtgttatttttgtagccaatagcgagctctactattaaccttgctctgaggcggccccacacatcgagctctccgttaatttttttgtgcgcatacgtgtggttcaattcgaacggtcgggatggctagtttgttggttgcctaagcgtgtctacactgacatacatgagagtatagatagctaatagatttgttaaacggcatccaacagaaaatttaaagagatttcttcaccgctatatatctgcgctaagattcatgtatgagtcccatctcctccagctctcgtaagttcctcctcttcttcgacggcagcagcatcccaactctgacagatgagctacgaattactaggtttgggatcaaaatttgggcaaagagtaggggaatgaagtccacttgggcttagagggataatcgtgggcgtgcaaacacaagaagacattgtggtggtgccatcgctgctagaaccacgaggttggaggaaacggagtcagtggcgatatctttagctacaggccggatctactggagacagtgaagatgatgggggcgggggaccttgctgagtaggggaggcggcgacattgacatcgatctactcaatctggaggacgcggcgttggggagatggataaggtgaagttatcgtagcagcactaatctcaaaccggtatgggtagttcaaaagtgaataagatgaaatggatttcctcgcaaatgttacataagcagtccctcaatctagagggaagtggactttaaactcttgagagaacatcctattgttgtttgcatgtcattcaaatagtgttatgaaactttttaaagaaaatcaagaaaatggttaatatgctatatatgtatcaatccgcaaacatgcgggttaatattaaattttattagttgaataaacaaatcaaactatagttggtcgactattttttttcttttcagcttgtagaagttaaattaaccttatatgtttatggagtaatctatcttattaaatattttctaaaaaaaattataactatttcaataattaaaaaacaagaggatatccctctcaacagttcagaaccgtttcctaatctaaagatgtatggttgttgagtcgaagccaccaacaaacggataatttatgaatacacacccaaatgtgtctgaccgatatccacaccacggtccaaccaccatctacaggaggccataactagctgccagtggctgatcgacctgtcacggcaaaaatacccacgacgcgcgcggtgctcagtagctcgatcggcctctacgagagagatgagcagcttcctttcctgcagggccctggttacgactactatcacgttgatccacgagcatggcgctagctaccgtgtactgcgtacgcacgtgcggcacctcacgcaccgggacagcatgcagggaagcaggcgagcagcgggccggggttccactcccacatgagaatccatcctcgtacgtcgtccggtggcgaactgatggccggccaccatgcatgcgcctcggctcatccgtcgtcatcgacacactgtcacacgtgggcgggggcgcgctcccgctcgagctccatctatcccgtaattttgataaattgaccctttcaaaaaacttattttaaaaataaaccgtaccaaaaactaatttcaggaataggccgtggcctgtcattgacgctgagctaaagcgtatcagcgccactgcagttggtgctgagatttcatctgccgtggtacaaactcgtcttgtatggagagctcagcgccacactccacagcgctgacctctgtataccataaaatcgcataggtgcttcaaaagcaaggaagcgtagatagctcagtggtggtgttgcgtagtagcaatccaaggcacgggagtttgattcctgtcctcttcattttaattattgtttttctcaacttgctctttttatgtgttcttttgaatgttcacgtgccttttacaacttcattttatttttagacttagagggaacgaatataagaaccaaaattatacgattcaagtttaaaattttatatttataattctttggaaaagaaattaataggacaataattcgtggaggataagtaaaagaaaaactgaaaagaaatactacactaacgaggtttgaacccgtgaccttcaagttcaaacttgtcgatactaccaccaggctagcttcacttgtttatctaatgtgagctaaaacgtcccagcgccaccggcgttggcgctgagatttttgtccaccatgacacgagcttagcgccaaatgggttggcgctgatatcagtgttaaaaccgtgggctggcgctgaggccacggtctattcctgaaattagtttttggcacggtttatttttaaaataagttttttggaagggtcaatttgtcaaaattatggccatctatcgatccccttcggcaaggcacaccgcacgcatgcgcgcgcccaaccggccacacatgtggggcgtatgagcagctgcgcggtatcacggacgcgcgcgacggatgcatggatgaatggatggatggatgtacgttgccgtgttggatcctgtgtggtgtggtgtagcgacttgtttttgctcaacacgccaaagttaggtccaacatgatgggatggcgtcaatgatgtcggcgacgttcttctagctcccgatggaagctaagtcactaatgtgaagggaaacggcgttaacattattggcgccaagtacctatttaatttgtatttctttaaaatataggatctatttataataataatatatttacaaataggtcattggcactagtgttttattacaaataggtccttttctgctacaaatatgtcatttttattttttttacaaaaaggtccttggcgccaacgagatattagtgacttagttttcacctggggatgagggggacggcgccaacgttattgacgtcaataacgttggcgccgcgaaaagggttcattcctagaataagttttttttagggatctatttgtagaataagttttttaaaaggtgaaaatccagccaatgcgacaatgtgatgtgcattcctatttctcgatcgaaatatttcagatgggtttatagatcgatctaccgaaagcaagttttattagattgagatctaggaagggagatttggcctagctaatgaagggtttggtggtgtctttccgtgcagctgagctaacgagttccattctgatcatgaagatatcaagtgggacacacttggatatattcgttgatagtttttattttactatttctatgaatccgtctcgacaatggattcatccattcgctggtgattgtgaatagagg

SEQ ID NO: 71371 - DNA, 4161 bp, Oryza sativa
cgataacctcgcattggcagtatccgctctatgaacttaaatcctcatgcactctaggcgtccatgtttctagcagtgtgaggagttctggcggtcccgggaaagagaagtctcacacatattaaattatggttcaagttaagttctctctctcacacactcatggcagttctaccaacggcgacaccgatgtagggcacgcctctcggctctacctcaacggttgtcccatcgtagcgcacctgcctcactcaggggtgaaccatctatgcagggatactgcctccgctcggctatctaatccgctaggtctatacccattcgagaagtacggttgtacgggggtcgtttcatgcttaactttatggctcggtccttaattgaccggggacggtactagcctttcccagataccacccaaatcatccgtccgccccagttgaaaacagttgttttcgctttattttcctttcacaaatcatgttatcaatttcatggcaatgtggtgctcatgtctccacatgccgcatctcaattaccttcccaaaggtaattgcccaagcatttagcatttgataaatatgagtatgcatgatcctagaatagcatttctaagcaattgtcataattgactagggactcatacgtaaacatggataaacaataatcaaggcatggcataatcacaagtaggatgtgcatcattgcatgcaattttatttataaacaaaataatttcgcaattaggatcaacatgttcaaggaatagtgatgacttgccttgctcaaggtcttgggggtcttggccttcacttggatccgcaactccctcgggctctatagttacctgcgaaaattgatttggattcgattagaattcaaataaaaatccaaataaatccaaatggaagtcgaacgcgaaagtcgattcttttatattaactttactattcgcgtactagggcaaacccaatttctttttgtatatcctaactattttgtgggtataaatattttgttatcataagtttttaatttaatctacccgagcgttatatccatataataggttggaaatttctatcgcaagctaaatatcgaacggaatccaaaaattatcttataatattatacgatttaattttagtctaggactaaacgactaaatataataaacgtctaaaattcctagtgattaagtccgaatttctaccgtgaatcaattacttatagagattacccaaaataatctataatagtctataagaattcatctaatcgtttagttcttaattacatttaaactactaccgcgaattgatttcttgtagaaattaccaagaataatccataatttatattaaatttcgcaattctacgactataactaatctataactaaattctaattattttaaattttcaaaacttccctaatctccctctaatttcctatttatttcccttttctttttcttcccttctttttctttttccttcctttctttttcttttctttttttttctttctctctctcctttcttttctttttccttctctctctcccttttcttttctttttccttctctctctccctcccggtttctctcctccttccttcttctttctctccctcggcttctcccttcctccctctccctcggctctctctctacccggcggcacggcgacaaacagggggggaaggcagcggctcaccgacggcggcagcggcaacgacggcggtggtaacgacggcgcacggcgcggcacagcgcggcggctcgaaggcggcggcgcggcggcacgatgacagcgacgcgtggagaagttgagggaaaagggagaggaggaggggatggagtggggagaggggagattggtgggcttttataggggaaagagaggataagggggagagggaaagaagggaagggcggtggaggggggtgaggcgacggcggcgatgtgacggcgcgcggcgcgcgggcggagatgacgacggcgcggcgcggctcagggcgcaaggcggcgcggcacgtggcagcggcgctgggcgcgaggcagcggatgcgcggcgcgaggcgacgggacggcgcacggcgcggcagcggcacggctcgaggcggcgatggaacgcgcacgcggcgacgggatggcgacggcgacggcgcggcagtggtggcgcgcggcgcgaggcggcgatggtacgcacgcgcggcgcgaggcgggacgcgacggcgacggcgcggcaacggcaatgagatggcgacggcgacaggcggcgatggcgacggtggcgcggcggcaggcgacgatggcgacggcgcgcggtggctctgggcgcgaggcggtgatgggacgcacgcgcggcgcgaggcgggacgcgacggcgacggcgcggcagcggcgatgggatggcgacggcgacaggcggcgatggcgacggcggcgcggcggcaggcgacgatggcgacggcccgcggtggctcggggcgcgaggcggcggcgcgtggtgaaggtggcggcagagagagggggaaagaggaggagctgggttaggggaccacgtcgaacacctggcggccgatgaatagtgactttttctatttatcccgattttagtgtattttccatataaatttgattccacaattcctaattttgcatatgtgcattttactcaatatttgtgttatcttaactaatgaattcaccctagattaatattactcatattttatttttatataatttatttgagttttaattagggttaattcttattccattgtatttaaatttaattgatccaaatatggtcgcgataatattttatttatttctgtccacacctaatctttattttaatttgtatttattttaccaatttgtttgtaaggtttattcctaattaactattctttactcacgattaataatcttcgagatcaaatccagataaaatagacgaataagatcggcatgatgcaattaatttaaaaagtttttgaaaatccgtatttttagagttttgattttgtcggtcgaattttcagggtgttacattatcacttctaccatctgtacacatagagtgtaatatggctataagcaaaacttgtgagactaaggaaatcaaagttctttgtgttgaatcatttcatgaaggcacatgatacagtgacaaccaaattaaggatagattatatgttggattttttttctacgtagaagttcaactagttcaattttttacacagttttgaagaactttaaaggtatgttagaacacataacacccacacaattgcttggctggtaatgcaaaatattagcaattgtttcaagctaattactttgttttttcatgcttgattgttttctttgaaacaacatttgtttgaaataagatcaatagtgtataaatttgattagtgtgtgtagtgtacttataaattttgaagtgttctacagtaaagtttgcttttgtcatgtagtccaattatatcaaagaatatagttttatcatgtaaattataatcaataagttcaatataatttatatcatcataattaatgaaacttatttaaaaaatatgactacttaaaaaactatggttcgcttttttttttctccttatttactggtgcctttgtctactcggaatcaaagaaaaaagtaacacgtcatgccatagttgatatatggctatatgctatttatcagtactctatgtccactcattgctcagtagtgtcttccactcaccaatcatcttgtgataatcatatagacaatatttgtctatttgtttagtttacctaaagggcaacaccacattgctcctttctcatgcatggtcgtagactctaaaatgatttgcccaaagcatgttcttcattaacacatgtaactagaacattaattacataatattatacaagtgtggcacacttggtaattttcgttctagtttcacccctgttctggaaaaagtgctttaggaaacaatatatacataattctttttctgaaacacatcatttaggaacttgggaaatgtgcaaatgaaaatccaaaatccattaggtaatcaacccttcattttagcttacactgagttgcattttgcaaaaacttgacccactggacttg

SEQ ID NO: 71372 - DNA, 1900 bp, Oryza sativa
gtagtctatggtaatttaaatttaaatagtatatatagaatgatgattcaaatgtaaaagatgatgtggcttcgtgagagaagaaaaggagagagataatttggaccatagattaatcatctaagggcaaaaacaattgatatgatatagctaaatgagaggagagaaataatattaactaagtgaggatgaactatataggtgtatgggatgatgatttaacattcgttcattttaaagctctaaagttcaataattataaaataaaattatagataatatagcatgcttgtacgatgtttatatgtaataattattagtgaaagatgatgtgtcatcattgcatgtagagttttagaatttagtgggttatagctttatagtaagataagaattatgcgggatgatgatttaacattcttgcattttaaagaactaaaattcaataattataaaattatagataatatagcatgcttgcatgatgtttaaatgtaataattattagtgaaggatgatgtggcatatataagatcttgctacgccatcaaaacttttgcctgaatcaatacattacttcttctatcaacagacctatcccaactatttgtcatatttctgggctaacagcaacaacacacgggaaaatcttggaataaaaaaggtatttaaattaatattatttttccatatcgactggtagtgtttcacttttgcagtttacatcacacttttcttgtttctcctgatgttcataacatatatagggaactgtggatgagtgggtgaggtgccatgacgatggactaccttattctcaggacatagagagcagtattaagtaccatcaaaatcttacatctagaggctatcgtgtcttggtatacaggtaaccaagttcttgtatgttcacatctcaaaagttttatgattatgaaacgcctagagattatgtgcatgtctcttaacaacaattaataattaagaaccgatctcttattattggtgcttccgctaatacagacagaagcaccaatagtagtagattaaaaggtccaactgttgggaaggatttctcagctcatttctcggcttataacgttatagaccctctaacgtataaccattcgaatttatactattggttgttttcttttctttttttctatgtgttgtcaacttcttatttttgtctttcatatagtggcgaccatgattccgtggttccatttttgggtacacaagcctgggtgagatcactcaactacccaattgtggatgactggagagcctggcatatcgatggccagtctgctgggtaagattaatgtgcctaattcgttttcttgtttagttatgtataacactactacggggtgattaataagattttcataagtttaaaatacactgtgtttttcagttcataataaactcagtcgaagagtacattacctgaaatacgatttatttatttgcagattcaccatagcatatggaaacaatttgacattcgctacagtaaaggtgacaatatatctgtctacaaatgcatgattcttgtttttcaaaaagcaaatgaaacttttcttttttacattcattatttttactatggttattttgaatgaagttaattaactcctacagtttcaaacagtttgggagtatctaggttctaatgatttgttaaataccagatgcaaatgtttggttgcagtatgggttgaaagttgaaactgcaaaacgaaaattttgaattaagggtacaagttgtacactccacattttcatgaatgaaaacttcatgcatagtgatgagtaaaaataaatccaaccattaatgtaataaagctatgtttgttattaaagataagtgaattgttcatgcttgttcacc

SEQ ID NO: 71373 - DNA, 7305 bp, Oryza sativa
tccgcacgccgtcgagccctcctcactgccgccacgcaccagatcgagaaataagagaagggggaggaggatgggggtaccgccgccaccgctggccgcctagcgccgccgcaccacctcgccgcttcgccttcgcaccagcgccgccgccacgcgccgctgagccgccgcccaccgccaccgccgcctctcccgagggccgtcgagtcctccgccgcccggtccccttttcttctgtggataagggagagagagaaaggcccccttttgtttctatggataagaggagagagagagtgagggagagagagaggatactctagtcaagcctagtcaatccccccacccacacctgtgacggctgtattgacgggtccgtttgagctgagttagcctcacctttgacggtttataaggatgcaacccgtcacaggtaactagtcacctgtaacaggccggaagtggaaaccgccagaggtgactaattacttctgacagctttcacttccggcccgtcagaggtgactaattacttatgacgggttgtagaaggatgccttaccgatgacggcgtcctgtaggatccgtcaaaggtgaccctcatcactaaccggtactaaatcccgtcacagatataccgtcaaagacgtgaggatctagtgtagtgacaaatagtcaaacctatcaacaacatcgtcactacaagaatctatttaatctatgacgaaaaaaattcgtcatagatcactgaaaattcgtcatagaaatatgtctgtgacaattctcttatcgtcatctattgagcgtcatagattaattttgccgacgttttctccgaaatcgtcacggatcagtacaatctatgacttttaaaccgtcataaaacgcttttaggctcgtgtagtccagcccatgcccaacctttgtgacaaaattaaatgtcacagatggttgccacgtggcggccaacattgcaggtgacatggtcgttgacacgtgtgtgtgatgacgtgtcactgatgacgtggcagctaaagttagcaaatatttttaaacggcccattatttttttgacgggccattaattttttaacagtccattaattttttacaatggtccattaattatttaacagcggcccattatttttttagaactggcccattttaaaataggcccatttcaaaactggcctattttgtcaaccaactatcagatcaaagcccactaaacaggcccattaaatttgagcccaccaaattcaatccaatttcacataccatctcagattcaaacctaataacagataccatctcagattcaactaataacagatacaatcataatacaacagaattcaaacaatagttcatctcagattcaacctaataacaacctaataacagatagtctcagatactgacaatcaaccgaagcttagcattctccctcttctcagctttcagttctgcactcatccttgatcgcttagtgtgcatcccaacattccgaaggaacacactcttcttgtggttgcgctcaagtacactagctacaacctgaagcacagacttgggttgttcgggtgtagccatcctttttctcgctgaagtggcacattttgaacaaatcaaacgcatcatgttctttaccctcatcctcgttcttatattcctgaaaatcatgtttatatggtagattacttaatcggtgacaacacttgatagtaggaaaaaaatgaaaataaataaacagtgaacaagaagaaggttagcatgcaagtatgtacgtatagatttgctgaaagggaggaaggaaaattacctggagagaaattgtgcaacttgaggtatatccatgtcattatatattttagtagcaaatgcctcagctcatatgaacaaatcaaatgagaggtactgaagtctatgacatgacaactcacaagaaatactgaagccgcagcaactctaactcgccatcgctcttggtcgttgctacggctaacatgcataaaagaaattaacagatatagccaaaaagagacccaacatacacatggaatgagttagcttaggcctagcaaaactcacaagcataataggaggacatagacatagcaaaatcagaattccggcagtaggcaaatcttaggcattgttggacttaggcacagcaaaacctgtaggatagtatagcaaaatcctctaccttaggcattgcaaaaatagtaacagatttgcctaagcctaacaagttaagatttatccatagcaaaagaggtgttacttaggcacaacaaaatcctgatgttatatatagacattgcaaaacagtaagagttatatatagaaaaacatgtgaatgactacatagatatagcacaaaagtaaaagtaatacataacaaaaatcatgagttaggcatagcgtaattgttggaactagacataggaaaatcaatgagttagtaaaattaacagtctcaagattaacataggcataaaaagggaatatctggagtggggttggcccggagagcggctacgagaaggactgctgcgactgcgagagcggctgcaaccacggcagagacgccaccgccatggaagcggaagccgacgcaccactgctccccccagtcctcctgaacagccatgaacacactaccatgagcaaaacacatcatgcatgaccagaacacagcatggaattggacggaggacggagatggaggcggaggagctctccacggtggtggtggaggcggtcgagaaggagacctcgcccttggctcgactggcctggcccccccgactcatcggctgcctccgcgtcctcatccttcacactcagcacggggggacccgtctcggccggcgtcctcctagggcgacgcaggcgactcccatgccctagccactgccgccaccctcctcctcccatccgcctcgccgccacccaagtggcccaccatcaaatcatctagctgtaaggatgacggtggcgaggctccttatccccccagtagcattgtggttggggcacctaggcgcccaaggtggaggttgcctagatctgggtcaccatggttggatccgatgaggggatgttggtgggcatctttggccgtggtggtaggccgtgaggtaacaggagtagtagagttagcggctggatgataggcagtgatagagacaattgctggtcctctaggcggtgatggagattgttgttgggttacaggagacggatacacgaccgccgaggttggatccctccagatccgcttggtggggacaggtggtagcggtgacggtagtgacgacgcggttgggttactttgtgcctgaacagctgcagcagtggaggagaatgctagcagggtagtgggcggtggtgaaggcaacaatgggggctgtcggatttggcatccccatatgcagatccaacgtgctcttgaccagatccgaagaggtggcgggatggatggcgtcaaggtggcgcgatgaatagtgacggcgtgtggctaggaagtgacatggtgccttgatatggctttccccggcgaggtggccctcggcaacaacgagcgatgacgatgcaggaggggtgacgaaggcggcagtcctcccctaaccccttctcctatcatggtgacggtggcggtgatgtggtttgtccatttgtgtcactactacaaaaacggtttttcatggcgtcaccctaaaattttcgctggtggccatacgcgaaaactgcagcaacaaagtaacaaggggtggggggcttcggaccgccagcgaaaattgatcttcgctagcaacggagttgagcgggccaccagcaaagatgtcgcagttttcgctgacggcgaacttaagacacagctagagaagatggcaaatttttgctggcgggcgagtggcgtggcctccagcgaagatgtagctatctttgctagtggccgacttaagccaccaccactcatattggctttacaagcggataacttaagtgacaaccatcgaaaattgattttcgttgtcggctgctgctaaagagaacagcctgtgaaaatcatcgccacactaaaaaaaatagtgacattaaaaaccaccacccacctactgcctccctctcctcgctcctcctcctcctctctagatccacctacccacccaccggccaccgcctcctcctcctctcaagatccctctcctcctccctcaccggcggcactccatccctcacccaacggcggtcgtcgtacccctctcctcctccctccccaccagcggcgtacaacggctccaagatgctctcggcgatggcggctctcacgtcaggatctctcggcggcgggtggtggcacagcaagaccagcggtggcacaacaaaggggatgcggcggtagcgaaattgccctcccctcacctcccctcctctgtccataggggaggaggccagcagtggcacccttgccctcccctctcctcctaggcctgtctagaggggaggaggccggcagcagcggcaacaacattaatagaggaaatggcttccttcacctccccttttccaaatctggcaggaggggtggcagccagcagatggccggaggtggtggcttcggcgaccgcttgtccccaatggctttggtggctagggttcttgtgaattgtgggatacgctggggagctagggttttagtgatgaatttttatgttccgttcttccatttgatgcagcggtgatgcagacgattcgatttgaatttcatgtttgatatgtggaaatgggatgattagatttgaatttcttgtttgattcatggaagagggcagctgaatgcatatggttttttttgttgccaaaatccatctgcactgtcggtcatcttaactcaccgcttgcaaaaattggatttccacagatggtcggttaaacctagttgcttgcgaaaaccattttcactggcagttgggctaggttgcccactagtgaaaatgatttatcgctggcggctggttgccgccattgaaaatggtgcattttggccattggttgctggcggcagtgctgaccgtcgtagaaaacccaagctggctgccaagaaaaatcaattttgtagtagtgtatagataagacggagagactgcggtgctcactagagtggtactgatggtgacagctctcctccatcacgacgatgatctacggtgctagcaatggagggatgtagtggcactagcgcggtgtgacaatgtgcgggagacatgtctcttcctcaggatgggactcctacatggtgtctgtctggcgatggggcgctagtgtggcggctagtgggtgcaagggaaagaggttctctggtcgaaagcctaagctgttttagggtgaacagcggcagcgttttctagcactgcttggaggcgttgttgtgaagtcttcttccttcccaatcgaatcctttgggtgaaaactttgtccttgtttccagggataggcgatggctgcgccctaggcgtcgcagctttgttggaggtattgtttgaaggtcatttcgcactaatctattctgtagagggtttgttttccagctgtggcgcttttgtccaccattttggcgggtccacgtggtggagagcagatccatgcttctctctcgccctctccctctcagatttgagtgcaatgggatgttgtgttcttgtctatttctcagtggcgggccatgtgtcgaggcatgtggcatgacatgttgtatttcctttttctatctatagccttctagggctatagtcttgtaaaacttttctattatatcaaatgatatctctcactatcatgtgcgggtttcgtttaaaaaatagaatggagctagctagggagtattagggctccctgatgttttccaatcctgattgttgcaaataatagaagggaaagtgtggtaattgccaatccgattttagtgaaggtcatcatcaacatctctagttccccagtttctagtacagcttaccgtgggtgtctcttttttggtgttccataaagtggaaagcgcgataatttaggatgtactaatagatccgaaatttggaaattatagaattttcagaattttttaatccgaaataattaaatttgtacaaatttggtcaatgatggggcgaaggttggtgggagaccagaagggttggcaagaggaggaagatcgagaactccacctccccgcatggaaaaaggtgttggccattaacgcgtgattaattaagtattagcccataaaaacttgaaaatggattaatataattttttaaaacaacttccctatagaaaacttttgcaaaaaaaacgcatcatttatcagtttgaaaagtgtgcgtgcggaaaaagaagaaggtgagttggttaagaagggtggagaacatagccagttttgaacttacttgggtgttgtgtccatgcctctaataatctttcagcctatcttcttattggttctctattctactgctcctccgtgtaaataatacttgacattttggataagagtgatatcaaatattaaaatatttgactataaatattttcttaaaatatatatattactttatcatatatatagattagtctcaaaaagtactttaataaaatcatacatttgttgatatttgtatctatattttaataaaaagtattggtcaaagttgtttctttaaactgtatcattgtttaaatggcaagtattatctatctagagggactagtttttaatatgatttgataataataaccattctacccattttagataaacctgcagtggccaggggtttaggatggatagatggttttgaagtagatatagttgagatgtcttcgaaatatcctttgccctagattcaaaattctttcctatatcttccatttaaattttttgctgattttttaaattttatttagagtgaattgtactttgggcagaatttgtcaggaagttttactttggaccacctttcacataatatttttctttgaactacgtattttggccctatttcattttggaccagcccaactctcttagcacatcaacagcctcaagaacatcgacatgctcatgtcgacgatcttcctaatttacatatatgtcatgcttttgatggataagtgattggatgtgactacagaacagtattagggtgatctaagagcaataagggtaaagatacctaatccaaactgaaaaacaaaggataatggatggcccgaagtaaaatcactcttatttattac

SEQ ID NO: 71374 - DNA, 1583 bp, Oryza sativa
tttttctcctacagaaatgactttagttgaagtcataattgaggtatgcaaggaagaaaaggattagaaactgtagcgaatgcacgaaacttgacatcaggaaatgcagatatatgtggtttgtgtctttgtgatactgctgtgttagtgtggtattaacaccatgacactcaaacgatgatatgtgttatgcaaacaacaagtacacttggctttgcaaaataatcatatcctgccatgatgagctagatttaccttttcatttttgtggatcatccaagcacaattgattgagcaattagattgtttaacatactaggatgtacttctaccctccaaacttgtgaacttgtgtataccaagtgtttagtacctgaacagcctctttttgtgcttcaattcatcaagttctgatcattcgaaagcatctgcatcattattctatcatgagggcccatcgttaaatggcagatggtattatggtcttggacacattaatggcaaagaagtagaaaggtttttggagataaacagtcttaagaaacatttgacgccttaaagggaaggttgtacaaatagcatgaattaccacctttcaatcagcagctgaagataaaatctaaatcttcctagttcctacatactttagacattctttagattttggcattttgtttcttgattgcttgggtaattttaaggaaccatttagtgagtttgtatcaatttgcttcatgttcttttttctgaatcatcggttgatttatttatctttgtatattccttgagctggaaatgttctaacacttgctgatgaaggtgctcaaagaaagaattgaacgtgtcaaagctaagaagaatggggcttttacatctaagagcgaattcactgaagagatgttagagatacgcaaagcttttgtcatcatccatggggagatgattcttctgcaaacctatagctccctaaattttgccggtgagctcatcaaaccaagttggctagtttgaagtatgttatcagtagtatacttctcatgcaatgccttgatattgtgtgcattcaggacttgtgaagatactgaaaaaatatgacaagagaacaggtggtttgctcagcctacctttcactcaacgtgctcgacaccaaccatttttcacaacggaacctttaacaaggcttgttcgagaatgtgaggctaatcttgagctcctgtttcctatcgaagcagaagtacttgagtctgctagctcctctgctaagttgcaacctcagaatgatgatgcggctagccatgacccagcgtcatctgtcgatgttgaaacctcggacgtgtaccgaagcacactcgcggcaatgaaggcgattcagggcctccgcaaagccagctctacttacaatcccttgtcgctcgccaggttcttccatggagaggacggtgaagcctgctctggagccatcacctctgaaagtgattcctattctgattcccagattgaagatgctgaagatgatgataaagaggtgcaatcaagggagcagaatacggctcaaaatgctgcagaaggccagccacgtgatg

SEQ ID NO: 71375 - DNA, 36402 bp, Oryza sativa
cccttatttatatacttaaaaaggtacttgataaggtatgttttattgcaccattccacattgatatgagcttggaatttcttcagaagagctggattataagggacaacccaccggttatctagtgaaacaccattcttcaccacatagcagccatcattgcgtcatcgataaataggatatccatcatcatctatggtagtaacatcacagaactgttttggatagccctttgaacaccgaccatccttcatgcaagggctgcttggattgtgctcaccacatgggccatgtatcatgaattcatcaacaagaccaacccacacctatcagctgttatatctggtatctcagcacagattaggttgtcaatgaatgcaggtgaaggatcttcagattgagctgtgagccatgttaatgtgtgggaatgcggcaatcctcttttttggaactcaacagtgtacacaactgaaaagcaaagcaacaagaaaagaacagataatgtgttaggggaagcaatagatgtgttaggaaggagatgtacgtaaagataggacagctatcatgaataagacaagtaacacaccagcttttatgggaccgaaggcttctccattcttaatagatgtgatgtactcatctagcttcatatggtaaacacgtgtgaccatatcacttctatcacttggtttttgccctgcctcaaaacgaatagcttcaataatctctggccatttagaattgcaggtgaaagttgagaatatttgaggaggagccgtaagaacggcagattgccattgaatcatggtagttttgaaccatgtatcgccttcctcctatgaaacttgatggcaaaattacttggtgccaacatcctttccatcactgtctcccctagcaacagcatcagatataccttgatgtgtctcagagcgaagttttttctggttgagggcatggtatatgagtcgagatgtctctatacatgagaaagcattcacagcgagctgatcagaaagcctaccacaacaggtgaatggattgggctcatcctttcgatagtgggactcgtaccgataaaattcaagcatcgatgcttcgtcgtgactaccgggtggctgatcatctacctctctaagcttgataccagtatgaaaacccacatcaccatatgggaatagaagcgggtactgcaatgacataagggctggatgaataggtgacaactgacataactcacctgaatgcttctgcacaatgacatcaaactttgatacctcacaagatgcactaggtataatcagtgctgccaactcagaggtggtgggaaggctgtaacggtcactctgagaatggcctgacccaatgagcttgatagcaatctcaggagcacttgaagaaagcagcttgtttcgagcaagacggaactgctgcacaagaggattgaactgatcaagcatcgagataagctcttgcacaataacaggatcagggacatccccaggattatcagtgtgatcaaaaatattaagcctattctggagctcattggcggtgtcatatatgtacagctgggcgaattccggacgttgtccaggagcaggaaccagagaaccaattctgtgatggacaacaccattgatatgaaaacataaggccccggaccagtgtttatgctcctatcaatgttagccccaagcgatgtgaatgcaaataatgaattatattgcctgatgagtcgcatgaaagagttggaatgggcaccgccatcaaaacgaatcaagtcttgtaagataggaggaaaaggcttgggtgcgggtaaggagatctttccaccacgacaacacagattgtatgcaatcctcttggctctgtgcgagctctggctaacaaccctttcttggtaccaaaataatgcaccacaatgattgcattcatagtcagggccaccataataggagcgatctgggtacgtagctataagagcggaaaggaaacctataagtagagaagcatgcatatgtttgtccagaaatagatagagaggcaaaaaaaagggacaaaggcgaagcaaagcaaggttggtactaagatattacctttaagaatttgcatgtgctcctttggtatggaatatgtgaatctcatcgacagtgaacgcggcacatgttctgtgcaaatagaagaagaacggaagaagagaaatagcaaataagaaataaaggtaaacaaaagcaagaaagaacatcgccataagcgacaagaaaggatcatgtacataagcaggtcaagaaccttgtcgcaaaataagacgcattttcctagcggcctgtcttttttcccggttcactcgagcaacacgtgctggcactattgggcaaaaatgatctcctatgaaaaatttaaacaggaaaaacaatcaatcggaagaagggaaaatgccttagcaagctaagcaacacaacaaatagtagtccagagctaactgttgggtcgagaagactgaatgtggccagctccacaactccctgtggaagtgatgcgaggagatagaatgagggatcggagagaaaacaaagctaagctagaaagaaccaatgagcaaatagatgaacttatcaatatgaacatacattttgagtatatcatatcacagcaagtggacaactgtacaaaaatatgagaaaatggatgtgcaagggataagagatgacactaaacattgagacagcagcgactacagcaagcgtacatacctatagtgcatgatgaactacccgtgagcattgagaacccagtggcaccgtgggatgatgacggctcatctatcagaaggcagaattgcgaatcaggaaacaaaaaaacaacaattatcctaatgacctcgctaactctcagactattgagcgtacatacctatggcacatgacacaccacccgtgagctctaagtgcttattggcagcagatgatatggaggacccatctattggtgagcaaaagtgtgaatcagggaaaaaaaggatcgctaatggccttgctaactccgaggcttgcatacgaaactataatgatatcaccaagtaccatgtggacgcttccgcgggcagatgcgaacgaatctggatggctccatgtcatttctatacaccaagaaacgaaaggagcaaaatatagacacattcggaaaaacatatggatgaatatataatggagagggaaagcataaagaacagaggcacgagctactatagaaatatggaagaaagatagatgcatataagcaagcactgaataactggacataatatgacatatctaacagcaacaaagtgggaaatcatcaagagctgaaccaggagctctcggatgcttagactggaacatacaaatatttgaaaatgcgtttacgaaaatggtaaaacaccaaagacataaccacattgaaaggctaacccaaacatataactgtataaggtccagcaaagaaagaaacagatggacgccgaacgaaatcaactggcaacaacacaagcgttcgaaaaacaaccaagaatatatatcacagcggaacaatgtaaaacaaagtaatcagtaattgaaggagggaaaaaaagaggagcgaatatatatcatagcggaacaatgtaaaacaaagcaattggtaactgaaggagggaaaaaagaggagcaccatatatacgaaatccaccgaacagctatactggagacaaaagcatctcggtttatacatatcgcagcatcgcatatgtgaaatgaactaaacatgtatcccacataagcgataaaaaaaccaacctacgaaagaatatataacatagcaggacaatagaaaaatgaaataatgtaaatatatgccaaagcacagctaattagcaatccaagggaaaaaaacagaggagcaccatatatgcgaaatcaagcaaacaggtattcgctgacataatcatctcagtttatccatataccacagctccacacatatgtaatgaactcaacagctatcccagtgataaaacaatgtgatcttgtactaaataccttagcgagcattagctgacgaaggcaaagatgcccccctccctccccccaaaagaagatgcgatgtgtgggagagacgccaattggagcccgcaacctggaaggcagagaaaaaaaatacactgagcacacgcatggatggaacaatgtcggcatcgcaatggggaaatcgacagcgagacacggcaggaaagatgaaaaacgaaataacataaatatatgccaaatcgtagctaatcaggaatccaatgaaaaaaaacagaggggaaccatatatgcgaaatgaagtgaacaaacatccagtgacataatcatctcagtttacccatataccacagcaccacacgtacgtactgaactgaacaggcatctccgtgataaaaccaggtgatcttatactaaataccttagcgagaagtagctgagggaggcaaagatgccccctccctccccccaaagcaagacgtgatgtgggagagacaccaatccaagagcgcagcctggaaggcataaaacagggaaaaaacagtgagcacaagtatggctggcacaacatcggcactgcaatggggaaatcgagagcttgcaatggggaaatcgagagcgagcacagcaggaacggtcggaccacacgagacgatgcggtgagggaaaccaccgagctagaaatccccaagaactaagcgggaggagcagcaaatagaaccagctccatatatggaagaaaaaagggagtggaagaaagaaggagcgatgcagattacctcccctggtcctcatagggctctccgcgtagtggagcagcagccgtagccagccccgtcgtcgtcgtacgcccatggcagagcactatcgttgctccgtcgctgatggtcagataggggatggagaaggggcacgcgtcgagaggatagcggcgaccaacggatgatccagcgcacaggaaaaccaggacggagcaaggtcacggcaccgatgccgcgatgggcctatgagcactaaaaggctgccgtgcattgggccaaaaaatcagctggcccatatgtcacgtcccaaaacgactctaaaatatatcccttaaatgatgcctagaataattaaaatccgtgtgaaagcctccaacaattaaaatgtgtaaagttaaaagccaaataaggcttagaggatttttgtaaatctcctaaaagcctaaaatgcgtaaataaattttagtggaattttcagagcacaaataataattattaagaaataaacaaagttaaaatgattttataaaaagaaaaaccctaaaagtcccccttccctcccttgggccggcccggcccatctctcctcccccctttctctctctctcctctccccgcggcccactcggcctctccccgcgcgcgcgccgctgacgggcgggcccgcccgccaccctcgctaacgggtggggcccacccgtcatccccttcctcccgccgctcccgccgcctcccccgcgccctagcgccgccgccgccgtgaatcccgccgcctcccgccgtccccgcgtgcaataaagtggggggaatcactccccgtgatcccctctccctttccccccattttttccctctctctctctcgcgttcaaacgggcggatttgcccccgcaaatctcgtcggcgccattgatggcggccggacctcccgcgccggtgtccttcccctccggccgctctctcccccttccaaccctatttaaaccctccccgcgcctccctcgcccgtttccgccccttgccgcaccgtctccccgctggaatcgagctcgcgccgtcgccctctctctcctccgtcgccgacgacctccggccggccttctccgctcgccgggaccgtctcccgccccggcgtcgcctcctccggcttcgccgcactgccgtcgaccccgtccaccccctcgccgagtccgccgaccgccgaacgccgtcgaccccatcgacccgagccgcgtcgccgccttcctccgctccggtcgcctttttcgtcgtcgccgtcgacctagggtgagccgtggaccgccgcctcttttcctccttcccttcccctctctcggccgccgctccgccgtgcctatggccgccgccggcgaccatagggacgcgggcgccgcctcccgccggccgcgccgagtggccgccgcgtggggcccggccgtcagccgcccgcgccctcgagtgcggctgacgcgtggggcccacggcgccggccggtgcgagcccgggtgcacccggtccaccgtggaccgtgaggctgccgcgtgggccccactcccgtggacccggtccgcgcgccccctcccctcggctgacgcaataaaccctttttaaattaaaatttaaatgaagaaattcgcaaatattcatttaaagagcatataaacttcaaatggccataacttggccatttgaactcggaattggaccgttcaagtctcttttttttccttaagaagtcaagaacccatttttgtgctttgttcctacttgttatatggagtttattagagtaaaagcccttttatttttccgttggtcatgtagacgttgcagcttcggaagatccgctcttcgtggaggttgaagccgacgtttgggaaagtgagcaaggcaaatcacatcatccttgaacatattgaatcccagtttataaaattattttgatttaaattattgcactatcgctttatttaaattctcgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggaatactcttatcacctggacactatggaatggttggattattgtggaattggattcacacctccccctctattcaaaaccctcaaaatgattttaggctgggcttggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgtcatggcacagggccggtgtcctgctgctaggggctcagtcctgcctacctatcccgggggttccggccgtaggtggggttgggtcggtactcttgtttatggctaggatgggttggaaactatgtcatgtcttccgtccgtataccatggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacctgcctaacagctaaaatgtggaatggttggcctgggttggcttgggacaagctgggacccagggtcgggttgccagttcggtctgaatcatcgtaggccttgggttaaggcaggttcgtgtgggttcacggccttagttaataatattgtatagctctaggaccgtgtttacaaagtagctttaagcaactaagtgacttttaatgctgtttactgcaaaccctaaccccctatattatggctcccttgtactcccttgcatttattctgcacttgtgggtgtgtcttgttgagtacggtggttgtactcagtcttgctcaatttttcccaaacccagaagaggagcccctggataatgaaggctttggtgtctagctcgtgcctgccgtcaagcgcttgtggtcgtcgccctagtcttccgctgtttttcgtttgtcttcttgtgtgctgggtcttcgtcgcccatgtaataaattaattaattacgcttccgcttgttaaactctgaattgtatcaacttttggtgtaccttgcctcctgggacaaggaataatgcacgcacgtaaggaacgcccgttaggttatttctggtcgtgacaccatagaagcgctatcctggcttggcagctgatcaactgtaacaaaacaacgtgtcatgattgtattggataacggctggctcaatcgcccggaaggcagctaatccagcacctttaagatatttaatattagggaagcgttatatctgttttgtaattttgtaatattagggaagcgttatatctagaattgcagtttagtgatgattttaaaattcgaggacaagaaaaagggacgtcaagtgaacttttttccttcttcatcaaatttaggattcctacataggccgatttattccttgaaaactcaacaattcacaagaagggcttttagggccaaatcaccacataatttgctcgtggcccataaataaatctacatctatatacctaattaaaaatatgtaaggcttcgagaaggattttcgtccgtccctcctcacgtcggtcaaggcgacacgactcctccttccctcccgcgtgcacctccccctccccctcccccactccctccctcctaacggacttcatctctccctcacgatcctgacaatccccctttccctcacagcccctctcctatgtggcgcccctcctccccatcgccccttcctcctagcgcccatcttcttccctttcgttccctccctcctgcgcgtttaacgaatatggaaccccctcatccgggaacgcgttttgacacactcactcggccggttcaccaccagagcttgtcgttaccatttctctctctgccaggaccacttgttgttgtttccgctattctagttttcttcattaccaaccgccaccatttatggacgagtcacgtcgtgggatacgtccggccaccttactcaccaccgtttggtttccatatgaccgatgctcatcttcccttctcttttgtttcttgtttcggctaggaaaggcgatggaaaatgttaatctttttttccatctttcattcttattgcgtattcaaggaagacggaaccctcttgttagggaatacgttttgacacactcatccagacatccagtcatgttcaccaccagagctcgccattgtcatttctctttctatcgtaccacattgttgctagccgcatgcatgtttattgattttcttcttagccaacccccaccatctatggaccactcatataatattgaaaccataggaatatgaataaaacatgaaaattcgaatttatgttaataaaacaggacctattcagaactaatagatcggattttcatctatatgttaaaataagcttttttaaaaaaaattctagttaatttcagttgtttttccatttccatttttaattttagcactatttgatccactaaaaattgttgtaacttataatattgaattgtttgtagctaaattaaaaagtaatttattgatatatttttttgatattaaattatcgttccggccaaagttatttgtagtttcatgttgatatttctatgattatattttcttcagtccaattgtgatatatggtttaagattttagtttaatcatatttctttcattccaattgtgttatatggtttgtaattttagttatgtcagtgttatttagaattcgttgcaacgcatgagtattatgctagttaattagtaatgagtaaatttcattagcggtacataaacttgtcaggtgggtgcaatttagtgtataaacttgtaaattactcgttttggtgtatgaacttgtctggtatgtgcaaactaatactaaaatggcacgacaagaccgatttttctatgatgaacataataaattatatattagtagatgtcgtgcttatacatagtagaaatgttatatttataaacttaggttccaatttatctttctttgtttctgtgccatgcatcattgctcggatgtttattttttttatgcaatcattataccttattatatatttatccttcttagacacatgtttacatagagtttaatcttgccgtgcgattttgaccttgttcacactcaccaaataagtttgtgtactaaaacgagcgttttacaagttcatgtattagattgcacccacctaataagtttgtgtaccgctgatgtaatttacttattagtcatttataagagaggaattaactaatatatttccacgtgggtgatttgactatacggaagcaaaggccaactaattaaacattttcttgtataagaatgatttctctcgtattccaggaatgcgaatcggtgaatttgaagactaataaagagagaagacgacttatgcatggcttctaaattttgctaaccgtgactttgtggactaataatttcgtcacatggttattctttaaatatatcgtctctgtgccccagctgttttactttattttgttggagtcgatccgtggaaataactgtggcttgaagttatagtaaacctttaccctcgtgcatggttcatgattgaagtctcaccgaacgttttgtcacaacgttatagaaatcgaccccagaacggctcagcaggaaagaggcacgtccaaatgcgcacgaccgagacagaaacaccatagttctgccaccgaacccaaacagtgcgtctgtgcgtgcagcgacaccagtgttgccaccgtatgcggaatcgcagttacctgtaccgtggaaatcccttcgtgtagcctggcataggtacgtaattccagtactaggctcccatcggttgcccatttggcctaaaatggcttatttggcttattagaaatttcaaattaatttataagtaaaacttttatagatttgttcgtagcgacttaaaagccaatattaacaaaaaaaatacgttaaaagcattttaaaatcaacttcaaaatcaagttcaaaaatttaaattttggcttattttttgcttgtctaggccaaacgatggggctactagtgtttccggcccgatctgctctgactttctggagcgagccatcgtgcttgtgatcacgtcgtctccggcgagtcacctcactcgtggttagtactgccactatctgaggtaaccaccagcacagtacatccactgatcgagagaacggaaagggcctattcattcatccccagcggtcggcgccgcggaagtccgtgccaaattctcccccacgctgatcgagatctgaacggtggtgacgactcacgcctcgtcagtcgtcagtgcccgcctcggcgcctcggctgcccgcagtttcggcgcgtgcgtacgccggcgcagacgccagatgcaattcacctctccgggtccgggcggcaacgcagcgtgcgcgggcgtgacgagcccgagggggggcggcggcggccgatctcgtctcggcatggtgccacggcgccacgcaccctcgtctttccgcatagcttttctccaggttcacctccccttgctgcccccaccaacgtggccacgccagcgcccaaccaccgcccccgcccgcccgccccgttcggccgcctgcccccacggccccacccacgcaagcgccccttccacgcgtcacgccgtgcggcgaccgaccaccctcccactgattgcgaccgccccctcaccacgtgtccctcccacgtcgtccccacgcccgccctcacacaccccgcgccactgtagacactgtcgtgtggagcccattggctctgtccccaccggtcagtgaggggttggtggacgactatccagtcgtgactcgtaagggcccagggtaaataggtaggcctgatatttgtgggtcgcccatgagagagaccccatgtggggtgggccccaccaggcatcaataaataacctgtctgaaggcgggctggcgccacgtgttggcagcacggggttaggcgataacaccggcgtcgtgatcgccgttaacatcaaccgcctggtggaccctaccgcgggtgggccccggcgcacggataccttccacgtgttgcgggccgggccggggcgtggccacgcgtcgagatcaggtggagatggacggctcagattccccggaacgggagcacgtcacaacaactggacctgtcgggcgctgcccgtgacggcgacgggcacctgccctccttcccctcctcctcctctcctcccccctaccttctcttctactccccccaccacccccgccttcgtgcttgcgtgtcgtcgcctcacctcgcgcctccgctactactgcttgtctgctgctgcagctgctgttattaccataccgcgggagaaggggggccgaacccgaaggcgtgcgagagggaggtgaggtgaggtggagccgtggaggcgcttgtttcgcgtgcgagacggtgcttcgtttcgcctcacgttttccgagggctacggcgacttggtgggagcgcggagaaaatctagcgagccgtcggagttgggtggcgcgcggccggctgtgcttctgaaggaggagtaattggagtagttgcttgccatggccgagatctgctgcgaggaggccatgtcgccgccggccactgccacggctgctgtcgcggcagcggtctccgcctcggccgccgcagccgtctcctcggcgatagacaggcggcgccgcaggatggagatgaggcgcatccgcatcgcaagtgatctcgagctgcaggccggagaggatgggcgccctggaaagcggcagaggctggcgcgcacggcgtctggcgccccgcgtcctgacgaggattcggcgtctgagcggccgagttgtggccgtacggaggagttcccgaggtatggggtcaccgctgtgtgcggccgccgtcgcgagatggaagacgccgtgtccatcagaccggacttcttgccggcatccggcaagttccatttttacggcgtcttcgacggccatggctgctcccatgtaagtgtttgctgatgtctaaatgtgcgaaccggatagtgatctgtgcacatgtaattcagcgtgctaattcgagttctatgaatattaggttgcgacgacgtgccaggacaggatgcacgagattgtcgccgaggagcacaacaagggggcctccggcgaagtggcgccttggagggatgtgatggagaagagcttcgcgcggatggatggggaggtcggtaaccgggcgtccacccgcagcgacgacgagcccgcctgcccgtgcgagcagcagacgccttcgcgtcgcgaccacgcgggttccaccgccgtcgtcgccgtcgttagcccaacacaggtcgtcgtcgccaacgccggcgactcccgcgccgtcatctcccgtgccggcgtccccgtcgcactatccgttgaccacaaagtacgtatatgctcgcatcacagggccggctgagcctttcccgtccatctgcaaaaaatcgttagtttcttgtccatgagcgtgtgcctgacatggttgctacttgctacctcggaacggttcagcccgatcggcccgacgagctggaacgaatcgaggcggcgggcggccgcgtcatttactgggacggcgcccgggtgctcggcgtcctcgccatgtctcgagccatcggtgagctgatctagttttaccttcttctctcgtcgtctcaagaattttgatttggcacccggatccgaaactcacctgcgtatgggcgcgcaggggatgggtaccttaagccgtacgtgacgtcggagccggaggtgaccgtgacggagcgcaccgacgacgatgagtgcctgatcctggccagcgacgggctatgggacgtcgtgaccaacgagatggcgtgtgaggtcgtgagggcgtgcttccacaacaacggtccgccggcaccggccgcgcggccgagcggcgtgccctcctcggccgaggcggcggaaaccgagaacggaggagccgcatcggtgaaggggataagcaaggcggagtcctccgacaaggcgtgctccgacgcggccatgctgctgacgaagttggcgctggcgcggcggagcgcggacaatgtcagcgtcgtcgtcgtagatctccgccggggattgtgattcttggcgcaatattctatgctccatgattgctttctttcttcttcttttttttattctaagttaatttttcccttcaaatttcttccttatttctctgtttagttttagttttactactagctcctaccaagataaatgaatataatagccttttttttcgcacaaacacgaaccagacagatataacaggagagtgatcgtaggcgtaagatttcggaatcaagaatcaatgcgcacatctttaatcctgccgtagttaatcgttattcgatcctaatgtctctgcaagtctgcatccatatgggtaaaattggatccatgggatgctaggttccgttgacactaccaaaattagagcatcttcatgaaggaagcatgaaaaagctcaccactcgtgtgagtgctagcaacacgtccatcgtgcatcctagaaaaggagaaaaaggagaggaaaaaaatagggaaacccaaaaaaaaaaacgtcccatcgtgtgaggctatttcggtggccatcctaggatgaggacagacagcagagcatagaaattgatgctgatccatgcgtgggggccgcccccatggtggtgagctgaactcggacgagattctcctgctccaccgctttctgtgtggaaatgtatggtgtttcttgtgataaagttttgagccccaatgatgcgacccacgagcaaatagctggggtccgcgtgtccagcctcgtcccccttttccctttctccccgtcctcgatgcccctttgcgttggcgacggagcaccgagccaccgagaggcgggagagcactcccttcgccgcgagttaggcgccgcaacattattgggggctgcacgctctcgacgcaccccggggcgtttccgcaacagaacatgacacgacgcgaccgggagcaaaagggaaccagctgtcgcgatacagcaggtgggaggagtagcgaccaccaaattttaaggcagcgtcgtggtggtgactccgtgctgactcgaccgtgcgtgccgaatcgttcgactggattcccggccaacccctcctaaaaataggcgtcggggggcaacgtggcgcaacgcgcgccgagaggtggggtgtgtgtcactcacgccgcgcgctggggacgacgggacgatgaggcgtgtgcgtgtttcccccgatgtgcccggcacgacacctcgccccgcgtagagttgacacacgggagggcgcgtcgccgtcgcggatccagcaaaggaagatatggcgcgatccatcggcggcaagggcgggggaggcaacagacgaaaggcgtgccgcgatcgcgatgggacgccatgcgtttttttgtgcgatgggagatgaggacgacgggacaggttacggagcacgggagcagcggcgaatcgtgatccggctgcaatccaacgtcggtggcatactgacatcagaggaagggcggggaagcaacggccagtccagctccagggctccaatcgtgcatgatctgattgacgataggcgtatccgcataggatgcttgctgtttctgtgttctgccgactgacgtcgcatgcgtgaaatagccaaacagggaactatacttgcaacagaaagagaggtgcatgtagctgcgccacatctacctatttggaactcatcccttattactactcactactacaaaatctatttttcatggcatcactttatttttttttctttggcggttatacgcagaaaccgccagaaaaaaattaggggggggggctatgggccaccagcgaaaatgaatcttcgctagcagctcacttagataaccaccagcaattttcgccagcgggtgcttaggagcaccatctgagaaaataaattcgagatataaatcctatccacctctctccgcgctttcgtggcctctcccacccaacccaactttctccgcctctctcccacctttctcgatacctctggcctcccccctctctctccacctttctcgatcttcctccagcctccctcctctctccaccgccgtcggctgccgtcgctttcaccgccgccgcatccgtcctggggaaggcgagagcgaggaggacgaatccgctgcctctcgtggcctctccacccaacccaactttctccgctctcttccacctttctcgatacctccggcatccctcctctctccgcctccgggcctccctcctctctgcaccgccgtcggctgccgtcacttccaccgccgccggttgccttcacttccatcgtcgccacggcatccatcctcgggaacgcgagggcgaggaggagggatccgccgcggcctggctgtggggagcgtgcatccgccgccgtcaggccgcggggaggatggatccgctgccgccagcacgcggggagcacagagctgtcggcggtagctgcggggcctcgtcgtgtcgcggatctcatcgtcacggtcgccgccatcgggccgtggggagcgcggttccgccgcctccggccgtggggcctcgttgtcggttgcgtcgcagatctcgtcgtcatgaccgtcgccgccgggcgcggggagcgcggagctgacactgctgggccgcgggtagggatggcaatcgggcacgacgggcacaggtagtgcctacccatacccgtgcccatgagattatttgtgcccgtgggtatacccattactacatgacgggtaaggatggttgcccatgcccattgcccacgggcgccttgtgcccgcgggtgtgtgcccgtttacccgctacaacaaaagcagtggaacaaaaagtctacaagcttctaagttcgaatcgaactttaaacatcaaatattcttcgccttggtgtggtgtctctcctctggcggcgatagagtaaggggaagagaaataataagggaaataaaagggaaaccgtagaaaacaaagaacgtggctaatgtattctagtggactttgctcctcgcctacatgtaagttagactttgcgggtaaatgggcaaagtgggcatgggtagtgattacccatacccatacccatttacccatcgggcatagcttttgacccaataagatacccatgggtataaaatggagaacaaacccaaccctaatagagtttttacccacggataaacgggcaaacgggcacaattgccatccctagccgcgggcggtggtgctcggccggtgatcgttcgacgacggcgacaacaagcggtagcggcttaaagtttctttggatttgtgcaacgatccgatccggttaatgtgtttggagatgggaatggaaattggtgtgattctgaatgaaaatttttttaccgtaaattattgatgcaaattgctgtggatttgtggatcgaggagtggatttgggaataatttgaactggtgttgacgaaggtggacagagcgatgttgctccgtcattttttttagccttggacagtattaacactggcggctggtatagtgtaccgcctatgaaaaatggatcgtgtggtattcaagtttcgcaggcggttagcttacgaaaaccgtcagagaaaatggatctacgctggcggtcagctaccgccggcaaaaatactgtattaccattggcctttagtcactggcggtgctgtcagccaccagcaaaatttcattttggcaaaaaaataatgatttttctagccgtgactgtatttaatttgttccaaaatggtacggcggtgattccaaatttatgatgtgtttagttcacgctaaaattgaaagtttgattgaaattggaacgatgtgacggaaaagttggaagtttatgtgtgtagaaaagttttgatttgatgaaaaagttaaaagtttaaagaaaaagttgggaactaaaccaggccttatagtctatagctatattttgagatgggtagctacgttaatagcttgtcaacaatatatgttagtgtagaatgtcagttagcacttggaagatttgtttataatcttcccagtttaacactatcaatcttccgcgcacagttgttgtgatgatggtcgaaacaagtcggtcgaacaaacgcattccacgtatgatgtaatatagtaactgtgctataaaatacagtcttttattctctctggagaaggtagcataaaattaagtttttctggagggtaacataaattccagttgtttgtggcgctcgctagtcgctatcacagaaataggcaatggctcgtcgagtcgttttccgtcttccatcctgtcttgtcctagaaaggccttcagtccttcacccttcaagccctgcttttgtttccaccaaagtctctaactgggccttcaccaaatactttcgcgaacattgtactacgatggggctatttttctgggtccaccaaagaggaaaatctattgtgtggcctgcgcactacaaaaagggcttgggacacccatgatctgactgggccgggagatctgccttggatctgactgtttgagagtctcttctttctttcgctaaaaaaaggtctcacctttcttagtctcccctgcaagagatgtcatgaccaatatgcaatgaacatactcgagagtaacgcatagtctaatatgattgcaatcaacgatgcactgtattattagagcaagttttatggaggggtgcttgctagcctttagttttgttcacatcatcaactaattaattaagcgatagtatataaaatagattacctctaatacactagctccagtataatataattttttatttgcatccaatttacactggtctctcgagtctcaattttctcccttagagtttgttaagaggttaccttttgtatgaggagtggccttttctcttttttctttgtcctctccttcaattcacctcataatttagtcttagtatatggcatcatgggatctggcttaggtgtccttaatacttaggtggtgtttagtccctcccacccaaacaccaccttactcttatactggcataatgctcgccaggttctgaatgtggtctccaatagatatcttttataataaagtagaataacaccaaagttgaatgtaccttttttggagcgtgtatgtgataagcatatgcttttgtattgtgtttctcaaataataaaataaaataaagcagagtgacgtacattagattggtaaaaccaaacaaacaagtctaacgcgatcgcaattggtttcgtttgctcatgtcaatctatgggtttatgattacgggcatgtttagactattgccaaaacaactttttcataatttagcatacccaaattttttataagagacaacatcgccatgttttgatagggtaaagttaatttggatatgtttagtttggtgcccccatataggataccaaatgttggcaatattcaaaggataccggattttggtatgttactatggtattgccaaattcctgtagtcattgctatttgctaatgtttcttaacaaaccgacctatgttttgtattccactttaaaaaaaatagcatggtttaaattgttagaatcaatccgaataggtcttatgtccacttcacgaaattcctgctgctcgggcgactggccggggccggggggaggggagagagagagaattgggcgctctccatgtgctacccctggggccccatcatgtgcccctgttacctgccacgtgtctccaccgcatactccattgcaaaaaatcacccacatattttggaaaccctctattaagagaattcgttttatttttttccacaaaaaatgtttcacctagtatactcacgatgtttcactatgtatagatctaatgttgcagtgaattgaaacattcttttgcaacaaattatccacatattatagaaaccctctattaagggaattcgtttcattttttgttccacaaaaaatgttttacttagtgtacttataatgtttcactatgtatggatcaaatgttgcagtgaactgaaacattatttcgctatttgctgaaacattgttttttatataaggtgaaacaacacccgatttaaacgattgaaacattttcgatctacttagtgaaacaattccaaaatacttggtggaacatcgtgcaacatttaaaaataattcaataataagctaaaaaagtttcgccggaatatatctatgtgtgatcttgttttaaagatttaattataacgaatttaatggtgcaatcggattatgatttggacaaataatttaagagaaaaaaatagtttaaagtggttttgcacgtatgcgtcatgctgacgtcaacgtccgatttcccccctccctgtcgggagcccgacgcggagtcgtcttctccacttcatttatcaaatggagctgattttggataggcatgggatatgccggtccaaattttaggtgttagggtgtgcttttagagcaattttaataataatattgccaatcactagttttaaaaattgaaacattatttataaccaatctaatagctcatttatataatagttaattatagatatatactgcatcattaatacctaatatattaatgattaatactgtgtgtaacaagaactctcttccttttaatatattgacgtacaatctttttacgtgccttttatctctcccttcacataagcacaaatataatgtggtacttcctccgttccacagtataaaaccttctaacattatccaaattcatataaatgttaatgaatctagacacatatataaaatatatatattgatcaatggatgaatctagataagtccaaaaagtcttacgatataaaatggagggagtgacttggacaatctgtttacgtcatcttattatactcactcttatatggataagtatataaatgtgtatatgcgtaaatatgtttattgtgtttctaataaaattactaccacattgtttcgattttgaaggggtgggtaggagagaggggaaaaagtttcctcctaaaaaaactagaaagaggaggttgagtcgagggaccgatcgaatatgtttagttccacgctacaattaaaagtttgactaaaattgaaaatttgaagaaaaaaattataagtttatgtgtgtagaaaattttgatgtgataaaaaagttagaagtttgaaaaaaaagttaaaaagggtaccgcatagtgccagatagtacagtagccaccaaaaagcccacatatccgactaggagtacgtttttacttgcttcccccatcggtctccctctggcgcgccgctttggcttttccgaaaggaagccagtcatccatctcccccgatttaacccgacgccgtgccgctagtctgatccgccaccgccacggtctcctcctcgcccccgtgcctccgcctcctcctcctcccgtccagcccgtatcgacgagaccagcaaggcgccgccgcgcgcggagctctcgacgcccgccgacgacccgcccgccgtcagatccgcctgctgcatgcttcctccaggtttagatcgtttccaaaaatcctctgcttctcttcagtaattccacccgcgtacggggtttctcgatcagagcgggggttccgtttatgatcgggtcagggtttacctattccttgtgatttgggcggcatgcgatttttggattataggtgacgtttggaggatatgtaatattatgggttttcaggaaatcgtttggatgctgtagttaccaaccaccgcagcatgcctagcaatttgtgcaattactcgttactcttaacagcactcacgctgtcacgcgcggtgtggcacactgtcaaaatttgagatacgttgacacttcatcattggtggaatctcgtgaaggaattatttcagcggatgtgcatatgctatagtatgagaacatctatggtattatgtagatacaacaatcactaaccagtcacgagaagaaggtttttagttgtgattctataatatatttgagaatcaaaactaactttacaagcttatgtgggtttgacccttcaaaatttcttggagttttttatagttcaacaagcgtcaatgattgcgattcatatatatacattgtttactagtaatggtttgtgtgagttcttgagacaaaaatatgtggttgaccacgcaccaaatgcattgttccaccactgcttttggttgtgatcattttcgcatagatagcgtcatgtcatgctgcattttgatggtgatgttgtgattcgtgaatgcaagcaaaataaacgcaatggaaacattttttttgcaagtcatattttttgtttgtttctagttctcatcgttatcttcttttaataaatgtgtccctttgttctcttagagcattttcccctctcagaaaattggaaacatttaataagcatcagagtgatcaatcttagtgaatacttaatagagaacataattccatcaatgttctgttcagagcaaatttgtagaaaagaaaaccaggcaagcattgaccttctgacttgtggttagaaaaattatctggttgaatctccattctctttgtttttaacagtatttttatttgtacccatgtaacatcttgtttttcctttttggtccattatatttcgttgttgaactgcaggatttcagtatgactgaacatataaattatgatgtggtggagcagtgtgttaaaaacatcctctctctaatcaaaccagtggaggatgacagacgcaaacgactatctgcaattcaggagttatcaaattccattcctaaagttgcagccttaagaggtgagttatctcatatttgataatttttaagtttgtaacaatgtaatttttgataagctaaatatgaaatgcaatggccactgtggacagttatggtcagttatccttttggcacctacagctgaggcccttggtcacttctcttgtgatttgttgctagaatggtgggaacgggcaacaagtagaatatctaagaaacaatgtcttccagtgatagcagataggcctgcaggctgcagaaggtggtcacaagttgtcggcgaatacagatctaggcgacttaagtttagtctcacgcattgcattcttttcagtagctgtcagtttcgtattagggagaatcctccagttgtttgttgccttttttttcctttttgcttctaattatctgcatcatttgatctctcaagcctttttgcatgctgctaaaaagaaaataaaggcaatggtgaccagtgttcagtttattttttcactacagtcctaatgctgcataatgtggaactattaggtgtttgttttgctataatggggtcatgatctcttcaaatggtatagattgttcaataacttattttccttcatatacttgcttagtcaatgcacaggttctctaataagtttccatgatggcaaaatgaaatgtcaaaggatttaatgatgatatgatggtggtgatttagtgttgccttatctgaacttttaaatttctttaacaggtgctgttttcaaaccttttggatcctttgtatcaaatctttactcaaattcaggtgatttggatatatcggttcacctccctaataactcaatcataagcaagaagaaaaagcaatatgtcttgagggaattaatgagagtgctacaaaatagaggtaaaccttttttaccatattacataataaaggagcatgcagacttcttctcattgcatgatcattgtacccatgaaataataaccatggcttttgcggtaaaaccataaaaggattccatattatgcaaccacacatttacgcacataggatagcaaaatcatgtaggagtactaaatatgatgaaccgtgtatctttatttcaaaggagaattggacttgaaattcacaaccttgtgctactatattgggcaattctttttagtcatacaggtagctcttatttatattatgatttcgttggttgaattgtgtcaggtgttgccggatatgtgcaatttgttccttttgcaagagttccagttcttcagtatgtgagcaacaccttcggaatttcctgcgatatatctgtgaacaactaccctggtcgaattaaatccaaaatcttctgctggatcagttctttagatgtgcgttttggtgatatggttttactggtaagactaggtaactagtagagagtttcttgctgccccatcattttgttggaaagcccaaggttcaaactatgttttcttgcagatcaaagaatgggcgaaagctcaaaacattaatgatcccaaaactgggaccttaaactcctattcactttgcctactagtcctcttccattttcaggtaatattcatctgtggtatttcaagttatactgatacatgattttaggaatatccttgttactgtctttaccttattccagacatgtgagcctgcaatccttccacctcttaaggagatttatgaagggaacattgaagaaggtattgctggtaaaatgaactaatattttctttgatgatgattgtctagcatatctgtatctgaattcattgcatttacatacagaaatgacggtgtatgatgaggaacatcttgatgaggtttgctctgaaaatttagcaaaatttcaaagcaagaacaaggaacgaaggaatgaaagctctctttgccatctgcttgcaacctttttccacaaagtaattaaacagtatgctccgtttcattggtaaagttagtatgcttcttgtaaggacatatttgctgttcatgtcttggcgaagcatgtcttcatgtttctaggaatatttcctatgccatattttagtaagttatatcgaggttgctggtgctcatgtagtttaataagttgagttatttcaaaagtctttggcccttgcttttgttcagcatcgtggcatcttgttaaactcaaacataccttttctctttgtgttttgtattttttaaactaattaacacttgacagactcttccttttagagaagtaagacgatttttgttataactcaactcatcttccatgctagcctttgttttgctcattttgttataagtccaataagatgatttgtgttcaaatctaagctaagtgaaatagctacttatcttcctttcattaaacataattaaacaaatgagctaatccctcctttttgtggggctacttaattactttgctccattaaactatattttatccccattaaaataatgctactgtcactgaaagcatatttaagatttagatgccatgcacatttttcattcgttactttttgtaactcatgagatacgagctttaccagtaatcttacattgattgcagttttcctctatcggcaccctttcgggtgatgtgatatccacttacacgggccagttcaaacgaatagaggagaacccaagttggatggccagatcatacagcttatttgtaaggatttccttttatggttgcattcagcagtcttattgaaatttggactatttactaacacaatctcgttcgttcattatctccttttcaggtcaaagatccaattgagagacctgataatgccgctagagcggttgatttgaaaggccttgagcggattgctggggccttcaccgctgctaatcgtaagtttgcatctctccaacacgccaaacgaaatgacttactggagatgctgtgtacgcctgctgttggctcaaagcttggcataagagttagccaagaagttatggctaactcttgcacaaatactccacggaggaaccgtcatcatggtagaccaacggaacaagtctcagcgaggccatctgataatcaaaatcaccgcggggccagagaatttacagttgggagacaagttcataatcccccacgggcgcgccaatcaactggagcgtaccatgctcttaacagtcagcatgtaattcctgcattgagccaaccagcaggaatttatcaaacagttggcccataccagagtaatggtcatccacaggtgtatactagagatgtccaaacagtagggcaccaaaattataggcatccaatgggacacaacacacagctccaaacagtggaaccatatcagagtaataatagtcaaccacaggttcatgctaccagcatccaagcaccaagacaataccagaattatactcgataacgcccggccagaaactacaatcaccaagtgttacatgctacagcgaccgagacaacggccagaaactacaatcaccaattgttacatgctgcagcaaccgagacaacggccagaaactataatcaccaatcgttacatgctacagcaaccgagacagaaggatcataccggaatcagcagcagagacaacacacatctggccgtcaaacaaataggaacgctgtgaacacaaggtacgtgcctgttgttggaaggccacaaaatgtagcatgtgaatcacgagctcaagactcctcaggcaggggaacatggcaacaaagggagccgcgagcaggatcaacctaccaaaatagatagcaacggattatcttcagcttttgcatcgcagtgtgtatgagtttttggtagtttgtgatagctttcgtcagccagcagtttgatctcagtgccgctgcaatgcagcgaactgtattgggtaaaatgcagttacaagattttcttttgtgcagatgttgtcatgttgctacacgcgtggctacgattgattgcgctgtagctgagaactgtttaaaaaaatgaagaaaaaacagtttatttttatatgtatgataaactaataaacgaggtaatctgcagtatcagccgtttaaaagattaaggcttttgtagtagttgggaactcatccttatttacgaaaaagaagcaacaaattaatatataattaattaagtattagctatttttttaaaaaaagttaatatgatttttaaagtaactttcctatatttttttttcaaaaaatgtactgtagcgtgcgaacccagcctaaggccgagaaaagaaaccaaaaacttacatttaaagtaacttttaatacttacgttttggttgtggctgataacccaacaagcagacaattttactgaatatttttgcatctggctattttaattgtctagttgtgaaggaataggtaaatatagggtagaaactaagtcaaaactcatgtcacccaatcccccgaaaaaaaacataaaatcatatataagttccatataaattcatataaaaaatctcacgcgtagatgatatgatggtgggcaacgtttaggttcgactttctttgtgagatgtgatttttcataacttataaacaaagttcaatttggacaatatatctcggtgtccaccatcatctcatatatggccttgtttggcataggtttggatccaagattttatgaaattgggtatccctagcttcacaaatttatagaattggatctaagattttatgaaattgggtatcctagctgcatcaaacactctcatctatgttggggttttcacgtatataggagaggcttggatgccaaatagagtgcatatcagttcttgctaccataccctcttttttttttctcacaaaatctatatgttgcatttggaacactgccgtttcaaaaaaaaaaatcaaaactcataagggaaaaaaaaaccacgtttcaaacggcttcctctgtggtttccccagaaactggataagcgttcccctcgggccggctccgacgtgctacggactgggccttcgcgcgccgtcccgtccccgctcccgaagcgaaaccaacgcaacgcacgactccctcccactctaccctcgtctcgtgcgcgtggacgactccctttgcctagcttgactcgtgcgccgcctactttcgccaatcgccatggtgcaagccgcctcaacctcctcgcgctttctccgcacaacccgtctccacggctcctccacctccaccacgccagcggagcccgcagcctccgcgtagccggcggcggctcctcctcctctcatcgcgctatctctctctctcggtaaacccctggcctcggttagtatctgaagtggatttctcgcttggtctactggcggggttcgctcgatactcctcctcgagttagggtttggcgaatacgaccaaccccgcggatcgcggttggatggcgactagagcggccgcgctgctctgagaatgcaatgtacctttcaagggttcggtattttagttccttgcttgataattgctactactgcgacaatctcgcggttcgtttgcgaagaaatataaagagggtgccttgctgtggctgtgcacttctctctccttctttgttttcacccgaaagttgtgattttggtgtggggttttgatgtagagaaattgatgagtaccacgggtattgccagccaaatattaattgcggaatgtggggaatggggaaagggtgttgccttcgacgtggattcgcctgctgcgacacataagcatgcatatattcgtagagtggagcggaattctgctagcattctgtagttacccagttacgttaactactgtagtgctaatgttagagttaaatgatttatatgatgaagtgatgaagtatacttttggcctgccgacttcgtctggggtttaatttacacaaaacttcaataccttgtaaactacacacccaaatatcatgcatgcaaatcacatcctaggggtggtattgcgggtgttttggttgatgtggcatgcaggtgaacgtgggggcatgatgatttagggaaagaaaattatgtgggcctttttctctttcctagatggggtgtggtatgggtgggagtactgccatgtgttaaagaaattgatgatgtggtagccacatgacccaatggccaacacctctagtaacctctttgggtgtattctgcgctggaaactggtggagggatgaaaatatattaaattgcagggtgtacattaaactagagcaaagttaagaaacaattgtagggtgtacgtaggtcgttgcactgttggtttggacttatggagcaaatattttacaatttacattagaaaaccaggacaaccattattcttgtaactgtaatgggtttgaatgcggttatatctggttatggtgcttagcgacgccactgtgtacccatataatctcttttgatcatacgtctatatcatttgttgcccaggatttcaggatgtcgatttggcgtgtccctaattatgatgtgttggagaagtgtacagaagatatcctctctctaatcaaaccagtggagggtgaccgaaacaaacgaatatatgcaattcaggagctggcagatacaatctattcagctggggccttgagaggtaactcacacctaaagttaccacataacccctgtattatttgaaaatcttccgttgggttccttgtatttattgacggtatggtgttgtgatgtttctacatcaagcttggttagacttatctatgatcttgaagagaaaatgtgttttccactttattgctgtgaatgctagcttgggcatggatttctgatagatctctgaaagaaaagacccagtcttataggtgtaaggtgcctctgcggtgcctatcgtatttcttgttatattcataaggaaccttaagttttaaagttatcatcacactttgtctgggcaatagtttgaaaatacaatgagtgacatatttatgcaatccatagtacttaaaagtgatgtgtttgttttgtgatcgatgctagaaaatggtcttcatgctgcgattgctgtatggcaatgggaactctacggcagacccatgaggttgctagcaggcaactgttgacctatgacagttcacagtacacagtaaccgttaaccaacaatttgtcatatcatgcctgacaaatgacaatcacgataagcttgtgttgctagaattaagggtgggcataattacctgaaaccaaagaaccaatccaaactaactgagaccaaatacttatgtcagagtttctaactaaccgaatttaatttggttataggccttggttaaccgaattgaccgaaatatagttaataagcgcaaaatcaacctgttaagcctattaagtatcatgtttgaacagttgaattttgatgttaagttgcaagtgctatctttgtgttctatatcatttgttgtttattttgtgactttttactgtcaaacatgtcctgaaactggggaattgctgccaaattttttactaccgaaacatgtcctgaaattgatcaatcagttcggtcatgacctaggaccgaaccaaaatgaccaaaaccaaatagcttggcctttatgattttgcattgaatttcggtcttgattttcggatggccaaaattcgagaaaaccaaagaatcaatccgaattaattgttcaaaccgaatggttacccatagccagaatggagctgctcaaatgtcacataatgtttttactggattttttttttggttacattctcttgttatacaatggatagtgtcttcctcaatgcatatattatttatgaagtttgcatgttggaaaagggtaactgttagagaagtcagcagtgcaattattttagtgtttctttttctgagttcttaactttcctttataggtgcttctgtaaaaccttttggatccttcgtatcacaactttatgcaaaatcaggtgatttggatgtgtcagttgagctgttcaatgccttgaatctccctataagtaagagaaagaagcaagataccctgagagaagtaaggagagctttgcaaaagcgaggtaaactttcttttcgattaatgaaaacagctttaaccgaaatgatagaagttttggttgtgtgttctttgtgatcaaacaaatagtcactatatgcatatacatgcaccaaggaaagcaataagtgggctttgcgcgtctttgatgcagcggccaggttatccattatctaaaaaaaaaaaggaaagcaatatatcttgtgagaggtgaagtcactgtaatgaataagttttgatcaagctattcacgatcttctttttgttccgtacttcattcaatgcaaccctttttgttgaatttacaggatattcttatctgttttcattccttatttaggtattgctagacatatggagttcattcctaatgcaagagttccagtccttcagtatgtgagcaaccaatatggtatttcctgtgatatatccattagcaattaccctggtcgaattaaatcgaaaatcttctactggatcaatactttggatgatcgctttggtgatatggttttattggtaagctctgtgtaaccaagagaattctctttttgctacaatcttcctttttgttaagccatgttttttggcaggtcaaggaatgggccaaagctcaaaacattaatgatccaaaaaatggaaccctgaattcctattcactttgtctacttgttctctttcattttcaggtgttatttcttactttacaagttacctctatttcttatttattgttccattaaagttatctatatgcgttctttattctgagccttccagacatgtgaacctgcaatattaccaccgctgaaggagatttatgaagggaacatcatggaggacatttcagataagatttcattatgggaatatggcttacctgtgatggatagtgactatctatttgtcagtgccttgctgtttaactgctgcattcacatacagggagggcgtactataatgagaaacatcttgatgaggtttgctccataaatatagaaagattccggcgccaaaatatggggcaaagaaatcagagctctctttctcatctacttgcatcattctttcacaaggtaattgaacttatggccactatattggctagtcaaccttgtctaagagagtatgacttccttctaagtactgtagttctgttgttcaaatacaggtgtatgttttattcttgtctttaggcatgtatctccacattttgttcttaactatgttaatgaatcaacactggcatttttaggccatatatggtctctcttgagcttgttcaaacatatttggtctgcttaatctaactcactgggggtgtaaatccaatgacgacgactcatatgtaacctttttagtaactagtagctatcaaattgtcagtacatgagctaatctcatcagtgatttcatgttgcttaactcaagatagtcagtaaaatacatttaaaagttatctgcaattcagcatttgtagtatgtctacgcaatgaaatttggcctgaaacttccccaataccaaggttcaagggctagtgtcaaaattgtagcctttagttttcttgctttgtatctgggattattgcatctttctttagttttttaacctgaagagctagatgggcttaaccagcaatttatattgcctgcagtttttccgcatcgatgccctttcggataaggttatatcgacttacactggtcggttggagagaatccaggacaatccaagatggatggacaagtcatacagcttgtttgtaaggctttcctttttgatgcttttggtggttatgatgattgatgttgctaaaagttttagcccaagtgctgatattctatctacttgctatttattatgtaggttgaagatccatttgagaaacctgataatgctgctagagcagtcggttcctttgagttccaagatattgtcaatgccttcagcaacgcgagcaataagtttgtttctgatgcgcatgcgcttactgaccgaaatggattattgtcactgctttgcacacctgatgttggatcaaaacttggtggaagagccagtgccagccgttatacaaataccttagtgagtcctcatgacagatttttatgatatcttgactatgtggcacctaacccatacgatgatcatcatcaccagccagccagaggaggaagcaggtcaggtcagagtccacatgggtatactaccaaccgggaaactgcagtgcattaccagaacaataatcatccacaggcatataacacgcagcggcaaacaacagttcatcaccagaaccagaacaatcaacaggtgtatgctgcagggaggcaaacaggaggtcagtaccagaatacccagcgtagcaaggagaacacatcatatcgtcattcaaattggcgagcagcaactacattggcacgaggccagtttgtggatgattctacaatggagaatggcagtaacgctctcagaccggcctcaccatcagcatcagttgatcataactgatggtcctaggatagcaacagattatctttagctcttgcctgacaatatgtcaatatgcatcacatttcgattcccttaggtctcgacaaacaatatgtatgagctcatgaaatttagcgcaagttattgccagccagctcgtatggttgagcgagcctggggcttatgtgcattttgagatctagaagatgtattgctgaacatgcagctctatcacttctgatgttcaatatataactttaggccatcttccttctccatctatctcccatgagaaagattgcaatggaatgtgtatttctggagctctcttgatagaatgcatggtcatgtatgtaccagttgtgcttcgcgtctatgcatgcatgcctccatggccgcagacggaaacaagaaattgaatcaagcaggaacatcaacaatgcgctcaactttagctgcaaatttgaccatcacagaacatcggaacatgcatgtaacacgtcgacgaaaccgtgcgctctgaatgttgagcacaaacagatcagatagaaaccggaactatatgacttgcaacttatatatgacttatatgacttgcaacttacaaaccgttctttctcattgcactgaattatatgacttgcaacttacggaacttgcattttccactttccaaatttgcaatagagctgtgccaaatgttcgcagtgatcagagaaaacattagagacacaacaacgctgatcatggacgattgatctatctcattacacacctgctctgcaaggtatgcccacacgagtacagaacataagagcagatgttgggcattgcatgccgtgccgaactgccgatgcaaggtgacatgctatgtactcgtcgcccagtcgcccccacgcatatcgatcaatctatcatgcaacgcatgtgtaaaacttgtaaaacttggtttttagaaatttcactataattagtgcaaacccgagttgaaacttgtaaaacttgttagaaattagaaggggccgcgcgaacgcataccaccctactctctcacttgtggggagatggtaggttaacactccctcccatgtgtaatggaggccgttaaactaggccatgagctttcttgatcgctcatcgacctcgtccaggtaagaatttctcaacgttgtacccagcctttgttttataccttctctctggccccttcaactcaaaaggagtgatgtggtactaaactgaatcgttaggattcagttcggttcacctgttgggctctcagggggccgttccgtgtaaattcaacccaaataagtagctggctcctatcatagacaagtacaaaatgatcttacccatctggcatactgaattataatgtttacaagctcatcgtattcgttccttttactacaaggacgtttgagtctttgaggtctacaatttgacgtggatggtacatgatagctgaacataaaagaaacgatgcacatactagtacaagtcaaataaattgaatttagtaaagccctttggttaaaaaaaaacctgaattagtgtatcaataaaatcataagtatttctttgagtatggggaatgtctatctatttgtcgggtgatttctaaaaaaaattcacccagatttgttctacccttaaatttacatccaccggaccacaaaagaaaataaaaatgcatatttagttacacaatacttttatcaaaattacaatgcacttacatgccatatcaactgaatttacaaatgtaattttagttaaataggattgtaattttatatattaaaaaaataccaaataaatatttacttacacaacattgttatcaaaattacagtgcacttacatgtcatatcaactgaatttacaaatgtaattttagttatataggactgtaattttgtattttatttttattttagtttcaattgagagagaacgagagagaacagcgtgcatatcaattttttaggggtgtagctatatttatggcgccatatttttcatcaaaaagtagttggcatgtatttacattgtaagtccctaaattacatatgtaattttagtgtatttacaatgtaagtctcaaaattacatatgtaagtactaaaattacatatgtaaattcgaaaattacatactaattatatatgtaagtggggtgtaaatgaagtgtaactactgtgcaagtggctaaaaaaaatcaactgtagcatatggcgccatatttctagcaactccattttttagagcacaaaaaaagaaattagcgcctctaaccgtccgactaaatcctatgcggattcccagcgctatatgtgcacgaatcttggtacttatcgaactgcctaaaaaacgacaaatccgagagaaaaaatcacacgacaaatctatagcaaaattgttgctttaagtaatctagttttcctcctattgtaccaagttcgttcatcctatacatttctacaatcaaacaggggttatcagttggacaatacaagcgacataattcagaatacaaaatcaatttttctatcaaagtttaaaaaacgttttaaaattttaaatattggtaggggccgcgcgaacgcgtaccccctctgccacaaattatgacgtccactcccacttggggagatggtagacgagcgttcctcctaagtgcaatggaggccactaatctaggccatgagccttcttgatcgcccattaaccccgtccaggtaagtatgttcaaacgtagcacccaaccttcgtggttataccctaaaaaccaggtagggggatccg

SEQ ID NO: 71376 - DNA, 49434 bp, Oryza sativa
tgcgttgcaacgggtgaaggattttttcttacaaaatcataagctgcaattagaaatctgatcgtctcaagttagcatgtgagtatgtctatttaaagagatttgtaaaaaaaagcgaaagaacttaaaaatgaatcaaatagggatatgtattttaaaaaaacgaatggacttaaataccgactcaaaaaggattacgtactgaagtactggcaaaaacatcttcaatttttatatcttttaataattagttaagaataaatagattagattagagataaatagatatatagggatgatgcgttttttctgccccttttaccatataatttttgcgttgcctaccaatgagatttttttcgctgctttttattttctgacgttgttttattggcttttttgtcgccacttttttttcattgattacgaatcagccttctttttcgctattttgttggacggcgttttttccggtctttttttccggctcgtttttatatggcattttttttgcacgaatcggacctctttttggctattgtttttggacgggacttttttttcgcacgaatcggacttctttttcgctattattttttacggcgttttttttgggcttttttttcagatggcgttttctttttcgcgtgacttttttttcacacggaggatggaaacattttagactttttaagtagtactagcaatagtgcccgtgcgttgcaacgggaaaaacaccgtttgatagtgtgacaccttaaaaacctcaaatcggtaaaaatcaagtctaaattgatatattaacaaataggtagaaccgagtctaatttgatgaattagcataggatttaggatttagttttagatttatttttcgagcctagttaggagtttatccgacgaaatttaatttaaaaaatctgagctttgatcaaatttactttcggcccaggtcctcccaagacgacccaaacttgggctggccatcttcggcgagccgagtcaattcgacagcctgcaagtcgagcagctgaccacggcacatatgcggggacggtccgatgcacttccacagcccattgggcgcagcgtaatctgttgctgcggcggcggcctgacgctaggcaaatctgagccgttcgatctattggacggctccgatcgtcctcttgccgaatgaagtgccaaccaggagagaggggcaaaaccctagctcccaaatctctctctctcctgatcctatttctcttcggcgataagcgagcggaacaatggcgaaggcggcgatggcggtttggcaagctagtgcacgcgtgcggtaatgaccgccgagcagctcctgctttgccggctgtggggcgcacctgagggcggcacaaagccgtgccacggcgtcggtggtctggctaggtgggcgcgcaaacagcgacgagcaccgagcggcatggacctctaggcgggaggggcgacgccaagccgacgcttcccgtcttcggcaaggtatggtggaggggtgctccagcacaacgcgcgcacagggaacccgacacgactacgaggaggtgaaggtgtggtggtgccgcttcccgaaaagctccggtgagctttgggacttcaagtccggtaagtaatccgaacccttagcttaattgattttgactgttagggttcttacctgaaattagggttcttcgaatttggggaattttgtcaggaaatttcaatctattttattccctctttttgagttaggggagtttcaatatcgtttatcctcttttaattttaggaacttcaatctagtttatccctttgctcaatttctttttttttctgctttggctagtgtttcatcgcacggacggggacggagggcgctgctcggtcccctcggaaagattgagattaagataagataagatttttacagacgacggaagtaaattcaatcgtaagatactattttattcttttttgttttaattttttttttgcctttttccgtttcgttattacggacgatggaaacgttttcaagtttttaagtagtagagatagagacatatactacaatgtcacgcataatagtatttatttttttaccgcgtcacatataattccttttttttggaattgtaccgaattcgtttttgtccgcttttttttaccacgtccaaagaatcgattcttttttttgcctttttttcacccgatttcttttcgcctggtcttttcacccgattcttttttttttatcggacagtccttttttttcgcctttttttacacgggatcggattccttttttccccggttttttctcgcccgattttttttcacctggtttttttgcccttttttatcacgtccacggaatcggattctttatttttttaccctatttttcgcccgattttttttatcatacagatttggttttttttcgcctttttttacatgggattggatttgttttttcccggttttttctccctgattttttttcgcctggtcttttcgcccgattctttttttttatcggacagtcggttttttttatttttttcgcctttttttacattggatcggattcgttttttccctcggtttttttcgtcttcttttactgcagtcaccgaatcggattctttattttttacccgattcttttttttatcggacagagtcgttttttttggcctttttttacacgggatcggatttgttttttccctagttttttctcgcctgatattaatcgcacacggacctttttctcttctttttacgtgaactcaaagggagtcggatgtatttttcacgggagtcggattttttttttgtttttttacagtttttctcgctttgttttctgttttctcgcttttttttctttcctacggacgacggaaacatgttgtattttttaagtagtgtatatatatatatatatatatatatatatagatagatagagatagagatagtagaagtagaagtagatagatagatagataaaaatgaaaatacaagcatattacatggttacggaaaaaaaaagaaactagcataccaacgcagcaacgctaatgttcgtgaggccatcaagcaaataaaatggaggtagcttgtatttgtatgcaatttagatgtactagcaaaatgcccgtgcgttgtaccggtaatgatatggtgactgaaatttgacttgaactatttatatgaagaaaatgaattgtatttaatgaaatataaattttctgcaatattaattatactctttgaaattataacaaaagtagtcgtgcgttccaacgaaaagaaaaaaaaaagataaaattgaattaaaacatattaaattctaattagatgaaatacaaattttctgaaaaattttggtatttttaagtaggtaggtatataattaaattaatttataagtaaagtaagtgcgataaataaaatgttatggttggatttaatttttattaaattttctatattaattacactcattgaaattttcttagaatttacatagcttcattgctaattttgataatacaaatatcattttagtatttatttaaataaaaatcttttttttctctatgggcttttttcagcccattttcttcttcagcccgcaagcgaccaaagtctacttaatacccccatactccttctctcacttggtggaccgccagcccgcgtgcggctcaagtggtgtggccgaaaccctcgatcgatctgagctattcgtttggatggacggctcagatcagttccatattgatgaaatccctaaccctaacactaaccctctccctccctctcccctagccgagccgagccggccgcctccccgacccccgacgccacctctccccctctccctctccccactagcgccgctttccctcccatcccctccggcggcgccgctccctctccccctccccccagccagccgcctcccctgccaccggcgtcgtctctcccaccaccggcgtcgtctctcccccccaccggcgccgcttcccttcccttcaccctcccttctcgctgtcacggcgcagcgacggcggggtgcggcggagacagcgccctcccaacggctgcgtcgacagcgtcggcggcatccgtgctccctctcccgctctccttcccgtctcgccggcacggcgcagcgacggcggggtgcggcggagacggcggcgacggccatccctccccctctccctgtcagcctcgacggcaacgacgtcctcccaacggcggcgtcggcttcgtccgcgggtggatccgtcggcagtggcggcgaccgctggcggattcgggctccctccgcgcctctcttctcccttcggcaacagtggtggcgtaagctaccgccgatttttttagtttttttgcattttttttcatgtctattgctaaccaaatcggattgcgtacggacgaaaacacggataaaaattagacgtgacgaaaggaaaaacacgaatatttatattagttatagatagatatattagaaaaatattattatgtttctattatatttcaaattttacacgaatgatgcggggacagcagcactgcatgcagccacgtttccagcttttcgcagagagaagaattcaacgcaaagaagctcgaaaaagaaaaaaaaaatgaaaacagggggcccgtcgaaagcagcccatcctcagcccatagtccaacaccactaatccctaattccgtcctctccctcccactaccctcagccgccaccaaccagtccatcgtcgcatcctccgtgcaagcagcagccggctcgccgcctctgcccctaccttctccactcctctttctctcatcttccgccccaagcttgcactctcatcctgcccgtcgtggtgcgcccgcggtgcattttgcctcatgtgcactccgagacactgcaacgacggtgaagaggaggagaaggcggctacagtgaccatggagatggtagatctggcggtgggcggctagcaaggtgaaggctagctatgggtcgagggcagcagccagcaagcaaggcggaggtccgatttgtcggagccagcaaggtggagtctcaaactcttaggtccgatttgtcgattacttcctcttgcaatgctaattttgtttttattgggatgggtttgatttcttccatggatccctctgctttgactataattgaattggtgtggattagagtccaatttgtgtggattagagtctaatttgacaattcagtgttctcttttcttttcagtttcgtgtatgaactgggaattggaaatttagagacgatctagttgtgtaggaaattttggggtccaaattgacaaacttaatgttctcgcttcaatttcgtgtacgagttgggaattgagaatttggaaacgatctagctacgtgggaatttttgattttgttcatgtgtttatgcttgacttttccctgtctgattctgaggatgcacgcagctgtgaaagcgcattgtgacgggacgaatcgaagtgtgacgattggaaaattacgattttttatattaggtatagatatagaaaggattgaggagggaaggaaactgtggagtgtggacacaatcgaccggagaaatcaactctcctttgctcatgaccgaggcagactcgcttttgatggacgaacgctggcggaagcagaaaaaaaaaatcaatacggacacgataggacgaaatcgtgacgaggacagacgaaacgtcctatgaatatggaattatttttaatttttataataggtaaagattatgataagatgcatctagcaatcgtaaatggattcggatgaggtaccaaaatcttgacaaaagcatcttcaacttttataatagtagatgttttagtctttttatctctcgtctagatttactagcatcaattagatactatcacccttacaagtcacttgtattttcacattcacccctacaacttaattaggtacaaagacccccataactcaatttcccttctaactttccctccatcagaattaattgatctctcctcgtttgctcaatttctcatgatttcatcttgtttgtcccagtttctagtgacccgtgagcctccatgggagctatgtttataggggtggacaaaaagctcgggctcatgagcttggctcgggtttggctcgagctcgcgaagctcggcttggctcgaagactaaacgagccgagcccaagctgcctcctgagctcgtttgtaaatcgagccgagcccaagctagcttgcaagctgctcggtaggcttgtcaagcttgtgcaaaatctgacctggcccattaacaggtctggcccatgagaaaccctaacctattatgcgtacagcacaggcactgaggcacagaaacccttcccttcccagttcccacacgtccacgccgccatcatgagtcagcgatggtcgagggcgaggggcatctggactgggcgacagggcgtgaggaatcgagggcttgagggcctcaccggcgccgccggccgccggccgccacctccctcccctgcactgtcggccgccatctccctaccctgcgccaccggccaccgccgccgaaggccgccacctccctcccctgcgccgccggccgtcgcctccctaccctgcgccaccggccaccgccgccgaaggccgccacctccctctcctacgccgccggccgccgccttccttcactgcgccgtcggccgccgcctccctccctattcctagaggccacgccgctcgacgccctctgtgccgccggcccgcttcctcctccccgtgcgcggctgcaccgccttcggcctccctcctcagcgacgctcgtcgacagttcaagctggctcgagctagctcgagctttggaacgagccaagccaagctgcctttttgctcgttgtatttatcaagccaagccaagcctgtccctgacaagctttcacaagccgagccgagcctggctcggctcgtttccacccattacaccatgacacaatgacaaggcgagcacatttagggcatgtttagttggcaaaagattttgcccctgcaatgtcatgtagaatatacggacacatatttgaagtattaaacatagtctaataacaaaacaaattgcagattttgcctagaaactgcgatatgaatttattaagcctaattaatccgtcagcaaatatttaatgtagcatcacattgtcaaatcatggcgcaattaggcttaaaagttttgtcttgcaatttcctgaagaactgtgtaattggttttttttgtctgcatttaatactccatgtatatgtctaaacattcaatgtaacagcatgaaaaattttgtttgggaactaaacagacccttagaaatggtgatgggtggaagaccagaagaaaacgaggtggaagtttcttacatgctactaaaagagtactactccatccgtcccaaaataagtacagttttaacacttttcatgctcaacgctcgaccgtttgtcttatttgaaaaacaattatgattagtatttttattgttattagatgataggaattcctagatgataatacatgaatagtaatttatgtgtgactaatatttgtaatttttttttataaaattttcaaataagacagatggtcaaaacgcgggatacggatatctatagctgcacttattttgggacggaggtagtatcaaatttgaaactgactttactgctttggattttggacccttcaggacttgaaacattttgggacatgtttgttgttgtgatgttcaaaattcgaataatgactgacagttaactacacaagagaccaggctgagttggtttccaaattttcccaactcacctctctcttttttatcatgactgaaagatattggtttgttttttaaaaaaaattctatacgaaagttgctttaaaaatcatattaatctattttttataaaattgattaatatttaattaatcatacactaatgagttgctccgttttacgtccgcaagggactagttcccatccacaagtgccgaacacagcccatgtgtcatgctgcacccttgcgctatgattcctatcacaccaccatgttgaaggttgacatgggtcatgagaaattgagcaaacgaggagagaaattagtgaaaaatgaagggaggggaagttagaagagaaatttagttgttaggggtcttttatatctaattgagttgacgaggggaggatgaaaatacaataggggatatttggatttttccatatgaaattaagatatatataaaacacgatcccttttaaaatacctaccaccacacgtagcattagtagtgtagtaggatctaaatccgaacattgattattatggacattttaggttttttcttaattaaggtggaagggtattttagtgtttttgttgtggtccgaatcggtcgaaaagatgggctgctattgatcggccccagccgccctactctcgcgaaggcgcaggacgccgctgctcttctcacgctcatgcgttctcgcgacttccatacatcgtcactatgtgcgatagggtcagctcctacttttcctgtactagaaaaatgaagcttgcttatttatcttgtgatttttttcctggagcacatgtatactttttaaagtaattactttgagactgataaaatctatgtaaatatcatatattaaaagtattattcaatgtgtacttggatttatgtttgtagaatacctaggaagaattatagcatgacagtatacacaaaacaaacaggtgaatttcgtctcacttttgtaaatttaaattttgcatataataaaatactttttatttcttgctatttttctaaaaaatgttttaccttttctataatatgggattaacatgtttaagttacatgcttccaattttaacatatcacacttagcactaagggcatgaataacggtacaatcaccgtatacgagagaatgccattccgtatatattttctaatgtggaggtgagtgagagaagagagagatgatatgtctgttaattgctagatatatatgctacacacaatattttagacagcttaataccatatatgcactccatatacaaaatatagaactaaatttataatgtaggtaacatgttatatgaattctcttgtatatcatgtaaatatgttgtgggactattatagggcaaccgctctctaaactatttatcatgttctttttggatattgtgcaccaacatcctaaaatagtatgtaaatattgaaatattagtagaattactattttttgtcagctttttatatttgtttatacttatcttttttatacacaaattttattatttgttgttttatttttaagtaatatatgaatattataacccaatctaagcgtgtgcatttttttctttattacgttgcaaactatatcgtattctcttcttgagaaacatatgcttttaaaatggcattgacactgaaatttgatcattaatattcatgcaaattatattattattattattattagctataaaattaatactaatttaacgtcacaataattgtatatgagaccaatatactttgattttttttattccaagcatgttatatgctgcagtactcacaccaagggttcagctcgactcggctagcacaggcgcacagcacggccgaatgtggttagctgggatgagtgtgtttggtctagatagcagggacggcaggcgagacatccagaatttgcttgttattttttgttttctcccgcaccaaaacagcagtaaaacagcagtatatgcgtgtgacacaatggcggatttagtggatggtcccacccaaaaaaacagcatcaaccccactataaaaaatagcgactattaaaaagaaaaaaaaagcgatctattctactccatccgtcccaaaataagtagttttgcactattcatgtctaacctttgaccgttcgtcttatttgaaatttttttataattaatatttttattattattagataataaaacatgaatagtattttatatgggactaattgtttttaatttttttataaattttttaaataagacgtacggttaaacgttagacacggatatccacggttgtacttattttgggacggacgtagtatttctctttcctggcgcctggcacgcacggcccataggccccacacgcgagttgcgcgtgtatcgaattgatcgacgcgactctctcctccccctagcccgtagccctagcgacgacgcgatcgggatcggcgatctctgagactctgatctcatctgattttctcacgccacggccacgccacgcgattacagttcacacttcacagagccacgccgccgccggcgctcgcgcgagcgggcgcccccacgcccacgccgccgcgcgcgagtccgcattccgccgctggatcaaatcaagcatctcctgcgtacagtagctgccagccatgatcacttgtggcagcaatactttgagggcatctcgatcgttttcaggacgtctctggcttgacagctgagttgagattattcaggttgatctttttgcttggttcagatttcagacccgtcagactattcaattctgttttcctactcgttttacaggttctgaatttgccaaatgccgaccaaacgaactcaacatgacgtgattttgttggatgaagagaacataatgaagactttcatggtcattagaagacatagacccgataagaaaaaaaaaataatatggtaattttctttagactttcatagccatacaagcttctgtaaatcaaaattttacttaattactagttttatctatgcttgcattgtacatatgtgtttaggaaaaaaaatttaggtcagaccacccatatcctaaatccgccactggtataacaacccatttgcccaatgctttaatgacacgtggcataaagttaaatggtaaaaatggaccaatcagagataattagatttgcgagaaattggtgctgttccatagcactcgcgagagatgtggggttgggtgcatgtgcctgcattcgttactgttgccgctggtgaagttggtgatggcaaggctcttctgtcacgtgccactcaggtatctacatggctttagaagattggactgcactgagacctagaaccttccgcagggtatttcatgaagtatcagatacaaatcacacctaaaacggattagtgatatgcccgtgctaaacactacggtgtaattttaattttctttaaagaattttaaaatagcatgttaccaaaaacaatttcttgtatgatctatgcagttgagtcttaatctaatttatgtcgtctgtcaaatatattcatggcaagaataatatactgtgtgggtttaatagaacggattttcgccaatatctatttaaaagatgcattttcaaccctctaatttaaatatttaccaaacaaaaatcaaaaggttgaaagttttaaaaattgaaatgaaaatttaaaattttcaagtacaatttttcataattggagtaaacaatttaaacttaaaaagtggattaaaaatttttatgtgcatgaagatgagcggcgagtggtgacgagatagataaggcacacgttggccgctatcctttgagcacatagcacaagggcatgaatgtaaacccaaataacagtttggtatgaaacatatgtcaacgtaataatagcatgttcgtgctaatgctactgcggcatttggagcaacgactactataaccacaaattcacaaataaacaaccatttataacacaagaagttcatttaaaaaatcatatcgatggtgttcaaatccatacaaagattattacaattttggtcatttactcattgctacatttcatcaaagctacttggaaaaaaatatcatcttccaggaatcaagacagggatgaacgatttcatatcactggaactttaacccatgtctcacccttttgctaatacttcatttcactcttcacaacatagcacaactactgcactttagctaaaaagaacttctcagccatttcacaagttcacatgaacagaacaccatgttataacgaagcagccatttaataaaacaccttgtaaatgttataaccaataattattgatcaatttgtaatatatactgcaggaaactctggtatggtgttaaaaaaatagatacgcaaagtttctagcagcaaattaccttgttgcaatttacagggagaaaatgataatactcatggcaatacctcagattgagggcaaattaccccgcaacaggcattggtattccatcaaattttatgactgcaaaagaataaaaaaaaacttagctttgatactgaataccatcatgtttcgttttctgcccctcaaatcatttgatctgaggccaagtagagggaggagaagaacaacatttgcaggaacaaagaatcatgcagaagaaattatgcagtaattatgaacatctttacatttgatttgagaataaaattataagcaaattatggagcggccagaatcatgtatgaatgatccgtagttatcaactgatctacgatacactaaagatgcaaaatgtatgatcagggatttgctattaaaaaaataaaatggaactggattcattgttttgaagcaatgcatttgctgctgaaatggggaggattcctaacatgaggtgcttttatgtttcgtgaaaatcataagatatccatggcaaagggagtaaaccatgaaggaaatggtaagaaatgtgctcccggtcccctggtataaaactcatttacagacatgtagagtcaagggaccaactttgaaaaagcttccatcaacaactcgccgaacaatatgataagcctgcacgttttctacccagggataactccagatgattcatatcatgcaggtgctaaaacgggtgattaagcacatatgcttgacttgtgattcatatttcatggtaaaggctgacttggattttgctaacacatacagacaaaattgttgcattatactacttattttcactgcattgctatcagaaaccaagttgtcgtttaatacgatacaaacaaggaattcaattccaaatccttttcatggaaggacaacaaaattgacaatgcactatgatgatgggtgaaaaatcatgaaatttgtgcaaagtcatgattgacaatttaagaaaaatagtgtcacagttgtcccggacaagaaatgccagggaagtgcagctcaggctcagatgatgatgatttacttccaaacagcaggcaacacttgtctaaccgaaagtgcccaaccattcaactttcattctgaatttccgacagacgaccaaaagagagtaaccgcaaatgaagataatggagataaattacaggaaggcagtgcatctgcagcacaaatatgactcactaattcagacaaagaataccaaatcaaatgcatttgttcagatgatttagatgagacattcagatgtatcccttgtttcagagaactttgattctacgcaagtgctgagcttagttgcatctaaagcagagctagaaaggctaatgatcttttgtgttgttttctctcttggggaggaaaaagactaatgatatcaattcaaatgctattttgtcagtttaatcaaccacggttgttgtgttccgttcgaaccatcctttttttttctaatacttataactccatccactcagatcaatctcaacttgtttaaaaatgtgtacatccatcaggtattttagttgatgcagagacacatggaacatatattactcccacagatgtacacctacatagcgaaagtagtagaaagaactatccatgtgacaaccattaaaaacctgagaacaacctagttcccactgataatatttttggtcaggcaatgcagtttgaaaacgaacatcacttattgagccggtgtaaatgccagcgaactccaactaatataccctcttcctactatcgcaatcttttcaggttttgaaggcagatcaaataatgttgcatctgaatagacatgatctattcctagaatatttgccatggatggacagccaccaactgctgtgaagtaaagtgttcccatggtcatatcatcatcacctcaagggaaacaacattgcactgatgtgcaaaagaaaacatgcattttagtttcaggtgtatttgagtatgcagacagtaaaccaaatatgaaagcaagctaaaagtactaacttctgatggaaagtcatatagttatttcacaacatcctacattatgaagctatatatgaaatctcaaaaagctacatatggatggcagggagtttcaaggttggtggattccgaccacgcaccaaacattcattggtcttcatgatattagtaaattttgttactggtgactaactctttagcttaagcgctagaaaattcaatagaaaagctaaagatagatcatgaatttagtttagcctgaacttaaaataaaatgatgactaaaacatatcatcagctatttatcattccatatataggcaattcaattacagtttcacagaaacagaggagaaaaattaaggattttcagacaactacggtctgctgcaaattatatttaaaatagaaaatccattaaaaggtcacctctaatgtgcaaattctgcaggatttataagaccgggggataaggacataagtcttcactgcaggttacaggaagatgagcagctatacaagaaatcatgcaaattggaaaaaccgaggaattgtaggaaacctttccttcactcccagatcacagaaaagcaaaagaactcaccttcaatgtcatacaaggaattgtagtgcacctcacccagaaggttaaccaaagctatagaaaaggaacgaagggaatgatcaaataccaccatttttcattgggatagatttaccaaacccatgtgctaccatgaacctggtgccatacgattggaggtaaaaatatgagaaataattgcagtgtgtacaaacatggtagcatatataccttatcaagtgtaaaaccaacatatacttttgtattaaaaaaatcagcataagcatttacatgaaaagttcagcatatacgcatctacaggaaaccagagaggccttatttgtgtacatacaagatatttttaggtgacatgtctagtattcatttgaaaagggaactttatggcaacaataaccagcgcacagatttaacaaagaaaacacgactcatataattatgaatcgatacctagaatgacccaatagaacattcagtttatatactgaaaaggtaattcagtgaaaacattaagcttgtatataaggcaatacaacttctgactattgactaaaaaggccaattaatatcctgaacttcgcttctttttttttttggcattggaagaaaaagaagtatgtgcaaccagttcgtattagtaaaggattggttccaattaaatatcattttcattatctgtaaatattattaggtagcttgagcaattatttaccttgcaaaaaaaacagatcatatcattgagatgttttactgtgcttacaaagtaatagaggtactttcactttaaagagatataatcagcagtcgatcacctcaagtgcattaccaaatattgtcggacgacgcggcagtggcggcggtggcagttgaggcggaggccgaggaggaagtcgtcaaagcagcgctcttgacaaccgagtctcaagcaattcttacactggagcacgtcaacccttttgcctgatccatgctaattctgctgaaaacaaagaaataacacatatataccctcaacaaattaaagaaatggcaagtactgaagtaggtacttgacatatagagcaagcaggtctgaagtaggtaaattcggcagaatactggagctagtttatggtacacataaatttgtaagacttgatggagcaggccttcaatataatggtaaatgagatatttgcttaaagttgtcttcagctacaaaacactctacagaaaattatgctcatatacattgtaattaaagttgataattctcatggccaaaaaaagtgcagttaatgaaatgaccaaaggttgaaatcccaaaatttcactaaacgcaacacattggttgtcattgaatcactggagcatccaagatagaaatcacaaaatacatcaacctaccagcctcccaggtgtttgcagcaggaacacagggggacagggcactacctagtggttaccccaataacccactaaattttgcacaaacactcatgttcttaggttacagttcttgaagagtagttttgctgttgatcgcgacggagattggggatccgcagtaccggtggcgggataacacgacggcggcggcgcgggcaagatgcagggcgacgggacggtcggcggttgaagagggcgaggcggggcggcacggcgcgacggtcagcggtagaagctggtgggggcgcgggcgagattagggttaggggagggagcaagggtgagagcccctctggaaagaggatggtggaattgcaaagaggagggagggaggaatctgtggcggaggggaggagaccggcggtgagtcggggcgaggggagtcgatcgcgaggagggcgagaccgcaagagtgcggaggaggggggcgacggaattcagggagccgaagatccggaccattacacgaggaatgaaagaataagcgatgagtgaaaccatttgttaaactatagggttagagaagatagtaattataggcaaattttgctacagggcactttgactttgtggttttagctgtgggacatcgtccgaactcacttttggagaaaaacactccataacgtggtaatttgccaatcgacattgcgctgattagaataataatttccggttggagaggagagagaaatcgcatgaaatggccaatgcgaagagaccagctcttgcacgccggacgtcaaacgacacgtttttcgccgacggcgctggtcttgatgatcgtcgcggcaggcatggcggcgtcgtcgtcgcggcgatcggggcttctcggcgagctgccgccgggaggaggactgtgtctttttgcgcctcgagtgctggtgatgatgctgatgcttgtgcctgatgcctctccaatggctgtggtggctgtcagccttcctctccggcggcgtcgatgtcgtcgctgcggctcgtggcgtcgccgtcgagttcagtggtggggccagggcgtcgatggtgccgtttctgttgctctctcgtttgctcgggagcgtcgatgatgccgtgttggatggagttcttctcgccaccccttctccgccactgcgtattggtgttacggtttcctcctgctgttcctgtgatcgtgtgacctcctcggcagcaccgtcaccgacgtcgagtcgacgacagccacgacaggagtgccgccgccgccgctgccgacactcccgtcggggaagggaatgaggcgtccgcggtggggccgctagcgaaggtcaccatgagtgcgacggagaagcatgccagcacggccttgctaatcatcatcacatggccgtcgccgccactgccgccgtgcttactgccgccgctttgtaaccgttgagcaacaatgacgatgaggacggggagaggaggccgtggagctgcacgtgtagcgacccgctactcccgcctctgccaacttggtccagcaccgacaaccatgccttccttgctatctcacgatggcgttatcttctaggagagaagatagagagaagagaagagagataggagagctgacgtgtgggcttaagggtattttttatatttcgcgtgatttctatctcctctttaatcggaaattgttattctaatcggcgcggtgtccattggcaaattaatgtaaaatcaaaggtgtttttttattattctgtgataaacaattggcattgaagattattggttttgttatttggaatttattcacgaagtggttttggagatgattggatttataggtaaatcgcagattctgttatttcatgtgaccggtcagaccgggcagtgtgtgccggttagaccggcgtgtattgcgcggtcagaccggcgcagcccgcggtctgaccgactgactctgtgtcagtttcggtttcgggttgtttgtttggatatccgtgattgtttcatgattatggcttctagatggatactatacgtatgtaatactattgtttgctactaatgagtcaagttggagatagcttggtctcggaatatggtttctttgtttattttatgtgtaggtgactcgatgcctcgggagagtatttgcggtgatggatcgggagtcggcttggggataagacgacatccgtggtggttagagatcacgcgggatacttaggctagagttgatgcacgtggttgatggagattccatatggcatacgatggaggtatcgtgtgcgtatgggatacggagttgaatttggaaggagtccaaatttgatatgattggttatgtaaagtttgtgtcttgtactagagggtttcctaaggtgtttaggacttctaatatgagtttggttcgtggctttaggctgcctacctcgggtataaatagaggaggagcgtgatgcttccctgtatcgctttagagagcaattgagttgagttttgagttggggtttcgagtttagtcgaaatttttgtaaggagtgctattggtgcactttgtaaacacagagagaatcaatacagtcgtcatccactttaagagttctttgatttgtgtttcatcgggtttcggcggtcagaccggcggcgggcagcgatcagaccggcgggagcgaggcggttagaccggcaacgacgacagcaagcggcagctgatctcggcggtcagaccggttaatctacatcggtcagaccgacgacatctgagtggtcagaccggcatagcaacttcggtcagaccgatctccgtcgaattcgagggtaacttttatttccgctaaaagttttcggtttttgggtataccaaccattcaccccctctggttggcttagttattgtgattcgatgctacaattaacacgtttatggagtgttttcccccaaaagtgagtttgggaggtgtcccacgactaaaaccatgaagtcaaagtgtatgtagcaaaatttacctagattgtaccatacatcaatcacatttttttttccagatgtacctttcactacccaatactacaccatctcatgtatggtacaaataaacctcatttattggatctaatataattggtggttcacattcacccgagagtacttacaaaaattctaaaacgaaaccatcttataaacgtgcatccttgcgagttgcgatggaagttggtcatcactagtctttttttagtcacgattgaatagcgaagtcaacaggtttggtccagtacatttatcttcatcacaatcattaagaaaatggaaatgagacagatcaacagtcaacgctccaccttctcctctcaactctcttgctgagatcctgagacccgacttttcacgctgatatcgccgccggcagcgcctgttgctgctactcatggatgtggtgggggcggcgtcctggctggttcaggtcgtcctggagaagctcgtcggcgacggcatcgacgccgcctgggccgcggcgcgcgccgggggggacccgggccgcgcccacggcggcgacgtccgccgcctcggctcccgcctccagagcctccacgccctcctctccgaggcccaagagcacgcgcccatggcacgcaggcgcagcgaggccctccttcgctctctccgtagcctggagagcctcgccaccgatgctgacaacctgctcgacgaaatgctgtaccaccaaatccaccgacggctacatccggacgagcctagtacctcctccaactcttgctcctcattgtttgcagtccaactagtggagcccaataatcgcgttgccaagagggtgcgccatagtggagatggcgataccaccggtagaattaaagacatcctagagcggatgtgtgaagccggagatgatgttcgtgaggcaatcaagatggagaaactggacgtcagtgccgctgggggaggccaagatgatcgtataattcaacggaggccaacaacatcttactccactgagccaaaggtgtttgggagggacaccgtgaaggatcgcattgtggtgatgttgattagctcagagacatgtggtgctgatttggcagtccttccaattgtggggaatggtggcgttggtaaaactacactggcacagctagtctacagtgacacaagagtgcaagctcaattcagcaagcgaatatggatttcagtgtctgttgacttcgatgaagttaggcttactcgtgagctactcgattgtgtgtccaatggtgtcaataagcatggtggtatcactaacctgaataagctccaagagattcttgaggaggatcttaagtccgagcggctactccttgttttggatgacatgtgggaagacaatgataaaagccgttggaacaagctattagcacctctgagatgtagttcattgaggggcaatgcaatcttggttacaacaagaaatcactctgtagtaaagatgattgctacaatggatcctatccatttggatggtttggaagatggtgacttttggcttctgttcaaggcatgtgcatttggtgatgaaaaatatgaagggcatccaagtttgcaggttattgggaagtgcatagctaacaagttgaagggttatcccttagctgcaaaaagtgttggtgcccttttgaatagagaccttgatggtgggcattggatgagcatattgcaaagtgacgaatggaaactgcagagaggacctgatgatatcattccagcattgatgcttagttacatacacttgccttttcatctacaaaggtgtttttcttactgtgcattgtttcctaagggtcacaggtttgatggcttagatttggtccgtgtttggatatcacaaggttttgtttcttcgaacaataagaaaatggaggacattggccatcaatatttgaatgatttagtggattgtggattttttcaaagaagcacatactattctatgcacgacctgattcatgacctggcacatattgtttcagcagatgaatgccatatgattgatggttttaattcaagtggaatagctcagtcaaccattcaacatttatctattaatacaaggtatgcttataagtgggatgtatattcccagaagttttattcaaaagatgacttccagaggaagcttacttatgttggtgaaacagtgcaaaccaggaacttgagtacattaatgctatttggaaagtatgacgcagacttttctgaaactttttcccatatttttaaagaagtgcaatatcttcgtgttctgaggctacccacgctcacttatagcatagactatttactctctaacttcagcaaattgatccatcttcgctaccttgagctaatatccagtggtcctggtggacccttgccagaggttatatgtcagctttatcatctacaggtccttgatgtcgagtactgggtacacctctccactttaccaagagccatgaatgatcttgtcaacttgaggcattttgttgcccgtggtgaattgcacgcactgattgctggagttgggagattaaagtttctccaggagttaaaggaattccgagttggaaagactactgactttcagattggacagttgaatggattaagggaattgggaggatcattagcaatttacaatctagagaacatatgtagcaaagaggagtctaagaatgctggattaagggataaaatatacctaaaggatttgttgctatcatggtgtagcaaccgatttgaggtaagttctgttatcgaggaagaggtgcttgagagccttcaaccacactctgggcttaagtgtctaagtataaatggctatggaggtatttcttgcccaacatggttgagctccattaatccactcatcagcttagagactatctgtctagatagttgcacaaaatgggaggtccttccaccgcttgggcaatttccactccttagaacactgcatttgattcagttgccttcttcaagggttgtaccaactgtatccagtgacgactggactggttctgaaaaacatattatatttccatgcctagaagaacttgtgataagggattgccctgaactaaggacattaggattgtcaccatgctcttttgaaactgaaggctctcacacatttggccgtctccatcatgctactatctataactgtcctcaactaatgaatttaccacaatttggtcagacaaaatatttgtccacaatatctattgagggagtaggatcatttccttacatccgattgtttgtgcgagcattgtatatcaagggatgcgctagcccaagtaaattggatcaaatattaatgttgattgagggcaacctatgtcttcttgagaaattaacgattgagagttgcctcgatcttacatatttgccatggaaaacactcagcaaacttgtctctttggagatgctggtaattgtggactgcccaaggctttctttgactttatatccatataaccaagatgggggtaatttttctttcatgtcattgctcaacaagcttgtaatccgagcatgtagcattacagggaagcagttatctcacttgatcttacagttgcccttccttcattacttgacaattggaaagtgcccaaagataacatccttgttgcttggtgatgtgattaatgggagtgacagctcttcaacatctgattacctccaattgacaactgatggcatgttgcaaataccatctcatctcttaattcaacttcagtatttgagcatagatgactttccagatctggttctactctggaaagaaggcttccatggattcacctcacttcggaccctacacatcacaggatgcacacaacttctctcccccatgataacagaaaacaaaagatccaacaaaaactcttccctcctgccaccattactacatgaccttatggttactcatgtgcataatgagttgctacctttcttgctctcgaacctcacctcgttatccatatttgcaatatctaacagtccagagttaacatcccttgttcttcattcttgcacatctttagaaactttgatcattgagaaatgtgttgggctgtctgctctagagggtttgcattccctccccaaacttaagcatctacggatttttcaatgccctagtttggctaaaacatggggcccttcctcagtggacaggccaggtttctctttatatctagacaagcttgaaattgataccactgtgttatttaacacagaagtttgcaagaagcttccatctcttcgacatttagtgtttttcatggtaactattaacacaattagtcaataatttcgttggaacagataaacttgctcaatatacagtggtttctcatcacttcattttttgcaggcaaagaatgtgagatccttcacagaagaagaagaaaaagcactttgtcacctcacatctctccatgtacttgatttttgttattgccctaatctcctatcactgcctaaaatgttgcattgcctttcttccctgaagcagttgtcaatcaaggcttgtccaggaattaaatcattgccagaaaatggcctcccagcttccttacacgagctctacgtgagcagttgcagtgcagaactaaaggagcagtgcaagaagacaaaaaatgttagatgtgtttatgttgatagaaatgcaagcaaattcatagttatatgcaagctgctacgtctctattttaggtattattttacagttttaaaaagattagcaattttattttgtgttttagacactcgtggaatgggtgctctctgtataattgttttaactgtatcaattgattagtatttatttttgttgaataactggtattgctaacctcagtttattttttgccaacctggttcatttgtaggaaacggaagagatgagaaaaatgagaactactagttatgaatgaaccttcagtttctcaatttataaaaggcatgcctatgcttcgcttaattgattattttttgtcacaagaggaggatagaagatattactgatgaaggttcacatgcagatgaattcaataaaccttgtgtgcactcaaccattctgtttaatatagtagtctcctcagatatctgtaactggatggagcttgaaatgaagatgccatgacttcagcagattagttaggctgcttcatcaccagctggatcaataactactgtctacatgaagtcaagacaacacaaggtgtggctacacttctttgcagaagatttgtttcaattgcgtttgccattattttgtattaaatcatcttttcataacaacaaataaatatttatttgcgatacctgaagtgtccttgttctgactgtggaaagaacataggtgcaactgcaagtttgcaaactactatattatatagaataattgatctttctcttggaaacaaccactgtttagtatatgttcattcagtagtcagcacatcagtaaaataaaacaaaaaactatttagctgctatttattcttgtaaatgagggaattacgatattaactatatagttattctgatttgattttgtttaaggttttagcaagccgatgggggatttatttttgtgtgttttggaggatcaccaagctgggagcatggcagcgatcactatggctgcaatcaagaactgggggaagcaatgagctcatggtcctaaccaagtaagcagctggcagctgcactgttttactgtggtagtattgctctattctggttctgcattaccgatcttcatggctgtgaatagctaggaattttttaacagacaaatcgatcaccattgcccttctcttttccccttgagcattttggttaggtgataatggggaagtctgcactccgagagtgggactgggagcccatgccctttctgcagaacttatttgtctctgcacataataatatatcgtttaatttcttcagagtcctatttactatcgccactacagttgttttcagaactggactagtcatctctgaactctgatagcatgcataggaatgctggacagtgctatatatctcctttgattcttgaattagtgatctttttttccttcaaattgactgatgagttacttatttcaatcctgttcgacatcctacctttccactttccatgtcccattcgaatcctttattctgttgtttatttctgcagacctacttgtgtgctgacataactactttattgtgcctccatttcttaaatatcttcaagtccgtacatacacgacattttctcataaataatatattagatggaagggccaaaatgtttagcagcacatacttgttctaataatcatggccatcttagtagacgcttatttttttgcattcggcttgtactagtctaatacttatacttgcatacatttacgatagatattgcaatcagttgaactatgctgctccaagacagggccggccgtgatagtgtgcttttgcaatatggcgggctggcctggggcagcgttacagtgcgatcgtcctggctatacacagctatacatgcatatatagtttggttgctttgcgctggagtattagttaatctcacctttaaaaccaggccattaatttatccttatcatcactagtacagaaccttctatgtgtaacggcctctaatatgccttcagccgtcttgtcgatggcagttggttctctttaaacgtcctgagaaacctaccccaaaaaataagattacaatgccttgggctcccgtttgggccaactgggggtgccaacatgctcaccatgtggtgagtggtgggcctggcgagacccaacctgtccgaaacggtgccacggatccattcttgcccatttggctgtgtcaggtgtcgctgggcatgcacgaccatgtccagggctaatgacttagctctagtgtcttatctactacgccttttcgacttcagattggtgggggttccttccataaacccatttcacttatggcagagagcattgcttcacagctgggtgttgtcacagcctgaatttccgtttcaggatttataaattatttaataaactagaaaggtagcccgcgtacatacgcggcaactgggcacctccaaacataatatgagtgaaattttattataaatatttatgtgcaggtggatttttatcaaaatatttttattttattctaaactaaaattaaacttattttatgtgctttgaaccctgcttatttcttttacaattaaccttgcaacatataaattataaaataaaattacttgagatcgtgcgattttgaattgatgagaaaatattgtgtcgaaatagtggagcgattcttaagagaaaatttaggatattttaactccctagaaatatatcttacaacccaaaagaaatccaataatatcaattttttgatttattgtattttagtttttatattttcttttcattgcaacagtccttgtaaaatgtttgactttttctatttgcaatgggttttagatctagcaacatttgttcaaatttcaatttatgtcatgtccatttttatttttttgggagattttcattctataaaccatccttgaacttgaaatgatatgatctttgcaaatcgagacaaaaatataaatgcatataacatggcatagcgtaaaggcatacgctctaaatttctctcatcaaatattaaagtaatggtcatggagtttttagcaaatcatcactgaagtggagtatcttataacaaatacatgtttatagattgttctacactttataatttactgtagcatgttttaccaaaaatagaaaaatggacatggtatttaattattatatgaaattgacttgatttattgctaaggccaccaccaggttgtttaaatattaagattttttggtgcaaaccacacgcttatcagtatgatattcaactggacacatctttattttcaacctattatctatattgctagatgaatacttattatgattatgattagtgacttgatagatcatatgtgtaattcggatgctatgatcatcattcttttgaatatttatttatctcctaataagatcattttaaaagtaccaaggtcaatttgtatagatacatagccctcgtatgcatgttatgagaaattaattaagctggtagaaagtcgttagatgcctaacgggatatgagtaagatggaggtacatttgtgtttttttccatatagagaattttaatttcaattgccaaggagataaaaaacagagagaaaagaatggcgcacactgtacacgggcagagaggaaggggggtttggatttttttttctaaatgattaatctaacaacctaaaataatgtgtctgatgtttaagtcaaagccgatggtcaaatgttttgttttcttgttagaatttttaggattttttttacttaagaaaatgatgtaatatcttatgagcgttctctgatttaagagaatgacgaaatatgttaagagcgtttataagatgtgtaacggactttttcacaccgcatgccgcaaagaagaatgatggagggaaggaggttggatttttttccccaaaatttctaagatttttctataatttaggaatgtcatatagcagcttgagaagcgtttataagatgtttaatagattttaacgccacgctgggatggggaggaagggcaagaagtttaggttttttcttattacaaaaacctaacaaatcaatagccggatgctttgttctttttaaagattttctagtattttctctaatttaatagtaccacgtagcagcttagaagcgttcattggatgtttagcatgccagagcgagaactgatagacctagcaggtggaggtctatttatggtttttttaatgtagaaataattttgattttaatttcatatgaagatagctcgttcgtacctacgtgacgggggaggttctggatgtgtcttttttctgaaaaaaataatctaaccttctaaaataaaataatggatccactgatttaaatgaaaatcgatgatcggataagagtaccacttggcgacctaaaaacattttgtaagttgtcacttggcggcttaggagcatttatgggatgtttaatggacttttaagtatataatagtattttttctataatttctaagattttctttaatttaagaattaatgtcatatagcagtttagaggcgtttataaaatatttaatgaacaccgcacgggttgggaagggagggagagaggtttgggatattttattaaaaaaaatctaacaactaaatgtatccatcaacttaagtagaaatcgatggttggttgctttgtatttttaagattttctagtactttatataatttaattgtgccatctaacgacttagaagcgctcgtaggatgtttaaagtgatggaggaagagctgctagacctaatagttggtctatttgtgattttctgaaagaaaaaaaattgattttaatctcatgaaatagaaaataacagatgaaggaatagaagggaagtaccacagtagaaggaaagtaccacagtacgtacgttcgtatagtacatacgctaggaagttcgtatgatgccaaaactatgattttgtttgtttgtacattggttttggatgtgacttttcttttctaaaaaaaaagatctaaccatctaaaataatgggtccaccaactttaaaactagatggttggatttctcttatttattagagtgccactcggcgattgaagaacatttatagggtgccacttggcggtttgagagtgtttatagaaagtttaatggaattttagtatataatagtagatagattattatataatttatattaaaggttcattaatttacaagtgaagttaaatgtggaaaataaaatttcctaagcataaagcatggttggatttaattgatatttgtcgacgggggatacccgtagaccggatatagagggtattgggatacgctggtacgaggatctacgtagtacgacatcaagcaaacaggaaacaaggattatactggttcagaccccttgataggtaatagccctaatccatttgatatgggattatatagtggaaaccacagactacaaagagaatagcagaacttgatgataccgacgagaccgtagttgagttggctcgactagatcaccctggcgacttggttcctaaagactccgacttcgtaggctatggtggttgtgttggcggtaagattcgatcccttaggtcctctcgggggtcccttttataccgcaggtcagttggtctccaagtaggattcggagacatcggaccctacatgatacagtgacgacccagttctgtccaagtaggactccttccatctgtggactccgtgatggatttccttagcgtgtacagagaacgtccgtatacgcacaggtatgccatatcagtgtatgacgtatatccaagagtagagggtataccttatccgtaaccctgacagtagcccccgacttctgcttaaatgaactcatgtaactgattgcgacttcagatgtcggagtcgttgtcattctcgactggtcgatctcggtgtgagaacaccatgtgaagttcaacggtcataagtgaatttaaattgaagtccaaaaactgctgcgcgtaacggacccagaaatttccggcggccatctctctccttttcttggaattcgcaccgtcaatagtgcgcctatttaagggagttttgtggatccattttgaagtccgcctggtgcgaaaaactttccagcctccaagctttcctcgtcttctccgctcccgcaaaaagaaaaccctagcttggtcatcttggtcccttctccggcgatctccggcggcaacggatctcgacaagtccacttccaccagttcgtccctgaagaagctgcaggaagacggcgctctccttggtcgtgggactatggagagagaaccaggaggtactgaacccaaacccgtcctaggccgcatggttgcggttgaggactatattctttatggttttcttcctccaccttccgagtttcttctcctcgtcttgaatttctacggtctttctttgctccacctgaaccccaattctatcgccttcctcagtattttctcctatctttgtgaggcctacattggggtagagccctttcttgatctcttccgtttctactatgagttgcgctggatggaacctaaaaaggtgtccggatgtgtcggtttcaggcttcgggatggcatgaagtcgcgatacatccccttccagtgcccctcttctcgtagcaaatggcgggggaggtggttctatcttcagatagagaattcggatccagtcttcattgttcctgaggagcaaccagataagattcccgaatggaccaccaaacccgccctaaccccctcccttcagtctttcatcgatgtcattgatgacctccgagtacgaggattgttggggtatgaagtcactgccgacttcatcggtaggcagattcagccgccccaggcctgagcccacccagcctttgactattctgggccagaggacgcgacccgggtttctcctcggggtattgttctcgtatttcatattgcattctttatttgcgtgtttctcctgacttatcgagttccaacttctcgatcttataggtttaaacagcgaaaccgtgaagcgccgcgttggtcaggtgatgattagcggcactactacggcgagtaaagtccccgtccccctttgcgagaagggaaaggtcgatcgcgaggctgcgatcaacgtgagtgtatttgagaactcctttacttcttcttttctggatcgcactgtgacttcatgtatgcaggtccttcctctgactgacgtcatcgggccgctcgtggaccaccaggtggtggcttcgttgaaagagggcgtcgcccaggaggcgtccgacgttcctgctgctgccacgaccagtggcggcaacattccgaagagggggaggaagttttcctccgtgcttggtaatcgtcggaaggcgcccaccacatcggtaagcccctttggttctttattgcgtagtcgaaatatcttgtcctcacaccgtactcgttttacttaggcctcggatgcgtctcccccgcctcagcgacggcagaggctggtgacacttggcgagaagtaagtagacgaatttgaggtcttttaattcatcaaactttggcagcctgtcttcatggcaatcacggaaatccttcacagggcggcgcgggcgaaggcggtgcaagacgggtctggagggaactccagtgcgtctcctgcagcggcttcgacaaatgttgtggtcgtgcccaggagttgtgaggcgacgcccagcggccttgccggcggccttgtgcctgctcgaggcccgcccgctgacatcctcacctgggggagctccaaatcgagatggagcgcatcctccaggccggtgctcgcggcatagggtgcgagattgaggaggcgaaggcagcggcggcatcgtcggcgaacaaaagcaccaacaagctggcgcgtgacctggcgcggacctccagaagatgagggagctggtggccggcaacgagcggcaacgacaggggcgcgagcaccgcatgtcggagctcgagaacaacctatcggagatccgtggctcgctacgggttacctaaccagcttgcaccagctcgccggggagtgcggcgtcacgaccaccatcccggcgaatcccgatgagttctcgctgacgtcttcgctcgcggaactggccacggcgatggaggagatcccctccaagcatgcggccaggatcggggaggagacgtccaacgggatctacaccggggcgtgccacgtcctcgcgtgcgtaagattggcgcaccctgaactcgacctcgaatggatcttggatcaaggggctgctagtgacgcgcgcaagggcgtgatggaagaagtcggtgacttgggggagtctgttctccccctttttgaagagtaggattttagttcccctgtactccttagtcaattatgcttgtgaaacttttgttggttcaaactgctttgtgtgcgcagtcatctccttcgttttctttagcatattgatcccgagtactttgttgtcgttgtagagatgtcgatgttgaggatgtccagtagcgcgggcagcctgagtcactggtagtcattccggcacttgcgcttgagctatacgtgcctcgggatgttaatcagaacttgtccatggaagcgggcatggcgacgacttccataggttggttctttgatcttcatctcctttgctctttttgttaggatcgacttaatttgccgtgttctcggaagaggggcacgacttgacttagtcatttccatgttgagcagacctcgagagtgcgttggccgaccgagatcgtcggatccaatattggaggacgaaattcgaggtggccgaactcgagaggactatggtggaggtgaagaaggaccgagccgtagaagcgctccggggtcgcgaggtgtggttcaactcgtacctcaggagctgttgtacggccatggccggagtctgcagggaactccgagtaccttgcggggaccctgaggagtcggcggctggatacatctcgtggctgaatggggcttgtgctcagcttgaaggcgtcggcaagcgtatcgatgaggccctgaagtaggagtgtcgtcgatcgagccgatatgtaggggggcatgtgctggcctgtatccgagatcaccgcccacagctgcacctcgagttcctgcacgaaggattttctcgttctcagaggactcccgcagagatagataatctggcgaagtcgatggcgccgcttgtagagaaggtcttccagtccatggactgcattggccttcctggtagtctttatatcctgtaaaaaatatctcagggagacatgaaatatattttggaatattcaggaactgtaagaattacttgtgaaatagaaaagaaatctatctaactaagttttcttactctggatgcggtgtgtacgagtgtcttctcacttcgcaacttcgatcagtcacttgagtcatacactccccctagcccccagccttgtcatcggagaatttttctcgaaagataaggctcttggacctttgacctgccttggttgaacaagcactgatcctagctcccagccgtgaagttggaaaacccaatttccgattacacggcttggttaatacgcatgacgagaactcttacatgaccagatcttacatggtcatttgtctctacataatctgacaaggccttatccgctctgggcgtccccagccaaagttcccttaggttcctcagaggccttgtcaagacggcgtaaagggacatgaggataggtttcaacgctaagtgtcgtcgtggtaagggatcgtcgggaaggaacactttgatcgtagtctttacctgaaatcaactttattaaagtcgtaagatgtcttacaagtatggatactattgatttatacaaaaaatttacgtaattgatcaatgttccaggaatttactaactcgcgaccatcgccgtctgcaatcttgaatgcacctggtcgcaagacttgcatgatcgtgtatggtccttcccacttgggtgagagcttgttgcgccctgcttggttttgaacccgacgtaggacgtagtcgccgatcgaaagtgtgcgtgctctgatgcgcttctcgtggtatcggcgaagggcctgttggtagctggctgctctaacggcgactctttctcgatgttcctcgagtagattgacgtcgtcgtttcgctgctcctcctgattctcgtcggagtacttctgtactcatgtactctgatgtcgtagctcagtggggagcatggcctctgagccgtacacgaggaagaagggtatctccttgttggacgttgttggtgtggtacgcacggcccatagtaccgaggggagttcttcgacgcacttcttgtcatgtgacatgagcctgtcgtagacacgggtcttgattccttgtagtactatgccgtttgccctctcgacctgtccattgctctaagggtgagaaaccgaagcgaagcagatcttgactcccagcccaatgcagtaatcctggaagtcggcactgatgaactgggagccgttgtccattatgatgcagtgaggcaatccatatttgcaaaatatccctttaatgaatttgatggcgttgtcggccttgatttcccctgtaggtgttgcttcgatccacttggtgaacttgtcgatcgccacgaataggaacttgtagccaccttgtcctcgtggaaatgatccgagtatgttgagcccccagcacgagaacggccaaatgagagggatagtttggagcgcttgcgttggtagctttgtgtgtttactatgaaattgacaagcttcacaccgctgtaccatgttgcaagcgtctttgagggcagtcggccagaaaaatccttgtcgaaaagcttttccatccaatgtgcagccggcagcatgtgacgagatcccacagatcccttcatgtatgttgacgagatgtttaccgtcgtcggacgagacgcatttgagaagtaccccgtttggcgccttcttgtatagatcgttgctgatcatatagtagattttgacatggcgggttattttctcggcttttgcatcgtccttgggcaactcgtcgctacttatgaatttaatgagtgggatccaccagtcatctgtggtctcgatgtcggcaacaacgcgttctgcctctgtagccaccgagctgatgtcgggggcgagtgtgctatcttcgtcgtttgcctctttcaccaatggctttgtccggatgtccagaaaggtgctggattcgagtggctcccgtctggacgcacgccgtgcaagatcgttcggttcgatgttgtccttgcggtatacgtgtcggacctcgattccatcaaatattttttccagcttcctgacttctgcgaggtacttggataactcggggctagagcacttgtagtctttgtgcacctggtttgcgactagttcggaatccccttttacgattagtcgcttgactccaagtgcggttgctactcttatcccagcgagtagtccttcgtattcggcagtgttgttggtcgccctgaagttgaggtgaaatgcgtgcttgaactgatctctcgaaggtgatgtcaagatgaaccctgcccctgctccttggctgttgagtgcgccgtcaaacaccattgtccacgtttcgttgtcggtttgattgtctgacctgttttcaggcatagtccaatcggctacgaagtcggcgagaacctggtacttgatggctgttcgtggcacaaagtgaacatcaaattggcttagctcgactacccatttcgcaatgcggccgacaatgtctttgtttctcacgacttcaccaagaaggaagtaggaaacaactgtgaccctttgggcttggaagtagtggcgtagctttcttgacgtcatgattactgcatagagcagttttcggatcagtgggtatcttgtcttcgcgtcgtggagagcttcgctgacgtagtagactagtctttgcaccttctctctctcgacaacaatgacagtaatcacagaatatggcgtggcggcaatatagaggaataattcttcattaggttggggagcaacaagtacagggggatttgacaggtagcgcttgagtgcgatgaatgcctcttcggcttcctgtgtccatacaaatttgtgttgtttctttagcagagcgaagaaaggttgtcctcgttctcccatcctagcgatgaacctgtttagtgccgccatgcatccagttagcttctgtacttccttgagtcttgtcggcgacttcatgttctcgattgccttgatcttctcgggatttgcttcgatccctcttccagagacgagcaacccgagtagctttcccgacggtactccgatgcacttctccggattgagcatgaggcgatatcgtcggaggttgtcgaacgtttcccagagatcgtcaatcaatgagtcgcttgtcttggtcttgacaacaatgtcatcgacgtaggcctcgacattgttcccaagctgatcattaagtgccccttggaccgttcgttggaaggtgtttcctgtggttatcagtccaaacggcatcttaacgtagcagaatacaccgaacggcgtgatgaatgatgtcttctcctcgtcctctttcgccatgctgatttgatggtagccggagtaagcgtcaagaaaacttaacaactcacaaccagctgttgagtccaccagatggtctattcgaggaagagggaagtgatccttgggagacgccttgttgaggtcggtgaagtcgacgcacatcctccacttcccgttggccttccgcaccataactgggttggctagccactctggatggagtacctctctgatgaagccagctttgagaagcttgtcgagctcttctcgtatggcctgttttcgatctggtgcaaatctccgcagtttttgttttactggtttggcatcgggtcgcaccatgagtttatgctcagtcacctccttggggacccccggcatgtcaaacggctgccaagcgaacacgtctgcattatcgcggaggaaggtgatgagcgtgagttcctatttctcgcctagtgatgccccgatcttgacggtcttgtcggggttggtactggagagcagaacgatcttgattacgccgtctggtttcggcgtcttgttcgttttgctcactttcttgggtggctcagctgtggcgggtgggctgggcgtctgctcgaccatgtcgaggctccgcttgtcgcattgtaccgtcagctttgcgttcccttgaatagtgattgttcccttcggcccgggcatcttgagcacttgatacgcgtagtgagatgcggccatgaacttcgcgagtgcagttctcccgatgatggcattgtatgctgtatcaaattcagcgacatcaaaggtaatctgctctgttcggaagttatttgcttggccgaaagtcacaggcaacgtaatcttgcccaatggtttggacgatgactgaggagtaattcgatggaagggttgatcagtgggcgtcaactcgcttcgtgggattcccatcgtgtccaaggtgctggcgaagagaaggttgatggagctgccgccatcgatgagaacccatgcaaacttgatattccgaatagtgggttcgaccacgattggatatcgtccaggggtgacagcagtcttggggtggtcttcatctcagaactcgatcttctattcagaccatttcatcttgggtgcagccccccgccatgtcgaacaaatttcatgctccactttcttgtactcttgcttcgaagagtatgccgtagaacctccgaagatgtgcgagacatggaggtcggaatctgggtatgctgagtccgagtagtgaatagctgcttccgcggctttctcgactacatgtactcgcttgcccttctccaatgccagttgctttgtgagcgactttttgaagacgaggcaatcctccagagagtgtctgtccgacttgtgtatagggcaccatattttgttcgtgtcaccaccttgtgggtctgggtgcttgggagggtccgcgtattctgccgcaaggacttccgcttgagctttccttttctcactcttgtgacttttcttcttgcttgattcaggtgcgtccttggctggtttcttctctccccctgtcttcagcttgtcattcttgcgtctcagtgcgtcgtccgcgtgagcgtatcgatcgacaatctcgaatagtcttcgagcagtcgtgatccgccttgttgccaactcctgggtagtatagctatctctaacaccggtcttgaaagcgtggatcacagaggtgtcggtgatttcggggattgtatttctgcacccattaaagcaccgaacatagtccctcaatgattcgcccggattctgtgtcaacacgtgtagatcgtcttcgatcgtgtggcgcttctaagttccttggaagttagcgacgaactgctgccacatatctgcccatgaagaaatcgagtagggcagggggtgcatcagccatgaacgcgcagaacctttcaatgccgtcggcaaataattcaccaacgcgttgtcgtctgctccggcagcgtagagtaccgtggagtagacctaaaggaattcttctgggtcgatactcccattgtccttctttattgctcccggtcggaatctctcaggccatcggacatcacatagcaaacggctgaaagctctacacccgccgctgggggcggtgggttatcggctatcgtatgtccttcgtggatgtctatctgacgatgaggatgaagaggatgatgacgacgacgatgagtcactcggttccggtgtgcaattccgaggatgacgtccgagttctcgagaatcctgacgacgctccccgttgtcgttccggtgtcgatctccgtcgtcgtcatcgttatggcggtgccctcgaccagtattgcctgccacccgctgttcgtgatcatcgcgttcgtggcggctgtggcggttatcacggtcttggttctcgctcgggtgtcctcctcgctccttgttccctcgacgttgtgaagagacgcgatgtcggaaacgattttcgttgtctcgcgcgcatcgtgcttctcggcggccattcaaatggtcatggagatcgctggtgccgcgaggtggaggagtggctcgtcgaggtgatgtccgctactcaggtggttcaccatcggcgccgccagctatcagttgttctggctgtgctccggcagcggcctcctcgaacgcgttactaagattagccactgattcccgtagccgttctgtccactgtgcaaggtcatcgtttagaacgggatcataaggggtttccctcagtattgcgttgatggccccgatatgctgggccggcgtaaccacttgattctccgcttctgcgttagcgcgcgctgacgtgctggtcccatcgatagcaaatacatcacgtggtgtactcgtcgacgatgagccctggtcttcgagcaagtgtagaactgacggctcgtggggatcgatgtcgattaccccaacgaatcgatctgagataactgtcgctccttattccttgtccgcatctctaagagagattttttgacttctggatcttaggaggcgacgtcttcatggcgctgagaagaaccttgcagcttgagaggtcgtgattctttgtcttgtggataggacaatagacatcacgagttagaaaagtacgttgaattccatgctctttgcaggcacggatcttagcttgtacatcgagaaaaacccaacaagcttgcaaggtgtgtttcctggttttgtggataggacaccaggaccttgtcgcctcggaagttatccttgtcggctcgtgattcttgtcggaaggacaagatttggccatactaggatcttgctcgggctcagatgtcgtcgatgttccgttctccacttctatgggaggatccttcgacatggagtcgcctagggttttaaccatgacgttctcgcttccggtcattggtggaccagtcgagatcagcaccctggtgtaaatcgagaaaacaatttcgccgacttgggtccacaccagcattgttgaagtagaaactccttggttgatgccggtgttgacgctgttgtcgatgaagcttgacgacatagtagtagaaccttgagtaccaaaagcccctacctggcgtgccactgtcgacgggggatacccatagaccggatatggagggtattggggtacgctggtacgacgatctacgtagtacgacatcaagcaaacaggaaacaaggattatactggtccaggccccttgataggtaatagccctaatctagttgatatgggattatatagtggaaaccacagattacaaagggaatagcagaactcgatgataccgatgagaccgtagtcaagttggctcgactagatcaccccggcgacttagctcctgaaggctccacttcgtaggctgtggtggttgtgttggcggtaagattcgatcccttaggtcctcccggggtcccttttataccgcaggttagttggtctccaagtaggactcagagacatcggaccctacacaatataatgacgacccagttctatctgagtaggactccttccatctgtggactccgtgatggatttccttagcgtgtacacagaacgtctgtatacgcgcaggtatgctatatcagtgtacgacgtatatccaagagtatagggtataccttatccgtaatcatgacaatattaaattctccatgattaattatactctccgaaattttctcggatttttcagagatcaattcctaattttaataatacaaagaatatttcagtaattattcacatattaaattaatcgttaaatgagctggattcaatttttttaaatactttgagtgcccagttattttcaggatttttcttcaaattatttgagcattggaattatttttaacaattgaaagatcatttcagtgattaatttaattagaaaagtaattgaaatcaacttttccttttcgggccgaattaggaaaagtcctctcacttcctctcggcctgcagccctctccctctctttccccaagtccagtttcgttccctccttcaatcgggccgaggaaaaggaagcccagccgaagtcttctttgcctccctggcgctacagtactctatcttcaacctccagacagagcccgagccgtcccaagcctgtgcagccgtgccgatctccttcccaattccgaccttcccgttgctcctctttctaaattagttgcgggaatggaatcctctcaatctcctctacaatttcaccaaaaaatccccaatagtttctatataaatcctttccaatttcgcggatcaatctttcctttctccggcgaagatcctaaactttcccgagtttttctcgtcgatctgggcccggacccgagctccctcccgtgcctatataaagtaccccctagtcgtcctctacctttcccctcaagtcctgtccttcgccgtcgccggaaacgccctccccgcgagcaccttctcactattacctaatgatggatatttaattgtagctcacggtggtcaatcatgattggttaattaattaattgcgaattaaaacttgctaatggtgggttgtgagcacatggttttgatggtcgtgctcatgacaattaagcaccgtttcacgagtttcggttgtaaaacattaatcgtgccaaccactagccagcatgggcaacggctttaccttttgtatagcatggttcactgcagggcaccagattgagaagtagcggagataagcccacgggggtcgctgggagcccatgccttattttataagggggtgattatgatcaaggaacggtgcgctgtggtggattgtgttatgcgaggggtagtgtcacaactcctttccgaggtaccgtggtggtattgaggcgcatggtgacatgttgtggggctgtatcttgtgggtacagtggtacatccctgtccagagtaaaactattcgaatagccgtgcccacggttatgggcgagtctaataatgtcttttgtgattagtctcacacttctcaccataataaatgatgctataactggtaataatttgattagctcctggtttagaatggtacattcctggtttggaatggtacatttctgatttggagatagatctgtacaacctggtatggttgttcaagattggttggacctgtgcagcatgggtgtgctgttcagtgttgattaatattgatgattaattactctattattttacaattctcaagtgtttgctaaatactgcttttgtaaatgagccctatattatgccattctgtggtatctttgtgcacttgcatagttgtgtggcttgcagagtattccatgtactcaccttgcaataatcaattaaaccttagttgaagacaagttgcgaaggagaagacgtttggcttataccccagttgagcttgcctgtgggagtggagccggagcttcgctagattttattttccgctgcagttttcttcgtggtgaggactaagtgcctcttatgtaagtatttattattttagttattttgatgaatctgtatattaaattatcagtttgtgtacctcggctgattcctggacgaggattttaatacacattagttcggaaattactagtgaatttctgggcgtgacaggtgtgaagtacgctcgtcatcccaacccactctggggtcgtgcccccacatccccgaaaaggtagttatgctatttttagacgagcttgttgaagatgtttttgatgaatagatgtatatcttatatgtctccatgctcctctcactgaggaaagtgtgacttacaaggcaaaggtgcctgggtcctcggacagggccgggtccgaggcagaactttgcttatattctttggttgtatatcttataggtctccacgctcctctcactcagcgacgtgggacttataagggcaaaggtgagcccgggacctaggatagggctgggtccaaagtagacctctgcttatattcttaatatgtataactcgtaggtctccacactcctctcaatgaggattgcgggatttacaagggcataggcgagcccaggacccgagacagggccaggtccaaggcagacctctgcatatattcttaagatgtatatcttataggtctcctcactccaggacctgagatagggccaggtccgaggcagacctctcctcatattctgaagatatatatcttgtagttctccacgctcctcattgtaggacttacaagggcaaaagtgagcccgggtcctaggacagggctaggtccgagaaagacctttgcttatcaggacataagtcgttcaaggttctttctagaagagtttttagtcatctggaagagtttttagtcattgtagattttatatgtttcaacctcctctttaaccaagaagggtgatacatatgttggcaaaagtgggcccagagtcactgaatggaccggccccaaatctatcttttccaatcattattaagatgtatttcttataagcttcgctacccttaggagagatccgctcagcctacacagacccggggggctagacacaccacgtttaacaccttaaaatgtagattttgtacataactatgctccaacaagtgaagcatgcatgatttatgaggacgagggtgtgtctggccccagagccaattgggaccttggtcaccttgatttttcattcaatccagtggacctaatatttttaaccattggatcaatctctaatctctaaaagacttaaaagactgttcctttttcatttaaaagacttatcttccaaattccactccctaccagcactgtacatggagtcgtaagtatttatgtgcttatccttggttccttggtccacctctacgcctcctctctttctgtttctttccctctcttattcctatttttatacaatattagttagaaagcacaatacatgagcacagttgatgattaaaaaaattataacatcaaaattgctattttatctgtttatatcgttagattatttatgactaaatatatggttaaagatcatattcattatatcgttagcgaatgaatataagagacgaatgccaatgataattaaacaaattcactaaattccacgctacttgcatgtacaagcctctaaggtgtcaataaaaaatcaatagcatttcttataatgatatgattagaaatttcctaccaaaattttattttaagactcattgactaggtatttttcttaaaaatattatagggtcctacatataagaaacacaatataagatatacatatttgataaattaaaaaaaaagagatagcaggatggtgtgtgtgaacacaattaagaagggcaatacctcactttattgaaacttattttgttatacctgtttttttaaaccaaattagaacaagcacgttcgtgcgaatgcgcgggctaccttccaaaacaatcaggtaacatcaaagcaaaaccaacacataagaaataaacaattattaaattttattttgtgaatctccatccatagaagggaactatatattatatataagtacttccaagttccaacaaacagccacacagccacacaggtgcacattcgggccattatttagaacgcacaaagctgatatatagcatgcagccatgcacgcatgcagatgcaggagcatgacagacccagtgtcagccactccagtacatagggctacaattacaactatatatacgcgaccaatccctaaaccgagcaagctatatgctgcttcaggctgcagagacacccacatagttttaattaattaagggattgatctgtcgccggagtttcatcagttggcgacgacccggagtttcatcccggcggcgcagtggccggggacgccgcagatgtagtagttgacgcccttcttgaggaggaacgacgcggtccccgtcgccgccgccaccgagtccgccgagctgcccaccttgcagctcctgtacgtcgccgcgtccacggccagcacgttgtgtgcgcccggtttgtagttgaaaactgcatgcatatatatatatatatatgtgcagagagcagacagcagtgtagtcaggacgatgagtgatatatttttgttctttacagaaagggaagtgtaacttccgatctccgtaacaactaaatatgcacgcggttatattcatggacatgggaatttaaattctgatgtgtgaagtcatacaaccatgatttcaccattgcaaccttctggcataacttatagcaactaaaagaaagcgtcttagatgtatatggacgcatgtgttggcaacaagacataatataagaaactattaatttgcactcgttttaactgatataactggcttgaaaaacgttacttatgctgatcagctatgtagagcggaaaagatatatatatcatcgagaattatatatactccctccatccctaaatgtttgacaccgttaactttttaaaatatgtttgaccgttcgtcttattcaaaaaatttaagcaattattaattcttttcctaccatttgattcattgttaaatatatttttatgtatacatatagttttacatatttcacaaaagtttttgaataagacgaatggtcaaatatatttaaaaaaatcaacggcgtcaaacatttagggaaggaggtagtagtataaagagagaagatatatagagcgagactgtctctgtgtataccaagagtgtcaccagcagcgaagacctttccatcagcccagctatcaaacgacacagagaagtcccaaccgttggagtcaccaacaacatgtgtttcagccagcacagtggtcgaaaacgcaagggccagcaaccctaaaaccacgagacccacactgtacttccccatggccctatgcgataattacgaactaactgtgtttacagcaagctagatttacttgtctgatatgatctatctgaatgtgcatgcaaagtagcaggcttcatggctccatttatacccgtaagcttgctacctttttgtgatgcttgtgttagtgcatacgtgctgattttgattcctctagataaaattatagataactagttcggtcaccaagctttgtggtgcatgagtaggcaagcatgaaaatgttttttctagcttgtgagtggttaattattccatcgggtgaagccactggtaacgagaagttaaccatgggcacaattttaggttaattttggacataccaatagcctgagcacttgtacaaacccttccatagaccatacgaagataaatcaatgttatcgtttctctgaaggtgtaactattgcgaaccagctagtttaaaccacgggcccaaggtaggatttgtttctggttggatgctgtaaagttcagttacagtgcatgcatgtacctaaaagctgtggcgaagttgtaattaaaaccagtggacaccctacgcgttgtagcatgataatttagaaattcttgccgctggaaaaaggctctctactcccagtttacaaccccttcaatcgcaggttgtaaaccgggacgtccaactctggttaaaataaccgggactaaagatttatttttagtccaggtgtataacaccaaccgagactataatatttagtcctagttggagttacaaacagggactagagtttttctttttttcattgttagttttttcttttatcttattgttttttttgttgcttgcatctattgatttcagtaccatcaccccaaatccccatagatcatacacaacaaaatcatccacaatatattcccatccacaaatctgcaaatcattcacaaaataatccacaatacatgcccatccacaaatccacaaatcattcacaaatataaaaatttttacagcatctacaaatcatcattcacaaaataaaaaaaagtccacagatccaccggaagtccacagatccaccggccgtgcgcggcctcccgatcgacttccatcggaccgctgcctagccggcgcccggctgccaccgcggctgcttctgccggcccacctttccctcgtgcgccgcccacctgcgtcggaggggagagggtgggagccgccacccgcaggtgaggggaagtggaggaaggggaggagagaaaatggggagaggaagagggagaggaggggaggggaggggagggggaggagataagatcgagactgggagaggaggaggcacgctgggagagataagatcgaggctgggagaggaggagtgagatgaggaggcgcgcggctcgggtagagatttttttaatcttggtcccggttgttataaccaacatataaaacccgggactaaatatgaatctttagtcccggttgatattaaacataatggagtactcacaaccggactaaagataatggagtactcacatgttcgtgaaccgggcctataacaaccgggattaaagataatggagtactcacatgtttgtgaactgagactaaaaatgatctttagtcccggttgacaaaaaaaatatgtttagttccggttagaataggaaccgagactaatgtagtttttagccaacccagcaaagatcaattctcaagtagtgtccgttacagagagatcgaagtaccaatcctaaatgctgatataaaatggacgcattaattaaattgctgacataatttgatgatatggctaaacttaagagatattttgtactccctccgtttcacaatgtaagtcattctagcatttcccacattcatattaatgttaatgaatatagatatatatatatctatttagattcattaatatcgatgtgattgtggaaaatgctagaatgacttgtattgtgaaacggaggaagtagtaattacttcctctgttctatattataaggcgtttggctcctccatttttcgtctatattcactaacatcctatgattttagatatatatatatatatatatatatatatgtagcacatatatctatccatgcatgaatttatttaaacgtcagaacgtcaattaattctaatggtggaaaatccctattacaaaaatcatctgtgaaggccatatgctttccttttcaaaggcggtaaaaaaaaactgtatgtgaaaatggctaatgccatctcagggtaatgtttgtggaaaatatttttacatgcatatccttagagaaacctccttgcatggacagttttcctaaggaaccgtctacagaaatctcaaggaataagtttataaaaaggaataagttcactttgactcccttaaaagtgacccgaatataatccatgaccctaaaccgcaaaaccggatatctcgaccccccaaactattgaaaccggtgcaatttgactccctaggcggttttgctgacgtggcgcctacgtggcggtattgaccgggtcttttttacatgtggcgcttaagtggcattagaattaaaaaaatatgtgtgggacccatttgtcattcacacaaaagaaatgtgggccatgggccctccctcgctctcccacttctctctctttctctccccttcttcttccccttcggctggtggcgcgtggcggtaggcaagctaaggcagcgaaggcgagctagggtgccgccaaagttctcgctgctgccaccggcggcggcatcgtcatggtcacctcgtcggcctgcacggtggccccgcgggcacccgtcttggtgtccaccagctgcacgcaggcggaggagcaagaaaacagattaagcgtgaccggcgtgacccaacataacacacgaacaaaaagaagaaaatggaaaacaaaatattgtactccacttgtaatcgtagatgagattgagaatgatgagcagaacaaactgcattggcattgtatatagaggagaagaaataaagaagcggaaattgaggtgaagtaaagaaaaggatgaaaactttgcaaccaagggagcagaagcggaatgggtcgaggaggtcgagggcgcagatctagcagttgtaaggggaggcggcggcctcgccgacaacggtgctggcgtcgcgtggctgggggtgctcgttgaggaagaggaccttggcgctgttgatgacgtaggtctggacgccggagatgtcgaggacatcctccacctccgtcacccgcaccacatcattgtaggaagaacgccgtatctgcaccaaaaaccaaatcgataataatcttcctggaagttgtttgcaattgcaattgcaatagaatgaa

SEQ ID NO: 71377 - DNA, 660 bp, Oryza sativa
acctcggctgattcctggacgaggattttatgcccaaataaatttggaaattactagtaatttcccggccgtaaccttccttcttccgcttggcagccgggtgagggcccttcggggcgaacccgcgggatagcccgagggggtgacgccatgccccgagcccccccccgcggtttcacgactcgcgtgaacccccaaatggggcttacttggcaagtcacgtcgccggaaggaaagtaaccctctacttcacatacccccgggtccatatctccgacagtagcccccgacgctatatcaggtatcgatttcctgagatcgttctgacatggtgcctcacgactcctcgagctggggttgtgggcccggcagggaatccaaaaggatatcgccgcgtggccaggttggcgtgccaaccataatagcggtttgaccgccactgaccgcgctcatgatgaagatgcttgaggcgcgataacccggggggtcagtcagaccacgcctcgattctcccgctcgctactcctgcggcggtagtggtgacggtttggtcaacttgcgctcataaccggtgtgcactccacctcgagtgtgccactgacagacgcactaaaggcgggagcggatacaacgggcgacgtgatgagtgggcgcaggatg

SEQ ID NO: 71378 - DNA, 657 bp, Oryza sativa
gcgttcatgctctcgaggtcgtccttgagctcctggatctcgtgccgaacgccgctgagagaacgtacttgtcgaagaggaattcgccgagcttcccgagaagaatgtgcaccacgccctcggtggagctcaccacggcggcctccatggcttcctagccaagtgtaagtttggtcgatgagctcttggcttcttctggtaggaatttatacagacgatccgcgccgaattggttgagctcaaacactgaagtgataagactgatagatgctgttcaactgggatactgtacttcactaacaatttattcaaataattcgtgtcaaaaaaaatattcaaattattttacaggttcaattagtagtaatttttattggggttgttggatcagccatcatgtgataagttggggtaccaaggatgtaggagtatcaatcaatacattacactgtcattactcttaaaaatatgggaatgattggttcatggttagtactatttttcgccttataatacgagatctctcatgagagtgttgtgtagtactctctcaagtaacgaaactatgttgtttcagacattttagaacatacttactccgtactcataaagtaagtcgtttaagataatgtttaagtcaaaccttgggaatataaa

SEQ ID NO: 71379 - DNA, 43839 bp, Oryza sativa
caccaatctccttgggacacgtttgtgtcggtgaccactgtagtacatggcgaacagcaaactactagtactagcgatctagaaaatcctaaatcatgtggttcctgtacagtttattggtgagaaagcacgataaggataatgacgaatccgtgatgaatcctgagacgtagactttgaccattaagctttgaaatgatggctttctttgatttcctttgctagcttacttagctggcaaagcttaatctaggccaatctgccggatattcgcagccatttacgctttccacgtcagtgcatgatggagtattctacgcacgggatgtattaaaattggataagcataactgataatttgtttgttctccgaaattaccaaactgtcctttttaacgcaatttgataaacaccctagtgccgtataagcgcccatatatctaatttttgaacaaatcacagttttttcacttcttatttctgaatatatttcactctgtatttcttcctcaaaaatcatgatgtgcacatgttttttcataaataatatttttagtacatataaaagtgaactcccacttgcatttgcatctagaaagcatgacaaaaaccatcggcggcacaacaaaaatcaacccaatttatctgaccggaaaaataaaaaagcttccaaaaaaaaatctgaccaaaccgaccaaagggcaaaatgggaacccaaaaaaactctctataaatgttgactccaggcaatcagcgtggccgcgtcacagcacacagacatcggcgaagcaaagcgcaccacgcacacggaaagagaggagaggtcacatcgcggcggcggcggcgaggatgttggcggtgtttgatccgacggtggccaagtgcccggagggcctccggagcccgccggtggccggcggcgccgtggcggccggcggcgcgggcgcgctgatgaagggcttcgccggagcgcacgccgacgcggtcaccgtcagcctgggccccgccggcgccctcgcctactcggcggccaaccagagccccctcgtccccaggtgtttgctctgttcttggctcctctcgctgattagctggggtaagccgatgctttgtagcgcgttcttgggatgcaaaaaaaaagcgtgctcttttttggctgttcggcacttaagcccgagatttggtgatgcggctgtttcgtctgaggttggaacgatgaaattttgggagatctccgtttcttttggtttcttggggctaagccagtgtaggcagtagccatggattttttttttcttggggtttcctatggggattttatcttatgggaaaaaaatcatgctattttagttcgaccttgagttttgcgaaaatttaggggctctttgtaaggatcaaaatgaattgagtttgatttgatgttctttttggtgtcggccgcgtggtcgatcggcatgtccgcatgtggtgtgatctcgagtctttcttggataaagttgggagatttctgcaccttaaagttaggtgaggctcgtcgatctaatagttgcttagatctgcacgaaaagttaggggataggaccattatgatgagcggaacgggtatatggtcaaccattctttcgtaccattccatcctgcaagatttagacaatatttttatttttttagtcgagttcgtttcttcatgtggatgcattttgttcatggctatactgtaattttatttgatcagttgagtaccgagtacgttgtgaatcaatggcatattagccgatcaaacaatttagtgaattccgcataaaacttgatgaaaatttagtaagatcaagcttgttcatgctaatctgaaactaccatgatatgggagccttggctgaaccttttcatagacagatatgtccattcctatccacccaattctttgtgtagcatcggatgtttcaacatttttatacatgtcgctatagcttagatattcaacagaagaaaaagaaacaatccagaatgtgtggtaccacatgtccattgtccattgttgacatgtttgtattacatgtcaatttggtacttgttaaacaattgttccttgtcatccaacagggatgatggtgatcagttatgttttttattgggtagtaacacgtcatttacagcaaagagcaaacgtggacgtttgtggagtagtctgcagttgagttttgagcccccctaaaataacccaaagtgcatggcaaattgtctttatatagatagcgattttaacttaaaataacatttggccggttgcacttgggtaacctattagacttctctgttgcaaatttgtaagattccagcatcatggttttgtggtgttcgaaccttgaagcatttctctgttgctgttgtgaaataaaaacattgtgttagaggaaatatttcagatgacagtgtgtatttgtttggcatgtggtcattctaataaatagcagtaacatggacttccttttcaccatgagaatggtgcatcgcaattcgtaattattgttactggcaactcttctgttttccgcaactctacaatttcatgaattatgtttagtaactctggatttgtgctcctacccaggttgtttggtgctgtgaatgacatattctgcctgttccaaggacacattgagaacattgccagtctgaagcaacactatggtctgagcaagacagcaactgaggttaccatcctgattgaggcctacaggaccctcagggacaggggccctctcccagctagtcaggtcgtgagagatctcagcgggaagttcacgttcatcctgtatgacactctgtcaaaatccaccttcgttgctgcagtaagtacatcatctctctttcctgaggcatatacttctgctctgaaggctgtggttctgatcccatttctctgctcaggatgctgatggtagcattcctttcttctggggcgttgactccgagaaccaccttgtgttctctgacaatgttgaccttctcaaggcatcctgcgggaactcgtttgcgccattccccaaaggtaaactgcgatgaccgatatcagtatcgggcctttcttctcattgtttcaccagaattcagctgaagtgctccactctctcacaccgtcatttgcgattgttcgtcaggctgcttctacaccacctctggagggctgcagagcttcgagcacccgctgaacgagctgaagcctgtgccgcgggtcgacagccagggccagatgtgcggctccaactacaaggtcgacagcgaggccaagaaggactccgggatccctcgggtcggcagcgccgcagactggtccaaccatttctgaggcaaagataccattgagatggcttccattttaccatttcggcatttccagttgtggactctgccctgtatgtctgatgctgaagtactcaagaaccactcctgagacgacgcgctaggttttactttcaggcgtccgtaaaactcttctgcaaacattcagagcattgctatctttctacgtcatagtactgaatactgatacttatgtaatctgatgataccacgttgtggttgaggtctatctctcgtgttctgataaataaagctcaatgaaagcttcagatatgtggtactgttggcattctacgtggcgtattgtgatgattgatgatagcctccaagaattttatgcagcactctacctgaagtttgtaaagaaagcacacggtttttgttgattttcaagaattcaacttcaccgtacagcagatcacactagagggagtatctatagatcacccgaccgattttaaacgaaaaacactcagatttttaatacttacataatacacatgaaaatagcatgtataacttacacgtatcataacacagaattcactattaaagataagcttattgttaaaagtaaagtgtaacttacaagcggtgaaaaatagaaaaaaaataaatcatacaaatctaatagaaattgcatttgtaatttactctgactcccaatgtaactactacaaattacactctaaaagtactatatttacactgtaattttttttcctcaacctatctcctctctttatcccctatacacttttgggcgaggtgaagttgacaggaaacaatgcactacacaactaacaacaacttaaactatttaattagtgagtgacaaaataatcaaccatatgaatggatgtactgtaccaggtagtcaagcactcccgagttaagtgtttcgtgggcgcgctgacacaataagggcacggatctcaaggttagattaacagctgaaaattcgacaaatttattgacagatttttagcatagtcgggcctaaatgggccacatatgcagacataagacatgtttaaatgggcctaaattccggcccatataagagagagctaaagtacgagatgggcctaaacttggtcggcccataccggcccaccaacctcgtcttctcggactccgcgtccacaccaacaacgcgctcttctcttcttcacttcttctcccccatttggaataagttcatctgaggtcccttaacttgtcaacgaatccgatttttgcccctcaatccgaaaaccagacacaaagggtccctcaactatcaacaccggtacagattaggtcccttggcggtttcgagggtggttttggctgacgtggcgcctacatgtctaatttgactcggtcttcatctgacgtggcacatacgtggcaattagatccagaaaaataataaacttcgtgggacccacatgtcagtctcacgcacaaattaattaaaaaatgatagggcccacgtgtcattcttagtgtctccctctcttcaactctctccccctcttcttcttcctctctcccctctcccatcccagaggcggcgcacggtgccgggggaggagggaggcggccgggcgaggaggggcagctcgctgtagccgcgcgaggagaggcgacgcgcggcggccgggcgaggagggaggccgagctcgtcggcgacctcctcctctgcctcttcctccttcggccaccttccccgctcgctgtccggcctccttgctgtgctcatgctgcactggctcacggcggcctacgacgggtgatacatcagcatcgccgggagtcgcgggttgggcgggggcgacggcgcagaggaggaggtggtcgagggtggctcggaggcccgccgcgatgacctcgttctacgggcgaggccgcaccacgcctggctctcggcggtggcctgacggagccgctcatccagctcgacggcgtggcgtcgggtgacgtcgagctcgacctccttctcccgcagccgccatgccgcggcgaccgacacgacgacaccgagcgaaccagcgcttgacattgctcgagcccgacgcacatccgctcgcactccatccgcacaacagcgtcgatcttcgcgctctacatgcacagctccgacaccagcgcatcccccaccgccgcagccgacaccatcgaccgcccacttgtcgacgtcattgtcgactccaccaaccggctcactggtgcaaccaccttcaccatcccgggaatcggcagtgaagaggaggcgagaatggcgtggctggaggaagacgagggagagggagacgcgcgtcggctatataaagcaacgccttgtcgtcggcggtggcggtgattgggggaacgacgacaatggcggcggcggtagccatgaggcggcgccacggcgcgaggagaagcacccgaatacggccacagccttgtgctatcgcgcactcgcttcgcctgccgtgggcgcgcgaggggggagaaagccgacgatgaggaagatgagggataagggagagggatcatcggcggccaggaccgagggccggaagctcgtagtgagggccagagaaggtgaggccgagctagatgaggtggagcatatcgacgttggccttgagcgtgtggagtggggcatcggcagcggaggcgaggagccggtggagatccgtgaggtgtggacggacaaccttgaggtggagctcgcgttgatccgcgacgtcgtcgacgagttccccttcgtcgccatggacacagagttccctggcatcgtgtgctacccacgccgccgctccgctctgtgcgccgctgttgacagaaaacacgaggcctgggagatctgcttaactccagtgcaggtccaaagcttgccttcgggtgtgctagcgtgccagttgatttgatcctgtaaccaacaagaagtagaagcaaagaaatcgcggttaaatctataaatgatagccgattggctaagtgccgatgacatatcatttatctttgagccgatgtcatatgtgtatcgatcggcaatcttgaataagtaagaaagaactaaatctacttgatcggctatagatgttaacgatatatactccttatatcgatatatacttaaatcaagtgattggaatagatcgatcgccatgccgagacagtataaatcacttagaccgaaatatatattaataacaggactatatatgtttacagcatagccgatcagatagatctagcatgtattggctaatactccgatactactttatatcaggatattaaaacagcaatatcttggcataaagagcagatttaacatgtcaataaagcatatagagcaaatatagttaaatcagataagatcggctgaaactccgatgctaccctaatcggcaaccagaagacaggctagaggttgatattctaagcacgacttaatagatcaaacttaactgatgcagcattaagtatgaaaagaagaacaatatctagacaatcaaaccactggaagtttcataaagtggtaaatatcttatataatttaggtcaacttcgctatttaacctggtcggctgccttctaccgaccggtgttagctgattgtagattagatagcggtattgccggagattatgtaagatatatgatagctcggcgaattatataaacgagatcagagtatcataaagatggaagcactaatcccgaaaacacaagtcgtcataataagttttacctctcgttgaagatcaaaaccgatgcagctcaacccgaaagcaagaactagtcgaaacaaaattaaagtaaaagggtggcgatgcgccgagattgtattgaatgtgtgttaaaagttacatagggctcaggtctatttatacccgagaattataagatatgtccataacggacacgactactatctctaataaactctaagatactatatgtctttgcggcagacttttgcccaatcatatctctaaggataaaacataaaacatcctaattaatagatataattgcctcctcaggactctatccatgtgcggcaatcaccttgaagcacctcaatccaaccagacatcacacatatagattggctacatcggcttacctagtccgactcagactcagccgatcttatcgtagccgatctggactccagccgatccctgctctgtttccgaactcgatctctgcctccgacttcgcttcaatctaatcttctttcccaatgccgatattaccaaatttggttgttaacagccgttgcccccatttatctgcttgcccagcgctcccgccgccggccaccgccaccatcgcatcctccagcgctgccgacctgtacgggctccaggtgctcaccgacggcatccaggacgacgacatccagcgcaagagagagatgaagagagggagatggggagagaggaggaagaagaggaggggtgaggatgacatgtggggcccacgtgggccccaccattttttaattaatttgtgcgtgagactgacatctgggtcccacggattttattatttttccggatctaattgccacgtaagcgccacgtcaataccacgtcagatgaagaccgagtcaaattagccacataggcgccacatcagccaaaaccgccctcaaaaccgccgggggacctaatttataccggttttgatagttgagggaccctttgtgtctggttttctggttgagggacgaaaatcagattcgttgacaagttaagggacctcaaatgaacttattcccccatttccattcacaaccaaaacaagcctaaaaaattgaagttttttcacattaactttattattccccccctcccccttctccttccatccccttcctcccgtgtacgaaaccctaggtggcgacgcggccgcccaaaaccccgccgcgtcggcccccggatggcccccgccgcggcggaccccgacgccgacgacccccccgcgcgcagatccgacgccaccgacgtcgccggcaacacctgggacctcgccgcgctgccgcccccgccgcccgcggcgaggggcggcggcggcgaggtctacatctaccgcaacacgtacaacctcgtcccccgctccatcggcgggtgccgcgggagcgtcaggtcgctcaagttcttcggcaacgacgtggaggtgctcccgccggaggctggcgagctggaccagctcgagagcctgcaggtgaaggtgtccgcgcccagggtttccggggcgccgctccgccggatgcgggcgctcaaggagctcgagctctccattgtcccgcccaggccgtccgcgtgctccatactggtcgaggtcgccgcgctcaagtgcctcaccaagctaacaatctgccatttctccattaggtatgttcaggccagtggcctaattggtccgggcagtgttcttttcagcaaagttcttcaatttgttcataacggtgtcttctatgtaattgagcaacgctatgcaatgtaaatgtggttcctttcttctgtatttacatggcattttttttgtcagtaacgcgtaacaacagattaaatggataggaataacatagatatgaactagcctctaactggccatgacctttttatttggtgtggattttccatgctgactatctctgatggttatgattgcctttgccaaatttaaatcagaattagaggaggaacattagctttgttaggctgttacaaaatctattaattcctctactggtaaatacacattttgtagtatactccctccctccacatatctagggaatattcctttgctgctcaaaggccaagagttcacctaaaatgaccaaacagttctttacatgcactagctgggcccccctttgcgggtatgatgggttggcatggctgcttgatgccatattccttcatccattcacacttgcactagttgaatgctcaatgcctgcatgcacattcagtacagtgtgcggagtagtgaagggtacatgagaccaaaaaccaagaagagattcttcaggtgtagtgtgcacccttcattcctggtcaagagctcaaatcaaaaggcaccctacataagtggatggagagagtgcgtgctgtacagcatctggttacccagagtggtagttagaccaactattggaaattatacaatatttctgataatgtttctattttaggctatattaagttaatcattttctctcactccttcaaatagaagaaatgatgatttctcaacccctttttttacattctataggtacctccctcctgaaattggctccctaaggaagctgcaagaacttgatctttcgttcaacaagttgaagaacttgcctaactgtataactgagttgggtgccctaaagttcctcaaagtgactaataataagttggtggatctaccatcaggaatctcttctttgagatgtcttgaaagccttgatttatcaaacaacagattgacttcccttggatcagttaaactcatttctatgcttacactacagtatttaaatcttcaggtatatcttattatttattaacataatttattttttcctacctgtttattttgtataaatggcatctttttttgctgtgaattgagctgtcatggttaaacatgatactgtctcaatttatttgatatccttcctagtcttgtccagtaatttctgattttttagatctcaattatctagtttctgtagccttttctgattctatggattgattcactttgtggatcaaaacctcaacatttttaagaacattattaactgttgtatttgaagagagatgtttgtcacttttgagtaaaggaactatcgatgggttaatgatctttgtccaattttttctgttgccattgaaattcaatgaaagtgcaagtacaagagtttatctggaactagaaaaacatctatagaaatgtctagccaaaaagaaatatctcgcagctagtggagtggatttataagataaataatgtggcactgtggttctctctcttttttttgacaagagttttgatcttttcttttaatgcttgcagtgattgtactgtggaacttttgcattgtgttatggtatttaggatttatataccagactgactttttttttctctgtctcaagtttaataggatctccaattcttgtgttattcctgcatgggtatgttgtgacatgagaggaaatggtgaaaacaatatgaagcctggcaaactaaaatctatagctgttgtgagcaacacttcagcagaatctagaagtatgaatcatacttgcaatgcttcacgtttatgttcacatccagaagcttccgcaaatttaaaagttcatcccacacagaaaacaaagaaaggttggaagcggcgggattgcctgcaacaacaagctcgtcaagagcgtttggaatcaagcaggagcaagttcaatgatgattatgttgatgaaatggctgtgaatatgacagaagatgagagcccgttgcatgatatggaaaacaagtcagagatgaaaggcattgatgaagaagcttcattacaggatttgccaaaagaaacaagttctatatctgaggacttgtcatgtatagttgatgatgactcctatgggcatattaaagatagtggcatgatgttacaggaccataatgaagaagaaaagcctggattaagtatgaaaagccatggcaactgttcttgtatcagcggtaacactgatattttgagcaggagaaggatccgcagtgttgaaaacgaactagaggattctgcatcatcagtccatgatgctgctgtggttgttgaagagaatccttcagaaacatctaagcattcatggaaatctaaaaggcaccctgatatggactgcaatcctaaacctagcaaatgccctagaccatttgatgaatgctcaaagttatcctataagtacagtgtgcaatcgttctgcagcattgatgatcatctaccagatggcttctatgatgcaggacgagatatgcctttcatgccattagaggagtatgagcggagtattggactatatgcacgtgaagttattctcttggaccggttagtgcacactcctatctatacttaggctctctctattttgcatagtgtgcatgttttgacttccttttttttcgttcagagaacaagatgaagagttggatgcaatcgcgtcttcagcacaaatattgctgtctaatttgaaaatgccaagctgttttgtagctgatgaagatgcaggccaggacttactaagggcatctgtgcttgctttgtttgtttctgactgctttggaggttgtgatagaagtgcttctctcagtagaacacggagagctattgttagcttgagaaaggagcaaccttttgtttgcacttgttctgctgggagcatatgtgacagcactgaagcatctaagcggatcaataatctttacggccactttgattttactggcctgtgcgataaatcaatacatatcatcaaagaaaggagaaattcaggaattgtaccgataggagcactgcaatttggtgtttgtaggcaccgagctgtcctaatgaaggtaactcctcgtttctttggcctgagctcattctatatttgctctttaacattgcaaccatatccactgcagtacttgtgcgatcgagcagaccctccaattccttgtgagcttgtgcgggggcatcttgactacacacctcatgcttggaatgttgttcctgttagaaaagggaatacatgggtaaggatgatagtggatgcatgctacccaaccaatataaaggaagagacagatccagagtacttttgcaggtaaacacactgtgatcctaaaatctgtctgtgctacatgtttttgctttgtgtgtaatttatgttgttttaacctactatgatgtttttgtaataatttttagaccgaagatgtttttataatattttcactatttgaactgtttcaatgtgtggtattgtcatgttagcaaaaagagatgacaacatgacattttcctaatgttgccaatagctaacatcattttttggtccttatttatatcataagtaatctatatatgattgaagttagaaaacataagaactcctgtccatctgccatactatcatcattttttagttagttctgaagttcagaagctatattcactcttaacaaagataacctattcatcaatcatcctttttttttgtgtttctaatagatagatatccatttgatctactgttattttgttcacttgatggtaagtaatctcatccgctgatctagttgcatgcatcttacccatcttatttcagttagttattggaaacaagtatacattttacatatatattcttttgaatccaacattctaacttactgagtccctaggtttcgaaaataatgtaatggaaaaggaagtgtttccagtaattgctatttgacttgaacctgttctgagaatttaccctttgttgcatattgttttaggtatgttccactcagtcggcttcagatcatacttgatgatcagggttatactccacggtctccctttccttctgtctcactgtgcaaagaaatagaaactacagcttctagttcagtctactactgcaaaattggtgctgttgatgcggcagcaaaggtttgttatttttttatttatttgtcacgcctttgtctttttgtttggagttagttgatgttgctattaaatgcaggtaagatatctagacactcgatgtgcttctagtgatgaagttaaaaattttgaatacaagcttctcgcggaagtaagaatgctgggtgccctaaggaagcaccaatccatagtggaaatatatggtcatcagctttattctaaatgggttcaagctgatgatgataaggaatacaagatattacagtccacaattatgatggagcatgtgaaaggagggtctctgaaggtatgcatatgactccttatgtaatcaccttcagtgttcagatattttcgttaacttaaggcctttgttttctcttgttagggttatttgacaaaattgctgaaagagggcaagaagcatgcacctattgacctggcattctacattgtacgagaagttgcttgtgcattgttggagctgcacaaaaagctagttattcatcgggacataaaaagtgagaatgttttggttgatctggatttagagagaagtgatggcacaccagtagtcaaactctctgatttcgacaacgcaattcctttgcattctctctcccacacatgctgtatagctcaccttgggacatatccacccaatgtttgtgttggtacaccatgctggatggctccagaggttcttcgtgccatgcgagacaaaaaccaatatggactggtatgcttttattccacagttctgtcttgttgctatcaatgctagtttaattgttctgcattctggctgaggaaaccaaatgctgcaccattgttattattatgtttttgtagttgaggcggttatcataatattttgacatctgagcgaatgattttttattagcatgtgctatccaaatttgaaccagtttagttattttcatttttcttaaagcatcactttttttttggtgaaaactcttcctttttcttttgtactcggccattagagttactccctacatttcagtttacttgtcattctagcaaatctcacaccaaacaaggaggtgtggcaaattacatggttaccctcaataagtacatcccaatcaattttcccaaaagcaagcattaaaagtccttgtgtggagtactagtattgatgaagggtaggaagtaacctctaaaaatgttttggaatgtgagaatgacactttgataaacaaattgaatgctagatgacaagtaaagtgaaatggatgtagtatcacttatgttgatatccagtgtacatccacttctttaaattattatgtgaatatcaacaatatgctcctaggtaccttctagcatgtagtcaaatcaacactccatataattgcttgatgtttatatatatatatatatatatattgcaggaagttgatatctggtcatttggctgttttttattggagatgcttacacttcggataccctaccagggcctacctgattcagaaatatatgatctcataatggtaggtccattacatcacaatcaattacctgtctctgtgtacatcaggattaacaatgatctgaattttctataatcagaggaagaagcaaagaccaagactaactcaagaactagaagcgttctggacgttagacaagccaattacgaggctggagttgggtatcacatctgatgctcatgcagaaaaactaagactgttgatagatctcttctaccagtgcactaaaggaattgcatctgagcgcccaaaagctgaggcggtttacaatttactgtgctctctacccacatgctatgacatgaggtgaaagtgtggatcttaaatcagtatgacataaggtgaaaatgtggatcttgaatcaggaacctgttgatgagacagccagccagatcggcctgcgccaggatggcaagttatgctgggtggttttagcaggtcaacagatctggcctcgcttggtttgaacttctgaccagcatgccgcttattctttgagtgctggcgatgcggaacacgagaaatccaaccaaaaccaaagccggtggcagcattgttctgagttctctggagttcatcctgtgtcagttttgtagcagccagccccgtttcccgcctcttgtgttgctgcggtgttggcctgaccatgtgttgcttgtcgtgtcatttgtttttgtttttcattattgcgttaatttattgatttaggccattcacaaccccaaggcgtctgtctgctgcacatgacccattctgtatttgtatctgtatctgtatgtacaagtgtcggtccatccgtgatccatgtaaccctctactgttgagtcatgtaacaataacagatactgttttgaggttatttatcatgagggattgtttttccatttaaagtttcaacaatagtactcatggcagtttatcatttgtgttagtatcacatagcatgcactgtgtatgagtgtatccctccctccagaggaacaatgtactattctcattaaaacagtttccctgcatcagttaataatattcgttgtgcgtgaactgtactccagtgtaataaagtggtgatcttatatttggacgcatgctgattgaccatgctttacgcatgaactgatttatgctgaattgcattctcagcctggagtgtgaagccaatgatatacttagggtccttttgaatcacaggattgataaaacataggaatagaaaaaacgtaggattttgataggaatgtaagtgcaaaacggaggattacaaaacgcagaaaaaacacaggaatgaccgtttaattgaaccgcagaaaaaaacacaggaattggatgagagagatagactcaaagaaaagttatcaagaggttgaagctcttgctaaatttcctccaaaatctctataatattattcattccacaggaatttcaaaggattggatatgattcaatcctttgtttcaaagggctccatagaaaatttttctataggattaaaattctctaaaatttctatatttttcctccaaattaacctgtgtagtatttctgcagcagctcgttggaaatccattgccctgacaatgtaacaggctcgatgtaacactcacaggtcgacagctatttccttagagatcagtatatacaatactgttcactgtattctagtgtagcagtagtagctgctacagctcccattttcaacaccggtctgttgaaaggcaaacatcgacaatgcacgcacaataaaatttgcagtgtgctaacttctttgaccaccgttctgccatgctccaagcataagccgtggcagcaacgaataaataaatacttcacctgtcttagactttcattattgttcacattcattaacatttatatttatgtgggccaatgcttattttaaaataaaaaaggtacatattaatatatatattttttaaaaatagcatacctttactttattaaatttcaatacaagtattccttaccttatttatttttaatgtaattattctttgtttttataaaccctaagggtatgtttagttcacactaaaattagaagtttaatgtaattattctttgtttttataaaccctaagggtatgtttagttcacagtaaaattagaagtttggttgaaattaaaacgatctgacggaaaagttggaaatttatatgtaggaaagttttgatgtgatgaaaaagttgaaagtttgaaaaaaaaaatttgcaactaaacacaccgtgttattttagataaatggcataaccttaaaaagcctaaccgaaggagtaccactaggcggctgctgctgttgttgcagtaaaccaaaaaaaaaaaaaaatttgtttacaaaatgcggtttggcttctcgagacagaaaagacgggcagttaattcctgccggggaggaagcccgagaggacaccacgttctcctcctccacgtcgcgccacgacacgccccactcccactgtcgcatgtgcccaccccgccctttgacttgccgctcattggcgacacacccgcacccgcacgctgccatcgcctctcggattcctcctcctcctcctggccagcgacatggccgcgataaactacgccgccgatcgatcgatccatccatctgcccccccatgtgcatgtcaccgctcgatcccctcctcctcctcctcctcctcgtcttcttcttcgtcgatggattcgccgtctttataaacgagcagctagctgggtgcgcgagagagtgtcaatgtcgatcgaatcgaatcgatcctccggtgcccaagagaaagcgtgaagctgccagcatgatctaacttgcagacaagaaatcagctcagctcgctggtttcgaacaggaaggcggctagctgaggcttcttctgagtacgtgatggttagatcatgctgtgacagtttcactccttccctgttgggcacacaaagctatggaacacaccacgaacagagtcagtacgtacccagctaatatagccagtgcaagagatcgaggaatgcgagagggaaatgcagctattttgttgatcaggtgcgtacgtatacccgtctctctgataatatgatctcaatcgacagtgtgtttagatttctaagaattaatttatatgagtgttatttagtttgtaggattgtaagcacaggagaatatctacgagttgtagagagaagacataaagaaatttttatccacttaaatcttttggaaaattcatgcatgcatttctatttctatattttccctttttctatggatggaaattccttcaaaccgaataagtcctaagctctcttgatatcagctaatttgtatgcgtactcgaactaaacttggaacacattcacacacacaatccgggtttacctttccgttttcgagtagaaaatcgctcctcatcgggttatcgaaaaccaactgaaaaccaatagaagccaacaattttcaatcaatgtcgtacgaaaaccagataaaattgattggattggttttcacaaaccgactagttttcgtgaaaactaatcggttttgtgaaccctgtgcacaatgtgacttactgactgatagagacacagtgctcttcctcgcaaccaaacaccgatatcacaatgacagacatttttgtgtggtttcaacttcgagatgttcgatccacatctttttgtcaaactcacatttccttcttgaatattggacacaagtttcttcttggtgcgcgtcgcccctgcccactgggcattgcatgtcagtgcaagcagaatccaaccttgcgcttccaatggcgtcaggaaggccaattagccgccgctgttcgccgccggtgcggcggcgacggcgagcggagcggcaggaagacgagaggcaatccaaggattaaaatgtaaatcgatcataatctgtggcaggggcgagctccgtgaatggcccatgttccaaaaactaggcccatccaacccaaaagcgctccaaatcgtttcctgtggaggcacattaattaattattatcatgatccatttgccgatttcgttgtggaagcatcgatccaatttctacctctatgacaattctatgacctcgggggtaactattattgtcaccgattattatttggttcatatgggaatatctatatctataactaatataaatatttggatttttccggttgtcacataatgcttccgatcaatttttttcgtccgtcgtccgtgtttgaatccgagaccgtcttgaaatttttttttcccgagcggactcaaaagaagccgaaaaagaaaacaaatatatatcaatcggcattggagtgaaaataaaagaagccaactcgatcaatcggctaatcgagtcaattgctcccaatcccattgcccctaattcccaaaatacatgaataacaaaattactcaattgcaatcccaaaccaaaataaaaaatctccacaaaatcaacatcccaaatcaaaccggcgtcgtactgtggttactatatcaacattccaaatcacaaaatcctcaaaatattcacaaataaaaaaatcaaaccaccgtcggctccacgtcggggaggtgaggggcagccagggaggcggggagttgctgccaacaccaggggagggaagcagctgtcggccgccactccggggaggggggagcagcagccaccggataactgctagaggagccgctgccctcgaatccgccgcaggaggaagctgctgccacccgatccactctcagccagcgccaccgccaccggatccacacgcggtcgccgtccccgctgtcagatccaccgtgggagggaggagagagggggcagagggagccgtcgccgctggatccgtcctcatccgccgccggatccacccgcggccgccgccgacgccgccatcgatgccggatctaccgcgggagggaggcgagatggagaggaggagatggcgagcgaggcgaatccatccgtggctcactcggcctccccgtctccgaccactctctccgcctcaagctgctcgcctccgaataccaccaccgcctccacgtcttcgccctccaggaggacctccatggtgatggcatcgtggatctggccggcaactcgagggaaaaagaaggcctgcgacgatgttgtggataggccgtcgacgatgtggtggatcggccggcaacgttgagggagaggaataaacggagaaagtgaggagggagagaggcggagaaagacgggaagagagaggaaaaaagagggagctgcagtctagatatttttactggtagtacatagtgtacgtgcttgagactttagataattacagtcaagtggcattgtgctctatattgtggtaaccacaagattgaatttcgctgaaaacaaactatttttgacatacacgtaccaactttacagacaagtaatattttattttattattactagcaaaatacacgtgcttcgttatgggtaaaagaaaccgttaaatagtataaaatgcaaacaattaaaatacttgcacgttaatatttgtttgagataaaaattatcgattgtaaaaaaaatttaaaattttccacgagacaacatattagagacactagcggcaatagacactagtggtggagctattgtgagcctctgactcatttcatgcataggataggataattattactgagatgtgcacgagatgcgcagcgaggttcttagtgtcaatcaaagcgatcgcctcagccgtacgacgcggcgtcgtgcatgccatgtcgcatatgacggcgagccgcctagcccggttaaggaatctcatagcggtgagcgacatgtcagggaaagatggcgaggttgacctgcgaggtggcgccgcggccaagactggatgggcggaacccgcccgtgccgcggcggaccgcatgatgggagtatctgcagagctagctgtccggtggcggcaataacaagagagtgggacggcagcggtggctccaaaggtggagcacgatagtcagtaggagcagaaggagtagcatggctatggcggtggccgtggcaatgatgaggaggtggtggctgtggttgttctcaaggataaacttgtcttttataaaataataaaataatacgtcgggtatcaaataactaattaccatgtaggacattgactcacaagttgtaggaaaaaaaatccgtcgccgatgccgctaccgctgccgtatccgctacaagagggaggcgagagggagaggaggagatggcgagcgaagcatgagggggcggagggagaggaggggcgggggagagtgagagtgagagagattttgtgtagggtggggagcgagtatggacaaggacgggacgcgtttggctcgtctaagtttttctggtgtcatttattttttaaaaaaacccaatatttatagtataggtatcagttttgtttaaaatcggtacctataattcctgaaatgtgctgattctgtatttttccaccccccgcttaggtgggaaaagttgtacttgtgatggttttaactgtttcgacacttatagtaccgtcatctatatgtctttttagtggtgttattaggtatatatttatcctcatgcgatttataaatcgaaaacaatactcccttagaaaaaaacaattacattggtttctatgatttttacgtgccacgatttagacgtgtcatcagttcaagtccatactttttttcacatagcaacgcacgagattatttccacaattacattaaaaatatagtttctatatgtcgctattcggacgtgtcgtcggttcaacttcatgcattttattcatgagtatattcaacaattacattatacatattataagaaaataaaatttctatgtgtcgcgattcggatattgcatcagctcatttccactcattttcttcatgtaaatagttcagaagtgtcattatccggtgcaacgcacgggcattttgctagtatgttaatatattcaaattacatactcaaacacctaatctattaacttattggagtaataattaaaaaaaaagagaaacatacatgtttgctctcagggcctagatattctcatattaattggagaaaaataaaaaaaatcatatggaaatataatttaaaaatagctgaaattcagaacttaaaaaaaaggaatatcagaagagaagactagagtccatacggtacacttcctacattccaaaatataaggctcaaccctttttttttcaaatatttcattatataaggtgtgcatgcatgaaaacaattatctagcatgtcttatccactaaattattgttttttaaacccttcattctcaagttctctaattctaatgggtgcatgcactatatttattatatttattaggggtgatccaaatggtgaggtgataataattgtttcttattctttgggttaaggatgattgtgccttatattttggaattgagggagtacaatttagagctaattgaaattgagaatttaaaaaaagagaaaaattaaaagtagaggttagagttcatatataaatacaatttaaaaatagctaaaattcgaaattaaaatataaggaatacttgaagaagagtatagaatccatataggaatacaatctagaaataactgaattcggaattaaaaataagaaatattaaaagatgagtttagagtccatataaaatataattagaaacaatagaaatttagaattaaaaaattattggaagaagagcatagagtccatgtagaaatttagaactaactgaaagttgaattaaaaaaaagaatattaaaatagagtttggagtacatattttaaatacaattaaaataaactaaaattaaaaattaaaaaataagaaatattgggagaagagtctagattccttacaagaatacaattttttaaaaaattaaaatcgaaataaaaataaggaatattgcaagaagtgtctagagtccatatagaagtacaatttagaaataattaaaatttggaatttcaaaataacaatattgaaagaagagtgtagagtccatatagaaatataatttacaaataacagaaatttagagttaaaaaaatagggaatattgtaagagaagtatagagtccatatgtgaatacaatttagaaataactaagattcgatatttaaaaataagttatattgaaaggaggtttagagtccacatataaatataatttataaataacggaacttcaaaattaaaaaacaaggaatattggaagatgggtctaagtccatataggaatacaatttagaaataactaaaattaggtattaaaaactaattgataattatcatgtatatacaatacaatatgcatattacatatttgttattttggtcaacttagtatagaatctaaattatattaccattttaatatattttaataataaaatatgaaaataaatatgttattatgtaaaaaaaaacaatgctagccacaaaacctgctcaggtcaccatgctagttgtagtaatagtagtggaaacatacaaagggcggctaaggttgaagcactatggctagcttggctagggctgaagccctatgtatagcgctacaatcttcaatataattttataaagtgccatgtaatttgtgaaaaaaagttacgttcttattagtttagcattataggtgaaagttttatcatggctcaccactgagtggggacgaatatatgttgttcacatctgatagtaatagttggtggtgtatatctatctttgtccttataccacgcatatcacattgtacactaacagctcaattgtcaccttgctgatgggacacagcgaattgatcgttgtatttatagtgtatttatagtgtgtaagatcaaattgattttgtggttatacatatatagctcccttctgccagcacatgccgtaccatgcatattagtattatgacaaacccaccttgatggctagaaaacctcaactaataaatgtacatatgtaacttttgtaattatctttttaatatacgttgtaggatgctctcctacaatagggatggaaacggatcggaaacggacggaaactaactttatcatgtttttaagattttttttacatgttcttctttgaaaaaactgtttttatgtggcatatgaaagaggaatcacgataacttgaacggaaaataattattgtgtagcatactaaggataatttaaataaaagagcatcaatacaagggtattctattagcatatgaaacataaattatactttttttagaaaaataaatacatccaaaatgtaaatataaagtaggatatgtaaaatattttatatttttcaatacttctattggtcaatcaattatcatccatcgtaggttttaaagggcattttaggtcttttttagaaaagtgtccaccctaacggtatattataaaaaaaatcaaccatgtattataaagagagacaaattctatgataaatttttgaactagagtaaactcattgatatactccctccgatccgtctaaaaaaagtctaattctaaagatgaatctgaacacagggatataatagattctcccgaaaattacatcaacagaattacagtggatccgtacggaattatagctgttctaggattaatccattgcagcggaaagctaaattaatgatgggtacaatgaacagttcttacattctgcccttgtttgaagctgtttaccggtagtgtattccctgctgtcgagccacacgttgttgacgccattagcatctagctaagcgacacgtactattgtaagagcgaatagtactgtagaagtcttaatacttatcccgaaataccacgtaagctcatatatgataatatgatgagaagagaagaaagaaaggattgtgaaccacctctcatacaagagataaccttcacatttaaaacttttaagaaaaaaaaattaagtgtggatcgaacaaacaaattaaaataaaaatattgaattcagtgagctagagtacatcagattagaagtggtgattagctcttctgtaaaacttgctcttagtgtagctaggactagcataagtacagttggtccttttcaccactaaacaatgttaattacagctaaaaaaattactatatctacttaaatgaacacgcccatagagattatgatgaggaaaggaacaaaagcagagacttgacacttgtatatattatattgttcttgccactctaaaagccgccaataattcaaacaactatatgggattctctgcggctaaaactatgacacaccttataggattatttggggtcgcaaaccttctgtataaatttcacgtataaagcagacgtgaacattcgggagccttttgttccctcggaaaaaaaaacattcgggatctttttggctgcgtttgttcgggagggttagaaaatgaaaacggttccttttcagcccgtaaaacaaagcaatgaattagcatatgattaattaaatattagctaaaataaattaaaactagatcaatatgatttttctttttaagaaacctttccatataatttagaaaaacacacaccatttattacaccatttattagtttgagaaacgtatgtgaaaaataagaagatataatgaatacaaccttagcttctactccctcccctctatcccaaataagtttatttttcactcatcccaaactatgaatacagagataaataagactataaacctctattttattaaatcacaatacaattattctccactttatctactcccaacacaattattctttactttcataaacttcgatgcaatgattaaaaaagcttaacttattttaggaataaataagtagagccaaaaataaacttattataagatggagagagtagagatttcctggaccacttgagctataatttttgtagatggaaatcaaaattaaggggctcggatgaataccgtgggccttttgatttgatgatcattgataatatgagccccaggtacgtagatgcaaattaagtaagatatcaatatcatcaccgtgttccacactcctgtataaaattggagatgtgtccttttattagttaattaaatgaacagagtaaaatttctcgatataatcacaatatcacgctcacgcactgttttaaagttattgcagggaccaacaaggatggttactgaccggaagactatgaattcatgtgcaaaattcaaaaaactgtacccgaaactcaaatatgtttttttaccagttggcaacaggccgattggttatcggacaaaaaaaatctttttggttctgaacttttgcctgataaaatcatttcataggatttcaccattggcatttgtcgatgggctgcacccatctaggatatttgagtatggggatcgttgaaatctgggtatacgtgagattgagataaagagacgggagatagatttttatataggttaggccccttaattgacaggtaataaccctactcggctactcctattggccgaagctggtgttgtctttatatatcagtatcatatgagtacaatatttgcgataaactaatctagtctttgtcggcttggcggcatggagctttcacacgtagtcgatagctagtatagtcttcttactcgaatataattttggtcatgttagtctttgtggctccacgttgggtttgtgtagatctatattggcttgtcttatgttggcctacccctctcctcctaggagttcttgtatatatttatagtgatgatcgtcttcctccccaagtataactcaaaaacttaggataagatatggattaaagagatattatgtttcctgactagaagtctgacatcttctattttggaaagataacttccttctagatatgtagtactatttccctaatcaaaggatacattcttgtatatctcattaggtatatggtattttcgtatactataaacccatgtatagtaggtatgtcttatccttaacactgacaaaattacattaattttgaagatagcggcattataatttcaacaacatctgattatagcattgccaacccaacaacattgcactcatacattagtgtgaaattattgacacaatattttggatatggcggcattataatcctggtaagcttcaacgaacattatattatcacattgccatcaaaaacagcaatacagcatcacactcataaacactgttgtaatatatgttaatgtgacaatctcgccacatttatcacacgcatcacactcatatacattttagcaccacttacattggcgctaagatattgtccgatgtggcaagattgtgacaatgtgatatcggtgagataatataatgtgcttcagcgaacatttgcaggtatgggtgtatatatgggcccagaaagccaggcaaggaccaacaaagggtggttattggttacccacatgaatgctatggattcatttgaaaatttcaaaatgtatatctcaaactcaaatgtggattttgttttttcatccgataactagcaggctaccggtaataaaaaaatcatcaattactatcattttaatatgatttcaccaaaggccgtaattttggaaatagtagaattacggtcatgggaagcttcaacttcagtatgaaatatttatcaaaaggaactgataagaatatacttgaataaatatttatctcctgttggagttattagtttttgcatcgtcaatttttagattttacgtgctctctattaagcgaattacgtaataaatgattgtaaaattaaaggccatacttcattccgttatcgatgagaagccagcgaaggcggtttatttagtacctttacttggtaaagcatgagaggtgtgccatcttttgccgaaagtgaagaactcgagcgcttgcgagcttttattttagacatttttaataaataattttattaatagatatcccaagaacttatttctaaaatgaaccattttgccacgccactggaactggcgtggccaaactactatgccactctaggacaggtggcgtggtaacaaatgccccgtgacgatcattgcctttggcaaggtcaagcgggtgctgacgtggcagggggctgaggctgggcttgccacgccaggcttggtggcgtaataccgccatgccatcccgcctagcatggctagggaatagccgccgatgtcgtccctttctgccttcttcctctcttcttctcctctccgttgctctctctctctctctccccgcatgaagcaaccaatgccccctcctcaaatccctcgaaatccattcaaaatccgatattcttactccgattttaagcccttttgagtaggagcccatcccataggtatatttccttttttaggttttttctcgtgtttgcatttagttatttccatccttctaaattgcagtgaaaacatgtaacaaggaatcgaatatacttgaaccattcatatcttcaacacataaatcaagtccatcaaaaccattctaaaatggattcatccaaaccattcattactatgtagttttctaataataccatagatattttatccgatctttatccgtttagtaccaattttctaaatacaaacttgttatattcatcataaaccacaatagtcatgaaattaataaaacaataatcctaacacatgaaattttcttatcgaacacttgaaattatttcttaaaaggcatgaaataaatagggctagctgcattgtcaagccaatgagccggacatttcagctgccacgccatggaccctgacgtggcaataagttctacgttggcgctgcttgactttgtccacgccaactactgccatggggcacctttgccacgttaagaccgatggcatgacagagtaatttggccatgcaggttatactggtgtgaaaaaaaaggtttatttttaaaaataagttcatatgaagtctattattaaaattatttattaaaaagtaaaaaaaaaacacatacacacgccctagctcactccagctgatccaaaatactactccacccaaacaaaccaaaaaaaaaactcaagttcgcagaagatccaaaccttaaacatgacacacaagttcatacgcctgcttggcagtagaccagtccaaatccaaccctgtcccccaaattaacaaaccccagaaatgcccccaaaagacaacaaagcactcaccacccccccaaccctaatcagcatttgattttgatccatcctcatcaacccccactattaatcctcttccccttccccccgctctccgtccatgttcaccccgcccccatgccccgcaatcccatccaggttcatccgcctcccgtcttctttttttttaattcatccgcaaccactgcgaacttgcgaaggccgcgggtacaagaaaagaagagaaaaataaaaaggagccgcattataagtaggtagtggtggtggtggaggaggaggagagcaaatcgaggtagccatggcgatgcaggccgccttcgccgcctcgatgttcccgcagctggcgcagcggaggggaagcgatcgcgcggtggtggtggcgccgccggcgccggcgccggtgagggtggcgatgaggagcggtggggcggcggcggcggcggcgagaggggtgaggtgcagggcgagcctgatcgagcccgacggggggaggctggtggagctggtggtgccggaggagggagggcggcgggaggcggcgcggcgggaggcggcggcgctggcgcaccgggtgaggctggggcgggtggagacggagtggctgcacgtgctgagcgaagggtgggcgagcccgctgcgagggttcatgcgcgaggccgagttcctccaagcacttcatttcaacgccatccgcggcggagacggggccatggtcaacatgtccgtgcccatcgtcctccccctcggtgacgcccagcgccgcgccatcgaggcgtccggcgcccgccgcgtcgcgctcgtcgacgccgccgaccgccccctcgccgtcctcagcgagtgagacatcccccctaccccacctcttcttgtttcccttgtttagttagttgcatttccctgttcagacgcttaattgcaattatttggttactaggagtgcttgctagaagagtaaaattactaattacatgagtggatggaatgtagatatattgattgttcgtgttggttggttgattctcacagttgtgggatgcctttggacctccaaaagccgtaatttttgtgcttgggttggaaattggaattgtgggggttgtagcctgaatggttcagagaagttcataggtggtttcttcaattggaaacataatatgcagaaatacagattatgagtgtttctgtgcagttcccacatttcgtgagcttatccctcacaaacttgtgctctggttatattttagactttaatgctagtaaacaatttgtttcacagcaacctggtcaatgatatatcattcatggcggaggttttatcttgggcgttaaactaattttaaggttgtggcattcctcttttgtcgattagactacaatatcgtcatgcggataacctttgtcatgctatatcaggaactcaggacatctttatacatctcggtcgttttcaggtcatatttttttgagtcgtatatatataatacgatgatcggtaataccattggtagtccttataaatacatgttccgtagttcttttgccgtgttctctaggtattttagttttatctatattaaactgacaagtgatattatatttgtttcgttgttttttcgccgcgttctatgggtattttagtttaagcaactgacacatgatatgatttacatcagaaagattattttttattcaccatttgtttataagggtttgtacacatccagctattgtaagatgttgttatagaggtgacgtaacaacgtcaaccgtttacatctgtgtctaggaactcctcaagtcatgtgtgttcaaaacaatccgacttgatttagcatggttttagttctttttaattagttataccatggcattccctgacatatttttcttctttgttgtcagcattgagatctacaagcataacaaagaagaaaggattgcacggacatggggaacaactgcacctgggctgccttatgttgatgaggcgattacaaatgctggtgattggttaattggtggtgacttggaggttatagaaccaatcaagtacaatgatggtcttgatcagtatcgcttgtctccagcccagctgcgtgaagagtttgccagacgcaatgctgatgcggtattcgcgtttcagcttcgcaatcctgtacacaatggacatgctttgctcatgactgatacacgcaaacgccttcttgagatgggttacaaaaatcctgttcttctgcttcatccattgggaggattcacaaaagcagatgatgtgcctcttagttggagaatgaagcagcatgaaaaggtacgctttaagagtagcaatcgtactgtcaaatctttttagcaaatgcatgttggtgccttgttgttgatgaaaccatttgatttaattacactactgtaaggcccaattcatgcacaattttgatgcgtgtttattttggtaggttcttgaggaaggtgtcctcaacccagaatcaactgtcgttgcaatcttcccctctccaatgcattatgcagggccaactgaagtgcaatggcatgctaaggctcgtataaatgctggtgcaaacttctacatagttggaagagatcctgctggtatgggccacccaactgaaaagagggacctgtatgatgctgatcatgggaaaaaggtgttgagcatggctcctgggcttgagaagctcaatatccttcctttcaaggtatgtcatcctaccagaccagatatcacattttttggatgcactagattgtgtagttcgctagcttactgtccatcttgtacatttgaatttggatgtcaagcaacatattttagttttcagataaaccttgttgtattctttttcttggcatgactcctgatttgttttatcaggtggctgcatatgacacaaagcaaaagaaaatggactttttcgatccatcaaggaaagatgatttcctgttcatctctggcacaaaggtaacatccatttcaatcctgttttggtacaccagttaattttgagcaccaatgtttttttccagcccagtcctaacaacattgcctgtgttatatagatgcgtactcttgccaagaactgccagagcccccctgacggattcatgtgcccgggtggctggaaggtccttgttgaatactacgacagcttgacgccatcagcggacagcagcaaactgcgcgaggcggttgcggcctagaaagctgaaactacctcaaataagcaagaacattgcatcttgcaactgtaaaatggttctttcagagagagaaccaatggtatatgtgtatactactggtcgcaaggcctaaacatttgggtttgattggaagcgcattctggtgtgatttgtatgtgccctatcatctggtaatgctacattggaagctcatcatgttgttggtgttaataaggatgagcctttgtgtgctctgctagatatgtacatatacaatgtggtggtatttatatagtgcttggtgtgtttgctattatagaagagcaggtttcatcttctattgtcgcatctggtcattggacagggctcgaggacatgagggatggtcagcaatatttttgttaacactggaatctcatcaaggtttctgtatggtatgggcaattgctttaggctagagtgaacttcatattctggggcaacgattattttcagagacagaatcaggggcagaataattattgacaattacttataggagagaattagatattattatgaagtaaaaatagtttgaaaaaagttatctaaacaatgctaataaaaaaagcttttaacatagtctcggaagaatggcatgaataattcggttgatagtctgcctccgaaagcgttgacgtataaagaatggggaatctgaagttctgaacccttcccctaatctgaattctgcatttgtataatacgagtagcaaactctaataaatctacgtctcctgaatgcccttgaggagtttgaatatacacacaaacttcagcctctatgatttgatcatttgatgttgaaagctctgttgacaacgagctaatcatgccggtgcacctacagattttgtgtcgatctaccaacgcttattcaaatgaacttgtgtcgatctaccaacgcttattcaaatgaactggtggtatatcgccaccatcttgtatcaacctaaacaagagtaggagcagcaacaagaagccacgcaaagaacttgttgcttgtaatatttcgcttgcatcgttcatttacactgaaaagcaggtaaagataggcccggcgaaaagcaggtaaagatacacaaagtgtatatacatacagaaaagggaaagccgtggagatatttgagtcgaacgctatctaacaattgcaacgtaccaagaatccagtttccatctcaagaaatgaacaagttccatagaatacctggggacaaagctatctccatctcgattctcgaagatcaatcccctccagcatccttgacatcgacggcgaactcgtactcctggtcgcagcccagataggaatcagacatcaagtaaaccatgtaatcttttctccctgcttctggcaggggcagcgaactcgagcttcactcgagccctcttctggagcttgaccctcttgattgccagcaactggtcggtggagcgatcaccaatcaccagccaccatccttcttccttgggctttgggaacctgggggcatggactggaccagcctcagattgcagcaggtctgccatctcgcgctctagcgtcacctgcacggtcacactgccaccatcgccttcaagaacttggaaagccatgtcgatgtttgggaaccgcctgaggaatccgacgatgtcctgcagctgggagcttggtagctgcagcagatcctgcatctcatgcgtgctcatctcagccagatcgaagatggtctcgatggccttgccttcgttctcctggcatctccgggctaactcctcggtgaagtgtggaagctgaagcagcacggaatcgcgatcccacatgccctgtgtcaccatctggctcagctccattgcgttgagagcgagggtgagccatccgttgctggagatgacatcgatcagtgcctggagcaatctatgagcaggaaggagaatctcccgctggtcagctgcaaggtcaccttccaccgtgcgccttgagaaatggcattgcagcagtgcgttggccttgacatgtggatcgtcatacctgactttcttctcgacagaaaatctctggtgatgaacaagcctctcaatggatttttgctcaccagggcgactggggagatctgcatattctgaggcagaagctagaatctccaggaggcctttcaacttggtcttctgagttagcatagaactgaatcgctcaatagtcgtgtaggtgacgtagtaatacgaggcaatgagaccaaggttgagggtcttcaggtaaatattttcctcgatagccaaacaattggttgattccaggtcgttcagcactgtctcaaccagctcagagagatgttctgatacatgcctgtggctcacatcctgcagattgtagtagttagggttcttcgcaagccgtcggtacatgaaggtccaagtaagataatccacggcatcttgcttgttttctataagaccagctaccacctcggcattcatatgatcatgcaagaagtgctggagatggctctcaacagggaaggcctcaaaaaggaacttcttgtagtattccttgcgaggcgcatagcacaatataacacatttcccagagtcatcttgaagaggcctgttggcatggcccatcatttgcaacagatcagtgactggataatcagtatggctgttcccccggccatcataatactgggttcccatcacaacaaccagatgagagggcaatgatcttccccagcacattttgctgcttgcaacacacacttggatcctcccaccaagaaagagctgagttacaagttcctgatcgaagtcgctcaggccctcatgcaagtagcctacaccacatttcagagtgtatttaagtgcttcatcattgacaccactagtgaaagtatccatctcgtcttctgacccaagaaggaaaggtgttccaccactctcagcacttgagtgtgcacacaaatccactgcggtcaaccttgcatgcttatgtgttggtacaaacaccagggcaggcttaccatgctttgcatgctgggttatagcagtgtatgttggctttgacattgcctgcatccttgcctcaaaaattgctacatcccaaccctgaatgtgaatttctaacggcagtggtcgcactgctggagggaagttgaaaaggctatgagaggaggtgccaatccattctccaagatctttaccatttgcaagggatgctgaaagcgctacaatccgaatgttactaccaatatgattcgccatatgcctcatcctagagatgatgatttccagaatatgcccattttcagatccaatcagatggagctcgtcaaaaataaataaactgacctgttgcacattctttcgctgtttccatcggcgtgagagtgcatcccacttctcagcagtactgattataatctcccctttatcaagaagcttcaaatcagctgctgtttcgcctgttagctcaactacccgcgccaattctccaaatttgctctcccaatccttatatctttcttttgcaagagcttcaataggagctacatacacaacacgcatgttgctgtcaccagatacagccttctgatggtttcttagaatagcaaactctgcacatatggtctttccactgcctgttggcgccgcaaccaacacgctgtcatcactgttgtacgaggcagtgaacacttgagtctggatggggttgaaatgtttaaaagcacagtaaaggctttcatatcgtgcatttctcagggcagtaacaggtagtggctgcagatcaatcaattcagttggtggagcatatttttctggaagagttaaatgcctaaaactgacaggaagaattgtctgagaaccaagccacttatcagatactacgcgtataaagtactgagggggcagtggctcatatattggcactgtgaagttaagtgtatgatcttcatccacgtattgtttcttaagcatgaagtactcatggtgaagaatgttatcgccaccgttgtcctcaacaataagccagaagggctccacatatccatgcaattcatcatcccattggaaatcagctgttatagtcagttcaaaacccaaaaccgtaggagtaataggttgaacatgggctgaaaggttcagctttggtaattggtggatgcacttgtgcagctgcatccccatcttcgggttacgaattagctcaccaatttcctgtgatgataggtcaaagtacctctcccaagccaattcttttttctccagtttcattaagatttcctttggaatacttggaaactggtgcaggggaatttggacgttccatatatgcttatcaatcatcttgcaaagattcaacgctttctccgctagttgggcccatcctctcttcaaaactatctcaaacagcgctcgtaggagacggccagcattctgcatcataaagtagaaaatgctacgtaagattaatagaccaaataagcataccataattcaggaagtgcattcagcagagataacacgtttttacctgtctgatgtagaccatatctgaactaagggaaagaccctccagttccagcctagaaatatatgcttgcagtagaacattgatctttgcactgggctcgtccaagctctctttcacaggaataggcacacaattgaaaagctttgccaactccattttctcatcctgtctaacactgacatacttaaattcttcactcagtgaaaagagtcgacacagctcaatatcacccattgtaggcttcaggcactcattgtatgttgagatagtcctgtgactaacatagtaataactagcaatccttcccaggtcagttacctgaaaatatcctgttttcctgtcatactttatcaaattgttccaatccagtatatttgcagcagcgtgtacctgcaacagcacatacaggaatcagagtgtgccgggcagggaacagaaggggtgagacaaacatattaaacatggaatgatgaaaaatcaaggcagcatctatataaacactaacaatacaatgatagatcatgatacttcttcaaaatcttgtgacagtagttattacaaaatgatgacatgcaatgaagcaagacaacggaaatcatcagacaaatagctctgaatcttttttctcccttttataaaataattgattatctgataggatttcaattcttcttccttattctacgtaactgtatagataattcaaatcaaatgtcccacgcaataatttcagatgatatctggattgcagcaaatagtctgttctgattttgtatatattattttacatgataagtaataacacaatgttttatattcataggaagtacatgtgctacattttacatgtaccacagttacatgtgctacattttcataaaatgctatatatatacattactccctccgtcccataatataacaatctagtaccggatgtgacacttcatagtacaatgaatctggacatgtttcctatccagattcgttgtaccatgaaatgtccaatccggtcctaggtttctatattatgggacagagggagtatgtattaacaatgaagagacatgaacatgaatagtttgtttcctgttactattattatactaagaaagcaagcactaatgtaaggagcaagcagcatagatttatacttcctttctagatgtatttgctgtcttttttaaatgaacctcgcaatattttgtatggttcgtttaaaaaagacagccagcacatctggaatggaagtataaatctatgctgcaaataagcaggtaaacaaaaatatccaagagcactgtacactatccattctagattccaacatgcaagtatgatgcaagtggtgaagtggaggaattcattccaggtttcttcactacctcataaacatcaaaggactgccctattgcagtttatgaccgcctagtcaatactgaacagtgatcatctcagtaaatgctaagaaaaaaattttacgagaaatatttatgctcacgcaattcctgaacattcagaaagcctaagaaaaaacttggacagttcataccacaatggacctaagagagcatagtgggattgtggaaatgcaagcataaagtgtgaacaaatattggaaagtaaaacaccagaatgaaaggactaatataaaagaacctaaaaaaaggataggacataagtttttacttaccaagtcaactctcctttcatctagagtattgtctgtttccataatatctgctggtaaaccgtacaacgttggattccggagcatcctgatgtagaggtaggtgtagccaagccaggtgcatgcctcccgaacattctgaatagtccccagaacgatctcagcattcagatgatcagccaatctggatatgaactgactctcaataggcagttgctgattcatcagagacaggtagtactgcaattcactttgttcagttagtattattccctctccatgtgtatcatactgaggtctgcccgcgcgaccaagcatctgcatgacatccagagggctcagttctgtccaagcacctttttccggattgtaaacctgggtaccctttattattacagtgtgcgcaggcaaattgacaccccatgcaagggtcgctgtcgaaacgagcgcctgtaaatgtttatcagcaaaaagcccctcaatgagctcacggtctacccttgtcaacccagcatgatgaataccaaacccatacggcaaaagatctttaagatcattgcttttcacatgatttgcatgatcggcaagaatctctaggctcgcgctctcaacctttggaaagcaggtcagtttgttattagataatgcaatatctttgatggcacgagcagttttggctgtctccttcctcgagtgcacaaatataagcacttgatgctttccagcagcagccataaccttctcatagcaaatctgattcatcaactgaaacctctggaagggcttcttcacagtgatcccaatgtattgttgagcaagagggcaaggtcggtagctgttatcaaaatggaagagaccaccagagtgaacacgcaagaaaactgcaacatcttgatagtttggaagagttgctgagagaccaactagacggatatgttccttggttgtttcagtctgcctgactgatctaaacaatgctctccagaacaggccctctgttgtcatgaagtagatgaatctcatcaattattagaagcttcaccatttgagtatagattctgtcacctgattttcttgtgacaatatcccatttctcaggtgtagtgacaataatctgtgtttcatcaatctgttgtttggttaagttctggtctccactgagttcccttacagtgatattgtactctttcagccgtgctgacaaatttccaacaacttcagcaaccaaagctttcattggggctacatacacaattttgtatttggtattgtcaaactctccatctttcatgtgcaagccaatctgctgaaggattgtaagcacagccacgttggttttcccagcacctgttggtgcacagagaataatattatctggtttgaaaagggcagtatcataaaccttgctttgaatcctattcagctgtgtcatcccagcaaaagctggttgagcccagtctggcatatcagatatcttgacaaccttctctccattttcatatggcttagctttcagtgctggcacatggacttcctcatacccgttatgaggggttctaaatgatcctggtggaagttcacatttcttgttaaccatcaagagaccaccttggtggaaggttaggttctcaagatcaagcagctgcttctggcctttcaaccatccactctccatatcccgcttaactaccctttgatccctcgcaccattaatgccagcattttgtttttcggtaagcctcttggcctcatccctgatgcttttctccatattcttcagcctatcttttgcagacaccctcgttgcatgcagctgctccaatattggacttaatgttgggtcactcagcatattctcttctatcatcttccgcttttcctgaccttcagcccttgccaaacaagtacaccagaatatcttgagtcggttccgcaccagcaatttgatgaaatcaaaattgtcatagcccaatagcgtgacaagccgattctcaacatccttgtcgtcactctcagaaagaaaactcatgatctccaaagaaagctcctggctaacctgcggatcaatatcttcatatgcctgtgataccttcctctgaagccagtaagcatcaatgtcttgtgcgtttatggccagctcctcattggagttatgcatatcatcatcgtctaactcatcaccaatttgcatggcaccagcagcattcagcatggtgtcgccgtcgtcctcatccaaatcatctagtacctgatatagacaaacgttgaagggcattacacattaggaattaggatatgatctatcagtacacgcagatagaagggagagcaagagattgtaaacagaaggatcatttgaatgtatgtacctgatcagaatcacttccctcatcgtcttcgttctgttcaaactcaacagcaacgccgaaattttcatccagttcactagctgaatcacaaactgcagtatcatgaaaatctgtgatgagcttaccgatggagacgaactggtggaacatctggtcggagatggggtcgaggaacttgtcgatccccctcttcttctcagggctcttgatcttgtcattgttgaggatggcaagcacctcgtcggcggcgctgccaagcacgtcaggaggctggccgccgagctgccgctggatgacgctgagcagggcctcgtaggcggctcgcgtctccttggtccggggcctgtacacgacgtcgtcgatgagcgtgagcacgctgacctcgcgctgcgcggtacaggcggaggcggcgcggcgcctgcgcttggcgtcgaggcggtggccgatgtcgtggtccgcggcgtcgcgcgccttcctcctgcgcggcggctcgacggggggcttggcctggacggcgcggtcgccgaagctcctcgggtcgatcctgccccggagcgtctcgggctcgccggtgtgctcgtccgcgccgccacgggggcgcgagccggagccggagccgagcacgaggttcgagttctcgacgtagtcgtacttcctcgaacgcgcgtgcgcctcggcgccaccgccgctacccggcttggccatggctgcagatcaaagtcaatcaaaagtcaaaaaaaaacaaaccgaatcgaatcaccacgcggccgagacggtgggggtaggtttttggccgaatcgatggatcggctggtggattacctttggcagggcgagccgaacgaagccggcgacctctcgccgagttgtccgccgccgccgccgccgccgccgcgtcgagtcgcggcgattctcctctcttctcgtcgtacgtcgcggcggagaagggaggaggagggtttggtttggagggaagacggcgttgaaacccgcgctgattttgcggggatcttttttttttcttctttatttttgcgggtatttattttgtgggggagacaggtcggtttgatggacgaaccgactttggaaacgtgtactacagtgaaaggaagcccacgtaacctcaggcccacaaggcccatctattttgacggttttgctgacgtcaaattttcttcttagatcgatttttctaacgaaaggcgtagtgtgcggttcgttacgtacgcggcattggactcgatgatgaccaagtgagggtcttgcatacatattttttcccttttcactgtataaactgaagtgattagatgataactctacttaaatgcatatgggagagatatgtgaccttcgaaaattacatactaattacgtgcaagttatattatagttacaatataattatattgcaaacgtaccatatttaatttgacaatagctaaatgtacaaataatatctgaatgtgataatttaacgctatttcacgaggggataggggttggcttttagtccgtgtgtctatgtatataatttgtatacatgtatatcaagtttatacgtatatgtataagtgcatacttttaatgtataaaatttttatatatatataaacaaaactttgtatatatacatacaaactttatacatatgcttacagagtttattcatatacgtacaaactttgtacgtatatataaaaatttgtatatacacgtacacatatatgtacaacaagtactccgtaccatatagaaactaactacgtgcaagggggccgcgcatggccgatcgttaattagcaatcttggtttcaacgtggtctacttttatccactaagatagtcttatatgtcatcctcaagtgtcgattaaaataaattggtaaaaaaaaagagtcaaattatcaaaattctcaaggttaccatatctataaatttcaagaaagggtttgtaagccacttacagaaattgaattctagaaattaatttttagggtttttcaattattatgttctactttttcagttttgtcttttgaaccattattaccaatataggtcttaccttaattttttattactttgtttatttttgtacgcaaattttgaaatagaatcacaaccttagaattgcattgaggaaaatcattacaagctgcaactatatcatgagcaggttatgcgcacagtggaaacattgcgtccaatctgggaactagtggttgcacccgtatgatttcttactagcatactttcactcaatttttttttttgaagcgaaaatttcactcaaatatttttttttctgttcaacatttttcatcatgagcacaaatagtttggaaatggtcttctccccaagattggtcatcatcagtatcctcgaatgcacacgcgaacaaggtggccagcaatggtgcaaaatagtttgatctactgtatattcgccaaaactccatttttttcccctagagaagaaagggttcagacttctgaatttacctgctatgtttcatttttatctgaccatttgatagatgccaacataaggaaggaaaatgaaatattcaaggtccataagaaatgaaattttcagagaatgactaaggacagcatgaaagcttgttaacatgattcccaaaaaaaggaaaacaagtctgactatctctttagacgcccggtcgctctgcctcgggggcgatgcgggcggcgaaacaagccgcgtcgcccccgtccctctcctcccctcccacgcctcgccgccgccggcaaagctgggcggctgcaaggacggcggcggcagggctctctctctccaccgctcgcagtggagttggacggggcgccggcaaggcgccgacgacgaggaagaaccgacgacggcgaccagatccggcgccgggatgcacggatccggtacccccatggccggatctgctgctccgggcggcggcgagccgggtcggcaagtcgcagcatcggcggcgtggaggtggtgccttcggcggccggagggccgcgtcgacggccggagggcggcctcggtggcgtggagttggcagcggggcggaggacgcggcggcatgaccgtggctgcggcgacaaacggcgagcgtggccagatctggccggacggctggcggcggcgctcgcgg

SEQ ID NO: 71380 - DNA, 1389 bp, Oryza sativa
attcgtcgtgatccgtggtcgtcttcttcgtggagcagcgtgaatctcgcattggcgcgaagagctgctccaccaacgattccagcagagctcgaaggttgcagctccgggtcaccgtcacgaatgccctgtgctggatgccccgcaccgcggggctcttgtacaccatcgccgccagcgtcgtcttgcctaggccgccgaagccgacgatggacaccaccttccggcgggccgagccgtcgtcgtcgccgaccatgtccagcagcttgaggacggctctggtcttgctgcggacgccgacgagactcgtcgacgctgagtgccggaagacggcggtcgaggtcgtcgtagcagcggggcgcgtactcgccggagctcgacgccgcggcgggcggctccagcttgtaacgcagcctccgctcgctgaccatgagcgcgcgggccttgaggctctggacctccacggccagcttgtacatcgcccgcagcgtcgtcagcggccggagcaccgtcctgcgcagccagccggcgaggtcctcgtcgcggtaccggtcgccgccgacgtggtaccggaagctgtcgatgcagtcctccgcgtcgtacgccacctccctcacctgcttcatccacgtcctcgtctgcaaaaaaaaaaaagattcatcgtgtcaagaacacgaaagcgcacaaccgattgcgttgtataacaaaaactattttcgttataatatattaacgtgtaattctttttagtgttcgttaaaaagaaaaaaataaggggcgacgccacggcgaggggctgacctgctgggtctggtggtagtcgccggcggcggcgaggtcgcggaggcaggcgttcatgctctcgaggtcgtccttgagctcctggatctcgtggcggacgccgctgaggaggacgtacttgtcggagaggaattcgccgagcttgccgaggaggatgtgcaccacgccctcggtggagctcaccacggcggcctccatggcttcctagcgcagtgtaagtttggtcgatgagctcttggcttcttctggtaggaatttatacagacgatccgcgccgaattggttgagctcaaacactgaagtgataagactgatagatgctgttcaactgggatactgtacttcactaacaatttattcaaataattcgtgtcaaaaaaaatattcaaattattttacaggttcaattagtagtaatttttattggggttgttggatcagccatcatgtgataagttggggtaccaaggatgtaggagtatcaatcaatacattacactgtcattactcttaaaaatatgggaatgattggttcatggttagtactatttttcgccttataatacgagatctctcatgagagtgttg

SEQ ID NO: 71381 - DNA, 1111 bp, Oryza sativa
tttattccatgagtccaataactatattttttagaatttggttaacaatagtctattgtttgaatgagctaaagatgctgaataaaactacagctactataagctgctcaaacagggtacatgaagcataatagacatatgaggtgccacaaccatatgtccatactaccatatagatgttactccctccgtcccttcgtcctaaaatgtagcaatctaaaatatgatgaggcctattctaaaataaaaaaaaatctggacataatatgagactcatcctagaacatccatcagattgctacattctgtctaaattcgtcatcctaggttgctaaattctaggacataggtagtaacaaagtacagattgcataagagcaagtataatatagggctataaaaaggctgaatgctgatgtggatgagagaggagaggagagatgataagcgagctgtaagtttgcagccggcttaggcacagaaaccaagaaaatttgtgagacagacaggtggaccatatatttatagtgaagagttaaccaccatatgagtgagctgagagataggctataaggatctgtacagtaagcagttggttgtattattagccttgctctaagagcaagtataatagtatagtcaattattggctttaaatcatctataatcaatttaatagccaatttatacaatagttacatatacacatatactacataattaacctttggtatcacctgtcatacacacatgtatcttgagttcatgttgcagctggctacagatctgtagcccgctattcttacatcttttcttttatcgttttaaaatatatttatagttggcttatagtctgctattgtaccaaactataagagcacccatcagtgtcagagtttagctgaagttgctcaggcgctgagcccaggaaaacggtatataaaattgtgattcgaagaggccagctgattgactctacactcgggttgcggtagctgcggcaattgaccatggaagccgccgtggtgagctcgaccgagggcgtggtgcgcatcctcctggccaagctcggcgaattcctctccgacaagtacgtcctcctcagcggcgt

SEQ ID NO: 71382 - DNA, 2004 bp, Oryza sativa
agggcgcgcgtgctggcgaagcgcgcgcgcgccgcggtgggcgaggccgggtcgtcgtggcgcgacatccaccgcctgatcgacgatctgacggaggccacggcctccccggagccgcagttgcagtagatccgaagatctcatctgagacagattaataagataggatttgtagcttccctttacttgtcgctaattcgtatgcactctgtaatggtctttatgaatacatttcttaatagttgcttgaatatctatctgtgtttttaacacaagagatcaaagtttgctcggtgaattttcagctggcaaaccaacaaaccatttcaatcttcaactacgggcaaaactgtgttggtattttttgggacagcggagcttttgtcctgactgggagagacataggaagcaatatctgcacatttctgtcgaagtcgaagttgccactgccaaatcctacctctcttccaaatgcgaagatctcatctgattgacaaggtagaatttgtagctttccttttacgtcttgcaatatatgtccacccaacagagtgataatcttcaggaatgaatattgacttgaatatctgtattttaaacagaaaataattcaagtttggtcggtgaagtttcagctggcaaaccaataaaccatatgtttattttcctctggatcatttggcaagctttcaatcttcaactacgtgcaataataaagcttttccaggaccttttttattgtactaaaaaagaaaagaaaaaggatgcttcagggtctgcagactacttcacaatattattgagcccagaagaggcctgcagctctatagcccatacaagcaatgaaccatttcgtcgaaggcccaaagggtaaaaaacaaaactttacttcgtctttattaagttacatgcaccagccagttgcacctaaaagcctaaactgatagggaaaggcgggcaattcactttatacactccaacactccccctcacgcgagaccccctcaagtctcaagcgtggaatattggagtgggctacaattattttatttaattgcgcgccagccaggattcgaaattattttatttaattgcgcgccagccaggattcgaactcgagacatttggctctgataccatattaagttgcatgcaccagccagttgcacctaaaagcctaagctgataaggaaaggcgggcaattcactttatacactccaaccgtcttccccaattgcggtatgggagcctcgcccattctaattatttgatgttaggtcattccctaatattcatatcttttttcaattgcggtatgaggggtcgctcgactggttgcttgttagggcaagtattacaagcatccaagtaaaatctcctaaatgtcacataaggttaagtagtgaggtggaagagaaaagagatgagagagatatgaagtcacccctcatacaagaggcaacccctacataaaattcaagacaaaagaagagagatgaagagtagattgggcaaataaacattagagctagtgtattagaattagtatatatgtgatataatgtacatattatctatatttattagttgatgatatgattaagattagatgtagcactatctcttttataaaacttgcccttagtgatctcggtaggtgctcctctagtgtccaggtccatgctcagggaaagttctcacgcttcgtttcatgcggcttgtcgtgaacacggcctgtggcaacgagttcatatcttccaaccaagtccaccggcagcggcagcggtgcagaggcgatgagcttcacacggcacctcattggcaaactcatgcatcccatgatgtggagcggtagcagacttgccgaggactatagccgcctccaccatcaactccttcaaatgacaatgccgcccgacggtggtcgtgaggccatccacctccgcgaatcttcgctgtcactactgctcagtcttggccgctgcttggcttcctcgaaccaa

SEQ ID NO: 71383 - DNA, 8525 bp, Oryza sativa
atatatatatatatatatatatatatatatatatatatatatatatatatatatagatatatatatatatatatatatatatatatatatatatatatatatatatatatatatatatatatatatatatatatatatatatatatatatatatatatatagtaaatttgtttggtgctccatggtgcccgggcaccatgattgaaatttactatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtaattttgtgcattagataccatggtgcccgggcaccatggtgccccatatgagtgtcctctatatatatatatatatatatatatatatatatatatatatatatatacactagaaaaaatatccgtgtgttaaaagctatcttaatcttattattgttatatatttttgggtttgctaattaactgttgacagttttcagcgctggcggtgcgtgcagagatggaaaaaatttgcaagccctgttcgtgctaacggtgcaggaggataggaaaaatttatcaagcgcgccatggggatcgaacccaaaacctgcaacatacacacttgctccattaaccagttactcctttgcacttttgtgggagttacatccgagttacatattaattatattatagttacataatagttacaatgtaattacactatagttacatactagttacatttgaaagtttttcatctaaaaaactgtcgagtgttgtatagctactcccatatattttagttaacgagaaatctattgagggaacttgtttggatatatattttttaaaaaaaatcatgagctgcaattaggaatccaatcgtctcaagttagcaggcgagtttttttaaagagatttcttatacgatttcttctatatttctaaaagcgaacgaacttaaaaaccgactcaaacatggatctgtatttccaaaaacgaataaacttaaaaatcaactcatgcacagatttttaatttttataatagtagagataaatgaactccaacagtaaatttcatcttaactgaaccatataacaataataagattaaaatagacttcacccgttgcaatgcacgggcattttttctagtacttaaaaaaataataggtgctttcgtcgtccgtcaaaaaaaccggccaaaaaaagggcgaaaaaaagaaaataaacaaattgtccgatccaaaaagagggcgaaaaaaccggcttaaaacaaatcgtgcgaagaaaccaggcgaaaaaaggaaaagaaaaattaaatccgtccgatcaaaaaaggggcgaaaaaaaggaaaagaaaaacgaatccaactccgtcaacgcagtaaaaaagggcgaaaaaaaataaaaaagaatctgtctgattccaaagaaaaagaaattatatatgacgcggttaaaaaaatatcaaatcctattatattatctctatctctactacttaaaaaaaatctctatctctaactctaactctacttatatgatatgagctgtttccgtcctctgtgaaaaaaaatcgggcgaaaaaaaaacggacgaaaaaaagctaatcctattccgtctaaagaaaagggcgaaaaaaaaccaataatcatgaaaaaaaacgggcgaaaaaattcgggtgaaaaaaaaccgtgcaaaaaacaacaacgattccgtgtaaaataggaatcggtaaaaaaaaccgggtgaaaaaaccagacaaaaaaacgaatctgattccgtggacgcggtaaaaagaggggaaaaaaaacgaattatgtctgattaaaaaaagaattatatgtgatgccgtaaaaaaaatttgaatcctattatatgtgacacggtactatatatctctatcttctctatctctatctctactactttaaaaattaaaacgtttccgtcgtccgtaataacgaaaaaagagcaaaaaaaaaacattaagaaaaaaaaaagtccgattcaatttacttccgtcgtccgtgaaaatcttatcttatcttaaaggtccaggccgctcggcgctcatcgccatttgcgagcccgcctagccagaccaccgacgctgtagcacggctttgcaccgccctcgagtgcgcccgctagctggcgaagcaggagccgcttggcggtcgtcaccgcacgcgcgcaccagctcaccaaactgccatcaccaccttcggcgtcgttctgctcgcttgtcgctggagagaaataggatcgggagagagggatgtgggagcttgggttttgcccctctctcccggtcgtcacttcatccagcacggggacgatcggagccatccattagatcggacggctcagatttgcccagcgtcgggccaccgccgccgttgattacgctgcgcccaacgggccgcgaaagtgcatcggaccgtccccacatatgtgtgctgcgtcagctgcttggcctgcgagccgtcgaattgactcaactaaccaaagatgggccagcccaagtttggcccggttgggaagacctgggccaatagcaaatttgatcaaacaatgtggctcagattttttaaattaaagtccgtcagataaactcataagtagattcgaaaaataaatctaaaactaaatcctaaatcctatgctaatttatcaaattagactcggtcctacctatttgttaatatatcaaattagacttgatttttaccgttttgaggttttcaaggtttcccactatcgaacggtgtttttcccgttgcaatgtacgggcactattgctagtaaaaaaaaaaagctgaagcccatgacgccatcttaatcctctgctcgtactgtccaccaactaacaggcacttgacctccgccagtccaatcatacacagccacgtgtcctggcacttcaaaagttagttaatgtgttcaaccaccagcagctaaaccccgccaacctttgcttcccgccattaatttctcctccctatttatgctcccccatcctccgcccaattcttcccccaaaacgcacaccccaatccgatccagaattcctccgtcgcgaatcctcccttgtaccctgttcgatctcgtgcgcggcgcggagcggcggacgacgacgatgccaacggcggcggcgatggccggagggatggcgacggggccaggcagccgcgtgacgcggtacgccaagtcgacggcggcgtcggtgacgccggtccgccccggcaagacgcacgcgctgtcggcgctggacaacgccatggagcgccacgcggtgtacctggtgctctactaccgcgccgcgccggggctcgacagggagccgctcaaggagtcgctgtccgacgtgctgtcgcagtacccggccatgaccggccgcctcacgcgccccgccgccgccgccgccggcggcggtgaaaagggcgggaagggcggcggcgccacggcggctgtgcaccacgggtggatcgtcaagtgcaacgacgccggcgtgcgcacggtggacgccacggcggcggccacgctcgacgagtggctcgcgacggcgtccggcgaggaggagatggacctcgcctacttcgagcccatgggccccgacccctacatctggtctcccttctacgtacaggtgaccactactctttactcaaatcaaatctaacgacagtaattacctcacttcgtgtgtttggtcagagtaggtgagctaattagcaaaaattaaagatgctaatggaccagtagatcatcttatctatttgttcgtcagttgtttcaattaacattgctaccagcaatcatgtcgcgaacctacgatttccggaatttaatgcgtctctctagtctggttagttggttgcttggaggctagaatcgtacgtactgttacatctcgccggccagcatggccattttctgtcaattgaatgcgtcacatggagttgccgttcatgaataatccgatcaattttcaagttgatatttgctcaaatcagcagcgtttagtacaaatttacagtgagtttttactagttttttacggctatggagtgatcgattctgaacttgtgtgagccccgtgcagctgacggagttcgcggacaaatcgtacgcgctggggctgagctgcacccacctgcacaacgaccccaccgccgccgtgctcttcctcaacgcctgggccgccgcccaccgccgggatagcccctaccctccgttcctccactcgccggcgctcgccgccaagtccgccgcgccgccgccggagcacccgctgctcgccgccaagtccaggggctccccggacaccggcggcgagatgtcatccgccacgttccgcttcagcgcagccgcgatgcgcgcgctgctgtccgccgtcgagccgggcaccaccccgttcgccgcgctggccgcgctcttctggctccgcgtcgagggcgacgccgccgacgccgccgccggcgggggcgcggccgaagagagggagctgacgctcgcgctggacttcccgaagcggatgcaggcgccgctgccgacggggtactacggcaccgcggtgcacttcgcgacggcgcgcgccgacctgtcgtccgggctggcgagcgtggcggccgcggtggagcggcgcgcggccgccgtgccggaggaggagctgtggcccgccatcgagtggctgcacacgcgccaggccgccggcggcgagccgttccagatgtacgggccggagctgacgtgcatggcgctcgaccacgtgcccctttacggcgcggagttcgcggccggggcggcgccggcgcgcgccgcgtgccgcgtcggcggggcgagcggcgagggtctcgtgatcgtcctgccttcggccgagggcgagtccgcgagggacgtggcggtgacgctgccggcggcggtgacggccaggatctgccgcgacggcgaggtgctccggtacggcgccgacgtggtgttcggcccaaaggtggacacgcaggcctcgtaggatgtcgggctgtcggcccacagaaaaactcatctgggtttctttgtgctttacttaatttgttgtgatgtggccttcaaaagttcaaatgattgatgtaccctgctttgatgtgtttttttttttggtcttctgttgtaatgcatttcctagttacaagttacaaccagtcataagttttatttatttattggtaataaaaaatgttgaactgaattcatttatgagagtatcactctatgctatttcggattatttgctccacacctttaaaaattgttgtatattttcatctattgtattgcttgaatcacttattctgagcatttgttaaatttacttttaaagatatttaatttttccttagtaaatactccctacatcccaaaatataaggcataaccgcttttctcttatgtctcataatatgaggcagacgtgcatgcatgcatacattaactagtatctcttggtccaatagaattgatttgttttaaatcctataccatcaagcctcccagttacattgcttgcatgcatcaagatgatttaaccaaggtgattaaatgttttcttggtctttgtgttatgagtggttgagccttatattttgatatggagggagtaatctatatcaataattcggtgcataatttcattccaaggggccagagtgccgggccctccctcataaaggaattgtcttgttatgtagttagaaatagcaatgtccaagaccgaagatgcagatatgcaacgtgtgaatatggaatcttctgcctttgtagctttagccaaaataggcgaatgagttgctacagacagaagtgtaaactgtaaagttgtcgaactgaatttcctttttttaataaaaattgttcatttgaatccatttctgattgtatcactatgttgagatgcacttgatagtgcaatgacaaagggtgtgtgatttcaacaccaagatcccgtgttcaattcccaacacactcatagtttcctcttaaaaaatgtttggagggacgtctcctactccaaatctcctttttttcccctattgtatcactctgttttaatatttgaagcagagaaatgcctctattatattcctctctcataaagaattgctttattgtgtagttagaaaaagcaatgcccaaaaacagctctttttttatcgctctgttttaatatttgaagcagagaaatacctctattatattcctctatcataaaggaattgcttgattgtgtagttagaaaagcaatgcccaaaaacagcagcagcagatatgcagcttttgaatatcgattcttttgaatgatttgctactgaagcgtagagtgcgatacttctagtggtaaaaatcttcagggctttcagaggccaaaagcgtgctaggcaccaaggagatattccacggcaggttcagtgctctttcttccgccggctactcgaaataaacgtgatttgtttggccactaatgacaatatgacatgtgccacaattggacttgttgtctctggttgctatcaatgtccttcaaagttcaaacatgatgaaactaatgtatcttagctgtgcaatcatgtttccttcgttttgcatcttttgcatcaatatatatatcatgcgccttacgaccaacatggtaacttataagcataacatttagtttttaaaatatagtttaaaggtttttcactatgatttattttccagtatttactttttttaaatagttaggaacaattatataaaagttttagcaataaattatttttttaattgttgataagttattttgcttataataagtataagaaaaaaatgttgagtcccttggtattacagcagtgagtttatcaataattcacataaagaatcttctttttttttcccgttatcagactagaggcaaatattcgatcttacttaatttccatctaaagcacacttacatatgcgtatcattcttggttatgggcaagaaggttgggtttacttcatcaacgaaacccgatcgattttttgcgattttcaatgttttcgacgtggctcaaaatcaatatctgggagggatttcgaatggtctttgataaattcaaatttgaaacagtagtttgatccaagttttggccttgtttagttttaaactttttcttcaaacttccaatttttccctcgcatcaaaacttttctacacacgtaaactttcaacttttccatcacatcgttataattttaaccaaattttcaatttcaacgtgaactaaacacatgtcgaaatgcaatcaaaataccaccacatggcgcgggatcgggtagtcagtcggaaacgtaaacaacaccgttgtttgtttgtggaaaaatatggtttgagatttgagaaccgtacaagagtttgccgagaacttgaaaaaagtacaagccaacgatgtgatactatcagaaaggtcaagagatacgcaccgtgtttagttttaaatttttttaagagatacgcaccgtgttttcatttttttttaaacttacaactttttcatcatattaaaacttttctacacacataaacttttaacttttttatcacatcgttttaatttcaaccaaactttcaattttagtgtgaataacacaccagatcatacgagacgctatttgagatgcgtaccgccctaacaacatctcgcgttgcgccgcgcgcttctctcccactccactccactcgtgcatcggccatggctgacgcgatcggcggtggcgggaggcggcgccggctgagggtgttcttcctccccttcttcgcgaagggacacctgattcccatgaccgatctcgcgtgccgcatggcggcggcggggcccgaggagatggacgccaccatggtggtcacgccgggcaacgccgcgctcatcgccaccgcggtcacgcgcgccgccgcgaggggccaccccgtcggcgtgctctgctatcctttccccgacgtctggatggagagaggggtggagtgcctcggcgtggccgccgcgcacgacgcctggcgggtgtaccgcgccgtcgacctgtcgcagcccattcacgaggcgctccttcttgagcaccgcccgacgccatcgtcgccgacgtgcccttttggtgggccaccgacatcgccgccgagctcggcgttccgcgcctcacgttcagacccgtcggcgtcttcccgcagctcgccatgaacaacctcgtcacggtgcgcgccgagatcatccgggccggcgacgccgccccaccggtgccccgtgccgggcatgcc

SEQ ID NO: 71384 - DNA, 36256 bp, Oryza sativa
ttttcaggaagccggctgatacatgctttcagattgacatacctgaaagagaaatagaacataaagaatagcacaaaaaagattcatgccaaataaaacataacagcagtacaacagtccaatcaaacagtagctaaggccttgaatgatgtagtataatctacataaccagaaaaatgaatagccattatcacagattttgttgataatatgctttgcatttatgaggttttaatggtgaatggtttaacagatctaaccaatgatgatgcaaaaagaaaacattattgccatctagcccatcataaatcaatgatattaaaatattatatagacaaactgtagtgaatggtgatgtatttttatggtccaatagcacatgtgactgttaaaattttatccaatacgattgcagccagaaagacatagatttagaatggtacattgaggtttcatcaataaaaacaggacaaaatgaggtcgaaacataccagacatcatctggattatcatcaggatcacaaagtgcaggtttgaccccagggtcacggttcatgtagcatgagttatttaatggtttcctccacatagcaatatatccctctttcttcacaagctcccaacagagtcttgcagtgaagtcttccatctctacacataattttgttcacaagcaattctttcaaaacaaaccaaaaaaagcacttcattcaaagtaagcctgtcaaaccaatatattatgtaatcctgataaaaaccatgcaatacattcatatttctagacatgatacatcataacaaaaatctgcagctttagttggtttctagaaatgaaaagaatttgtagtttagctttgcatttactttacttcacgtggaagaatgcctcaggcttgccatggatttaatctggagatccatgcatattaaacattttgcattaatttttttcttcaaattactgtgtatacataaccatatgaatcactccagatatcgtaaaatttgacatatgtcattccagaccataataggaggttgattcaaacttcaaagcatatgaaacataatgctgatacacaacacaataaacaaggaaagaacggcaatgcatgaatgaggaataaaagagcagctgtcataaatctaaaaatgcaaacgacaagaacaaatatgaattcgtcatgtgggaaaataccaacagaataaatgaaagactagtgtgtttcccccacaatggaacaaaaattactaggggtacataggaaataatgcatacctttccatgcttcttgctgagcctcttcatgcttataaacaggctgtgctgcccaagcaaaataaccgccggctctgagcattctattaacctccagaagcaggattccatctttaaagtggcaaatcatggcaacaaaagttaagcaaattggaagtcagggtgctacaaaaaacagttatctttgtgttgatattttgttgaaaacaatcattggatgaaaaagcgtcttcacgtgctaaaaataacacactatctttgcaatgtttgagtgccttgagcatgtctatttttctaataaaggaacttccagtcattatttgaataaaatatttttcttatgccgtaggaatgaattcagactagctccttaaatactccttaaatatgttgcctttgctcaaacgcataactaagaaaaaaaaaggtagaactttacatcaaagtgagtgctcaccatcgtgggtccaatttattcggcagcgtgaacaatggattaagtcaaatgcttgactgggatatagtaatcggtgtgtcgcaaatgctgctgccattgcaggcacaccacgctcaagagcaaactgtatctgattctcatgaacgtctttgggagctatggataatgtcaacacatcacgtgaaagtaagtatgcaccaaaacttgctactccacagccaacatccagggcaactctagtgtgagagccaaatgcaatatctggtaccatctggatgaacagagagacaggtggtgctactgagagtcagcaacatgataaaattttcatcagataaaagtacaatcagcatacttgagaaatctgatccaggtattgatttgctccatggataaattgagttcctcctccaggaaatctaaatttatccttagctttactaatccaattctgccctcctttgtcatcaaccaaccgcgtgtgaggtacattgctaaaccatacctgcaattcatcaaagtgtgttatagaaactcctttacctgaacccagaggtctttgaaaaattaaaccaaatcagttggttatactccctccatttcataatataaggcacaactacttttttcagatatttcataatatgaggtgtgcatgcatgcatgcaattaaatagcacctcctctctattcaattattatatttaaatcctccacactcaagatctctaattctattgggtgcatgcattgcatttgttacggtgatccaaactaggaggtgatcgtaattgtttcttggtctttgggttaagggtggttatgccttatattttggaattttggaatggagggagtatttaattttgcattaaataaaatgctgtacttcaaatgctgcttcatcatgctctagttaatttgaattcatacttcatactgatggcagaatcagaagacatctcctctacttagcaaacagaaaacccagtatgagcttgctacaatgctagtaataacccacaaaatcaaacactaccccatgttccacgttcggaaaatccaaaggcaatccatcaatttttgaataccttgcatgttatactcgatgcctagtactatagggcatagagttatacactgaagaattgtatgcatcacactatcaaaacttttgtttacagcacactgtcaaaatgtgaaagagagaacaccaatgcgcacctcatctctgctccgaggccaaggaatgggtgccttataccccttgggtgccggcacgaggcagctcagacccttgtccttggcagggcagtgccgctcgaaccgctcgccacgctccgtcgagggcagcctcctgatctcttcctcgttgtcgaggcagggtatgtactccctcatgctctcaggacaaaccgggaacctcccaatccgaaccctgctcccgacggcggggcccgcgtcggtcggctcctgcggcagggcctcgtcggtggcggccagatcggtgtcgttggcgccgccgacgacgacgtcgaagtcgtcgcgcatcgcgccgtcctcgccgacgatgccgaggcgggcgggagggggaggggggcggaggggaggaggaggcggcggcagcgaaggtgggggcgaggcattggcagtaggagaagcaggcggcgtggaggcggcaggggtggggatcagggaggggtcgaaggagaggttggcgttgggggagacggcgacggaaggggagccggtggagaggagcggcgaggaggaggaggaggcggtggaggagaagaagagcaggcgcggggaggagtcggaccagtggtagccgacgaggaaggcggcggcgcaggcgaaggcgagggccgcagcgcggaggacgcgcgggccgcagagcaggtcggcgccgtgcgcgcccaggggcttcatgctcgcctcgcctcgcctcgcgtcgcgtcgcgtcgcggtgcggagagcggtcggcgcggcggtgccttgccgatgcgggagggatgggatcgtgcactgccggggactgaactgaactgaggggcactgctctgttatttttcacttgaaaaatctatccccttcttggagtactactgtataataataattcttccaagtgggtcctctttgtcagtggacgcccgggacaccggcgaattgaagtcggctttgccgtcgcttctaccgacctcgccgccgtcgatcgtcgcctcgtcggtgaaggatgggaaaatgggtatttttggatctgggctatgaaattctcgttttctgcgagagagagtattgctcctgaaatgggtgagcaggcctagaaatgttgggctgggcaatgagcaagaatttggaaaaagtaaactgaaggtccctaacgcatccctcaacttacaaaaccagtgcaaactagatccctcggtagttttgactctgtgtgttgtccgacgtgcgctgactcggtgtgggacccacatcggtctcttcttcccctcctctccaactcgcttcctctcctctcctcatactctctcttctctgtatctatccactctgtcccatgggagcagccgagcagaggggagcggagtaggtggagcagcgacgcacgaagccggcgggcggagtggggcgacggtggtgcgtgaagccaacgaggcggcgacgggcgaagaaggcaggtgaaatagggtgacggcaggcggggtggggcggagcgggatggcggcaagcggagcagccaggcgaagtgggacaacggcacacaaagctgacagggtgacggtgggcgaagcaggcaggcgaagtggagcaatctgtcgccggtgccgatctccacagcttcggcgcccccccccccccccaactccctctgtcgtcatcatcgtgcctcctccaccgagctccactctcgctgcggctgccgttcccgctttcccacctgcttcctgccgccgccagacgacaacgacgggttcgacgaggaagaggatgtgcaccacttcttcctctttcatgtctcctccatcttcatgccactgtcctctcgccacatctgtcgctaccgtatcatgcgggcccctcctcttctcctcactcccgccgcacgccaagctcctcaccctcccctccccccttccaaccgccacacccctcccggcgcggcctctgccacttcgtcgacctcgactccttctcgggagcgttgctcgtcgcgtcgtccccgcccttcttggcgccctccaacctgcttgctgtcctctgcaccccgtctccgccgtcctccgcaccgccctctgacctcgacggcgtcctcaccaagggcagcggctcgccgcgctatcccctcgccatgggcagaggaaatgggacccactacccgcgcccagctgctcccccactacttgtgcccgccggcccccactcacacgcagctgctcccttccctccctccccccaaccgcccgtggagagaagaggagagaggaagagaggtggagaggagaggggaagaagaggctaacatgcggggcccacgctgggtgagctgccacatcggacaaaacctgagtcaaaaccacagagggatctagtttgcactggtttcgtaagttaggggacacgttgtatctggttttacggtttaaggatgattttgtaacttgatggcaagttgtgagaccttgggtgtactttttcccaagaattttgtgttcctttgatcatactggacctgagtaaagctaagcctgcatggacgtttttatgtttgggctgtccttgaggttgggtttggcccgttaaaagagcggtataatgggcttccagctatgcagtgaccacaatgcgagttctgaattctggattgctccgtgaactgaagtactgctgaactgtgacttgtccttgtgagttgtgagagatgcctcccaccgattccgattatgtacattgctaacttaacaatcccttggtttgaagcgaagaatatggacaacaccgctgatttgccaattgtcatatactatattttgctggtggcaaacaacagttttacgtgttccctttgttacaacgcatcttactgaaaagagtgaacgcagtcttattttatggcggtcctaatatcttccattttcttgccaaacatgcttctaaaggaaggcctttttcctatgttattgcagtattgctacctgaaggatggacacgtttccacggtacatgaagcaccaccccatgtagcattctaaagggaaaagttgcgatttctacgagcagtctatcggaaattaaacaatctcatgtagcaagagtgcatgacgcatgtggatggttacaagaaatcaataatgcgtcgtcgcatcccgggtctcgctatcgcgcgatgaatgagaaaatcacaggtggttggttggttggtcgagaagcacgatactaacaaacacagcaactcgaccacggtgcgccgtacgctcaccacaggagaggcatcacacgaacgatttcattcagacaccgtgcgtgcacaacggctcatgatggttaggctcccatatggcgggtgcgggaggcgagtcaagtcaagtgctcgagcgaaagcaaacgcgaacggaggaggcagtacactggcagtggcagcagaagaacatcgtacgccggtcgctttcccctcctcccccacccgtcgccgtcgcaggagaggacaagtgtgaccaactggtgacacccacaggcacgtttacctgttaccgcaagagagacgttttttcctcgcacggcacgcgtgcgcgtgacgtttttctcccacaactgctcgactcgatcaagatgacggggctgcttgctgctacagtgttgttgacgcggccccctttttttcgctgctgattgatgcttgcgcggggcgggaaactgaggcttcgtgaagcttcgagacgttggccacaaagcgtcgcatcgcacgcaacctggcccccgccacgaagtgggccgatggcgtcttggcgcatcggctggctggcggccgccgctcgtgagtctcgtggcccctcgagcggtcaagccacggagggagataagaaactcatgatgcgtagacgaggttcgtcaccggagcgttcagggccgaataataaacgagcgcgcaccaaagccggtgcacggctgcacgctggtcacacgttctcaccgcgagcctgtgtgtttaccattcgatcgggtcatgtgtggagccaaaaaatggtttcgatatttagaatattattttaaggattagttttacataagcagctatcttttacattctaaccctttcgaaaaacatatttcagaaatggacgcaaaactctacactagatattgttgacgccgaagttaaaccgcccacgagacaacccaccctagtctgattggcatgggtgaaaaatgttgtgcgcataacgaactacagtatcgtgtggatttctattaaaaatatcatgaaatttatgtattccagacatataaatcgcacattagtgcatatgcctttcagataaaacatggtgttatcaatcggtgaatctactgcacgccacaattacgctactaaaagtactcttttatgtattcattttttttttttgcaactggatatagttgaactatttaagttttttttatgacaaaacctactttctccgtttcatattataagactttatagtatttttcacattcatatatatatgttaataaacctagacatatatgtgtgtttagattcattaatatctatataaatatggacaatgctaaaaagtcttataacctgaaacagaggtagtactaactagatctaaattttaggcttagcacgaatgctcatgtatacatcagtagagagacaggtatggtaacttcttcagccttaagatatcccaaccgtcttcctcgtacgggtaaggtaaggtgtacgtacgtgcgtctatagggatgagaggtaactctgttaatttcaatcattttttaaatatgttggtccaatttttagagatgctcatatgcgtagaacgtgtgtgcatgtttatagagatgagtgtgtacatgtgtgtccgtatataggcctggtttagttctcaattttttcttcaaactttcaacttttctaccacatcaaaactttcatacacacacaaatttccaaattttccatcatatcatttcaatttcaatcaaacttccaattttagcgtgtactaaacacgccctctcccttatgccttttgtttttttttcgtacggtgtttaaaatcacgatggtccaatggtccaggatgttcgagctaccaacatattacatataagcatttactccattcaataaccagctttagatgatattgcattcttaaaaactgcgaaataaaactccctactaaaactatccttataattattttcaacatttattctatcatatactcaaccaatcacaataattttgtatttgatttatgtatataacttttaacctcaaattaatcactattatttattatttataattttttacctcaaacaatcacaactactcgtatgtttttcttattttattttttttgaaaattgataaaagtagctagtataatatactcccaccgtttcacagtgtaagtcattctagcatttcccacattcatattgatggaagtagacatacagttgtactccatcatataggaaaacaaattgccattccatcgggaaaaggcggtttagagcatgtacaatagtcggctataagccagctataaacatatttaaaagagacaaaggaagagagagaagagcagcgggctgcagtacggactccaaatcgtacaatgtgtatgacaggtaggaccatgtattaatagtgtagtaagcaactattgtatgaattggctataaatgatatggagctagttgttggctatactattaaacttgctcttagagcaggtacaatagcaggctataagctagctataaacatattttaaagagataaaggaagagacagaaaagtagcgggctacagatctgtagctggctgtagcacggactccaagacgtaatgtgtgtatgacacaggtgggaccagatattaatattatagtaagcaactattatatgaattggctattacattggctatatatgatttgaagatagtagtggcctgtactattaaacttgagcaattctacggttcttaagaaggtaccatgaggtatcatttttttctattgtaaatttagtacctcttggtacctagatactatgagataccaaaaatttagtataaaatctgatatctcatattacctcctcaaaaactgtagaattgctcattaaacttactcttaggaaggctaccagcaaatttaattggtggatgcggcgccggggagtcaaattgcagccggccacgttttccctggccgcgtctcctggctccgacccgcacgacgtggcctctcccacgggccgacacgtagcccctccaagccctgggcctcaaacctttccagaagcttccggccgtttcctggccaggaattcgccgtcccgatccagcggcccgccgagcgccacgtgtctggggcccagccacgtcggcatccgacgtggcgcccccggccccggagaaactgatacgcccaaatctcgcagctcacagcctcacgctcggaaagcaagtggccgccgcttccccaccccaaccaaaccaacgccttctcctcctcctcccccccgtggccgccgcgaggcgagagcgatcgagacggaggcggcgacgacggcgacggagaaggtagcggaggaatcggcggcggatacggggaggacgggtgctcccgaggagatgaacggccgcggcggcggcggaggcggaggcgtgggggtggtgggagcgggaggcgaggagcagatggagatggaggaggacggcgccgggcttcgcgcgcgggtttctgcggggaggaaggagcgggtggtgcttatgtgggggtacctccccggcgtctcgccgcagcgctccccgctgctcgggcccgtacccgtgaggctaccggccgcggcgggcggcgatgggtggagggacgtatgcggaggcggctgcggcttcgccatggccatctcaggtgacgtcccgtgactctccttctcattgctgttccgctcgtgctccgttgctctcgattcgttgggtttttcggggtgggctgtggtagatctactggagttgtcgactcttacaattaccgtggtggattgatgatagtaataggtagtgaatttggcgaaaatttgcgaacagatagtataggacgggtttacggggcattaatactcgtgacgatttttttttacagcttgcatttattgggcacatttgaattagttgattgtgatgtacttacatttcaagtggaggtccagttttgcacgacttggtgcggcaagtttgagctcggacttgtcctcttgttccgattgtgctttagttacaaccatttcatagctgtgggtgaatgtgtgaaatggggatttgtttgtcgagagctatatagtgaaagaagatgaatacacagctgaaatttgttaaattaagtgtatttctgaattttctgagaccttattcgtgtgatacccagaaacaacgataaaaaatcgtgtgatcgaggagaggtgaaagaagaacgtcatatcatgttcttagttgcctctaacatgatcacacgagtgaccttttaattcattttgttcggttgaccgtgatggggaatttgcattcttgttggccggccccacgaattaatttgatgtaccaaatcagagtgttcgaattaaaactattagttcaggagattgtatgtgttcagactcaacaatatgccaatagaaacgagctttctctgaaaatttctgtaatcggttgctcaccatgttcaagataaatttgatactaaactggggtttttatttggatcagagtctggtaaactcctcacttggggttctgctgatgatatgggccaaagctatgtgactgccgggaagcatgaggtaaaaatgctacccgtatctgtattgatgctttatgctctcatcactcggagatatttctaaggacaattttgtacttctcaggaaactccagaagcttttccacttcctagtgacgtggcaatagtgagagctgatgctggatgggctcattgtgttgcaataactggtatactactagttgaacacacatagcgtactttaggacagcaagagctcataatttttgtgttactagtaatttcgtaaatgtcatactggaccagatgaaggggatgtctatacatggggttggaaagaatgtgttccaacaggaagggtcatttctgaccaatcttctggtggaactttggaaaaagatgaaagacagagtgcgattgccgctgaccaaggtggtgatgattactgcctaccttgtttcatttgtgcctaaaaagtataagcttctctacatcaattgttttcagatataacaaaggcaactccattacagtgagccccaggtcgcaggtgtctaggacaagtagcggagcagcatctggtccttctgaaagtagaggtactgatgatagcacgaagagacgaaggttgtcttcaaccaaacatgcacccgaaagttcaacgtccagtgatgaaaacctttcagcacccccttgtgtagtgacatttaatacaggagttaaaataatggcagtagctgctggtggtcgtcatacattagcactatcaggtagcctacattttgcactaacactatggcactacatttgctgggctagggaactttgctgattaaaactaaatgttttctcgaaagcttcagatttaggccaagtatggggttggggctatggaggagaagggcaactaggcctgggttctagaatccggactgtttcctctccacatcctatcccgtgcattgaatcagcattgtacagcaaagatcggccagcagctatgaaaggaaacaaaagtgctgaagtgcagattagcaaagtcatgggaaattgcgtgaaggccattgcatgtgggggtcgccacagtgctgtagtaacaggtaagccctttctttcaagctcactctgggaaccttttatcctacttatttaaagttgatgtcgatcatatatgatcttaaggtggtatgtgtgaatacctcagttgggtcggtttttttcttgtggatgacaatacatactttcaaattggtagttcagtttgctttggtacagtataaagtaatgttttgtgatgtagtattacgaatttacaagaatggacaacatgctttttttcatgtttgttttcacatagaaaatagttggtgattagaggcaacaaggtgcattgcttgattggaccatatattgtagttaacttttaagtaactacgatattatgtatatgagattttctgtgtaaaatcaccaaagaacatgttccaaagaagttactttaaatccaaggatgtgcacaaaagtctaataatcaaaactgcagatctagacgagttacatctaggaggaatttcaattcaaaccaaaatattagcaactgttcagctctgttcatatcttctagtgaattccaacctgcttttacaacacatggaaccctaaattctagtaaaaattttggccctgcacttttaacagctagttcttttgcagattcaggagcactacttacatttggatggggactgtacggacaggttagtgcttctaccatagcatatcagttggaccaagcttgtgtgagatttcaaagcatcatttgcatgactaaacacatccaagtagctaggaaaagaaatatgtattcaagggatggagaagtgtatgatttgttttgggtaatccatctatgtattcaacaagattaggcattgaagagttgtttgtacttgctttccgactgaacaagtacacagcaaacttatgctacaatttaatttggtttacatgtgatatgtagtttcattgaaagtctctctctctctctctctctctctctctctgttttcaactttgacatcttccataacaatggtgatgacagttcttgctcactcacttgacactattttggcatggtatatattagatttttcccccattttgaaacctatgagtaggagcaacaaaagttctgttgcactagtgctcttaattattgtataatttattcttcagtgtggacaaggaaacacagatgatgttttaagtccaacgtgtgtatcgtctatcctgggagtcaagatgcaagacattggtgcagggctgtggcacactgtatgcacatctgtagatggcgatgtctattccttcggaggaaaccagtttgggcagctgggcactggttctgatcaagctgaggtacaaattctattgagtaaagtgcattggtggtccttaaacttgtagggttggtcatataggtccctaaactctcgaaatgcatatctagatcccagaacttgtcaaagtgtcccaaatcgacacatcccctctaagatctacgtggcgctgatgtggcatgccatatggacgtgacgtatccttttctttttttctttttttctttttcttttttgttttcttctcattcttcttttttttccctttcttctactcgggtcacagagaaaggagaagaaagggaaaaaagagaagaaaaaataaaaaggaaaaattttaaatgggtctcatttgtaaatcaaaatgatgccatgtcatgtccgtgtggcatgtcacatcaacgccacgtaggatactgaagagtttgtggcgatttgggacttagataacacactatgacaagttttgggacttagatatgcattttgagagtttaggaacctagatgacatacccctacaagtttaaggaccgcccgtacactttactcaattctattcttttcgatgttaatggaggttaattacataaagtaagtttagggaaaataactacagttaacataatgattgcctcccaaaatggagttagctgtatgtgaggtgcatgtttactcagtaagtgataaccataagtatattgcttttttttttatgcagactgtaccaaaactggtagatgcctcaagcttggagaataagaatgcacgagctgtttcttgtggagctcgtcatagtgcaataataactggtacctttgactgtactagtatttttcccctagaaggaatttgctatcctatctgtctaatataactgcatattaataaaatgctcttctcatgctcatttaaatcaaggaaatatttctggcaagggtttgttgaataaacccaattatccaaacaagacctttagggtttgttgaagaggtagagattatactcgatcccttagaaagccatgagtattttagtttaatctgtctgccaaccgaacgtactgagcctaatccccatataagcaagccctattgaatcttcctagatattctgatgtgtaatcatattatgagtcactgtagttattagcgtattatcagtaacttgtgcttggaaagttggaattctacaataagctgttccatgtgtgattgaagtacttaaattcttgttaatctttggcctccctgacaatttgtttaaacatgcccgtagaaagtgctgttcctggtctaacatctactgacaaaatgtggtgacatttatgcagatgaaggcgaggtcttctgctggggatggaacaagtacggacaggtgcgtatttcagctctgcacttggagaagaaaaacattcaccgttgcagttctttttataacttttgagttgcgcgtgcagctcggtctcggcgattccatggacagaaacgtgccttgcagtgttcctgtcgacgcataccacccactgaatgtgtcgtgcggttggtggcacaccttggtgctcgcggagtcccctacttaaaacctgacggcgaacaaacttccctagttgacaattttgttaggagtttggtaggctttcatcaaggtgcggccgtgttgcatttcgtgtatatacatggcagtgcatgcagatatggtgtattcattctttccggtgcgctcttcaacgggcaacgtacacaagcttgtatcgcaccgcgtatacagttgggtaggaatggctgtaaggcctgtgcttgaaagtgcatgcggtgatgactgtgtccatgcttcgtcttgcattttccagttgctatatgcagacgaaattaaccggttgctatatgcagacgaaattaaccggaacgctgattacgctagaacagggacgatcatgtatggggctgatgagctatacatttctgctcccgcctctgaaatccttcagaatttgacggtcacttcgtgttaattttccctcaatccagactttatataaggcagctactactgacgcaaagacttttcatttgaatcacctcaataaatacaatatacaatgtacacatttaagattagagaccctcatttagatcatccttataaacaatgtacacaccagaattagagatcttcaggatgacggatttaaaaaaacgagcgcaatggtacagtttaagaccgcaaaggctgaattgtattgtgatcggagacatgcaagacgcccaatgacacgatataatgacatttttttctgatcttttagatcaacttatgagttgtagcaaatacacgataccataatatgggttctacatctatataggaacaacaagaacgaaaagggctgccccgttcgcaaaaaaacatttatgtacaacgagaggggtcagctacagcgatcaacgaatacttctaataaggttacacaagagctcctggatgaggctgtcgcgaacaatctgtcagtcagcaacttctttcctttaaagaacacaagcatcccacttttgcccgtagatgctcatacatttattgtgcttccatttgctagcaatcctcaagttagatactaattaataccaagctgtatgtgaaatgtcctagaacctgtactgaaaacttcagatgattagaacgaggatgtattgtggtatgaaagagtgaaagatgagagcaaccatattttgtttcaaagttccatttatatgggaggcgagtatgtaatagctgataatgattataatggaaaaatggcttcaccatggacgggcaaagcctgatagctcgagtgcccgtaaataatgcccagtttacataatcactgtcagctgactgaagggtataccagaaagttgactaaggtctatgcattgttaataaacatcccaaggcaattgtgcaaaactattattatgtttattactaaaagacatgcaaattccaactgtagtatcatcacaattctgatgaagcaatgttaaagtaagaaaaggaatgattctatctgctgaacagacttacatgtaatttcccttttcccttgcactgatgaggaggcatgatgcttagaaacggggcacttttgacagaggccccattgtgggcattggtgaaggctcagtaaccggaggtcttgtttgatggttggcaactgaattgttaattaccaatttatttcctgtgcttctaataccagcagcatcacattctggttgttgagggtccactgatacctttacctgttgcagtttattgttttaaataatccaatcaaacttttgtttgagcttattgctgaatagcacagcagcagtacatgcaatgcaagatgcccagatgatgagaataaaggcaatggcaaaaatataagtgctagttctatttcaaaataacaaacagacaacattgcattctaaacttttataaccaaacaaacaaaggaaacagggaaaattgctgaattaatgttccctttactaagtaaattctactagaaagcactagactatggtactttgatagcgattacccccatacattcaaagtcataaaacctaaaacccaaaaacaacaaaatggctacaatagccaggtcaattccctcagaagttgggtccagatgtccagttggcatattgcataacatgagtgcacatgaacgaagattaagaaaaacagtttcacaaaatataataagtaatagaatggcatttcttagtcttacaggatgtctttgcggattcttgtcctcccttaagaaaccaggaacagataagtgccaatttttttctgcatgaaaatatattcagatttaataagcaaataaagttgattctatcacatcagagaggagggttatcaacctaggtgcagcaatacatccttggcttccaggactgatgatttcctatgcttcgcaagggtacacgcaaatgcagtcacctagtaacaaataaaaaaggtcagttgatacaagttttgtccatcagataaaagaagcaaaatcagaagctcaaggtactcagattctgaatcacacggaatcacatttttcaaccaaatagaaattcactaagagcaagtgtgctgtaaaagcatgatttacaaacaacaaacacattaccgaatcaatgaagtcatcagcaatctccaaaagcaaatcttccacttctggatcaaccttgcccaggggatctacctgtaaataggagttcacaattcaaagacaaagcaaagtattattcaaccaaaagagtaaagtattattcgaccaaaagagcaaaatattattattcaaccaacaaagagaatatgcttctgaaaaatgggaatgcgattctaatatttcaagaaaaatctcaaagatcatgatacgatcacatcataccagtgatacagaagctcataagaatgaacccagaaggttatttgttacctgtgaaaccaaatcttgtatttttctcttcccaagaagttgattagttacttctgctccttgacttgcacttccaccagtcatagttccacctgataaaggagtgcccggttgtgatcctgtcaggttcatggacttctgggaaccagatgctgatatccttggagattgttgttgttgctgaagttgctgtagaatgtgttgctgctgtaaaagctgggtattgagatgaggatgctgttgttgggtttgtgcgatttggtgttgattcaatcctgactgctgttgaagttgatgtattaatagcatcctttgttgatgctgaaattgttgtggagaaacaggtgatcccagcgatgattgcatttgttttaaccatgctgcctgctgctgtttctgaggaagggacatttgtgccatcggcccatttgtcgacgatccaggtagctgtggatttaatgcagcaatcgatgctgttcttgtcaagccttgacccacaaccttctgataaataaaccaagatagaagttatccgcataaacatgagaggtgctagaaaaattgatgcacgcaactgtcacaagttaaaaatagaatatccatggtgcaaagttaataagcatagttctgattaatcctaaaagaaaaagggaaaaggacacacaaatgcttaactctcatgcagttttagtgggtaaaagcataattttagtaactgtgtgtaaagatacatcagaaagctgccaagagattaatattagcttctttgatcagtacctgttaatatatgttctttaaaaaggaccttggctatttgctgcggcatgcattcacatataataacaataaggccatgaaagatacatatggtaaggtaaggactaaggaggtgggtgcttgataaccaaagataattcttttgcttacggaagtcaagtacctgtggagacagtgtgccttgctgtgatgtctgctgcggcctcaattgtgcttgtgcatgggcaaaacgttgctgattatatggaatagttccatttcctctcataccacccatgactcccatggactgcataccttgtaatgcttgagctgcattggcagtattaaattgtgcaccttgcaccatacccttctgccttggctgcagcaacaagaaaaaccaattatgctagtaatacaatcagatggtgatagttactagttaccttcaactgaattattttccccaataataataatttcttaacataggcaaaactagtacgaatcactcctcttaatgtggtttccaataaaaaaaagcagagggtgtttcattaagcaattctaaatataatacagatattcgaacaattgtggttgcgcctgcaaagattccaacaacagaaggcttcttatcagagcttatatttgattctaaaagaaatcacaaatattttaccaatggaacatagtacgagaaatgtagatttctagtttttctttcttgtggtatgcaccatcacacccaaggagttatctccactacttaaataccatgatgctacaagaaaaaaaagtcaaaactgtttaagaaatttcaagattctggatccacgattcatttccttttgattcacaatcaactggtaaatgcaaagtttcagccggacctggcattctgatcaaattgatctaattttgtgtgcgtaccctcctaaaaatattcagcatagatatttgagtcaccaattcactaagccatgttacaaaactgttaccatatacgatacgctaccctgttaagctgatagaaaaactctaaccacaagtaaacaagtctacaattaaaagagtctgtgtttcccacttccgttaaaagtggaattcatgatgattagatgcaaaattcagctaactcaaagcgtgcctgagaccccaaatttacctgcgccatcatctgtgactggagaccatagtgcgccgcagatgctgcgttcccctgcccttgcagcatcccaatctggccttgactaagcatggccgcgcgagcagccagctgctgctgctgctgctgctgttgtcccacctgtcctccacctcccgagaagttcacctgactgccgtacatcctggccgcagcagcagcgtactgtggaagctggccgacagcggcgaggcgggagcccgagcccgagcggtggatctggccgaagcctccagccccggccgccgcctggccgggcgaaggagcctgcatctgcggcggccgcggggggtagtccatggccccgccgcccgccgcggacgggtcgagctgcggggacgagatggcggacaggtcggagacggtgggcgacggtgggatttggggggagaggagggggttagggttggggttttgcggggtggagacggcggcggcggcgagctgatcgggctgcggcgaggcggtggcggccgcggacggcggatccgccatggcgggctgggggcggcggggctccggcggcggtgggcggcggccggagacgacgcggggtggacgattgcgtcggggggtgcgggggcaggtacgggtcctgtggggtagtttgacgtgtgcgcgtagtcttttcgtggttgagtcaggaggggggtggttgctgtctttagggtcactgccaggttggccccacgggatcatttagcggataagaagaatccgctcagagtttgcttctcgttgccatcactatgcttgcttgtactctcctgggttgatctaggaacatgttcgaggcatttgaggtgtaacaatcatattcaggttccctgcaaaaaaaaaaaaaacaatcatattcaggtgcagtgaccgtcgaaaaaataagcccagacgcaggagaaaccaatgctgtctgggcgattggagactaaattaacaagagacggtaatcactcgccgttacacgtgcctgctggccgctgccaacgagcaaagcacggcacgctcgcatggccgtgtctcagcagcttacctcctggagaccggcagtctcgccttcgatttctctttgatcctttccgtgacccgaccggctccgagtcgacgcgctccgcccagctagcgcttgccgtctttcttgctctttgccgaggcagcgacgcccgctcgccgaaactctcgcggctcgcgctgacatcaacagcagcggggggcaacgcgcatgcgcgattgcgcgtggccgtgggagacaagccaaacaccgcccggctccgactcgacggggcaaccgtctcgctcgcgcgcgcgcgcgtcttggcgttcgcagtcgccgcgcgcttatcctatgggtcgcgaggagccgaaatatttcgcgttccagtggctgcgagtctgcaacctgcgactacgcctttctccattccactcccgctggccaaactcgtccgcacatacgccaacagagaacacccttctgcctacgaattacccgcgcccgcacgcgggatatctctctatgctttccgcggtcagttcttgctgctatacacctatattcctacgctgctgtcaagttcaaaagcacatgatcagtttcagactttcagttccagtggacgaatggcacctaggcacgcagacgcagagaagaaacgtccattcctgtgctgatcaacagggttaggctgcgggagtgtgtggggtatctacatagcgctgatcgatcaggttgattgctttatattttccagtggattagtgcaataatactacagtgaacgaagctgaaagtttcaacgggacaacggcgtaccggcattgtcaagatcaaggtttaaaaacgctgtcttatttctcctcccgtagcaggtacgctagattatagcatcatcaacttcaagagctgaaaaggtcatccacaggtttgcatcctgatatgattgccgtccaatcgggaacgcgccttgtaagactggctaacccctcattccctccaagtcttcatggattacactggattaattatccaaaaattaatccgttggctgaagagaaaaaccacggggctagctgccggtatatgatacatccacgtcagagtaaagccgatcaagattgccatttcaacctaatacagttaactagtagtatttgggattccgatcgatcttgtttcaacgtcattttgctgcgtctgttacagtagctcgtgtcactttctcggcaactttacctgctctttttatagcccccatcagttcaagcctcactcatcctaatccagcatcagtcccagctcgatctccctacaactcgcaaggaaaatcctctgaatctctcccatggaaggcatcatcccgttcatcttcaaggcggtagcgcagtacaaggagggagggcacgtatccctcagcgacatgatctccgacaggccgtcgccggcgtcgtacgtgctcctgccgggggactctgacggccgacacgccgatgacaagacccagccacttcgtcttcaggcttccaccggctccgaggaggaggtcaccacctgcaccgcccgggcgtcgcacctccggtgctccacgctgcgccggcgagcttaggatgccgtgaactgctacgccgatcaaactgcaggtgccagtcgttcagacaatttgaggtttgtggtgctgtgcttgtgcagtgcagacagtgagagatgtaaggagcctagtactttagctagtttgggcttttcagcctatagcatctataagcgacctttactttttttttttagctgtttatgctctgtaacgaggtgcaggtctccaaagggaagatttgtgcgtcgaagggcgaaacgctttgtatcttgagaaaaacgaatttgtaaaacaatactgtgcgtgtaactgtataaatttggtgataggttctgtatgcagagaggtacgcatatgcaagtgctatctcggtcactgtgattgatttgcctctgaagaaaaaattctcctgttacctgatgcaggactgccgtttgtttgggttgggctttgctgggcgtaattagacagtggaaaaagtacactaaaagtcctttgtcttgtcgttgaattacaaaatcgtcgctcaaccgaaaaaccaaactatgtaatatctctcaacttaaaaaaggaattactttagatccttagatggttttgaccccgattttatccaacgtagcagttgaatcaacatgggactcacatgggccccacatgtcagcgactatttcccctcctctctttctcttcatatttccctctctactctttctcctcgacacgaagcatttgactaagatggaggagatgacccctccgccgaggagtatcttcaggagcacgtcaactatgaagatttttagggttccgagcctagttccaaaaccgtgcctatgaaataagttagtcgcttaggcgcttagcctagcgcttagtcgttaagtcgccttccgccgttagctcccgctatgttgttttcgcgttatgttgctgtcttttgtgttccaaagttgtctatatgggatctgtccacgatggcaacctatgtaaggactaccctagtgatgtaataatattagactgttttggatcaccgatgttccgtgtgtatcagcttgtgtatcctgggactggtacatgttacacaagtacagtatcgtggcctccggacttgcgaggttcggggcactatagttgccagtgttgcagagacggtgcgcggcagctgttggcaagtgccactgccacctttccactgcccacccgccattgcagcctttccgctaatgagctggcatgggcggctgtggcgtcaccgatgcggcgggaaggagggccagcgcgacatgggaggaatgcggcggagaggagggccagcgcgacagacggcggccggcaaacgagagcagggcggtggcgtcaacgatgtagcaggaaggaggggctgatagagagaagttgggcattggcagcggtggtgtcactgacacggcagggaggagggccggcgagcaggcgcagctggtggctggcgggggaagagcgcggtggtggctcccagccgaccgactctcgagctcctgattcacgggctcagcgacgccgccgccgcagagctcatctacgccggcagccactcttccccaatgccgcgctgtcgccgcacagccttcgagcttcctccactctctctctctctctccactgtcaccgccgccagcattcttgggagccacccgccgccgaccgcactcgaatctccagtgccaccgcatcttgggccacctccgtcgccgtcgaggtcgcccatagccattggagtcgtgcgccctcctctggccttcctccctgtgcgcaggaaagagaggaagaagagagaaagagggatctaacatgcgggtcctaccttttattattttattatttccccagaaactgccacgtaagccccacgtcaatctcacgtgggatgaagaactagtaaaagaagctacgtaggtgtcacgtcaatcaaaactggggacaataccaccggaggacctcatttgcactgtttttgtaagttgatggatgagttgtaactgggtttttttttagggacgatttataattcggttacaagacgagggatctccggtgtactttttccttagacagccagtagcttttccaagattctgttttttcaggcccagttcatctggccacagagaggcccatcatcacgtaacgaaatgtaacccgactaggccttatggcccaaaaagtcgtaagaacggctaagccttatccaaaattccgaagcttatcacgaaacggacaataaggtatacaccctaatcccaaaaaccattgaactcaaaaggggaataaaatatcgactgggaggttttttctgacggttgtatcacaggatcacacagtattactagtgtattactgcagcgttttcagatcataaacagattctggcggcaccatacacgagaatacgagattaagtaatcacaagatcagcttggaagcaaggaagaaaaagaaaagagcaccgacacggcatttctctcgcatgcgcgtttgcgtatcagtgagtgcgcatttgggtcccgtcactcgcaaccaaagaaagattagtcgaagcaaggtgcagatatcttggataccggagagccggttgaccctagaaagaggagccaagatcatcagatctgccgggtttccggacgcatcaggattagcacatggaatatcctatgttatgcgtgattacaatgggcagcgcaatgcctcgccttggttggttgcctgcatctacagtctggacagatgacagtccgaagcggcttcattgtgacaaaaaagaagaagcaatctttggtttcttggatcagggaaagtggaaagcataaactggaacagaaggccaggcggaaataaactggacaagaagaaaaggcgtatgtaacgtactaacgtgcatgtttttttcctcattcaaagatttcccctcgacttctcattcaaacaaagcaaacatagcgttttctaaaatttatttattttaataatattctcccatgattagaaggggattaaaagaaaatctcttccgttgacagaaaccacatctctactgtagttatctgaattctgaaagcctgaacctctcgtcgtgtctcgtactctcgttcccctcccctcgcgtcgcctctccacttcgtctctataaagtcccacccaattctcgattcccaatccagcgcagcacaaagccctcctccttccaccgcagctgcgctacctacctccaagagggctggtccgctggtcgtggagaaggaagagagatcttccaggctgatccctcctattggtacggaagccctaaactcatcggagctttgccgcggccgcgagcgatcaaatcgaaatctttctttctttgttctttgatgctccaacctagtgtcggatttgattttgactgttgcaatggcagctttctccttcccgagcccgcttgaggatccccgccggagtagggattagggaggggagaacaggaggcggcgattcaccatgaaggcgctcattcttgttggaggcttcggcactcgccttcggcctttgacgctcagtttcccaaagcctcttgttgatttcgcgaacaagcccatgattctgcatcaggtaataagtggtttcgctagtactctgatggagtaataagagtacttatttgcagtgccaatggatgaattgggcacaagttaattatagtacagtattctttaccaacagtccaacaatggcactggcctctccatgaaaggagggagagggtgctaaactggtcagagaacattaatactatttgatttgtttattactcccacataaacatggtgtaacaactaaaaatccatggtaggttgcacttggatgtgattgaatgcacctttttactattcaattgtttctttccttagttatcaatttggttacatgattttggaaaactcttttggtatcacaccaaattttctctgtcctcgaaaattccaatcggttatcaagagtacttgatttatatccaaaatgttggctccagcaaacatgagcatgaggattgaggagagtaatgagctctgaattaaaagttttccgatttatgcagattgaggccttgaaagaagttggagtaacagaagttgttttagccatcaactaccgaccggaggtaaaaaggagataatcttttactgttgtctcatggtataagtataactaacttcacattctaattggtttgctctgatccgtcttttaggtaatgctcaatttcctgaaggactttgaggataagcttggcatcacaatcacgtgttcccaagagactgagcccttgggaactgctggccctcttgctctagcaagggacaagcttgtggatggatctggtgagccattctttgtcctcaacagtgacgtcataagtgaatacccttttgctgagctcataaaatttcacaagagccatggtggtgaggcaacgattatggtcaccaaggtagatcctttctttgaccactctcttgaattgtaaacttgtgtactgtgtatactgactattatttcaatataggtggacgaaccatcaaaatatggtgttgtggttatggaggaggtcactggaatggtggaaaaatttgttgagaaaccaaaaatatttgtaggcaacaagatcaatgcgggaatttacttgttgaatccatctgtcctggaccgcatcgagctgaagccaacttcaattgagaaagaggtctttcctcgaattgcatctgatgcaaagctctttgctctggtccttccaggtttttggatggatgttggccaaccaagggattacattacaggcttgcgcctttatctggattcacttaggaagagatcaaccaacaggttagccactggagcacacattgttgggaatgtgctagttcacgagagtgccaagattggcgaaggctgtctgattggtcctgatgttgctatcggtcctggatgcgtcgtggaggatggtgtgaggctttcccgttgcacggtgatgcgtggcgtgcacattaagaagcatgcttgcatatcaaacagcattattggatggcactcaactgttggacaatgggcacggatagaaaatatgactatcctgggagaggacgtacatgtaggtgatgaggtctataccaacggcggtgttgttctcccgcacaaagagatcaagtcaagcatcctgaagcctgagattgtcatgtgaactaaccctccttttatgttatggtatactcaagttcttttaatgcagtatctttagtttatacctgtgatccttccaagatgttgacctagcatgtgtgttactcacattctgaaaactgcttctcaatgagaattcagtgtgccatatttgattgtaccttcatttggaccatccagtaaagttctcaaccctgcaccaagaggaccagaagaaactctttttcctataaaagaagaggatcagccttgtactttgttctttttgaaacaaatatatactgctatatggaacagacccatgatgtattgcacaatttgtagcaaatgatgcaaagtggataataataaggatcaggcagatccatataaactataggccaattatttgtacaagctcatcgcaaaaactagaaaaagaaaaaataaaagtagaactactggtatgtaagtatgaaacggcaatttgctcatgctgctgtgctgagcttcgcagttgcggttgtgatttgtggtggtgatttcgatctgtactggcaattcaagccttgtcattttctgtataccgatgagtgatggtttatggatctgaagttcttcagtatctcaatcaataaaccaaatgagctagtggagcaactgaagccaacgagatgagaaaccatcctaggccatgcttcttgttcttccatcagcctcagtcttgcaagccattgtgaggacgagagtgttccatattattttctactccacaaaatagctccctgaaatgggtagccatatacatatggccaagagaaacgttggaagcgaatatgcatcggaccttttcttggttgggacaagacacaagtacctaccatgttgtcctctcaaaaagaaagaaaaaaaactatcatgtgttgcaataagggctgggatgactcaaaatcatgtggactggaggcttagtgaattaaaaaccacgtcactctcggatacagtccttgtcgttgggtcatttagatagaacatgtttcatctcaatgcgcctatctgatgacattacaagtttacccgtccttaattcagttaaccattgtttcggtagagaaaatttcgtttgtttggtgaaaattatgcagtaaaaagcttcatctgtatcgtttagtaattaatgtagaagtacaagtttaagaggttatagtgcctcattgcattaaattcagagaggggttggaaacaatcgacgataactttgcaccaatggaaacaaaaaaaaacaaacccaaaagaaaaatgacgatgagaaggaaacgtgcttgagcatatggaacataaattttctgcagatgttccattcaattagtttctcggaaacagagttcatggagcttgtatgacatttcagaacttctgttgtgttgtcgtcttcaaaaattagttcgtatacagagaagggatcaaacagaggggagctacagacagaggttgtacaaatttattcacaatgaagcgaggagccaaaacattacgagagcagatgtggcactaaacgcccaagaaagaaaagcacatgctatggctagttcaaatcttccacaagggagttggggattcctgcaagcgtatatgtccctatcgaagagaacaactacacctgctgctgagcatgatgccgcgaacgacaggattgctgttacctgcatcatgtacaactgttgctttagtacatcagaaaacacactttaaatgtttagatatggcacaaaatgttttatgttctttatgccccaaattcaaattgtgcggtaagatggattggaaactgtatagtaatgcgaacgattcgcaagtcatggaaatatttatgtgcttaagctaagattttcgcatgaaattgcccatttcctgtaggaatagcgaaacctcttgtgtttgaaactttattttccagtttgttaactaaccatcccaatttattgatgttccagtcctcacataattggcagtccaaattgcatacatttatttgatttagttggtaagtggagaactaggacaagtcaagagttggtctcgccccacctggatcctaattctacctacaatcagaatgtactaaatgaaaattatgacaaattcgatctcaacaacatccagctaatattaatatttgataccatgtagctcaagctttactagcctgcatcatgcgaacggaagtcgattaattctgttgcctgtctcttaacatgtgatgcaattacaaatcctaaaacagaatgatccaggaatgctaaatgtggttcaaaatactgcagaatatggttttgatgtgctaaagcaaatcatttctaagtggatatttttataatgagttctatctgagtataatacttatgctttgacaggcctggcagagaaattttcagaaatttaaatttttacttgatttgtttctaaatatttatccatttcaatggttgtgggaactactgaggtgaataatacatgagatgaaaaaaaatcattaataattacccagtcgccaacaacaaataagctcaggagaacagcactgtggagatctttcttgaatttcaaggcatagcaatcaaggcaagcaagtcccaagctccagagtgcctgtagtcccatcgatgcaatcaagtaactgaaattgagagttcaccaaaaactggttacttaacaggatactattcaatctgcaagttctgtcatagtgcagatcaaatggttttgctttgatggatgcatagacgaatgttcacatatgcaaacgactgccagattccttccacaaaatgaacacaccaatcttaacagcacagacaacactgagacttcctatgtcactcatcaaattaaatagagtaataaataggacaaacaaacaaagaacagattatcatgaatgattggcatgcctaccctacttaaacaatgaatgttggatatgagtaaagttgctcaatgttccagcaacataaaaattttaaatttcattatattgactacctttggtctctcctagtgcttcaaacatttagataacggaataacaacatccccggctgctgcacccgaagatgaacaaagccattctactgcttgaaacagatgcctcagtcactgaatagttttaactgattgtcaattttgaaggagtgtctattcaaatcttacagctatcagtggctacaaacttagaccaaaagcctaaggccaacttatattcaaagcaacagtgacaatatatttactttgatgatccaaattgcacaaacttgaattacgaaatgaatcgttctgtcaatgaaattgtgaataatataatgcacaaaggaaacctcattgccacaaaacttccatccccaattacagtagcagacggctccaggaagcaagcagtcggatatagaataaagccacaacaatgattatccagcaacaaagctgcatatcaatcagcaaattgcagggcggcgtgacatgccggccaaattttaataagctactctatcaatcagcaaattggccgactcaatcatgattgttcaagcgtgtatgatactatgatgcctatgatccgcactaaatcactctgcccaagcacgcgaaacgccgtcaccagagcatccccaatcgatttgcaaacgcataaggcacgcagcgagggttgctcgtagcaatcgagcgacagactactcgtctactcgtacgggatgacgtcgagacaagggtggggagaagagggggcgggacggcacgcaccagaaggcggtgtatgcggcgaagccgagggcggaggccgtggcgcagacggacgcggcggcgaagacgagctgccccacccgcagcgagaggccgctccacgtcccggggctgccggcgagctccctcatctcgatcgccctcctccgcttccgacccgcgccgcgcgccgcgcgggcgccctctcagacgccgccccggcgaccggcggccatgcggcgaaagttggtgggcggtttccgtgctgggagttgaactggcgtttcggtttttcaaagaagcgttgggggcgatgggtggacggcgaaaggtggcgcgcgctctctgacgagagaatttttggtggaattggtgcgcggtgacgacgccgggttggggttggggtcgcgttgcgcggcgtcgggtgcggtggggcaagccaggacgcggtcgcttgcgtgcgtttgcttgcaaagacggcgaaaattggtgggctttggtgttggtgggcactgcacacagaaatttgtgattattgattaaggccaagttttttttctcaactccaaattttaactttctctttttttttcattagcatgatttttaagcggtacgtttttttaagataataatagaagttgtttgaaaaattcaaataaactatttttaaaattttaattgttaatgcttaattaatcatatgttaatgaggtttctcgttttaggtgtattaaaaatatgccttcaaaattgacgatcgatcgcagcgagtcgtgcttctatgcttctaaagaaaagaacgcacgaaaattgaagtgcataaatggctcggattaaaagttactccagtttacatgacaaacatcattagagaggggcattttcgtccatggaaaattttttcgcgaacacaaatgagaccaatctagaaaggactagattgattttgaattaagaagggggtgaggctcaaacccggaccggctagctcgcagcttgtgttgctagtcgggaagaccccggacctttctccatgggaaaattcagtccatctccagccatgcccgtcctggcgccgggagctcgcgctgctcgaggcgacgcgagcggcggtgggagctcgaggcgaggcgaggcggcagtggcggcgaaggaggaggcgagcgcggcgggcgacgccatgcgcgacaaccagccccagcccgcggccgcgcccgcgatgaagcggaggaacagatgggaccaatcgcgtcgcttgtcgtcgtcgctcgcgccgcgcgccgtcgccatctcccctcgagccctgcccgtgccgcgcgccgtcgttcgtcgcccgtcgccgtcgtcgcctcgagcctcgttcgcgcgccgtcaccccgcgccgccgcctcgcctcacctcgagcagcgcgaactcccgctgccgctcgcctcctccactgccttgccccgccgccctaccacctagtcctcgcgcgccgccgaccaccgcgcgcccacgacgaggaggagcccgcggtggcggtggtgtcccaccacgtgtccccatgcgcccacgatgaggaggcacccgccgcgtgtccccgcgcgcccggtcagcctccgcctctgtcgccactcccctccgtcgcctctgccgcctccgcctccgcgtcgacattcgagccgtcctcgctaaccatcctcgctgtgcacgctgcatgagccgcgagagagaaaagagcaagagagagaatagaaagagagaggaagaagagtatggcaggcgggtctcacaattttttattaaaaaaacgctgactggattgtcacgtgtgcgccacgttggacaaaaccgctctgaattggtttgagggggataattcgcccggtttgcatagttaggggtgaagaatatccatttttttggtttaggggtaattcggatgactgcaaaagtttaggaaggtaattcgtgctttttttccctacaaactatgccccgtccactcgacacaacctgccaccataacggtgaacctgaagcctcccgtagtctcgtggccgcgccggactgccgggacaacctagccgagcgctcccgctggccgctgcctacagtaaagcagcgcgctgcgcccgcctcgccgccgcctccgcagggtccccgtgccttctcgcaccggcggcaccgctcgatctctgcgtgacggcgtgtgaggctgtggggtggtagtaggggcgggcggagatggcgaagcatttcgtgctcaacaccggcgccaagatcccctcggtggggctcggcacctggcagtccgacccgggcgtcgtcggcgacgccgtctacgccgctgtcaaggtcccccactcgcggcgtctcctcctctcctcttcatcacctttttcgtttcgtttttttttctctctctactttgtgatggatgatgatggcaaaccgatataaggttgttttcggattgtgcaggcggggtaccggcacatcgattgcgccagaatgtacaaaaatgaaaatgaggtaacttggttggtccaaaactttgaatcattcccgcattactggggtatcactgcagaattctgtaggcatggtcctcctagttctcgtctatgtttttgtttgaaacgattcgtgtatcaattttgcattaacagcattagtgaaaacagatcagcggcacaaaacagatgatttccgttcttgattcaattgggcaacctactgttatggaaacttgtatgatattcctccattttatatggactgatagtgaactactcgtttagataataagttgatgatcttccaccttctcaaaaaaagaaaaaagaaaaaaagtttacatagtaaaagacaaatctgcactactcagggccatgcgctggcaatcagaactcaaaactagcacttacctgtctttcttactactatatgctttacactagaccccaattttatcttgtttcaagacgagtaataattaataaacgcattttgggttttcaggtggggatagctctgaagaagctatttgaagaaggtgttgtcaagcgtgaagatttatttatcacatctaagctatggtaaccttttgcgtgattgtcctgtaaatatgtcttgtctttgcagttgaattggattacctagtgcctgcttgagcttttacttaaactgattggtgctgatgggtatgtttgtcaggtgtgattgtcatgccccagaggatgtgcctgagtcactagacaaaactctgagtgacttacagcttgagtacctggatctttaccttgtatttatcttattttcttaagaatttggatcaatacgtgacttgctagattctgtactttccatcgtcaaagtcttgctttggaaccattggcatcaatctatacaactatctctacatgctgcagaataagcctcctgatcagtcgatgcacattgataaactgttacattatccagcaaaatttctgcgagcttttatggattagccctgagacatccaatcataatcatcatgtgctagactgtagtccattgcacgagaacttccttttatcattcattgggtctgtaggaagatattcctttagtcctgccacgcaaccacaataaataaattaatatagaattatgttgttcatatcagttcaccttctttccttgaattatggtggatttttttttcatcctaaggtttcttctgggatcattacatatacctatatggttaatgactttgataaccttgacaatattattcagacaaatttgcaatagtaacataatatattgaacttgaataagtcttttctccacataaatgggaggatacctatggttaacctttgacttaataggttccttgttaaaatagtttcagcatgttgttacactaataataaaaaattctgatcaccattacgtttatgcagattcattggccattcagagtcaagaagggctcaggcattagtaacactgaagactacataccacctgacatcccatctacctggggagcaatggagaagctatatgattctggtaaatctcgtgccattggtgtaagtaacttctcatcaaaaaaactgggtgacctgcttgctgtagcctgtgtacctccagctgttgatcaggtagaatgccatcctggttggcagcaaacgaagctacataacttctgccagtcaactggcgttcatctttctgtaagtctgtggtacttatataattactctgagtcaatgctcttgttaatgagtcccgtggtttttaattttctgaatactgctaatccttttcttcctcttctttttaggcatactcgcctctaggttcacctggttcaacatggatgaacagtaacgtccttaaggaatccgtcatcatctcaattgcagagaagctcggcaaaactcctgcacaagtggcactgcactggaacattcagatgggtcacagtgtactcccaaaaagtgtgaccgaagaaaggataaagcagaacatagatgtttatgactggtctattccagaggacttgcttgttaagttctctgagattaagcaggttagttcaacatcctttgatcacctatatttaattgtcaatgttttcaaacatctctacagactttttcttaacaaccagtgtctgcatatgatttggacaaacttacattgatacctgctaacaattggtagaaggctatatagaggaaattaaagttgcaaaggtcatccataaaatgtttctaacttccatatggcgacctttacttttggaaaataaatcatttgcgaatactctcaaagaaatttgttttccttgaagcatgctacatttggcggtaattaagtaaatgaagcggtatactgtatgtagcttctactccctccgtcccaaaatataagggattttggacggttgggacactttctagtacaatgaatctggacatgagtgtccagattcattgtactagaaagtggattttgg

SEQ ID NO: 71385 - DNA, 792 bp, Oryza sativa
gagttaaccaccatatgcatgagctgacagatcgactataaggatctgtacagtaagcagttggttgtattattagccttgctctaagagcaagtataatagtatagtcaattattggctttaaatcatctataatcaatttaatagccaatttatacaatagttacatatacacatatactacataattaacctttggtatcacctgtcatacacacatgtatcttgagttcatgttgcagctggctacagatctgtagcccgctattcttacatcttttcttttatcgttttaaaatatatttatagttggcttatagtctgctattgtaccaaactataagagcacccatcagtgtcagagtttagctgaagttgctcaggcgctgagcccaggaaaacggtatataaaattgtgattcgaagaggccagctgattgactctacactcgggttgcggtagctgcggcaattgaccatggaagccgccgtggtgagctcgaccgagggcgtggtgcgcatcctcctggccaagctcggcgaattcctctccgacaagtacgtcctcctcagcggcgtccgccacgagatccaggagctcaaggacgacctcgagagcatgaacgcctgcctccgcgacctcgccgccgtcggcgactaccaccagtcccagcaggtcagcccctcgccgtggcgtcgcgccttgttttttctttttcgcgaacgctaaaaagtattgcacgtcaacatattagaaaaagaaaagagtttttttatacaacgcaattggtt

SEQ ID NO: 71386 - DNA, 6667 bp, Oryza sativa
ctgcgcggcagtggtggcgcgcggcgcgaggtggcgatggaacgcacgcgcggccctaggcgggacgcgacggcgacggcgcggcagcggcgatgagatggcgacgggacaggcggcgatggcgacggtggcgcggcggcaggcgatgatggcgacggcgcgcggcggctcggggcgcgaggcggcgacgcgtggtgacgttgccgagagagagagagggggaaagaggagctgggttaggggaccacgtcgaacacctggcggccgatgaatagtgacttttcctatttgtcccgattttagtgtattttccatataaattttattccacaattcctaattttgcatatatgcattttactcaatatttgtgttatcttaactaatgaattcaccctagattaatattactcatattttatttttatataatttatttgagttttaattagggttaattcttattccatcgtatttaaatttaattgatccaaatatggtcgcgataatattttatttatttctatccacacctaatctttattttaatttgtatttattttaccaatttgtttttaaggtttattcctaattaactattctttactcacgattaataatcttcgagatcaaatccagataaaatagacgaataagatccgcatgatgcaattaatttaaaaagtttttgaaaatccgtatttttagagttttgattttgtcggtcgaattttcagggtgttacaaacctacccccttaaataaatctcgtcccgagatttcttaccagttttcgaatagatgcgggtactccgtcctcaagaattcttcgctttcccaggtggcttcatcctcagtgtgattactccattgtaccttgtacatacgccacactttgctcctagtcctcttttctacttcatccaatatccggatcgggtgttctggatacgtgagatcgttgctaatgtgaatctcttccagcggagcttgttcttccggcactggtaagcatttctttaattgggacacatggaagactgggtgcacatcagcgatattctctggtagctgtaactgatatgcgacttctcctcttctagccgtgatttgaaagggtcccccatatcttggtgctagttttcccttaaccttaaacctttttgttcccctcatcggagaaactttgagatacacgtaatctctttttttaaattctagatcccttcttcgggtgtcagcgtaactcttctgccgtgattgtgtcacttttagacggtctcgaattaggcgaaccttctcttcggcctcgttgatgatgtcaggtccaaataccgcccgttcacctgtctcagaccacatcagcggcgtccggcatcgtcgaccaagcaatgcttcattgggggacatcttcaggcttgcttgaaagctgttgttgtaggagaactcggcctagggcaaacacttctcccagtctttactaaaatccaacgcacaagctctcagcatgtcttctaggacctggttggttctctccgtctggccatctgtctgtggatgataagctgtgctaaaagcaagataacttcctagggcttcatgcactttttcccagaaatgcgaggtaaactgtgtgcctcgatcggatataatcctcttaggtataccatgaagacacactatcctagtcatgtacaactcggcaagtttagcactgctatagtttgtcttgacggggatgaatcttgccgtcttggtgagtcgatccacaatcacctagatggaatcgtaccctgttgcagtcttgggcaatccaacaatgaaatccatacctatctcatcccatttccattcggaaatcctgagaggttgcaacaaacctgccggcctctggtgctcagccttcaccttctggcatatgtcgcagagtgctacgtattcggccacatctctcttcatgttgggccaccagtagccttccttcagatcctggtacattttggtacttccggggtgtaatgagtatgccgatttgtgagcctcctttaggattaatccttgcagtcctccttgttcgggtacatacaaacttcttctcctttttgagtagttgtgtcattggccgggctatctttgagaacccctcgataaacgttcggtagtatccggccaagcctagaaaactccgaatttcggtcaccgacttgggtgccttccattccgtaacagcctccacttttgcagggtccactgctactccactggctgagattacgtgacccagaaaagcgacttccttcaaccgaaattcgcacttgctgaattttgcgtataacttgtgctttcggagtttctggagaaccaatcgtaagtgttccgcatgttcttcctcatctttggagtagatcagaatgtcatcgatgaataccaccacaaacttatccaagtaatccatgaatactttgttcataagattcatgaagtatgctggggcattggttagaccaaatgacattactgtgaattcatacaacccatagcgtgttgaaaacgcggttttggggatatcctcggtcctaatcttcagttggtggtatcctgatcgaaggtttatctttgaaaacaccttagctcccttaagttggtcgaagagatcatcaatccttggtagtgggtacttgttcttaatagttacttctttcagtgatcgatagtctacacacattctcatgctaccgtctttcttcttaacaaatagcactggggctccccaaggtgacgaactggggcgtacaaatcccttttcttgcaactccctaatttgctttttaagttcttttaactcattgactggcatccgatatggtctcttggatatgggggcagttgcgggtatcaggtcaataatgaactctatgtcacgatctggtggcattccaggtaaatcttctgggaacacatcaggaaatcgctgcactacgggcattccctttaggggtagcatggtaaatatacctccggcacgttcggttagcctaggattttgatccatggttgctctcatatccgatccccagggtgtgatcagggtaacttctctacgtctacagtcaattactcctctatgctttgctaaccaatccatacccaatatgacatcaagggtctgtggtatcaaaaccataaggttggagggaaacaccacatccctaaggcgaataggtacatcaatgcaagctgtgtccacggctatttcacccccaggtgaatgtactaacattggttgccttagtttaactctggttaaattgtgttgttgacttgctttcagagatataaatgaatgcgatgctcctgaatcgaagagaactttaactggagtgaagttgagtgaaaacatacccatcagcacgccttggtcttcctgggcctcttcagctcgaacgtggttcacttgcccgcgtccaaatccggtagcggtcctgttagtctgcggagtcctgaatagacctcgtccagcagcaggagtagcagtcccatgaatagccgttgcattagctccggtgcgaatgggtgtcttgtttggatgaggacatttattggcgaaatgcccatactctccacagttgaaacagcttcctggccttactgatccagtggcggcctgattcggtgcaggagctcggttttgaatggtaaccggcctgtggaaattgctggaggtggcaggtcgactggttgtcaccactgttggtctccatgccgaagaggttgcccctttaggacgctggggtgcggtctggggcgggcggttcatggcaagcctccttttacgattgtgctccacgaccttccggtcgttttctagtctaacgaccttattgattaaactctagaaactatcgtggtcttgtccaatcatgggcccgcgcaactcgtcatttaagccttcaatgaatttgtcgatcttttcctcctcgtcggcaagatctctagtcgcgtagcgcgccagctgagtgaaacagttcaggtactcttgtactgtggtattcccttgccgtagtctcctgaactcattcttcttcatccgcatcaccgcggcaggcacgaagttgtcacggaagtctgtggtaaattcctcccagtttggttctccagcatcttcttctcgggcttccttgtatgtgtcccaccagtctccgactggtccttccaattggtttgccgcaaagatcactttatcggcctcacgtactcgaacaagagttagcttcttctcaatgatccttaaccaatctttagcatccattggttcttcagctctggcgaatgtgggtggcttggtcctcataaactctccaaagcttgatccgccacggttgccttggttatttgcaatggcttgcaggagttgggtttgggtggccataactccggccagggtggttaggtcaggtgtctgggtttcgtcattgctggttgttgcccgacgtcggcttgccatctgtgcaggttgattgattgagtaagtatcctaattctctagctattttttacggctttatcccattaggggagattgttttgatgtgaactttattttgcaagcatggtggaataaactcatttataacacaaccacaatagatatcataaataacatcacagagtttcacaaatagtacataaatcatgatgcaatcgactgcatacatacgcagtccagttaaggtttgtccaaaagatacaacgaactaatcatcaaactactcgtcaatctaggtaaaggggggggtgtctcgcatgctatccaaaaaccatctgatacgagatcgaagctgcaaggagtccgtcagtctagtcctccagccatccgtaggatcctggggcaggtagagggtggtcgctggcacgcgcaaacctaagtccccacggctcagaagtagtggcctctggatctggcttgggcctcttgcccggaggtcgtgtgctcttgcgagcagtgctgagggtgcgagggcctccgaggaaggtgatgcggggaacaggggtctcatcctctaaaggatcagtgatgtctggctcgatctttggctcggtgtcggtcccctctgtctcggagtcgacctggatcggagtctccaaactggaacccagctgcggagaaggtgtagggatcagtggagtgtgcaccatctccgggacaggtggctgtgtcgctgtcgggtccactaggtaaggtgctgactcggtagctagcatactagcctctcccagaagaacgtggaacgccggtgggtatggcagggtgaggaataagtagcggtcacgacctactgctgtggaagtagaagcccctgtggtgctgatcttggctgctcgaagctgctcctccagctggctgacgtgctcctgactctctctcagctgctcctcaagagtatccatcatcccgcggcgatcgttgtactggtcagataactgctggaactggtcgccgtggacctggagctgtgccttcagtgagtctatctcactgccccaagcctggtgctcctcctccaattgaagctgctgcactgagaggtcagtcaactcagtctccagctctcccatacgtctctggtggtcgtcaatctccaacagagcctcctcgtagtagtcatctactgcctcagcccatcgtgacaaccgagtcaccatcgggttgtagcagcagggcgtgtcctgaactgtgcaaactgagttgctctcctcccggaacgggtgatgagcaaactcggtactcgctaactcagctcggtggatagagctgagtcggaggaaggcctctcgggctgcatcctgcattgcggtttctggcaggtctcggtggtgacgtgtcagaaagctgtagtccaactcggaagggactcgggggtgaacctcgacccaagcctcccaaactgagccacactgtctcactcggtatgacgggaacccagagtatcgcagacgcctcaacatccgatgcagctcaatgacatacccctctgattgaggtaagctcaactcccaggtagcgggtgaatccggatctgccatctaattttaagaaaaacccaaagtcagttgagagtaaaacttgttttgtaaagaaaatagttaagagtaagatgaaaattgtaccgagttttgtaaacatagcgtttttatttttgaaagtattactaaatgggaatttctcccttggccaacttagaaaaggggtggggcgccttttggtcttttcctacagtcgtatggctctgataccagctctgtggacccccgtttttataacaggaatcattcgtgtaaacagtaccatttccctggatcaagtagtctggtacacacgagttcatagctgaaataccaaaagcacatacatgagagtctagtgctaattattacatcataagcccgcaggcattgtcttaaatcatcggaccgagcggtccggaatacatccaaaagcagaaatagataaggcagcggaattcaggcagcggcatgccattgccacaggcaacgaccgtactaagacctactgagcgccatcgtcttcatctccctcctggtagtaggcatagggatcctccgaagcttcatctaccgcttctgattaattttatatttgtaaggg

SEQ ID NO: 71387 - DNA, 19884 bp, Oryza sativa
ttaagttgtcaagtaaataatgaggtatttaaatcatacacttgagtttggaatttggtattctacttcatcttctatatgcttaagtggatattccgatgctgattttggtggttgtagaattgataggaaaagtacgggtggaacatgtcattttcttgatacatcattgattccatggtcttctaggaaacaatctagtatttctcaatcaactgctgaatctgaatatgttgctgctgctagttgttgttcatagattctttgacttttatctactttgaaatattatggacttacttttgagaaagtacctctcttttgtgataatactagtgctattaacattgctaagaatcatgttcaacactcacgcacaaagcacattgatattcgctttcattttttgagggatcatgttgagaagggagatgttgaattgcagtttttggacacaaacttgcaacttactgatattttcactaaacctttggattctaatcgttttgcttttcttcgtggtgaattggggataattcatccttttggcatgatttgagggggagtttgtacctcatggttttatcaagcaaaaaatatgacaatgagaaaaattgagaaaagagagctttgtttatacatgtggtattttcttgtacatgctagcaatactttgaaggtttatttgtctctaacatagcttgtttgtattctagtctttgcatgagatttagattttgctttttaagggagatgatgcatgacacttaaattctatatttgaattaagtaaatatgcaatgttgacgctagcatgtggtttgatttctaaatgctctatatatatgctttattgaattgttattcctcgaatagctttaatttcttattgtgaaaagagaataaaaatatggaaaaaatgaataccgaatccttggaaatagtcttgatgacaaggaagtattcaatgtgagcaaaataatgggtgccgaatccctggaaacagtcttgacgatagggacgtacccagaataaaagagaaaaatataagcaaaaaggctcaagaaaagaaaaagttaaaaattctcttggttattttctgctaaaggttatttgagaaagagtgataaatgcaataggtctatatgtttagtgtttatttttcaacctatgtgcttgttaagatgttgcattataattcgtatgaaatcatgaattttgattgttgattcaagcttaattgtaaactctttggttcatggttatattttaatgcatgcttgctatattatagatgggttcatcttctttttattgcaacaaatgacatgatatgctatatgtatgctaagctcttatccattaatgaacataattcctatgcttgatgaaatcattgtcaaaagggggagaagccaagtgaaaatttttggagaagcaaatttctttcttttcaaaagtaagagaagttttcttttggattttcgagcacgatgtgtacgtttgtacgaagtgtgctttttaccagttttgtttttatttttccaaacaccaaaacatttttgatgggtttgccaatgtgttcatcaaggggttaattgtaaaatcaaaggtgtttttgattattattctgtgatgaacaattggcattggagattattggttttgatatttaaaattcattcacgaagtggttttggagatgattggatttcacaggtgaatctacaggtactactggattgggtccggtcagaccgggcagtggttgccggtcagaccggcgcaactcgcggtctgaccggccgactctgtgtcggtttcggtttcggattgtttgtttggatatccatgattgtttcatgattatagcttctagatggatactatacgtatgtaatactgttgtttgctacaaatgagtcaagttggagatagcttggtctcggaggaatatggtttctttgtttgttctttgtgtaggtgactcggatgccgggagagtatttgcggtgatggaccgggagtcggcttggggataagacgacatccgtggtggtcagagatcatgcgggatactatggctagagttcaatacacgtggttggtgaagattctatatggcatacaatggaggtattgtgtgcgtatgggatatggagtcgaatttttaaggagtccaaatttggtatgattggttatgtaaagtttgtttcttgcactaaagggtttcctaaggtgtttaggacttctagtatgtgtttgattcgtggctttaggctgcctacctctagtataaatagagggggagcgtgaggctttccggtatcacttttgagagcaaatgagttgagagttgagttagggtttcgagtttagtcgaaatttttgtaaggagtgctgttggtccactttgtaaacacagagagaatcaataaagtcgtcatccactttaagagttcttcgatttgtgtttcaccgggtttcggcggtctaaccggcgacgcaccggcggttagaccggcggcattggtttcaccgggtttcggcggtctaacctacggcgcaccggcggtcagaccggcggcatcgcagtggtcagactggcgggcacacggcggtcagaccggcgtcggcgacaagtttcggcggttagaccggaagatcaacaccggtcagaccggcggctacgcttcgatcagaccggctaatctactccggtcagaccgatctccatcgaattcgagggtaacttttatttccactaaaagtttttggtttttgggtataccaaccattcaccctcctctggttggcttaggtattgtgtttcgatcctacaagtggtatcagagccttgttttcttctttggattttaaccgatctagagtttttgccatggctgatagattttcaactaagcctcatgtttttgatggaacggatttttctcattggtgtagtaggatgcaatcatacattatggctaaagattatgatatttggagaaaagtttctcatccttatgtgattcccgaagaaattaatactaccgctttaaaacttgagtttgaacaaaattgcaaagctcgcaatattcttttgagtggaatttctcgttcggattatgatcgtgttgctcatcttcaagctgcccatgagatttggattgctttgagtaattttcatcaaggaacatataacattaaagaacttcgtcgaggtcttttcaaaaaggagtacattaaatttgagatgaaacctggagaagctttggatgactatctttctaggtttaacaaaattttgagtgatcttagatctgttgattcttcttatgatgctaattatccacaatctgagatttctcgtcactttttgaatggtcttgacatgtctatttgggagatgaaagttacatcaattcaggagtctgttaatatgtctactttgactttggattcgctttacacaaaactgaaaacacatgagatgaacgttctttctcgtaaagttgattctaagtcgagtgctttggtttcttcctcttcttctttggatgttgatacttcttcatcaaagtcttctattcttactttatttaatgccacatccgatgaccaactcgaacagttcgagaaggaggatttggctttggttgctaacagaattgctcgagctatgaacaatgccagcttcaggaaaagaggtggtccaaatcgttgctttgaatgtggttcgattgatcatcttcgttcgcattgtcctaagcttgggagaggcaaaagagaagacaaagatggtgagaagaccaatgacaacaagccgaagggtacattcaaagggaggaagatcaaggagaatctcaagaaggcttttgatcaagtgtacgccgcgtttgaaccactaagcgatgtagatggggatagtggagatgacgataagggaaagaacatcttcggtgttcgcttcatggcgcgtggtgaatcggattcagagtgtgaagacaatgaggtaagtgcttttgaggaagctattaatattttgagtgcaaaaaataagaagtgtgagaaaatgtatagaaaacaggagtttatcattgaatctcttaattctgaaattgctagattaaaatatcttattcctaatgatgatggttgcaaaagttgtgaggttttaatgaatgtgatttcaaaaattagagatgtcaatgctgcccatgatttgaaaaataaatcttctcttgctcttagttttgctttgcacacacgcactttggatgagttgtttttgactaaaaagttgttgcaaaaatatcaaattgcttttcatgctagtttgatgtttaacatgatttgtgctaaaaagttaaaacaatctcatgatgttttggattgctcaacatctaatttaaataaaatgaaactaaaagatgctttagatcgtgttaagtacatggaagatgttgtgaaaaccaatgaagtgctttcttgccccaaatgtcgtaaaagcaaagttgtcatggtagattgtgaaaattgtgctaatttagaaaaagaggtttcttatttgaaaaattctttgctaagattttctgatggtaaaaagaagctcaacatgattttagatcaatctaaggttagcacacataaccgtggtttaggttttaattcttatgctcatcatactagtcatcctcctgttgtgttaggtgctggtgctagaggtggtgagattttagttaaacctgatactaataaaactatgtttaaatatgatggtatcatgtctaccttgagtacatcttcttcaaagtccaatgttgtgcatgcaaaacctcctgttgttgcttgtgttgctaagtgatgaggacatcctccactattacccgctggcaaagacgccaaagtcgggcaacgaccgtgtgagcctttgaataatcccaccttgcttagcttgggaggaggaagccaccttaaaagggagagccacccttcccctattggactagtcttttagggagattgggcctttctccgagtgggtgtgcctaagaactgttggggtccgggaaaccttaagttattgggcctcagccgaccccacctaggccggattattatcactaagttttctgattctaccaatatgtcgaatcatcgtgaaaaattgtcacataccatgactttgggtgtttggaaaacatggaaatggtggaagaagtaaaataaataaaacttttgtttaaaacttatatgcttgcttgtttgtgcattttgtggtgtatgcatatggtttataggatcatgttcatatttaactaaaaccaatggatcaaagaaaaattcttggaacaactcaaaaatctgggaagaatttgtggtaacttcttgctgaccttagaaactaaatgtggattttaatttagcttatcaactcattagatcaaccaaacaactctctaaacacttaagcacaggattttgacagattctctggagcactctttgacacactgccaaaattggatcttgaactcctaggctgtaaaactcgatccaaactgtagttcaatcattgctttacaactttgcctttggtcactagctctaactctgcctagaactaattttaaactgaacccaaagatggaattccacctctgttccagacttggccaaaacctagatctcctctccttctctctcactagtcgctgccatgtgggccagggctgcatggcgggaccccattgtcagcctcacattcctctccacacgggcccactgcctgaactcgcatgccacgcgtgtgagcacgcgtcgagcacgggagaaggcgagctcctcttgtccatctccgccggcgaccatacttaacccgaccggccgaccaactttctctccctctcgcccttgtctcgtttcgcagaagaaccgaggtaccccgcctcggattcgccgggaacggaggcgccatctccggcgccggcgagataagtcctcgactccgtcacaatccggtgagcccatttccgttcaatatgcgttctgtaatcccctctcaatgccgtctctaacaccaccaagaacacctcatttggtgcagccaatctccgggaacgtgaccgcgtcaaatcggaacaccgtcgcgctctggacgccgctgcttcgcctttgctcgtcgccctgcttccatagttcgttacaggctgagccacttcgtcacgagcttcatcaacacctgtagatcaagaatcccgaaggaatcgacgcgaggtggaccacagtgggagatcctcttcttcttctccaatcccagccaccgacgccattcctttctttctccttctctggtgagcttcggcgcaatattttccgcctagagctaccttgtgctgatctaaacagagtcatgcttcctctctttgcagtagaagcctggggatacgccgtcgacgacgaccgtagcagccgcgccgtcgccgaaccagtacaccgtcgccaagacttcgctgagctgcgtttgcttcttggtgagcctcctagtagtccctagagtccttaccatacgcatgcacgattagatcgagcctcaaaactcacatgcatgtgcaagccgagcttagccgccgcttctaacaccctgacagccgctatagagcaccaaggcttgcaagaaaaacaccaataggttcgtacggttgttctctacactttttgttttgggagcttgagctgaatcgccgctgttcgccgctggtgatactgtgaagttcgtggctgtgctgctgctctgttctgtccagagcaagggcatggcttttgaaatttaaagactcccagggatgcattagcagcccgagcaatcacttacatatggggtcgtgcactaatctgtaaataacatagaactcaagtcccattttgaataaaatcctggaacacgtgctaggggctgcgggatctatttcctgagaacccaggggcttttgcgcaaaatgttagtctctgtctggtggacctgagaaaggaaaatgatgtatgaaaatttgagaaaatacaaaaactaatttcctatcaactgaaaaatgtcagaactttagaaagtggtagaaaattcatcctgactctaaaaattgcaaactaaattatgttagaatcatattttcatgctttgcgtcataaaaatgtttgacttaacagaatcataaagatttatgtctcaataattcgaaatgcatttaggaccataattaacatgtaaacactttaaaaaaaatctgtaactttgaatgtaaactgttagattgaagtttctttcactgaaaatcaaactaacacggagcacaccaactccataaaaaaaagcattcattttagagcatgttggatttttatgtatgtttaaattttaaatttttgcatatgtatgtttagacgattcgcagccgagtctcgaggaggcctactttgtagctgagcaaggagtggaagagcaaggcaagccacctcccttctttgatcacattgaacctatgatttggatgtttttgaaaagtttgcaaaatatgcatgtctattgtacactaatccattaaaatcttgtaaaatttgttagatcaactccttaacttgcattatcacctgaactccacaaaagaccttaaccattattccaaaaccttaggaacaatccattgtgtcacattaagaatgatgtttgagatagcaagtctataaaaatgctcagccatgcttagtgatgagtttacttaccatttgggctcaattacatatattaaatgatttattttatgatctggattaaaatgataaaatgtgatatttgttaaataaaatgttggaaaatgtggattttaggtttgggccgcatgtggtacacatattgtgtttagttgtgtactgatagggggacagtgtgcccaaaccgacctaaggacttcactcagcgtcaattcatttcgtatacagtacaaccacatgtgctagtatgggatagcccaagcttagtaaattatttatgatttagccttacattctggtaggccggtgtgtatgagttagtcgataattctgaggaattagtcgttgattcagaggaactttctatttaccccgacgtggtagtttaggtgactaagtctgtccaatacaacggtattgtgccacgtgggtgggttcccgttgcgtccgccaccacggcgttaagtttaaggcgtgggcccgccacttaacggttctaggtcatatatcgagtatggcttaggatggagtaacacgtatcgtgctggtgtaaggctaaatcatgaatcttggaagggctttgttgtgagtaataaatcgggtacttatgtatcgcgtgccatgcttttgcatgattattatttcgcatcatgtgggtaaagtgtacatactctgcagagttaaaactaatcgattagccgtgctcacggtcaagagcggcgtgtgaatatgtcatgagtttagacatgtgttttattcttctaaagctgaatttgaacttcaaaatgtgatgtaatttgtggtttatatccttgctgccatggaaggcaataaggagctatgttatatgtgtttatcatctaatttggtgcccaattgctaagtgtattcttgctgaaatttatttgaaaataaatctgaaatttgaaatgctctttgcaaactaaatttgctttatgctaaaattatcccatgttagctttactttgaatttgccatgcatgtagagtactaggcttgcttggtgcttgccagtacaatttattgtactgactcttgcttgtattgttatattgttgcatgtttagaattggttgcaggtgagatcactcctgtggaggatgatttcgttggggaagtttctttcttccaggatggttcttactagggtctatcctagtcggttgcatgaaagatcttttgggtagaagatgcttccgcgaacctatctattcagccaatcggccatgtgtatctaagttataagttgtatgatcctaactaaaacttagaacttagaactccctatgttgagatatcatgtgcttggatgaaagtgtttagtgtgttccttttgttagggacatattaaacatgagtatgagttaaagatatttgagatgttgtggatctttagccatttttgtcaagtctcctgattgtgtaacacatctggtcgccaccttcgagtggtttgacgggcacatctcaggctgaagttgactggcaggctaaaggcccggcaatgtctcacatatttttctctcggagcgtcgaatgtcttaatatgtttgatggaagaattgtgattagctattcatccttcaaatatactaaggggttcggagtgcttccgacagctttggtatcagagccaagaccgactgtaggaacccttttaagactgagcggtagtaaggcttcaaaagaaaatattttgagggtaatgtcctcactaaaatatatttgcaaaatctaatctattcttacttcttagccctgtttggataaattcctttcctatgaatcttgttttgattttaaaaccccatcttactctataggaccggaagatgcataaatagagaagtagtaactcatagagaagaataaggaatgaatgaaacaaattcgattcaagtcagtacttgaatgatttgaaaacttctcagtaaatagatgactaaatttttcccttctaaatttgaatttaaaattttaaaattttatcgatggcctagaaagtggtagtacggggtaggatggaattgatttgttttaaccatagtttgcttgtcatataaaggccaccagatgtttgtaaagcctctacattaagttcttagcatgtcccaaaattggtacgaattttacatgctcgcattttttttaaaaaaaatatatataatttttttttaaactgcgcagattctagaactggtagcagtcgtccttctccttttttactcagagcagtatgctggacagaacctgacataataaccaaaacaccatttccaagttcctaaagagtttcaattgaaattctaattggtctatacttccaatatcttgtagatgtcttctatgtggcaaccattgggctattctggaggttttgaggaagaagcactgcctcacatcctgtggcttatgctgcaacatctaggttatgatcatccaccggagtatcatttcttttctcatgagcggagttcatctctcgagcatatatggctgagctgtgtatacagggactttggacccatgaaccacccctttactttcaagcttgtggttgggatgcaccctcagcaatgcaggaagctgcattacaagcaattgtgtattaccgacattataggccagggttggacgggttctttcatttctttccagctcgcgcaaaccaatcctccgctaattactatccaggtcttgagggaaacatgagagagattgacactccaggactattcttagctggcctggttcgtgctatggatagatatctcgcaaaaactataactgagttgcgtagattgcaagctagggtggtcatgcttgatagacgaatagaaccactcgggcatcaaggacattttgataatgccatcatttatgggaatcatgaactccagcctcttacagagactttgcctcctcccatgggtatttatcataatataaacactagagcccgcatgagagttggttttcatcgaaatcgtcgaaccatgccagaccctgcacttgctggagatccggtgctgctggggccattctatgagttcgagcggaatgggagacaataccgtttgactatggccactccgtcaaccacagtgcctcaacctcccatcggattctccgaagttccatagaatggtgtactggaaaaaaagaatatgtatggggtgtaactttcatttcttttctttaagatgtatgagatgacaccctaatatgtaatctttttaacggtcaaaattttgtaacaccaaggcatgaacttggtttcttatgaccattatccactcctatgtatctgtgatcacttagatcctttaaaactaatgtactggaatgaacttatgctccttttggaatggattgcttgctgtccagaaatttgtttcatgcaaatatatgatggatgacttgtaaattcggctataagaaatcattcctgtatgctacctatttagggtaatgtatatgccaattctatgctcaagcagctcatgtacttttgtactttgagtgcaggatgacacatactcactctatggctgctcttactgatgatgccaatggtgagggagcgagtcagcctcgcactggcccatattcttctggacgtgccgggggtagtcgccgtgctgccactgcagaacagcatgatgatgaaccatctcttgctcaactcctggctaatcagaaccgactttttgaaaggatggtagcgaactctgaaaacatgggggctgccatggcacagcaggccaatcaagcaccctccaagctagcagatgttcaacgaacacatccacctcatttctcctctgcggctgatccactcgcagcagatgattggcttcgtgatattgaaatcaagctgaacctttgccggtgtgatcctgtagagaaggctacctttgctgcttactacctgcaaggtgcagcagctgcttggtgggagacatacaagactctcattcctcctgacgagccaatcacttggactgttttccgtgagggattcaggtctgctcacatccctgctggtctcatggaaatcaaaaagaaagaatttcttaacttgaagcaaggaaacatgcccttcatggagttcatggaacgcttcaattatctgggtagatatgccgcttctgacttgaacactgaaacaaagaaggttgagctatgcagagatcgtcttgcacctgaactcaagcatgctcttgctgctcatgaaatcaccagcatgaagacactggttgataaagcccttcgtgttgaatcaagtgaaaaggaagtggttgaagaccgtaagcgtaagtgggctgcaaagaaatttgctggcagcagcagttccactcggcctcgtcttgctccatctcctgcggttcgtcctatggcacctcagccacctcggcagatgtatgtgcctccacgtccgcaaactcagttagttcgtcaagttcctcgcgcagttcaagctgcgggagatgcatctcgtaatgccaatgtcacctgctacaattgcggcaagaggggcattattctcctagctgtccttatccgaagactggaaaatccggaccgtactcacagggagcaccgcagcagcctcgtggtcctcctcaagttcagcctggacagcgtggagctcctgctgttcccaagccagctccaacttttggaaggggccggctcaaccatgtcactgcagaagaagcaaccgacgcacctggtgtcgtacttggtacatttcttgtgcactccattcccttaacagttctttttgattccggtgcaactcattcattcatgtcaaccttgaaagcaaaacaacttgacttgaaaacagaatttcttagcgatgctatgcgcatccaatctcctggatccaccatggtcaccaaacttctatgcaaaggtgtagaacttataatagacggggtaaagtttaaagctaacctcatattattagacaccttgggcctaaatgtcattcttgggatggattggttaactaaacatgagggaaccattgattgtgctcatagaactgtaactcttcgtagcaccgatggtcaatttgttaggtttacctttgaacaaacctccacttcaaatcaaccctctatacaatctctctctataccggagttaaaatcagtacccatcgtgaatgaatattccgatgtgtttcctgacgaattaccagggatgcctccagatcgtgacattgaatttgtgatagatttaatccctgggacagcacctatagccaaaaggccatatcgaatgacttctgaaaatttgatggaattaaagaagcaactcaatgagcaattggctaaaggtttcattcgtcctagttcatctccctggggctgtccagtgttgtttgtaccaaagaaagatggaaccatgcgaatgtgcgtggattatcgacctctgaatgaagtcaccatcaaaaataaatatcctcttcctaggatcgatgatttatttgatcagttaaccggaactcgtgtcttctcaaaaattgatcttagattgggatattttcagcttaaaatcagaccggaggacattcctaaaaccgcattcacaactcgctacggtttatttgaatacaccgtagtctcttttggattaaccattgctcctgcttctttcatgaatatgatgaataaaatcttcatggaatatcttgataaatttgtggtggtattcattgatgatatactcatctactccaagagtgaagaggaacatgcgcaacatttacgtatggtactcgataaactccgtgagcatcaactttatgccaaattctcaaaatgtgaattttggttaaaagaagttgaatttcttggtcatgtactttctgaaggtggtattgctgtgaatccaagaaatgtacagaacgtacttaattggaagcaaccacaaaatgttcctgaaattagaagttttcttggactagctggttactaccgtcgtttcattgaaaatttctccaaaattgctaggcccttgactcaacttcttaaaaaagaaaataaattcatatggtctgaggcatgtgaaacaagttttcatgaacttaaaagaaggctcacaacagccccagtgctagtgatgcctgatgttcttaaaccttttaatgtttactgcgatgcctcacatcatggtctcggttgtgtactgatgcaagaaggaaaagtagtggcttatgcttctcgtcagttacgaccacacgagatcaattatccaactcatgacttagagctagcagctgtggtgcatgctctaaagatttggcgccattatttggtcagtaatcggtgcgaaatctttaccgatcataagagtttgaaatatttctttacccaaccagatctgaacctaaggcaaagaagatggttagaactcattaaagattatgatctcggtattcattatcatcccggtaaagcaaatgtagtagctgatgctttaagccggaagctacatcaccttgccgttattgagacaataaatcagccatcgttgtcctctgaatttcagaaattgaatttgggattggtagaggatggttatgttgctgcactagcattacaacctactctctattctcaaattaaagctgctcagtccattgatgaggaagtagctgaaattatgaaagaaatcaattcaaagccacaatctatatacactcttaattctgatggtatggttatgcttggcaaacgaatctttgttcccaataatcaacaccttcgagaaaccattcttgatgaagcacatcaaacacctttgtctatccatccgggttgcactaagatgtaccaggatattcgcactcaatattggtggcctagcctgaggcgtgacatagcagcatatgttgcaatttgcgatgtgtgccaacgtgtcaaagctgaacatcaacgacccgctgggctactccaacctttgcaagtacctgaatggaaatttgatgaagttggaatggattttattaccggtcttcctaaaacacccaatggacatgattctatatgggttattatggatcgactgactaaagtggctcacttcattccggtgcatgtgacttatggtggagccaagctagcagagttatatttgactcatattgtaaggcttcatggcgtaccaaaagtcatagtatccgatcgaggaacacaatttacatccagattttggaaaaatttacatgaacttctcggaaccaaattgttcctcagcaccgcctttcatccacaaacaggaggtcaagtggaaagaacaaaccaaatacttgaagacatgctccgagcttgtgtgcttgaacataacactaactgggagaaatgtctatcttttgctgaattctcctacaacaatagctttcaatcaagtatccaaatgtcaccatttgaagctctttatgggagaaattgtaggactcctctttattggtccgaagtaggagaaagacaattctttggacctgctatcattaatgaagctgaaaagaatgtcactcttattcgggaccgattaaaagaagctcaaactcgtcaaaagagctactctgatcgtcgtcgacgagagctaagttttgatgttggtgaccatgtctatcttaaagtatcacccatgagaggcactcaacgattccaaattcatggcaagcttgctccacgatatattgggccataccaaataatatctaagcgtggacaagtagcctatcaattggaattgccatttcagttgtctaatatacatgatgtattccatgtttctcaacttaagaaatgtcttcgaactccgattgagcacacctcacttgaagacattaatctaaagccaaatctctcctatcaagaatacccaattcgtattctcgaagaaagtgaacggcgtacccgcaaaagctccatcaagatgcttcgagtacaatggagcaatcatactgtggatgaagccacatgggaacgagaggaccgacttaaggccgaattccctagtttcttctagaatgacgaatctcggggtcgagattcttttgtaagggggtaggctgtcacataccatgactttgggtgtttggaaaacatggaaatggtggaagaagtaaaataaataaaacttttgtttaaaacttatatgcttgcttgtttgtgcattttgtggtgtatgcatatggtttataggatcatgttcatatttaactaaaaccaatggatcaaagaaaaattcttggaacaactcaaaaatctgggaagaatttgtggtaacttcttgctgaccttagaaactaaatgtggattttaatttagcttatcaactcattagatcaaccaaacaactctctaaacacttaagcacaggattttgacagattctctggagcactctttgacactctgccaaaattggatcttgaactcctaggctgtaaaactcgatccaaactgtagttcaatcattgctttacaactttgcctttggtcactagctctaactctgcctagaactaattttaaactgaacccaaagatggaattccacctctgttccagacttggccaaaacctagatctcctctccttctctctcactagtcgctgccatgtgggccagggctgcatggcgggaccccattgtcagcctcacattcctctccacacgggcccactgcctgaactcgcatgccacgcgtgtgagcacgcgtcgagcacgggagagggcgagctcctcctgtccatctccgccggcgaccatacttaacccgaccggccgaccaactttctctccctctcgcccttgtctcgtttcgcggaagaaccgaggtaccccgcctcggattcgccgggaacggaggcgccatctccggcgccggcgagataagtcctcgactccgtcgcaatccggtgagcccatttccgttcaatatgcgttctgtaatcccctctcaatgccgtctctaacaccaccaagaacacctcatttggtgcagccaatctccgggaacgtgaccgcgtcaaatcggaacaccgtcgcgctctggacgccgctgcttcgcctttgctcgtcgcccggcttccatagttcgttacaggctgagccacttcgtcacgagcttcatcaacacctgtagatcaagaatcccgaaggaatcgacgcgaggtggaccacagtgggagatcctcttcttcttctccaatcccagccaccgacgccattcctttctttctccttctctggtgagcttcggcgcaatattttccgcctagagctaccttgtgctgatctaaacagagtcatgcttcctctctttgcagtagaagcctggggatacgccgtcgacgacgaccgtagcagccgcgccgtcgccgaaccagtacaccgtcgccaagacttcgctgagctgcgtttgcttcttggtgagcctcctagtagtccctagagtccttaccatacgcatgcacgattagatcgagcctcaaaactcacatgcatgtgcaagccgagcttagccgccgcttctaacaccctgacagccgctatagagcaccaaggcttgcaagaaaaacaccaataggttcgtacggttgttctctacactttttgttttgggagcttgagctgaatcgccgctgttcgccgctggtgatactgtgaagttcgtggctgtgctgctgctctgttctgtccagagcaagggcatggcttttgaaatttaaagactcccagggatgcattagcagcccgagcaatcacttacatatggggtcgtgcactaatctgtaaataacatagaactcaagtcccattttgaataaaatcctggaacacgtgctaggggctgcgggatctatttcctgagaacccaggggcttttgcgcaaaatgttagtctctgtctggtggacctgagaaaggaaaatgatgtatgaaaatttgagaaaatacaaaaactaatttcctatcaactgaaaaatgtcagaactttagaaagtggtagaaaattcatcctgactctaaaaattgcaaactaaattatgttagaatcatattttcatgctttgcgtcataaaaatgtttgacttaacagaatcataaagatttatgtctcaataattcgaaatgcatttaggaccataattaacatgtaaacactttaaaaaaaatctgtaactttgaatgtaaactgttagattgaagtttctttcactgaaaatcaaactaacacggagcacaccaactccataaaaaaaaagcattcattttagagcatgttggatttttatgtatgtttaaattttaaatttttgcatatgtatgtttagacgattcgcagccgagtctcgaggaggcctactttgtagctgagcaaggagtggaagagcaaggcaagccacctcccttctttgatcacattgaacctatgatttggatgtttttgaaaagtttgcaaaatatgcatgtctattgtacactaatccattaaaatcttgtaaaatttgttagatcaactccttaacttgcattatcacctgaactccacaaaagaccttaaccattattccaaaaccttaggaacaatccattgtgtcacattaagaatgatgtttgagatagcaagtctataaaaatgctcagccatgcttagtgatgagtttacttaccatttgggctcaattacatatattaaatgatttattttatgatctggattaaaatgataaaatgtgatatttgttaaataaaatgttggaaaatgtggattttaggtttgggccgcatgtggtacacatattgtgtttagttgtgtactgatagggggacagtgtgcccaaaccgacctaaggacttcactcagcgtcaattcatttcgtatacagtacaaccacatgtgctagtatgggatagcccaagcttagtaaattatttatgatttagccttacattctggtaggccggtgtgtatgagttagtcgataattctgaggaattagtcgttgattcagaggaactttctatttaccccgacgtggtagtttaggtgactaagtctgtccaatacaacggtattgtgccacgtgggtgggttcccgttgcgtccgccaccacggcgttaagtttaaggcgtgggcccgccacttaacggttctaggtcatatatcgagtatggcttaggatggagtaacacgtatcgtgctggtgtaaggctaaatcatgaatcttggaagggctttgttgtgagtaataaatcgggtacttatgtatcgcgtgccatgcttttgcatgattattatttcgcatcatgtgggtaaagtgtacatactctgcagagttaaaactaatcgattagccgtgctcacggtcaagagcggcgtgtgaatatgtcatgagtttagacatgtgttttattcttctaaagctgaatttgaacttcaaaatgtgatgtaatttgtggtttatatccttgctgccatggaaggcaataaggagctatgttatatgtgtttatcatctaatttggtgcccaattgctaagtgtattcttgctgaaatttatttgaaaataaatctgaaatttgaaatgctctttgcaaactaaatttgctttatgctaaaattatcccatgttagctttactttgaatttgccatgcatgtagagtactaggcttgcttggtgcttgccagtacaatttattgtactgactcttgcttgtattgttatattgttgcatgtttagaattggttgcaggtgagatcactcctgtggaggatgatttcgttggggaagtttctttcttccaggatggttcttactagggtctatcctagtcggttgcatgaaagatcttttgggtagaagatgcttccgcgaacctatctattcagccaatcggccatgtgtatctaagttataagttgtatgatcctaactaaaacttagaacttagaactccctatgttgagatatcatgtgcttggataaagtgtttagtgtgttccttttgttagggacatattaaacatgagtatgagttaaagatatttgagatgttgt

SEQ ID NO: 71388 - DNA, 591 bp, Oryza sativa
tgtggtactcttttgaggttgctatcataaccccaatctttagaggttgctgtcataacccccagctgactgcattcttatcagatgttcagtttgttgaaaatgacgtaattttgaaaggatgtttatttattttgatttttgagttagaaggctggaattttatatctttgctaaaattgctcgtataaggactcgatgagtaagtgcatactggtttatttagctgatgtaaattgtacagcttacaacattttaatttgtaggttccctctctttgagaggacttgcaaggagctgaatggagccgaaactagcattcccccaggatagtccaccacttgccatcctctgtgctgctaaggtcgcaggtgtttccctcaccctcgatccgaagctcgcctcgggttcagcacccacacttcaccttggttctgggtaagtggatactgatcagtctgtagcttctctctgagacgaaccactacttttttttccctttcttttaaagcttatactatgataatttgctccatcatcatgcctgcatcttgaatcgtgcttggaatggcaagttcggtgcataatatt

SEQ ID NO: 71389 - DNA, 540 bp, Oryza sativa
caaaatttaacttctacatgttgaaagaaaaaaataaatttgactataaatgtaagttaattagttgtaatgtaatttattatttttacttgtaaaatttgaattttaacttaatgtttatagaatgatatatatatatatatatatatatatatatatatatatatatatatatatatatatatatatatatatatatatatatatatatatatatatatatatatatatatatatatatatatatatatatatatcacatactaatatattttctcaatttttttaatattttaactatttaagcgacatgcaaataatgagaagaattctctcgagagtgtttaaaataatctactctcccactgctgcactactatagcaaatcgaatgtgttatacattcagttgcagttacatttagggatgaaaacggagcggatagtttccgtccgctccggagaaaaacaaaaaacggatacctttcggattggatagttcagatacggatacgaatacggatattttttcccagatacga

SEQ ID NO: 71390 - DNA, 625 bp, Oryza sativa
atatgccctatacgtttccctttcacgaaggcgtcaaatcgttcgaccacgtgatccactggactctctctccatccaaggcccaatttaccgcctacaaaggcccatatttgaatgggccctaaattttgatcggccttaggtgggcctcgcttatgagagcttcgagagggcccacgtgtccactctctctctctctctctacagcgacggcggcggcggcggcgaggtgagaggaaggagaaggggatcgaggaggaggaggcaagcgcagccaccatgggagtgatggagaagctcaagatcttcgcggtgaaggagcccgtcgtcaccgcctcctgcctcatcgccggattcggtgcgcttccctttctctctcgatcctgccgtggccgaaaccctagtagtggcctggtcgtgattcctcgcccccattgaggacgctggtgttgccttgcactgggcgcctctgtttagctcgaattcggtgaccgaggattgattctaggactctctgggctggggtggatgggttcagaacgccttgatgtgattttttcgcttgctaattttctgttggatctagggttctaaatcgcttcagaggtgttcttctttgcaagcc

SEQ ID NO: 71391 - DNA, 716 bp, Oryza sativa
aaaaaaatggactagtagattgagtagagactcgtggcatgcaactgtcggaggcggcaacccacgtaccggcggccaagcttccggaccctcgcgcggcggttgcggccggggccggccggagagacgtaccggagacgcgtcgcggagacggagcccccaccgtctctaaatgccgccgcccttttggtactttgatgctgcagacgtacgactcccaattcaattctcatgctgtttccatttaattttcgtatacagattgccagggattctgattaattaagtttgtggtgatcttaattagccccccgccctgctactgctagatgttcctttcaaatacagagaaaaagtcgcctagtagatgcgaatgtgatggaattttgccggaactgaatttaattatgagttggtacgcttgagggggggatgatgatcaaatgctgtaaacactgtacttaattttgcatgttgagtggtgctgtcgagtgtaaactgtatggttgctgtgctatgctgcaatggacaagagcagtaggatgtgtcttgtgaccacagttggtacgtagtacgtgatcctttttttctgatgatatgcatggctgcaaactgagactctgacaaaagagataaaactgcgcatatgtttggagtaatgtgctatatatgtaagcgttatgctgctaattaagctcgtgtgaaggcacaccaaa

SEQ ID NO: 71392 - DNA, 1215 bp, Oryza sativa
  unsure (1)..(1215): unsure at all n locations
aactctacttgccttgagatcgatgggggcaaactgtttattcacgcaacaaacactacatatcgtgtccttacagacacgcaacatttaaaagattcagtgatcattgaagattttatgccggtttcgcctcttctggtgtctgcataaagcgtggaacttctccgttcatcaccctccatggcccccagtagaatttgggcggcatgagcggcacggcctcgcccggatgatcttcccagtacttctcctgctccaaaatgcggtcacaatcaggcaaaagcaactgtanattgaggtcaaattgccaatcctagttatttcaaaggtatattgcttgcattgttttgtacaacctgattcatataggacaatagggcgatctgattctatatatatatcaccaatcaaacctggccaaacttgcttgtagggtaaattgacagtcctaaactcctaatcagttcaacaaagtatgcaaccaaaatttgttgtgatccagctagctactactaccgagtacatgttaatcataccatacgggaacatatgctaaacagacctttgatcactgaagcatgcgaaattcatgtccaagtttcgagaccaaggggcctaagcattccgtcgagcaccttatgcgcggaagccccaccgagggcaaccacaaggagtgaagcagggaggggggaggaggagtggaggagcggtctgttcctagagtatcctgaccttgtaaagctgctcggtgatggcggaggcgacgacgccggtgtagaaggcggcgacgtaggtgccgatgagtggcgcgaacgagcgcggcgggcggtacggctccaccatgtcccagagcaccgtcttctcccacctgttgaattgccggtccgcgtaccacctccacaaccgcctcgccatccctctctcccctcgccgccgccgccgctcgccttcgcctccgcctccgtccccttgccgccgcaagcctctgcaacgccgccaccggcaaagaacagcgccaccgctcagcacgtcaccggattaggctttcaattgggcccaaatgagactgcagatcacgtgggcccgcacgttgcgttgcagtccaatttcagcccgacccggcccgtactcgaggccaacttagacccgttctacccagcccagccttagcccagacgggcccgagaacgggaagtgaaaacgcaaaggcggggg

SEQ ID NO: 71393 - DNA, 602 bp, Oryza sativa
caaagagtataatatagaatacagaacaaacaacatgcaattgttcaatatttcaggtatattatgtaacacaattaaggtataaattcccaaataatacattttaaacaatccatgacagcccacaaatcgctaacttttattgcataccgattgtcctttattcccgtagtagaaaagagtcccgtgactgtcgagaacaaagaaccttctcttccattctcgtgaattttcagaacgcttaaagagataaccttgtttgattatttgaacctgccagaaaaataaattagtgaaagaaagcaacaaagcttaactaaaaaaaaggttgcatgttatatataattaaaatgtagtctggtgaattataaatgggaataacagggcattataatactagaatttgaaccaaagggataacaccatcgatctctttgcctagatacctaatttaggaatacatgaagaagcaatcaccatcttagaaataaaaggtgcttcgctcttaaacatcatcaatccctctgaagcagaacattgaacagtgatgcagcaagcttagccgtccaggtatcctagcctattatttatgattgtttact

SEQ ID NO: 71394 - DNA, 804 bp, Oryza sativa
tatcaacctccaaatgttccaatcacatctttgcttccaacgcaaccaaccatcatccaggcaggctccaccagatgacctttttaatttaccttcaccgtttaggtagtatgcaactttggaacgatctcttcagattagccatcttgagcttgtacgttatagaaaaaaccgtttttctgatggtgatttggtgacgcagatattctcgtggagtgacgagaggatgggactcactgatggagcagcgcagatcaggggttcagagtgacacacttgcacacacatttacatttttcctagagatggcaattgtgctacagaagttttcgtgtacagcgtttttatggattcagagtgacacgctggtggagcacacgacttggtgatttgagtccgattacagtcggcctggaacggcactgtgatgttaccttcagcccattctagttgggccagaaaggaagtacttaaatgtggccccattatacttgggcctgggagggaatacgagtagggatggcaatgggggggctacacctacaaggctacacccgtcggattttgctatcctgtcccgtccccgtagtagaaaaaaaatcccgtccccattcccatccccgcacgcgggggagtgttttcccctcccccgttcccgcccccgtgcgggtatggggcaccgtcgggtgcccacacccgacaatatctcaatagatttggtagcagcaaagcaagacaagaaatagccaaacaccagtgaataagcaccaaatcttaccgtaatccaagtatccaggctatcaa

SEQ ID NO: 71395 - DNA, 80141 bp, Oryza sativa
cgaacggacggcgccgccggtgacatgggcgcaagcgcgggcgatggacgacgatgatattggtgacggaggacggacactggcgcggctaacaccggcgtcggcgccggcggtggcggactccctctctccgcggccacgccacgccgtagacgatgacgatggacgccgacaaggatggacgatgccggcgacggacggacgccggcgcgggcggtggcggactgacggcggcggcaccggacggagaagacgacggcgctacggacggaagaaacggagtggcacggaacgaaggaaattcgcgctttgatggtgtattttgaaaatagcacgaattaggtggcatatcttgaaagtagtgtgaattagatggcatattgtgaaagttaaagcgcagggcaacgcagtgaagagccctgggctcctggccctgtgacctgcctacctaccagccgccggcggcctaccgattgcccctctcgtcgcgtgaccgtgagcgtgaccgacgggccaaacccccagtccgtcacttagcctcggcgcgaaacacgccaccggatcgatcggcgcacgcggggcttgccggctgcacgcggtgcccgcgcacccgtggcgcggcgcagtagcgtgatgtggctctgccaaccaaccgtcagtccgcgtcatctcctgccaggccgcccggtcacgagtggctttcccgcggccgagacattacatagcttttggatctcacgtccgatccggtggcggacgagagcagagagccagacccccacgcacgcggcgcgggtgcaggtcaatgcaggtcatcgtacttttcgttcgttcggtcacgggatggatgctgctcggcgctgccaacaatatgttcaaccgggtggaatttggtgtttactcgcctgatggggacacgagcggaaacttgacgcgtgtcgcacgtacgagttagactcaaaccgacaataacaaggtttgacgcggggaacgagcctctcttctcccgttggatcggtggtcgcaacagcgcaaattttcatccacggcggattggtttgtgtggtgcaggtgcgaccggcatctccgcttcctggacaaaaaaatgagcgtctatcaaattgtaacgatgtgcgtgtcctcctttcttggactaagtcatgaataccgaccgatcttctcttgaaaaatgatcgcgttttcatccttcggtgccaaatgacaaaccacaagttagttccggaggacccaagtcagacggaataccaagcaagcttgctttctgcggcttaattaatttggttactcggtgacaggagatgatgctgtatgggcccctaacgtctctagcggtctaggcgcctaatgcaacaaggacggatcgagagcgacgcctacccgactagacccaacgcggcggccaacaatcgtgtccgtctggtggattcccacttcagatacatattggcgtccatcattccattgggcgacctgcatgcccaggccaagaattgggatccgcttaacaattgcacgtaacttcgaccgtccattttattcaggctttgtttagttttaagttttttcttcaaacttttaacttttccatcacatcaaaatttttctacccacataagctttcaacttttccatcacatcgtttcaatttcaaccaaacttctaattttagcataaactaaacacaccctcaggtctaaagctatagtacccatgtgaacagtgacccgtgctacaatattactgctacagtgctgtgaacagtgcattgtgtgatctgagccgtccagggtgtatccaatgatgtgtactgctactgcttattttgcacttgactgcacctgatccaaatccccaggccaatcaaacacaagagaatatcctacatctcttcatactgacaaagtgacaattaatccagcacaccgttttataagtcaatctcccgtgtgagctcgtgttaatgttgataaaatatactccatctgttctagaatataagaagttttagaggtagacacggttattaagaaagtaggtaaaattatatatgaagagtttgtgattggttgagaagcggaggtagatgagaaaagtgagggttggagggctgtaattggttgggaagggaatgttgatgaagaagttgttatattttaagacaaatattgagtactaaaagtggttatattttaatatagagggagtagatacacacgttgtaacaagcctacaagacatgcctattagctagtcacttttctgaagttccccggtcactacggcatttcttttgtccatttcgacgggtgagactgagaatcaatgggcaaattagagaaattcctcacgactaagagggcagaggctacgaagacgtagcattcatagcgcacgcgtgtagccgtaagcctgtcctgcttgcgagccactgcatcaggctgataataacttctcaacatgtttctttgaatgactcgcacgaaacgatacgaaattctattaataaagtaggaaaaaattataatattataattctggagggtcataaccagtaaaaaatgaaaaaatataccgtcacccgtacaccgacaacaccaacacacagatccgggagaaggctagcaccgaaccacttttcaacatgttggcagtgccgttgttataaaaacgtttctgcagtcaggcactgccatatccacggaaacgaatggaagaaaaaaaaaactttgtgatttgtcagcagaccacttgctaaaagaccagttaaaatcagcagtatggcactaaatgggcaggaccatctccactaaattgaaagacgaggattaatgaaaggatttcgctgactggtgccggataggctcatcctcacgtcctcaccaaccaaccatgcaagcccgctcgaccccggataggagggctacttcaacgtccgcatcgtctgcgtcgctctaccccttcggacgcatgtgccctccggtggtggcatggtgcattgcaattcatgtcaggctaaatcgatcaaccaaccacacgggcctacggaagccgccgatccaatgtaatctacacgcgtcgcgcccgcgcgcaaaagaaaggcgagaaaaacgacctatatatgcgacgtgctcggccacgacccacacgacagcgaacgtgcgcgcgtgcgtgtgcaacggcggcccaaggcgcaaacgcgaacgcctcaatctttccacttcgttccacctctcctccgtgcaaaatccccagcgcgcacgcctcgtccccctacgtgccgcgggcgtggttgcacgtcgtacgtacgcaggcgtcctcgcgagggcgcgcacgcaggtgcgagctcgtggcgggtgacgaagcggtgaaggcaaggcatcgcggcggctgtttgatccggggcctctttttgctccccgtgatcaggtattcgggtgctatacttaggtctggcaaaagtcagccgggccgcgcgcggtttggccatggctgcggcgccgccgtccgtggcgtcgtcgtcgtcgtcgtccagccccgtcctgtcggccgcgcaccgccgccggctcaacgacgtcgagcgagacgcgttcgactacggcggcccgtgcgacgtcgacgtcgatcatgatgacgacgacggcggcggcggagtgcgccgcgggcacggcgccggcgtggcgggtgtcagggcgctgttctcgtcggccaggaggagcaagagggcgtccgtgattatcgatcaggcatggctgcggaacgtggtcgcgtgcctgctcggcctcaccgtcgtcgccgggctcgtgctgagctcgcaccgagtgagcggcgccggcggcgggaggctcgtgcagaggatggacctcggtgacggcgaagtgatgggctggacggaggagaacttgacggctgttgctcgccagtcacctgacacgccggtaagtacgtatcgccgttaacggttcggttaatcaatcccacacaaaccggtgcttagcggttggtgcacatactagacggtagatagagtcaagattatttaagaaaagaggaaattatgacgcgccatgaatgatatatatttgagtagaagtgtagaactcgttccagcttttgttcctgggtatagacattgaattggcacagacgtgttggaacctactctcttcgtggactggatgtcaccatgtgtgtacgcaagagaagtatagaacttagagaaaaattcatggcgagcgtccatggccttcaggtctcagctgtcttttgtattcttgcttagaaacacgctgaacacggtagagacatttcttcttcagaagttacaggggaagcccttccatccgtgtctttgtcgatggataagtgcctgttcttgtcgcccgtggtgtagcataatggtattttctttagcacatcgctgtttcttctttttcgcgtagttattatcgctggtggtcatccgttgcagaattcaatcgggagagtgattccctaaggttaacgccacttatgtaggcccttggcgcctgcagcgcgaggcccttccaaattgcttgatgttgatgtccaggcactcaaagctgggatttgctacaacatttcaagaaactcacattgaagaaactcacagcgttacacaaacattcatttcattgctagtgccaaaacaatcaagcagcataggagaaaaaacatttttcaagtttcagcactgaaactatcgccaagttgaaacagaggttcaagacacaaataaccaacagatgcactaaatcttgcaaatgaaaagaaaaagtgggttcctagtgtttcctggctatctaaatcctctgcattaggttataggaatgaaaatctgactgtcgcaattctagtcccatgccctcgacaaggaaagatgagaaaatgaagtgggaaatatacatcaatcaattatatcctcactaagtgctagaatagtgcttctatgactagaacactaggaaaaagatttatttgatgaaacatgattatcacctgtttccctctaattaaaagcgtcttctgtagacctgcaagtaaagtagcaggatgatcattgtcatatacgatgttcctaattacaagagagatttttttttaattcaatcagctgttttttcccattcatgaaagcaaaatatggttgaaatgctactatgctagtaataatattctatgatcaacgagctctatactgaagttcacctacaaaatgaacagatgaagatatggatgacgccagatagtgaaggttatggcaaatgcattgaacgcccgaagaaacatgacagtaagctattactctccatctttcaagttcatgctagtttaaactgagtgcctacgcttaaccacatatcatatgcttcttgccaggaatgaacagtgcaacagctggttatataattgttaatgccaatggtggattgaaccagatgagactgggagtatgtacacatctatgttagggaaaaaaaacctttaaacatatcaagatgattacgacttccagctcacttacattgcttcaaaatctttcatgcagataagcgacatggttgcagttgctaagctcatgaatgcaacactagtaatccctactctggatcacaaatcattttggactgatccaaggttaatctctttatgaccagtataaatatactataatgagggtcctagagaaactactgggatatataactgatgttttggtcctaacatgcagtgatttcaaagatatatttgatgtggaacacttcaagaaaactttagagggtgacatttcgattgtggattccttgccactagcttataaaggattgaaactttatatgagagcacccacttcttgggccaaggtatggaccaatcactcaagtgggcatcaaagttatttagaaaaagacataatatactgcagtcgaagagttatgaactgctagttacttttctgcaggcttcttactacagagctttctcaaggacactgaagaaggccaaagttgtgaaattcacacatacagattcacgaattgttaacaatggtcttcccccatccatccaacgactccgttgtcgggcaaattatgaggcactaagattccacaaagaaattgaagagctgagtactgctctagtagatagactgaggaatggatccaatcattatatcgcacttcacttaaggtgattgaaactggaaatgttaagtgaagctgacataattttgctgcaaataatcttgcagatcagtaatgtacttccttttcttatcaattaacaggtatgagaaggacatgctctcatttactggttgcagccacaacctaacacataaagaggcagatgagctgagagaaatgagactcaacgtgcggcactggaaagagaaggaaatcaacagtagggagaggagactccaaggacgctgccctatgactcctcgtgaagtagctcttttcctcaaagctatgggctatccttccagcacaaagatctatattgtagcaggtgaaatatatggtggacatagcatggattcattaaaggctgaatatccaaacatatatacacattatagtctggcaacggtagatgagttagagcctttcaagctataccaaaacagattagctgccttggactataatgtagccgtccaaagtgatgtttttgtgtatacgtatgatggaaatatggctaaagcagtacagggtcacagaagatttgaaggattccaaaaaaccatcaacccagacaggtacagttctaggaatgttgtaattattatacctcaattgtaagagctgaattttttaactgattgtaggcagaagcttgtgggactcattgacaagcttgatgaaggtacactaacatggaatgagttccaaagtgaagtgaagatacatcatgaaaacagacttgggggtccatatcagaggttatctggtcgaagtcctaggcaagaggagtacttctacgcaaatccccttccaggctgcttgtgcaaaagaatgcaaaggattaaatgacgctgatttgttatgaagaggatgtgatattattgtcttcaaaagttccaaccacttccctgatgtagcatggatatacaaacacaaaatcttctaacaaagaattacactggtaatggacagggacagcccacagataattttcctagattaacagtgtatgcagccatcattcatagaaaaggaagcaggaggggcaggtccatttattatcgtctgagatctgcatctccagttgattatttattcaagtatacaggaaacggaagagtaaaaaagattttaaataccagcaaagcatagatgtgccagaagtgatgggatagcttgaaagaataccttttttagtgcatgtatgtagttcacacttcacacactccatatgtacagtctgtcctctttttatattttgtattcatcccaaaattgcagctttattcagataggcatgtatgatgtatatagagagagcaggatgtacccaagaagaaacaagtgatgaatggtaaattcttttttagtttatttcattccattgagtctttgcatttcaagtttgctttaggaatttgtgctgccatgatgccaacaaacattttatcactaagttcagttgattgttttggatttctatgctttgctccatttcatatcaatcatcctcgatatcataactaaatatcatccatgttgccagttcctctcaaacagagtactgttgttcttaattcttaaacacattccctgttaagtttccttgaatgtgtgaaactaagtcaatttcagaaattgtgacttcattctgattatttagctttatcactaacataaatgtgtgcagaaaaagaagcaccaatttagtgacatgggtcagtgggttagacacttgcatccctaccatggaagtcaataggtaaacatagctcttcaaaactgtaaagcaatggaagcctccaagtggcagacacatttttccaactaaaactgaacactgaaacaatatggaacggacgataggatgatacctgaaaagcctgtaagctgttttggtaaaacttttcccttgaccacctctgttgcagcactcatgaaatacacttgtatatcatgagcattgttcttttaatcacaaatgattaccagtccgccagtcaccacatagaaggcacatatacttgctccttcaagttctgggcagcactctcagtagggaatcctcgcacagcaccaatagtccattgcgaaatgattccggcagcaacagcgaatctcagattcctctccaatgtatcctggtcctcatacatctcaggacaagacgtcaattttctaatagcagcagcaacaacagcatctccagaacctgtccggtcagttgtgtatggagttatgagtgcatcctccgtcccaatcacgcagccatgaaacttgggtgtgtagtagtggatcctaagtgttccgtatgtcacaagcaagagttttatcccatcatgccaaatgggagcaatttcttcgggggtgtaatggtagtactgtggccagttccttgttagatgaaaaccatccagataatactgaggtggattggcacgcttatattgatagtactcgtgatcaaggaggaattccaactcatcccttgacacctctataatatcagcctcattccatgccttgtttatcaactcctttgtttcatcccttgacctccacaaaggcaatggcaagttaagatcaaagaatattttacttccaaatttcttggacagttcaattgctctgaagagtgtgctttccattgagggagtcaataggacctctgaattgaaatggaacactctagcctgcaattacagcacgttaggtctaaaattcatttttttttgctttccatcaaatcataaataaagaaaagacggtctacaatctactttcacgggcacataaaaaattcatcttctaaggataaacatcatataacagggtaaaatttgtttgtctttttaatctgcaaaactggttggcttggcaccattgtatgttcaactgaactaatgaatagacataagcaattgtgctctgtagtacactactcacatagagtcggtgtttttcaatgcaacaatgtaccgcagctgagcggtggatatccttgccgagaaataaaaatgcagcaatggagtatgcagaagtcaccaatttcaatcatttaccacaaaatcaccgactcacctctttcaaaacatccacattgatctcagccttgctgagggagtcctcggcagcgctcttcaccgtctcagccacaagcctcgttccgccgctgccgtcctcacggtcccggaacccgaccttcatgcgcgcagtggccgtggccgcgccgtcgtcgaacctgatggcgcgcgtctgcactcgctcgcagttcatgcggtacacaagctcgcggccgaagtcgtcgtcaccgaccttgccgagcaccgcggcgcggccgccgagcctggtgagcgcgatggccacgttgctcgccgcgctccccggcgcgcgcgcgaactccggaggctcccactgcagatgcagccacgtggagtatatgtccgggtgcatctgccggtccgacacccgcaccgtcgggacgaactcccaccgcggcgccccgaagcagcacaccagcggcggccagtcgtacggcgaatcctccccgtcttcggagtcgctccccgtcgcctccgcctccccatcctcatcttggaccgctctcttcgaatcctccgttccggggctcgccgcccggacctcatcctccttctccgccgcctcctgctcggcctcttgcttggatttccttgtccgacggccccgccgcttcggcggctcctcctcgccctctgaatcagactcctgcgtattcttcttggtcctgcgcctcgtggtcttcgccttcggcggcgacggggatggggacttcctgcgcccgcggcgtggggcgggttcaggggattccggtacggcggcgccgttcggggagcagcgaatatggcggcctcggaagatgctggggtggatgcgcgcggcgaggatggtgggcttggggaataaggatggcaagatgaggaatggggaggccgccatggccatagccggctctctccttcggtgggaagcctggtagaagacgaaggtgttcgactctatccagttcgcgttgaagggtttagcgaccgttaaggatgtcgggttgcgcccgaatccataaactgggttgcagccttgcgggtatggatctgagcgctttgtaggcccaacattgaaacggaacggtgctgcaccgctaactaatatgggccaaattcgatctcgacggccagcctgaagtttagatttgacagttgcgttggctcaagtatgaggttgcagtgagcgtctccaataagttcaggccggaacaaatttaccgtcaaggagcataactgcataagctgtgtactctgcccgtgactgaactgcagagtattcttgtgtgcatgcttgattcatttttccggactactgaaatttttcccaagatatgtccattattcgttgatccaaacatacatcagtacagaacaaagtcaaaaggataaagaaatagagaaatagctagggcctaggagtaacaaggacaccctgataaaagtacatgcgcatcagtacatcactagacaccaacaatggagtctcgccgtatcactcgacggggaccatgacctcgttggtgcgcagcggaggcagagtaaacggcgggttgtaccgcgccagcacgaaggggcccttgacggtgaacccgtccttctccagcgcggccttgagccactccgccttctccttcaccaccttgtctccggtcaggccgctgaacctcaccaccccgtacttcctctcccccacctgccgcagcaccacccgctcgtccgtcggccgcggcgcctcctccaccttgctgtacttggacggcagcagaaactgcattgtcatctgacccttcccctggctgcgctcttcggccgtgatcaccggcgcggtcatcgccaccggctcaggctcaccggaggtgatgaccggggccgtcatggcgatactctcgggctcgccggaggtgatgaccggcgcggtcatgtcgatcttctctggcttggtgttctgcgggttgccgagggcgccgatgtagttgccgaggacggtgaacccgccgtcgcggtcgcctttcatctccgcggggtcgtaggtgacctcggcgacgacgcacggcgggtacttgcggacctcgtagccggcgccggtgtggagcacctcgtgcttgggcgtctccaccgtgatcttgcccagcaccatccccatggcggtcgacggccggcgagatcagcgagcaggtgaaaattaaggtcggattcgatctcagcggcgggggtgggtttgttctttgttggatacttggatgagtgattggcggtgggcttggccgcttggagtttaaagaagcggcgaggaggcgggatgtgtggacgaagtggggagcctgaatcgcggcgcgtgttgctccacgtccgcggtgcgttttgtcttcggcttggcgggcaagtccagcactctgcaacaacctcgatacgtcctccgttggctttcgctttgactagaggtctagagccgctggcgcacggtattttgctgctttctggagttcatgggctggactttgggctttaccaaaataacaggaccaaatgagggccagacggccagtaaataatgggctcgacgctttcgaccaagttatatgagcatgtgacaaagttcggctctgatcatatatctattatattattaaaacagctttgaaaggagacaccatgttcactgtgggggctagaaattttcacattaatcggagaaaaataaaaaaaaagaaaaaggagagtccaagtagaagtacaatttaaaaatagctgaaattcgaaattaaaaataagcaatattgaaagaagtttctatataagaacccaatatgagattaatcaaaattcgaaataaaaataaaaaaatccaaaatcaaaaaaggaaaggagagtccaagtagaaatacaatttaaaaatagctgaaattcgaaattaaaaataaggaatattaaaataagtttccatataagaacccaatacgagattaatcaaaaatcaaaataataataaaataaaatctaaaattagaaaagaaaataagagtccaagtaggaatacaatataaaaatatctgaattcggaattaaaaataaggaatattaaaataagagtctatataataacccaatacaagattaattaaaattcagaataaaaataattcccacattaattggagaaaaagaaaaaaaagaaaaaggagagtccaagtagaagtataatttaaaaataactgaaattcaaaattaaaaataagaaatattgaaagaagaatccaatacgagattaattaaaaattagaataaaaaataaaataatatctaaaactagaaaaattaaaagagagttcaaataggaatacaattttgaaacaactgaaattgaaaataaaaaataaaaacattaaaataacacaatacgatattaactaaaattttttaaaaaattctgaaattagaaaaataaaaataagatatcaattaggaatacaatttataaataactaaaatttgtgataaaaataaagatcattgaaagaaaagaccatctaaaacacatgacgagataaattaagtaacatgcctataaagaagtagagtggtggcggttgatatgagatataaaaattgttaataaaacaccaaatagaatcctaatgacgattaaaaggagagacgtcaggcaggccatgaagcaaacgagtaaggcgattgccgggacttctagaaagtaaaaaaaaacccattgataatcatattcaatttttaaaatctcaatgataataaaaaggagaagcagcgggcggggtgtataagagcatagttgtagagccgccgacggttgacaggacttctagaaaataaaaaatgaattccaacgacagttatgttcgatttttagaatcacaatgtcaataaagagttggcggcggacaggctgtagaggggcattgtagcatcgtttgatgggacttctaaaaattataaaaaataaaactacaagtccaatttttaaaggttttgaacttctaaaaagtaaaaaaacccaacgataatcatgttcgattctaaaatctcaatgccaataagaagggaggcagcgggtgagccgtagaggagtacaatagcaaagccgctgacggtttggcggaacttctagaaagtaaaaaatgaacccaaacaaaaattatgttcgatttttaaaatctcaatgacaacaatgagaagagaccgtggacgggccgtagagtagtataatggcaacgtttgatgggacatctagaaattataaaaatgaaacccaacatgacaataaactctaaaaactataaaatctaatttttaaaggttccaagaagaatgaatgaaaatagtggtagatcgagcaagcaaataaagaaggagatgacataagggatagcaactggtgtgacttttaaaaactatataattagaaacacgaggatgataaggtttggtctttcaaagtcttaagacaatgaaatagctagatagctatttaataaattttaaataaaatcatacttaaaaactatatgattttgtttggatgctagccgctcaattgcgcgggccacccagctaatttaaaaaaaaacaaaaagaaaagttcggttctgattgtttgattccaaaaagaatgaagcaagaaaaataatttacatgtagaatccctcaaaatcaactctaaatagtaaaattcaatttgtggttgcaattgatatgccaacaagtaaacatagcttattcattcttttggtgaagtagttcgttccgtgagcctatgtgcaaatattccaattcttgcagcaatgaaaaatttcatgaggagctattgtagtaatccagcttacaatgagaggctaaaaggaggaagtagtaacaagacagtgacgaattggaaggctccagaagcccatcctttattcagtactgaaatcttaaaaagtggcgaacttcgaacatgattgtcctaaacacaagcaggatgagaaaagaatgaccacacgagcagtaagtacatggaatttgaatacgggcacgcctcgcacactcaaatctttctttttcaggtgaaaactcctatacccaatctcattcctggtatcatgaacttgtcgagtatactctgtatatacgcacataatctgtaaggcgttcatccatggcattttggatggtcaacaggaggtggagggagcagattcggggctggtccgttcagcacctcgaaaaccatggccagccccaacggcaggtgcgcgtccaagtgacagtgcatgaaccacatacctacagtttcatccccgatgcatggaaccaatcagaaatcagttgcaactcaacaactcgacagtcacttgcacggttgcaccaaatcatgtaaggtaaaaataaattaagcgccgcgggctcacctgggttgttcgccatgaaccggatcaccgcccagccgccggccggcacggcgacggtgttgcgcacctgcgggtccacgaggttgtacttgctcttcatcgacgggttgaaccggccgagcccctgcgccagcaggtagaagtcgaacccgtgcaggtggatcgggtggttctcggtgccgagcgtgctactgtactgctcgctctgcagcaccacctccaccacgtcgttgtacttcactttcttcaccgccgtcgccttcctgaacccctgcatcggcggcgggaagtccgggaagtcctcggagtacacgcccggtacgcccttgtagagcgcctcgagtagcgacaccttctgatccgggaactggaacgagttcctgttcatggccgccacgagcgcgaacccgctgcacttcgtctggttgggcgcgcacggcgcctggtccagcccgaacgtcaccaccatgttgtggtcgacggttgttggcacgcccgggtcgctcgggcgcgcgaggccggtgagtgaccagtagaatctgccggcggtgacgacgtcgtcgtggggcggcagggacggcatggccgccggggcgtaattcggcacgcccttgtacttcacgatgcccgtggcggtggactggtcgaacggcacggcgacggtcttgctgtcgaagacgtgtgccgccatgtagtaccgaccgggcgatgctgtggtgttcatgagggcgtccaccgtctggcccggcgcgatgacgatgacgtccgtggcgtatggtttggtgtagctggcgtcggcggcgaccacggtgaaggtgtggccggccaccttgaagaagagctccacattgactgcagcgttgatgatgcgcaggaggcaagtcttgccgtactccacctccacttcatacatggcggaacctaatgtgttgcacacacacaaaaaaaatgcaggtcgggaaaatgttggtcacaggtaaactatctaatacgtgctggtggagctgtacctttgcagcgattctggtcacctggcatgccgttgatggtgagcgcatctgaaatctgaggccctaagccggtcaggtacccatcattctccacatcgtccacatttctgttccaccactcacctgccagagaaaacaacaattacgtaatatcgtgacgagccacacagcaaaaatgaaccatgccacattgccaccatctctccatcgtgtatacggtactagttcttgcgtacctagtaggatcgggatctcttcatatggttcagggaacgggtacccactcggcccattcctgggttttatgatgagcgcgccgtagatggttgctcggaggagcgaggagtgcgcgtgccaccacagcgtcccctcctggccggtgatgttgaaccggtacgtgaaattgccagaaggctggatggggcattgcgtgatcttgttggccccgtcattccaaccactccggagctggtatacaccgtgcctgcatcaatcaccaccggagaggaaacacatgagttttgggccggtttgtccaggtgtggtaggccggaagcccagaatgattgagggactatgggctgtgtgggctggatatgtgaggcccacaaacattggcagtctgttgtattcagatcacgccccctgtttggcaaaggaaagttcagagaatgtcaaagcgcttaccaatggagtgacagagggtacggtgagtcgttcacggcgtggacgaccagtgtatcgccttcggtaacctctatggtcggtcccggcagctgctggttggccgtgtagatcacactgttcatgcatagctgggtgatcttcgtaccgcccacctgaattcaggtatacgcagaacttagaaagacatagccgtggacccttgcaacactccactccaaaacgaacaagcaccacagccacaggtggagcgacgcgcgcgaaagccagagtacagtacataacgctggatatatacgaagagagcaaacatgcacacaaacaagtttctgggcaggaatttttaccttgaaggtgtgctccacgacggccgcgcttgctgctgccgtgcagagaaccagcacgagcggcacgagcatggctgccgatgccatggccggagtcttcagtagcaactggagtagcaaagttgaggagacacaccgccatggcgcgcgcgtccttaagtattagcacaatagtacatcctattgaactgacattggaactagtctatcttattacttcttcttgcagaacgacgtatgaaacagcgtattcgtgaatgcgtacgtaagtctaatgaaccgattccacttggccgtcatggcgtgagagctttagtaacaacgaaatcagattgcgacggcatgagccatggagggatgctgttttcctcgaaaacgcagttggattaaatcaccattacagtatatggcacgtcatgaagttggtaaaggaagaagtttggctagatgtagcatctatcaattattctaagtgtgtatctgaggtcaagagcatccagtagaaaatttctacacttatacatattgttttactaaagctccatctagcacgtatagtacgtaccgtctcttcagttaaaaaattcaaataattgagtttaataacaacgtggatgacacattcaacaagaaaaactcgtagtgtctgcgcatgtaccatgtgttttaaaaaacaacacacactctcgcacacgcgtacaaaacttccatcaagttctgactaaatggtggactccacgaccctacacctcctggccaaatgtaggctaacaaagagaatatggacagaaatccagagatggacatgcaccgaccttcagatgggtagttgggaaacttgtcactctgttgggcagtggtggactctcgtagcggagtccccaaacacccccgcaagcctctaaagactatgattatcctagtctcgtgggaaatctggtgcgaacacaatgcaagaattttccgaaactctgcgtcatcaccgtcctcaatcctagcaaagatcaaggaggaaggaagagcatgggtcaaagcagaggcaacaaccctacaggagtttggaatcctgggagatatcacttagctcttttccttttttgcggggtagtctttttcctcggctaaccctatatatacccttgtttatttttctcctgctctattaatatacacaaggcaaagcttttgcctttcttcaaaaacttccatcaagttctcgttactaagttaagtatcaaaacaataagaaagctaatgcgtatcatagagaacatagacacaacggtgaatatgggacgttcatgcaagctaccaaagttgctcaacttctctatacacttagggccctttaaatcgcagaattagaaaaacacagaattttgacaagaatacaagtataaagaagaggattgcaaaacatagaaaaacacatgaatgaccgtttgattagatcacaagaaaaacgtatgaatcagataagagagatatactcaaagggaaatttttaagaggttgaagttctcggtaaatttcgtacaaaatctctataggattgttcaatccataggaattataaaagatggagtatgattcaatcctttcttttaaagacttcataaaaaaatttcatataggattgaaacactctaaaatttcttttctttgttttttctctaaatcaaaggggcccttaaaataaaggggcccttaaaatgttagtctagctattgcaatgcacgaacatactactatcactactactgtaaaatggaaatggtaatttcatttatccgctaccccttgaacgcgattccacgtgatttcgggagttaccgttcctcttcccatggccaaataaagaaaatgatcagataaaaactcatgtgaccgataaaaaatgatagacaacttaatgggtgatcgataaaaaaaatggatacaaaattggatagcaaaaaccaaaaactaaacccccaccatcaaccaataaaaaaatagatataaataaaatgaaccgctccctaagtagattcgtcggcccgtgcttgcacaaaatcccattgcaatgtacaacatgctgttctttttgtcagggaaagcctagtgtgtgtttactcataaaaatatcatctggtttttgtgggtcttaattcttaacaaaaacatttttgtagcattagaaaaagaacaaactctatatttaaatgtttggactagaatactcaccatgcatgcctacatggcatgaatactatactatatctatataatactccatttgttttatattataagtcgtttgactttttttctagtcaaactttgttacgtttgaccaaatttatagaaaaaatttcaatatttaatttttgtcaaattagtttcattaaatctagcattgaatatattttgataatatgtttgttttgtgttgaaaatattactatatttttgtataaatttggaaatttgataaggaaaaaaagttaaacatcctatagcgcccgttccgtcgtggcgcctagcgggaaaattaaattcttaaaaaccctaattgcaaaatttgttctttgagtgttgtcaagcatccgtgccattccggatctcaaaatccccgatctatcgtcaaattcaaatcccgaatccaaatctttcccaaatcaaattcctccgcaaaagtctaaaatgcctccccgtcgtttggtgggccgattctctctctctcagcccgctctctctccccccctcagctccgtctctctctccctcgctctgcccgtgtgccgcacgcgcgtgtgcgcgtgcgccgagccgagcgctctcccctctctcgctctctctccccgctccatccccagcgagctccccacccgcaatttcgaatccgcgtgccgttgcttcacgcgtgcgcccgcgcggtcgccgccgtcgtcagccacctgctacccatgcctacgccgtccggccccgcgccctaccgcgctgcgccgcttgcgtcgcgccttgccccgcgagccagcgcgcgtgcccgagccgctccacctgcatccgtccaaaaaccggagacagcgcctcccgctcccatctctctcccttcccaaatcggcatggctcgagctccctttctccccctctgttttcccctttcctcactcggcccggcctctgtttctcccgcttggttccagcgccatgggcagggaggagcgcctgacgccgagccatcgcccatgccgtttgaccccgcgcccgtgagcccgttccttcccctcgaagctccctcgccccagtaccgctcgaggtcggtttcctctcctcccaaaccgacataaccaccccataaaagccgcccctccccctctcgctcgattcccctgtttcgctccaagccgccgagccattgccgcctcgcccgtgccctgcttgctgtcgccttccgccgtcgcgtgtgccggaggagccagtgcgcgctaggaacggaaggggactccgggcgcacgtcttcctcctcttccccggcccgaggccggagcgatcacgccccgcgccgtcagccatcgtcactgcgcccttcacctcgtcgcggtagtgcactccccgttctccctcctcgttcctcctcctgcccctagctttcggtagtagcacgagtagacccccgtagtcagctggcgccgccccaagccttgccaccgcccgctgtgtgctcaccgccgtcgccgcccgagctcggtagcgcctctcgtcgccggcctccctcggtgcgtttcctcctaatccggcacaaggaatggattcccggagtcgcgtagatgctctagtgcgaaggaatcgaactcccgtcgcgccgtcgccatttcccccttctcttgccgccggttgccaccgccgcaatccgccgccgtcgcactccctccggcgaatccgagcagttagctcgtctcctctagtctcgcgctacctcccggtgtgttcgccctcgcccgcatcgccgtatatcgccccgccgctcgccgccgccgtcccccgtccgttcgcgggcgcgtcgtcgtcttcctctcgccggtccgcgtggcggccacgtaggcgccacctcggcgccacctcggccgcgaccgggtcaagatgaccccggtccgccgctcccctccgccccgctcgtgcgcgcggtccactgcgagccgtgaggctgcgtgtgggcccgccgcatccgcatcccaccgcgagccgcgcgcgtgcaccgcgccccctccaaaccctagcgccgcgtcgcgtgctcctcactcttggtgagccgagccgccgacaagcgggtcccactcgggaccacgcgaggtggacccggcccaccggttccccctccctctctccctgcgcgtgcccttgggccgccttctcgggccggccggcccatttagctcagctgagccgctctctcctctcgggccgcggctatcccgagggaagtctaaactcccttcctccttcttttctttttcaaaagggtttaattaaatcctttttcctttagaccaaaaatccaataatcttagaaattcaataacttctcaactgtacatccgtttgactctgttcaacttccaaaaatcctcaagtctcgagatctatctaatggcacgcttagaggtcaataatacggctttattttcaccgtttgttgagttgtcccgtttcgcgtgtagtttcggagcccgaagacccacagcgcgaggatttcgaggatcaagctcaagatctcgagcaaggcaagtcacctttgaacattttgcacctataatttaaatataagtatttcttttccgcaaatattgcatgaataggtttaacacacgtaattcggccgcggcttgcgagatagcctgcctgccccaaatcctaaattgctgcaattaccctccgtgaattattgaatacctaaaactcctttgtcgactgttgtgcttcgatgcacgggccttcgggcatgggcatcggaacacctcccctcaaatttaaaacatccaacgatgggtaaaacttggggtttacaaaagacttggaaaaaaaccctgatacctgggtcggtgcttgcgaactaaatgaatttccaaaatcgcagaccgggggacgtaccgagagtacggtttcccactcttgcactaaggaccgtttccttggaatttcatccgaacataagacaagtgcgaccacatgggtgtaatgggacgcccctggctgagtaattagctaatcgggggagccatgatgccaagagacatgtggattcaatggggtggtgccggggagaacccctaggtttcctgacacagtatggtctgggacctaacctggtgttggtctggacccctcttgttggcatatggtgaacctgtgtcggctttcgaaatgccttgtcatgaaagcctcaaggtctccagacgtggccgttctgcacgggctgggtgatccgggttagtaatgtcgtgtgggtaaagtgtaccccctctgtagaggttattaaactgttcgaacagccgtgcccacggtcatgggcggatgtgaggtgattcctagcgtagttttgtttgactactgcttgtgaaattgctgatgtggaaagggttcgatgtttggaaaaatctgcggctgatgggatcagccaggcctgggtggccgtttgaaagctgttggccgggtgccaacctcgatccaatcaaagactgatacattgcacatactccgaccggacaagacgcactgtctcatccgtgtcgtttgagaagcactcacttagttgtttcaaaagggggtttaaataaaatcaattgcacaaacaacagcctttcctttgaagcctgcattaaatacttaattcccatgtcttgctgagtactcctgtactcacccttgctctacataaataatcccccccagttgctgaagaagatgaagtaggtctcgctgatgaggagttcttccaggagcaagtcggctacgatgagttttagggtttctgcctagttctcaagtcgcgcctgtgatgaatggtccaagtcttggcttccgcttttccttttgtaatgcagttgtgagttcgggatctgtccgtagcccaacatgattgtacccctactctgtaataaggagacctctgttgctgtgataatctgtcttcctgtgataccggcactgtttcctgggactggtatcgattaacaggttaatttggagagtcacgggctagttccgttcagggctagttcggggcgtgacaagggttctactgttctgattgcatttttgtttcacagtttcacaaccatctgtgttctatattagtgttctacatacagaggaacatgaaaggctcaaataatagtcatccatgaatggacctgaattctgccaacgtcacacgcatactttgatcaagtcagggaaaaaccgcggcgatgaaatagcacatatatataagtgacgcattgacatttcgttttgtaaggtaatgtcccattgacaattggcgataagattggcacttgaacaaaaatataattgcaaatgggccgagggtgtcgtgagcttgtgactcgtaagacgacgtcgtcctttggtgaaaaccaatcagagcttgccctcctggctcctgctaggctaaatggccaaatgcacccctggcagcttatctaaacacaggaatctttagctgaaaactaagaattgcaagcaaaccaacgtcattctcccaaatcgttgcttaattggtatcctggaataaattcatgtttaacacagtcaaaggaatctgaagtttgacatttgttgctttacagtttacacgttcccccggagaggaaaaaaaaaacagacctctttacagtttacacatgatacacatacacagaacaaataaacgaacggcactacctcgtttcgtgcctcctgtactccatttacacaaacacaagaacaaatatgaagtaaaatttggctacgaaagtgcattacaatttgacaccaacgccagaatcttgcaggttctagcacttcggcagatcggcaggcggcggagggaggaaggagtcaggcgtcgtcccgttatccaccgcgaacaccatgccgagccccatcggaacgtgcgcgtcaaggtggcaatggaagaaccacatgcctgcgtccaaagtccaaaaccagcacccgtcattttcagcccatacgttaggcccaaacagcccatctctagtttgggccggagaaatacgacagatttagcgacagtaggattcctacctggattgttggcaacgaaacggatgacggcccagccgccggtcggcacggcgagggtgttgcgcgaaaccgggtcgacgaggttgtagccgctcacgttgcccggcgtgaagttgccgaggccctgggccagcacgaagaagttgaagccgtggaggtggatcgggtggttctccgacgggaaggcggtcgggttctgcagcacgatctccaccgtcgagttgtacttgagcctccgcaccttggtcccctcgaccatcggcgtgccgctcggctgcggggcgtccgggaagtcggcggtgtacacccccggcgtgcggttgaactgcgcctccaggagggacatctgcgacgggaggcggaacgacacgccgttcatcgccgccgcgacggatttccccgagcagctgctctgtgtggagtcgcacggcagctggccgaggcccagctcgatggtcatgttcacgtccaccttggtcggcacggccggcgcgctgggagacggcgggcccctcagcccgaagtagaaggcgttggccgtcgcggagtcggagctctggggcatggtgggcatgacgggcgtcgcgtttttcttggtcgacgtggtgttgtagtgcacgatggccgtggcggtggtgtcgtcggttacggccatggtggtcggagacaggctgtcgtacgcctgcaccgccatgtagtagctgccggccgacgcgttggtgaccatgagcgcgtccacggtgtgccccggcgcgagcacgagcgtgtccgtggtgtagttggcggtgtagcacgcgtcgacggccacgacggtgaacgcgtggccggccaccttgaagaagaggtgcgtgttgagtccagcgttgatgacccggagtagcaccgtcgtgttgggctgcacgtccaccgtgaacgtgtcatctacgaaccaattttttacagagttatttcttcgatttgagcagaggatttacatttttcgcctgcagtaaattaaactgtgtcattccatcaggatttaccaaatgacgtacgtacttgcgcattggtagagctcgccggtaacaccattaacggtgaacgcgtcggattctctgggaagctggccagatgagacggcgtcgctctcgatgtcgacgacattccggctccaccattcccctgtgtccaccaaggcctcatccagaatcaagatatgcccaatttccgtatcaatgcatagtacgacagctaggagattcggcggctaccaagcacgatggggacctcttggtccggcgcggggaagggataggcggagccgtttcttggccggatgatgagagcgccgtacacggtggcgcgcaggaaggaggagtgggcgtgccaccacagcgtgccttcttgtccggtgacgttgaacctgtacgtgtacgagctgttcggctggatagggcactgcgtgaccatgctcgggccgtccgcccatggcgtcagtagctggagtatgccatgcctgtaaaattttccaccagcagcagtcacacgtgcaggggttagacccaactctgcttatgccaaatggttaggttaagtgtaccgaactaaattgagctaaaaaaaaaagtgcactgaattgctgcactactccctctatctcaaaatataagcatttttagcatagtgccaaatcaaatatttgcaatcttaactattaatagaaaaaatataaaaaagattaaaattgatgttattagatttattattaaacaaactatcacaatatgcaactttttttatttaaaacatactatatattgttggtcaaaatagcatctcgaagactgtgttgaagtccaaaaatatttatattttgggatggagggaatactacttttattttcaagagcaacacaagcagcctgacaatcaactcctagtagcatgcgaaatgcagaaagtctttgcacttattactttatcagcggcatactccctccgtactcgtaaacgaagtcgatttggacagcgacacggtctccaatatataactttgacttcttgtttctataaaaatatttatttaaaagtgatatatgtatacttttatgaaagtatttttcaagacaaatctattcatatgatttttacattttcaaattcaacaacttgagagttattcatgattttttttctaaggtttgacttaaacattatcctaaacgactttctttacaagtacgtaggaagtatctttcatgacatccaattcgggaaaatttataaaaaagatttaacatcaaaggtcatgttgtcagccaaatttattatttttctccttccccattctataaataatacgcacgcttcctaaactcctaaatgttatgtgtctgcaaaagaacttcaaatatattaatttattaagatattattttaaatccacttaccaactttatgatatttaatttgttcatttgtatcctctgataattattaaaagaaacaatcagctattcagtaattcaaccattcagcgcaaaagggggattttatgagacaatagattagtatcatgacaatgttgtaaaatatttttagaattttttgttgctataagattgatatctaggaagaaacatacccttatggtctttaacagtcacagtcacatattcacatatctttcttgcaagtgattttcaaggcaactcattggacaaggttttggtttttgtttcttaaagaagacgataaaatggaagttcaagtcaaatgaagttttctggataagagagtaatagagttcttttctacctttggttggaattttagtagaagaattgaggcttagactgatgttattcttttaactattttgttaaactattatttggtatccccatgtagtgggtggagtcttatgtacttttaattgcggtttaggctgtgtataactttctaaggtgtagaggcctggttaatataatccattataaaaaaaatcacctttcttttcagaaaacatttgtagtttgcattggtgcagttgagggtatattgctccgtatctctacttacgatggtttaaattctagcattttttttaacgactcgcacaaaacggtgcgaagttctattgatagagcaggaaatatatcctagcatctttaagtaagaaatttttgaggataatactttgtctctaatatgtaaagtgaacgttttcttatatgtgtggtgtatgaacacttgtatctccagtataattgaaacatgactttttttcctatgctttattttaaacttgtaacagttatcagctgtacaacacttggcaaatagtaagatgagctttcgtacatttaacggcttaattggcatcgtcaggtagggtgtccttttcaggactttcactttcggctctaatcatatattcatatatagatatgctcaagagttcgggtaggaactactaatcactcgtacttatcaaaggaccagctagcccccgaatctaaataactagcccgattgcaggactctcacgccatcccacatgctactacaaagacgacttgacgttactgcttaaaatgaagaaaaggttacagcaacttgattaccggaagtttctgaggcacaaggattagtgacgtaccagtgtatggttaagttatatggtgatccgttgatgacctcgacagcaactgcgtcaccttcattcacttctatcattgggcctggcagtaggccgttcaccgcaataatgtcagtgctgttgcatagccgactgactcgcatgctttccacctatgtgattgcaaacaaatgtggcatcagtcttatatacagacaaccgaactcttctcatactactactgaagaaattaaggaaaaaccaacaaattgtatacagtttcaggtttatgaattctcatgctttccacacacaagttgatcaataactctagcttgcaggtatagcaagtatctaagttcttgttgctgtacaaagcttcttgaaatcaatgacatgaacgaatacaactacatgtatgcagagagatgagatgatgatgatgatgatgatgatgatgatgatgatgatgagagagagagagagagagagagagggtacagtgaaagtgtagttcgcagttgcagcatctgccaccgatctggcaagaagaagcgcgaacaagaaccacaaaagccgcatcatggacgaacaccaaggtataaccatctaagaggattcaggagcgccagagaaggataggcaaatccttattggtgatcttggccaacttgtatatagcaaagtcttcagagaaacacgataagtatatatactatggaatgcttttggcacttccccgagaatcacttgcgtagggcaatggcacatttgtctatttttttctccgattgcgacataaagcttctagcgatatcacacgctcataatctaggtgttgctgacccctaattatttatgtggcctgataaaatgatagagaaagcaatgccactcgtcaattgctagcttgttcactgctatctttgattgcagtatcaaattcacggtctatcaacctgaacattgtcaattcctctttcttggctagcattaccgccacgtccacaaaaaatgccgttttcatcataatcaatcaggagttttactattggacacactaggtatatagttttctgacgaattatgaggccaacgtataagctaaacgtgtaacaggaaaaaactggctgagaaaacattagaactaatcccatgtctcaaagtgtccttatattactcccccatctggatcaataaaagcagctctcataatagctgaggtgtaccaaaagtaccctgaaccaagcattccttgtcagtggtttgaatatcggatcaggagaagctaattaggacaacaatctactcattagtctatcatgtcacggatttgggcccaagcaataatattctatacaaattctgcccaatgaattaagcaacgaattcttctgatatagtgaagtaatgcacaggatggatgcataaccggacaaacagcattctctagataaccaatacagcgtgcatatgttgataaagatgacacgaaaacggaaaatgacctgggatcatgtggtagttgatcatggaggtctatcttgacgagataacgttatgatgtttatacatacggctatacggtgtagagctcaggaaaaaaaaaacaaaacaacactcggagtctatcttgtggagaccttgttttccctttgcatgaatgccagggaacatccagaagtaccatctccgaataaacgattaagttctgaaggcatggacacgatggagacctctcacctaactgcaggatgtgcgcagggtcagcatggttgccagaagcccagaaccatgcggaaagcaaattgaatttgctcgtctgaaacatgcacgcagttcatcagatatgcagggagcgattgttttagcaaggggtatgcatgggtaattcagtgaattttgcttttgtgaaagaaatcaggagcacttccgaattccatggaagtgggaaatgatctgcaaaaagctttacatagatacaagatcacaaggcacaagctcttcagtgattcattatctaaaaaaatttcttcactgattgtgttcctaggaaaaatcacgtacatgaatttctgcttttcttgtgatttgttgttatttactctttgattctgacccctcttatttacatgttaacgtgcagaactgcagaatccaggaacgatcaaatatcaacacagaaaagaaggtaaaactctacggataaaatacacttgcaatcaatcggaatcgaattgtcgaaacaatgtatctcttcaaagattaccaagatgtgtatggaacttaattgtcatctccctgtcgtccgaagcattttacatcatgatggcagcccatctttcaccggatcgaagaaggccagaactgaactttcagagagcaaccttagcagctagtagctgccagctagcattgcggcaagtcggggggcggcggcggcagcgtcgtccccggcgtcggcccgctctccacctcgaacaccattgccaagccaatggcgaagtgagaatcgatatggcagtgcatggcccacattcctgcaagcagaaaaagtttccaactaatcagaacatgcgttctttactctgtttatccccttgcaaaccgcaacaagataagcttcttgacagtgcaaactatatcaagctgataagattcttgagatgacagaagcataatggttagtgacttagttggcttcttataaaaggagaagataaaccgtgagtccgtgattgcgtatcctacacaccatcagtacgtcagcgccgagcgcttcagcatcggaacttctggggaaatttaactatttgccacttttgggatatagcaattaacaatttgtcactcactatctatgacatgtagatctagtggcaaatcgttaagcacgccccgaagttccccgcaaaaaaaaaagccccgaagttctgaacgggccagattacttgacattatctatatttcggcctgacaagactgggctgaaaacggcccatataggcccaacataatatgcacggatgcaaaacagcccaaagcttcaactttgtgcgaactcaaaccggtgttggtctcttttaggcccaatttggaggggcccaaatcccaattaaactttacctgtttactgcagccgtaaacgttcatatacgaagttgattacagatgactactgtacctgggttatcggcgacgaagcggatgactgcccacccaccggtcggcacggcgacggtgttccgctcctgcgggttgacgaggttgaactcacctgctccagccgcttcgccgtcgttgttgccgaacccctgcgccaccacgaagaagttgaacccgtgcaggtgcatcgggtggctctcgagtcccaccagcgcggtgttctggagcaccatctccaccgtcgcgttgtacctgagcgtcttcaccttcgtcgacgggctccccgtggatgccagaggcgagttaccgagcaacccgcggctagtgtagtcgaacgcgacgggcggctggtcggggaagtccctggtgtacacgccgtccgccgtgttccggtacagcgcctcaagcatggagacggtgttcgggagagcgaatgacacgttgttcatgttcgccaagaccaccggggcgctcctgttgcactgcgtctgttcgggctggcaggaggagaagccgagcccgacggtgacgagcatgcgggtgtccacggtgagcggcacggtccgcctgccggggcggatgagcgccgtcaagctggtgtagaactggttagccgtgtacgtgtcgttcggttttggcatgacgggtagcacaggggagccagcatcggtcgttgccgtcgcgtcgacgtactccacgatggctgtgctggtgttgccattgaaccccgcgggacgcggcgggaaggggatcgcgctctggtaggaggagatcgccatgtggtagcagccgggggaggcgtcggccgccatgagcgcgtcgacggtctgccccggcgcgatcacgatcacgtcggtcgcgtacggctccgtgtagctcgcgtccgccgcgacgacggtgaacgtgtgccccgccaccttgaagaagaacgccgtgttgagcgcagcgttgatgatccggagcaagtaggtcttgtcgcggcgcacctcgaacttggcaattcctgcacaagaacgtacttgattgttgcagaacataatcgtcacacatatgcgcgcgtgatactaactcgaacgtacggttagtcgtctctggacagaggtacgaatctcccggcattccgttgatggtgtacgcgtcggcgttcggcgccggtatgccggtcgagaaggactggctctccagggcgacggggtcgccgttccaccactcccccagcaagacggtcttctcctcgtatggcgtcgggaacgggtagccaccggcgcgcctcggccggatgacgagggcgccgtacaccgtggctcgcatgtacgagctgtgcgcgtgccaccacagggtgccctcctgcccggccacggcgaacctgtacgtgtaccggtggcccggccggatggggcactgcgtcaccatcgccggcccgtccgcccacggcgtgccgcgctggaacacgccatgcctgcacgtacgcaccgttcgccgcgccgtttgttagtttgtcacacatcgggcggcgaggagtaggtgagatacatgtaccagtggactgtcacgttgtatggcgagtcgttgatgacgtgaatcaccacggtgtcgccttcgcgggcttcgacttggggaccgggcactcgtccgtttacggcggtgacgctcgtattccctggctgacatatacggggaagagatagtgtagcgacctgacaaaaatcatatagaaacaatatcatgagcatgactgttaagactggggtttagtaccataggcaagacttgagaattgacagagaaataatgggtttctagtgtgtggtacgagaatattagatatgaggtggcaagctgccaagctgacaattttcttggacgctcgcatacaaccgcgctacccgcttgtcgagaaagtttaaatcttctctctcatttaggacatattcgagcaaacttttgaaattgtgatcatcaactttgaattagaaagtttaaaccacgtaaagtcgttatattttgggacggaattatagtaagtttgtgctatctttgtagtacttttcaaggtaaactccacattttttacaactaagcattttagaagatattgattgtaaaagttttgaaagtttaattaaatctaattttaaacataaaatattattgatcagaggtagtaatcatggttccccttaccgtttttggcgcagttactgcactcccgcggtaaggcggttaccgcgtgaaaaccgcgtgataatcgcgagacataccgtggtttcaaaaactgaaaaggttaccgtgcatggtaaccgcacggttttaaaaaccctggtagtaataaatattagttgtagaaattttgttttggcaacttgtggtgtgatgtcatctactagctgttactccctccgtctcaaaatataataacttttagctctcaggatttgtcccaaaatataacaacttctccactaacattcttttcctaactaatcacaaccctccatcattcattttccccacctaccttcactactcattcaatcacaaccctccaccactcacttctacttactttcttaataactgtttccaaccctaaaacttcttcttacattctgggactgagggagtacaaaatatcagatgttattgaaaaatgtatcttaatattaaaaaagatgctagaaaaataattccaaaatatataaaaaaggaaaatatgatcacttaaacttatcacttgtctttgttgcttctccttgatacattacttgattaaatattttttccatatatttgttattaaaccgactataaaacaattacacgttcgtgacgttccttggttgtgcaaactttctcctttttttcccgactacatagaagatacacacgtcactacactaagtatgtacatgagtacatgacatgcacacacttgtgagtgcacctgctaacacaagctctgagggatggatgccaactacaaacccttatacgtattaaattcctattaaaaatatactcgtgtgtgtaatagttttcatggcactatttttttgttgtgcaaaggacaaatgaacaattcaatgcggattttgtttgtagagagagagagagaatgattacattgaaggtatgctccacgacgtcagcttgggccgcggatgcaacaaaagccagaatagcgaacactgggatcatccaagaacacgacatgccgtatgtttgattccaaggccaaagctagctagcaactctcaatgatatggtgaacagaaaaattgatctggaccttactcaaaatctgaaaaaaggacttttttttttttttggggggggggggaccagaaataacacttaccagcagtgattgtcgaagttaaggggatgacaaaatgcagccggaatgccgctatatatatagctgcccgatgcccctggttgacttgatcaatcaagtattggggtgaataatgctgacttgcgtgtcattttgttagttcaactgcaacttgttgaatccttctcatggaacatgaagtttatggatgcttattgcagagtacttcctatttattatcagttagaacggtttcccaagtcaaggctcagatatagactgactcatattgtttacttttcactgatcaaaatttaaaaagaaaaggtttaaaagtataacttatgtgttttagttatggctttaacaactaactaggatcatacatatccaaatgatgaccatagcattatatttttacaatttctatcaactactctgctaacaacttcctagacatggacctgggcttattgtaacgactgataccttgtttgctgagagtagaataactcaaaacaaaaggaattttcaatgattgatggctggccatatatcaaggtctccagcgtacctttactagaaactaggaatagcttgtatgcttgggcatctgattcaagttctatctagaagaacttctttttagagcgactttttaatttttatccatactacatttcttctgtactcatcacgacttatattttattttaattgaacagtatttactaaccttacagtggaagttacagttttgctttcaaggaggaacccacttcgaagttcaaaagaggactactaattgacatgcgaaatagacaaaacaaaacaagacaaagtttattgaaaatttatatatttatgcagtgattgctactacccttgaaactttacagctagtacgtgatgttgagagaatacaagacatttctacagaataccaactacagagtctgatttctaaccccttgccgactggtcaagactaggtgaagcaaccattcagccacctagtggatttttcctatatgctgtaaatatttatcaaataatatttgcacgcgttcagtttaaacaagcaccaggagctcatttgtgttcgctgtcacttgcaagttgcagagctagtttgagctagactagagtctcgacttgaattctcttcagaagtttcttcaggaatttatataagcaatttttgcatgagacatttacaaacaatgtattgtttttattttttttcttttaactctgtatgtattgttgattactactccctccgttcaggttataagacgttttgactttagtcaaagtcaaactgctttaagtttgatcaagtttgtagaaaaaagtagtaacattttcaacccaagacaaatttattatgaaaatatattcaattattgatttgataaaactaatttaatattataaatattactatatttgtctataaacttagtcaaacttgaaacaatttaattttgaccaaagtcaaaatgttttataacttgaaatggagagagtacttcacatgatttattctttatcgtaatcttatttttattcttttaagataacaattcggtctttactttagagaagctttagtcacctattacaatgttttagtctagacaactccaagttatatatagcagacaaccgacaggatagcaaaaggacacaccaccatataaacagagatattacaatctccatatatattttttttagagaatggtattttttacccggcctctacatccaatcggatatatacggccattgaagtagggaacttagccccgcaaacaacccaatctgaaattcgctccataagagatttgaaccaaacaacccaatctgaaattcgctccataagagatttgaactcaggaccttggggtactactcaggtcactgtaaccactaggctaaatctctatatatggttggcaaatatctctatgatcgtttctctaagctttgacatgcttgttgcataaacttcttgtcattgtcacacctttttagcataactcaatatcgaagccaacgaatttttttgagaattaatattatttttatggaaaatcgcaaaagtagtggtcaaccggggaaaatcgcgaaaataggtccctgtcgaacgggtgcagttcgatagggcgcctatcgaacggccagagcgcgactggcgacgagatcggaaggctgccgttcaacaggacctgtcgaacagcccccgttcgacaggcagggctgtcgaacagcccccgttcgacaggctgggctgtcgaactgccgcagttcgacaggatgtccgtcgaactgccgcagttcgacagggtcgcgttctccatttatttgtaataagttatttttttaataatatgtaatttattttagtgtgtaagaaaggaaaatatttttgtaatgttatatgtatgtgatttagggttttgataatgtttggtcagaaattgtagtatttatttgttggttaaaatatttgaattatttagtttcattatttgtatatttgaatgataatttgtcatgattcattcgaagggtatgctactgagtaattatccgaagaagtttatgaaatagtactgatagtactaagttaatcgtaaagtgtttctcaaatagtacggacagaacataaatgactaaaagtttaatacaaatagataagtcaaggacgataagtgcccttcgcacgcttgctaggtcctcccttcttcctacgcctaatctgctcagtgggatatgtcaaattatcaggggggtgcctatctctagctgcctgctgtggtgtcacgtctggcccctgaccggcctccgtctcctgcgtcggctgtgtgacctgaggtgctgcgtgccagtaatccatccctacttccccctggggaggatcagtggaaaagaagtcctcaatgaatgctgtgcgaggggagtaagcaggcactccgtgatgcgtcgacgccgaaccatactcatcgtctgtttgtacaagagggagaaaccaaaaaatatggcgtagttagtaacgatacatataattagaaactaaagcgtgttattgtttaaaatgacttacatgtgtgctgtgtgtggccctgctctggcgcacgcggagtgatatgaagtccccatgctggtgtgttcaacacgttgtcccccgttggcatgtaagggaagtgtgccgacccagatgctccctgcgaggggtgaacataaggcggagtttggaatacctgcggacgtggtggtgccgtgctcgacgtgggtacccctgatccggctgaccccctggtgtactccggtgctggggtgtgctgaaaggaaggacgaccgtgagatgtgtgggctgcttcgtacccgcgacgtgaagaggatggaccactccgatccacgctggaacgtcggggtagtggtggtgatggccgtcggcccgacgtttgcaccacatctgccgcgctccgacaggagacacgacgtagtagtgcggcagcacgtgcacggaagttgcgaaggacactcgccacgtcgtcagacctgacgactggaggtctcgcctctagtctttgcagcagggtgtcggactccacgtgaacgtgctcaacaaattccgcctgttccacaaataatcaaggcaattaaaattatttaaccagttgcacatttattaagagtatttaacaagatgcacatttgttagaaataatgaactagttgcacatcatttataaatactgaactagttccacatttatgtaagaaaaggaactaggtgaaccaattgcacatttattagacatactgaactacttgctaactttttaaaaatattgaactagttgctcaaattccacaaataaacacgtaccattgagttgtaagctgatctaggctgaggggcaaacgtgtcagtaatcgctgcctggtgggggacggtgctatctccttgtggaggaaaacacctccatcgtgtaacactgcggtaccaacgaaggtaagctccataataactcccatcgtctggaggtgtctgaagtgccaagttatcagctgcgtgctcccactcttgtaccgtcgggtttgctgaggttcagactagccatggaataccttttacagagatacttctgtgtacccctcgtgatgccctccaggatagcaacaagtggtagaggtcgtgtattcttcataacccaattatacacttcagcaagatttgttgtcatcacaccatacctcgatccatctgtatcgtacaacaacgaccatttctcccttggctcaaattctacccactccgtgaagcacttcgtggcccgtccacgtttcctgcgccgagtaatacttggtgcttcattaggaatgggttcaagtccctccggctcctcctgtctggcaactatgggttttttcctaacctcttccatgtgtatagtggtcaaacgatccagttgctcccatatggcatcaaactttctttgttgattctgcttgcataacttcttgaacaggtccatcaatctcttactcctgaattgtctataaaaattagccccaaaatgtcgcatgcaccatctgctatgtaaatctggccatggcacggactgtgtgacatcttcttgaagcttctgtatcgctgatagcaaaccggcgtgtcggtcatgcagaacacacacattttgtctgttttcaacaacacacattttaatgtgccgcaaaaaccatagccagcttgatgtgttctcgctttcaacaaatgcaaaagcaacaggaacgacatggctatccgcgtcgactccgatcgcggttagaattgttcctctgtacttgcctgtcatgaaagtgccatcaacacagagcaaaggaatgcaatttttaaaggcctctatcatgcacccaaatgaccagaaagcccgacgaagaacattctccccatattcattcacctcatcgagaatagccatgtgtgtgcccgggtttcttgcctgcatcacctccaatagtgggggaagattgtgataagaatcctcataagttccaaacctcatctccaatgctttctgttttgccctccaagccttgtcgtacgatatctcatatccgtactctttctcaacgtcatgcattatggtgaaaggggacaaagatgtttttctaaccacctttgaatataccatttgtgccacaaatgccgctgtcaggtttctgtgcaccagatgggtattctccaacaaacacgtatgttgctcaaccctcgaagctacccataaagtgtcatgttgtggcttgtaaccatgcactctccaaggacatccaccctgtatgcacttcacgtcatacgtcgtcctatttgaaaccttcaccctgaactcacgcttctggacaaatgcccacctcttcaccgcatcttgtaagtgacctttgtcatgaaacatctgtccaactttcacctgcttactatcataacaccagtgggcatctaaaccatcgtttaccttcatacgactcattgatatggtcgtccaattatcgggtatgtaagtttcgttgtcccacagtgttgtatcttctccttccactacaagcgcaatgtattcctcgttttccacttccatctgatccactaccgcctcattctcctccgctgcatcaacacgcataggcgaatccggttcttcatcgtccgagtcgttggcctcacgattagtaccacaaacaatgacctctccttgtgtattaccctctactacttcttcccctcgaccttgctcagtccgccaaacattttcagcttgtccaccttccaacggagtttcttccaccacggcatgacttgactcccccgatcgatcaacacattttgtcttctgcaccactattgccaggctatagcctttctcccttactttactaacaaacttcctccaactcccagttgacgcaacctccactactctccactgccatccatgttgacccctcactggccacacggcatttatgacaaatttatcgtgcactggatctaccccaaacatattatacaaccaccctaacacgtcgttcaaacccatatgctccggtgcattcagactagtatcatggaaggcatatacagtcaaatccaccccgctatcacatatttgtataggagcatcgccataatacagacgaatgggcatatcacctgacatcctgataaaacatgataaatagtctcacgtttaatcatttaatcattcgataattaccctattacaacttatactacattgccgtgtactaatttacaactattagtaacaaacaactagtttaataatccaaataaaatataacacctttgtacatattttaacacacaacatatcaataatatgtactaactaagaactaatttaaccgtacaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaacttcactgctggagggcgtcgccaaccctttcctcccggccggcgcctcctctccggcctgctatcccctcccctcgctccctccggcgctcacggcgacgatgtggcgactctcgacggcggctggcgatgtggtcctcaaataaatcgaacaagcatcgcgggctggggagacggggctttaaaccggcctgtcgaacgcccattgttcgacagggtcggtggagggacctgtcgaacgcccccggttcgacaggcctggcggcgcggggtggtgggccctgtcgaactccctccgttcgacaggcgagcgtgtcgaacgccagccgttcgacagggctctgtcgactgtccgtcgttcgataggtgccctatcgaattgcacccgttcgacagggacctactttcgcgattttccccggttggccactacttttgcgattttccataaaaataatattaatcctcaaaaaaattcgaagccaacaagttgttatcaggaaatccatttcatcaagtacttgtgatcaggaaatccatttccagcatgaatgcatatttgcataactctgtagtatcattttttgtccagacaggaatatacatatagcgcaaaagattgtaggaaccaaatcgttgctcactccttcgttattgtttttgtattagtcacagatgagaccaacaaggcacacaaagaaaatacaccacttgcatgttgtctactgcgtctaattttactccacttgacagtgaaaacaatagttttgattgtgaatgtctggttgtacatggacaaattgatctggggaacaaacaagagcgtgggatgggcagagtgacggtgaaacatgcagttttattcgcctagctagtttagtcaggttactattgtcaagatttggtacaggaaagcaacggcgccatgcagccatcacctcacgcacgtatacctgcccaagtctttacataccgagtagattcacctatttgctgtcccggccggtgtgtcagtgtgtggcaaagaacaacactactatttgctacgaacatctttatcaacccagccatatgtataggccatatgccaattttttcttttttgggggacaagttgatccaacaacggcttgaaaacgatttcttttaattttgagggaggaaacggtttcttatttttctgagagttgaaaaatgaaaaacgcccacgctacatgaatgggagaagtagtcaacactagaatcaaatatgttcatactattttttaactgaacagccatagtttaacattaacccaaaatatagcttcacacgctgtagtacaccaaatagtcatgaggtttggtttatatcggatagataaaacataaaaaatatataaataaatataaacaacactaaacaagatcatggaagatgcaatactttaaatgatcatcaagtgcaatatacgaattggctgtgtgcatccgtctcaggatgtagaggccggttctcccattatcttaaaaaaaaaatgcaatatacaaaagattattccgatgattaaaaaagcatatgattaattgttaaagaaacaaaaatattcctcatttttttctaattaagatgcaaattttaccttggtttttgtcactcccttcatttcaggttataagacgttttaactttggtcaaagtcaaactgctttaagtttgaccaggtttgtagaaaaaagtaataacatttttaatccaagacaaatttattatgaaaatatattcaattattgatttgatgccactaattcagtattctaaatattattatatttgtttataaatttagtcaaacttaaaataatttatctttgaccaaagtcaaaacgtcttacaacccgaaacagagggagtagtatgcttttcaaaccgctaaatggtacatttcatgcaaaaattttctatatataagctgctttaaaatatcatataaatctatttcaaatttaaaataattgtacttaatttttcatattcatcaaattaaatggctggtaccgtggtacgccgttttccacaacgctgcaaatctgcaatggattgcctgagacctcgtttggatgggctgaaatcctggtccatctaaagggacctcgatgggctccaaaaagcccatttaataatcgaagggccgagaggcccacgcgaagatgactgacaatatgggacccggaagtcagtcaacggaggatagaaaatgaaagggcacgtctccggaacactcgccacaacgaacgaactagcaccaaccccacagcaccagccaccaccatgtcgtccgaaaccgccgcttcgccgccgccgccgccgccgaatccaccggccgccgactccacccattccagccccgcctccatgaccgacgagacgcacggcgcaggagcccatcccgacgagtcccaaccgcatcgctcctcatcgtcgtcctcctcccctcccgtggccgtcgacggcgagacgcgcgtcccactcccagtccggtccctgccccaacctagccacccatcgccgcctccttcgggggaggacgaggatgacgtcgtcatcaccggccaaatcgcagtgggtgacgccgcgggggcggcgatggaggagcgggtgaaggggccctggtcctcggatgaggacacgctgctgagcaatctggtggagaaactcgggccgaggaactggacgctgatagcgcgcgggatacccgggcgctccggcaagtcctgccgcctccgctggtgtaaccaactcgacccccaagtcaagcgcaagcccttcactggtacaatctgcctttcatccagtagtatctgtatcctataggatacgtgatgttaaccttaatccaaagagtatttgtcttgtctatgaggcaatgctagtttggttgtagcattatgggcatgaacattgcgcgttcagtctgttgtgtagtttcgttgcatctctgtaaaacttgcttgttaaattattattgctgtttctgcagaggaggaagaccgcattataatggctgctcatgcaatccatggaaacaagtgggcggctattgcaaagcttttggttgggagaaccgataatgcaatcaagaatcactggaactctaccctgaggcgtcggcactgcactggtggccgatgcacacaaggtggtgttatgaagagagctattccggagaggcctaggtcggtttcagaagaaccttggccattgggcaatcttagttccttaaatgttagggaagcaatggaagctcccgcacaaacagtatctgaaagttatgttggggcatggcaaatcggggatcagagttgcaaaactgaagttgttgatccaccttatcttgcccgaccagttgcaaaggttggtgcattcaaaccatacaatgtaggacctgctcaatcatcacaaaaggaaatgctgagctttgccaccaagtttgactcaaaccttcatcctttcaagcctgaaaatggggtctgcaagtttgttgatcctacaagttttgctgctgaggtgccaaataaatgtgggcatggctgctgcagttctcatgggcaacttcgtaagaactcattgctgggtcccgagtttaatgagtttgaagatcatccaccaatttcagatagtagttttgcttcgttggtgtcagaaattagcagcattgcctggatgaaaagtggtttgcaaagcagtgacaccttagcgcggtctgttccaccagcttaacagattaggataatgtaaattagtgagatgaaacttttggagtcaatttttatatattaaggtgtaatcaagtcaaatcatggttattgttgtatttttggtagatggacatgcatgtagtacttgcagttcttaccatattttatttcaggtgctcagtacccaactaggtgaagcatggaggttctgcttaggcattgggacaagcctacctcaaaaatggaattttagaaaaacttactaggcaatcctgatcgtaatttaatgatatttttagttccatgtctgaatactaaattttataaatagaacaagccctcagctatgagaagtgaatattataattgtcatttgttgttaaatattaattgtcaaataatgactctctctctccccccttttaatgactcatgaaattagtattatttgatgttatagttattgacttgtgccacagttttttttaataacatcaggaatcaagatcttctgataatggaataatctaatatatgagaatttttgtttactagggaacatgtgggatctgtctatgtgctatgtctggcataaataaagtcaactgataaattaaaatacattagcaatagaacagtgctatcatacaaaattgtgatgacaaccgattaagtgcagagaattaaaatttgaaaaaagaaacattaggttactctcttggatttgcgcaaatgtttatttccaactatgatccttgaaagttgagatttaattttgttacattttgttgcatatgcatgactattccttaggcagaataaaccgtttagtgtaattatgcgattcggtttagtgtactatgaagactcaacttttctcaagctaatttcgaatcagggtttcttaatgatggtggttttcatgatttaggggtgattcatatatttgagttcaatgctgataatagcatctaatactataatggtaagtcgtaaatatgctgcgcaaaattgagggttaattcctttcctgtctgtgagaacaagtaggatttcctcccttttcccgagagcttttaaccatgcatcaccagactattatataattgaaatggaataagtatcttcacttaaaattcgtttattatctactacctgctatcatatatttatttatttatttatttgcagtagtgctttagaaatgatgtagtgttctatctttcgctttgcttaaaatgagtggtctttccttttcttggaagtatacaaaaccaaaataatggtgtagctgaaattgtagtttcatgcctctagtggttcaccagttatccatgtttcttaaagatcaggtttcgtcaagtgttactgcgtttgaattgcggaggactatcaggttatatgctttttcctctatgcagttatcagttatacgaagttatagatgagtatgtttttggttatcgatttgtgaactgtgataattgactagaagatagtacaatcacaatatcacaatagacacaaagctggtcaggcttgctttcatgggtttgtacattctgctttgcacttattaggatagagaccagcatttactatcccgctttttttcctttcaaattttcatttgggaccaggtattgccctagtctgttcaatgtcttccataattgctgaggtcttgtgctgttacttttttttttatcagtgaccaattcatatctctgggaagatgaatgctggcacattcatgaggagttaaaatattgaacactgccagaattgccaaggtttgatctatcttctgcgatcatctcccgtcttccttctagtagtccattagtccatctacttaccagttaccactgctcgctttccttttgagggatgacaaatagtttcattttttattgttaattatatctcttgttgttcaagaaattttcattagtatgattatgatatatttgcaaatacatccatgatatgacctgggttgtaaatcctttcgttttgtggacctgccccactgttatttgtatttatgatgttgctgtaactttatatgccacactcttgatctagacacatctagtttacaaaggcagataaagatcagattgtacaggctcctcaggtgatctagacacatctagtttacaaaggcagataaagatcagattgtacaggctcctcaggtgttcttgcctgtaatttctgtggatttactacgaatttgctggacgaaataactcttttgttttcttgaggttccataggcaatatttagacactaaagggtagtttcagagagatagaccatgcaaaattgcaaagcctaatttatgtagtatactgcatggattatggtctacttgtctgttgctttgttgatgccagagtgggactgtgggagaatttgcacctaatcccttatcatgcccatcttcgctttaaccggtgagaaatatcgatgtgtgtacaggctatacaatcttttggaagatgaaagctgaagcagcctgttgctttgtcatcgactggtaggcccgggggacctgtctcaaattataggatatgcatcctgtcatgctgatataaagattctgtatttcatgggaccggctatggatgtgatttggaaataactgggtgcatcgaaaatttctgcacaattcatcaggaaatggatacagggtgctgcttagactggtttcatggttttgctgggtagttggattagtattttaccttcccagccgagatggtttagatctccctggattcctgcactccttgcatgtgttagttcagaggtagcatcagcaagtataatttattggatttttgggcgatcgtggggcttcattcttcactcggtgtcagtgcccatcatcttcaatccagttggattgttctggtttttgctacgagtgatgatttgctaatcgtgtactgatttttctccaacagaagtgtctatagggttttggctgatcttgctcgtagaatcttctgctgttaagttgcgatatgtatagttgggttgaattgtggacttgtggtgctgcgcatggccgaaggcacttccagttccagccttttgataacacgaatcttgcagtgtgtcagttcagttcctctcctttgttctttgttctgtcccatataaggatggttttgtaagcttaataataaactagtatggtgtatggtggcccgcgcagattacgcggctagcatcattatattttctctcgtataatagcatatatgttttcttattatattattcaaatatattaaaatgacatcataattttaaattttgcaataactttacgaaactacaaatgtgtaatattcacactgtattttatatacgtgttagttattaattatttttaatatcaaattttagttatttgtaaattatatatattcctgtatgtactctagactcgttttttaatattttttttaattccaaattttaatatttttaattccgaattttctgtaaattgtatttctatatagactctatactcttcttccaatattatttattttgatttctgaatttttattatttctaattgtatttatatgtggactctaaactcatctctcaatattcttaaatttttaatttcgaatttcagttacttctaaattgtattcctatattgactttaaactcttcttcccatgtttttcttaattttgaattttagttatttgtaaattgtatttttatacggactcaaaactctacttttaattttattatgtttattctgaattttagttagttttaaatttctatatggactctacactctacttctaatattccttattttttaattccgaatttctattttttttcttaattgtatttctatatggactctataatctacttctaatatttcttatttttaattcctaatttctattatttcataattgtatttctatatggactctatactctacttctaatattccttgtttttaattccgaatttcagttatttcctaattgtatttctatatggactctagtctcctcttctaatatttcttattttttaatttcgaattttcactatttctaaattgtatttctatatggactctagtctcctcttctaatatttcttattttttaattccgaattttagctatttctaaattgtatttctatatggactctgttttttctttttctccgattaatgtgagaatttctagaccatgagagcgaacgtggaggctcttttttctattcctttaataatataatagatagatagatggatccaaaccggagacgactttgttctccaccagaaaccaacaaagatcgccgaaactatttttgtctcaccatcggcactactcctacccagctagtagtcagctgtcggctgtagatagactcctgaggccctgtttagttctaattttttttttcaaaaaatatcatatcgaatctttggacagctaaaaccctatagatacttttaattagtctatgattagccataagtctatgattagccataagtgctacagtaacccacatgtgctaatggcggattaattaagcttaaaagattcgtctcgcggtttccatgcgagttatgaaattagttttttcattcgtgtccgaaaacccttttcgacatccggtcaaacgtccgatgtgacacccaaaaattttcatttcgtgatctaaacatgcccggatgtaagcctgtttgcacgcacagttccttccctattttgataggtacagttgaccatcatgaaacttccaggactcttctggctagcttcatatggtggtgggctagacgatttgagttcgaagcctcaccttttctaattatttgatattaggtcattccttagtattcgcgtcttttaggtaggtacagttgatcatcggtcaaacatcaagcagtgtatctatcttactctctgtcctaaaataaatcaacttagattatgatgtgatataatctactataataaatatatatgtcctaaataaaattaacttagattgtgatgccatataacctactacaatatatttaaatagaggttatcttattttgtgctaggtcgatttatagatggttcgtacacaccgtccgccgctagaaaataaacagaggacaatttttctttctcctagctactcccagcattcagaatctttttttgctgttggaatcacgcgaaagatggataaatatacaggagggatagccgaggatatcggcggtgcccatatccagtgcatctgatcggcggcgagatgcacgagagtgtgatggcgagcgctgtgaatcactgtgaggactgaggagagctgaaaagcatagtgcgggcggcgaaaagaggaggattcgggcggcgccgcgacagaaatatctcgttgtgtatatctcaacttctgaagacggaaggtggcggtgcccaagtgccaccggttaattagctgctgcttcactgaaagctccgtttcgaatccaggtgacgggcgccatcgaccaatgatttgtgactagattctcaaaaaataaaaaagatttgcgactagattcaggtaaagttgagtgagtgaaaggccggcctccttatttggcttattcgagaaataaatgaaacggtatatttacaaccgaaaaataatttataaataaaagttttatatacgtactcttagcgatctaaaaataaaggcagaaaaataaattttagtgaaaaaatttcaaaaatcaactttaaatttgagtgaaaatttaaattttggtcctaagtataagtataaatgaaaagatggtattcgtttccctaaaatatggccttcggtggtatccacgtagagctttacgttaactctgcttaatgattagagtaagattaaaaggtgatagcgttgtcaaccataaaaattctaggcaaaacaggtgtcgaacgggatcaaattcacagttggcgcgggggctgtgtacaccaacacgagatttttcgtgaagcaaaaactcgtggatggtcaatttcttctctcccatcacatgacacggtcttctctacttcattgctgacccaagagaccgtctcatatgcttcatttcttctcctcttctcttccccttcgtccccgacaaagcaccacaactccgcaagttttctcttttcttttttccccttctctctttcgcctactccttgttcaatcgattcttcccagctacgcgactcttcctcgctttctcgcttctctctctgcgccactgtggatcaagaaacagctttaaaatccaatcttttttaggcacctgatgcctcgtcggtagcagtatattttcaattcgttatttttttagagcttagaatctactggcagcttggatttttcttgggtggttgctcccagtgatcggccgcattgcttgcgtggtggcacaccgtcagctttggagtaacctgtaactgcaagagtgagtatttagtgctcgctttcggcgattcttgtttgcttgctcccttctctgctcttgtccggatttggtatagaagcaatttcgagtgattcttttcctttttttctcgaattgctttttttttttggtaggtttgtttggcgtgagcaatggtgaacgacggcgagcaggcgttgacgatcgctcccgccgccgccgcggattctagcgcggagccggcccgccacgtcggcggcggcggaggaggaggaggcgggcttgcggaggagagctcggatgaggataaggggagccagcgcttctccgacgcggaggaccactcatggcggtcgcactcgcgccagggctccgttgccctcgaggacttcatctcgacgtgcgcgtccgtccgctccggcgccggggacgcggacgcggacggcggcggcaggaggaagtcgtgcgtgtcggagtgctcgctgggcgacgtggacctcgaggccgggctggccgagatcagcaaggccagcccggacacggccgagaggaattgccgcatctgccacctcggcctcgagagcgccgccgccgagtccggctccggcatgttcctcggctgctcctgcaaggacgacctctcctgcgcccataagcagtgcgccgagacctggttcaagatcaggggaaacaggtaatatctctcagctgctgctaattccacacttcacttctgatgatttaatctgctaatactatgcacaaactcgaatgaaaatatttggctactgtaactggatggatcttttagtacgaaatgttccttgtttttgctttatttaggtagggatatgaaggatagagtgtgatgtgagaggtaagggcaaagtggagtatgattaaccagtaggatctaggaaaagcttaggaaccccaacatggtgtagaacatttcagatggaggataaagttagattcctttcggtctgctttttcttgcagattcttgtgtaactctcatgatctccgaaagtggaagcgctgacccttttcttggcatgccttcgttgtggtgatctagactctatagggagtgctatggtgtcacattcctaaaagaatgtacttagatacttctacacgaacattatggccaatagtagttaagttacctgacggtcatttcattaagagatcacgagctatgtttatctgacatcgaattccaaggaactagactattagaattctcactggtatacatactaattaatcttaactattaaaaaaatgaagtgagaaaaaaagaagaagatggagggtcctcatacaagaatatatgagtaagatatagtaagctgaagattgtttcttatcctatccttgctcttcaaatcatttgatgagcatgtaccatgtagaaccaatatgaatggaaaataaatttgcatcaagctatcatctttaagcaattaaatgattggtgtttttcagtacaacattcacaagagaaatataacagatagtcccttgaggcaagcatccagatggatgggctattttctccctatacatatgttcactgttttactaacaccagtatttcctttattatgcattttatagttatagttactttttttagatagtgaaaatgttttacatccctagcctctagttactatgggatgactgttggtaaatgctaggaccagagctctgaattaaggtgtatttcacagccttttgtgtattactgttgcttaaatggaagggaatataatattgaaagtgggaacctgtttttgtgctagtatatcgtaccaacatagttacttgggttttatcacctcaattgaggtgaggattagagtcaggataagataaatacatgcttgatatttctgaccaaattacaagcatctgtgctattgatcagtgttgagatgtaactgcacttgtgcccttccacttcatgttgtgctttgatagtggttcaagtgaaatattaattgttaaagcattcataatgttgttactctctttgtattgtagaggcataaaagaatgtgttagcattattctccttatgatctgtaatataactacataagcataactccattttctgcttttgcaattggaatctagaaaattaaaatgctccatgttcctttacttgtcttaggatctgcgaaatctgtggctcaactgcatgcaatgtggtaggtatcggtgatgccgagttcatcgagcagtggaatgaatcaagtaacaccgcggcttcgcaaatgcctgccagtgaacctcggaggttttggcaaggccaccggtttctcaacttccttcttgcttgcatggtgtttgcttttgttatatcttggctctttcacttcaatgtccctggatgagttttccaaaagaaaatgtcgtaataaaatcttcaaagccattgttacaagtaaatactagcccagcatcaggaaatccaaaaggatgctgagctgaactgaaaatttgatgaagagggcgttggttaacagtaaggttgatgttagttttgtagaaagtttatggcataacatccaagaaagaagtcactgtgtgaagagttggtcacggtgagcaactgtgaattatgttgatcatcagatcatcggtggtggaattgaaagcagagaaaagaaatatctcatgcttcgttaacattagaatggtttgaacaagtttttgttatgtgcatacacatattctgtgtgttatctgtgtattacatttttgtcacaattcgagcggtacgggccagtttggtttgaggcctaaattaggcttgccaattttttggcaacctcaacaataattgtgtatgtttggattgaagccaaattttggcatgcctatataacataggccatttcaatagctaaattagtttaatttggcttcaatccaaacacatgttggccttaccaaaaattggcatgccaaaacttgcgtgtccatgcacttggccgtctggtcagctatcctgatctcttacccgcccggatcaatctgggtggttcaaatatataaagcacatccctggatttaatatccaccatgttaaatctgaagtttataagtcaaattaggaacaaaatagtttatctaaatgttattaatataattgtggatttagatttatggagctaagaatagctcattcgaagaaatcttggacttggagctatttcaaacaggtaatagcatgcaactgagatatgttgattgcagaacgatacgagataagcttgcttagaatacaactattcacatgagttttttggacgaaaggcgtcatgttaactacagccacttgacgaatttggtttgcccaaggaaggcacggagaagtggagaacccaggagaaatcagttcgaagattttttggggacagaagattttatactagtttaaatgaccaagatttgtgttggagtaaccgcagcggtcagcacgttggttggggtgcaggagagtaacgtgcaggtcgcaggaattctgggaggacgacgcaatcagccgagcaacatacaggaatgcagtcgactcaattgttggcgccttctgtaaaacgtaatgacagattctcaaatccatatgtctgctaacatgaactcctagttagggccccattttaaacgtagtagaaaattctccctattccaaccgaaattgaatttgtgaaacggctataagatcctacgattttattatgttctaaacaggggattgctgtgctatccctacaatcattcaaggtgtatgcagagacattgccattgccagcgatagcagagacatcagtctgctcagagcaagtttaatggtatagccagctattggctccaaatcatctatagtcaatttaatagccaattcatataatagttagagcaagttttgtaataggagtggttgccacatctaattttatccatgtaagatcagaggtgatatatacaatacatcacacctacactacctctagcatactaacccaaatgattttattttatttgtatgccatatccactctttctttcatcttttttttaggtttgtgtggaggttacatgacgggtgcctcattttctatttcctcacttatttcttccacctcatcatccaatcttatgcggcatgtttagggggggggggggggtggtggcaacacatctagctgtagcgcccgttccgtcgtggcgcctagcgggaaaatgtaattcctaaaaaccctaatttcgaaatctgtttccttgcttattgtctagtgtccgtgccaattccggatctcaaatccccgatcgatcgtcaagttcaatcccgaatccaaatccttcccaaatcaaatccctccgcaaaagtctatttcgcctccctcaggttcgatgggccgaattcctctcggcccatctccctctccctccccatccctctctctctctctctctccctctccccctgctctgcccgtgcgctgcgcccgcgtgcgcgtgagccgcgccgagtcgagcgcccttcgccctcgctgccgtttcctgtcgacgccgcccaaatcgccgcgccgcccgttgcttcccgcgcgcgcgcgcgccatggtggccgaccggccagtcgccgccgccgtcagcgcctgcccgcgcctgccgcccgtgccgttgctccgctccaaaccgcccggccgtcatcgccgtcgtcatcgacttggccccgcctctcctcgcgcgtgcttccaagggacggaggcagagcttccccccctctgccgcatcggcgtctctccctcttccttttcccccaaagtggcaagggggcaaccccctttctctccaccccccttttcccttttcccttttccctcccgccggcgtcatcctcccccccccccggttgccgtttgggccgcgactgccgagcactggctcgctcccttgaccgcccaaggtcggtttccaaaccgacattgccgaaatataaacccaggcgccctccctttcttttttcccctcccaatcttccccgtttttcacccacgccattggcgtcctctcgccgaccggcgccgttgcgtgtgccggaggagccggtgcgcgctaggacgcggaaggggactccgggcgctcgtcttcttcctcttccccggcccgaggccggagagatcactcccgtgccgtcggcctctcgtcactgcgccccatcacccccgcacggtagtgcctcccttcgttctccctcctcgttccatctcctccccttagactcgggtagtagcacgagtagcctccccgtagctagctggcgccgccccgaccgttgctgccgctcgccgtgtgctcgccgccatcgccgcccgtgctccgtagcacccgctcgttgccggcctcgctcggcgtagctccgcccaatccgacgctagcaacgaactcccggagtcgcgtagatgctctagctcgcccgaatcggtctcccgtcgtgccgtcgccgtttcccccttctctcgccaccggttgccgccaccacaatccgccgccgtcgagcatcccccggcaaatccgagtcgttggctcgtctcccctcatcccgtgcaaccttccggtgtgctcgctttcgcctgtatcgccgtggttcgccccgccgttcgcagccaccgtccgccgtccgttccggccggcgtcttcttcaacctcccgccggtccgcgtggcagccacataggcgccacgtcggcgccagctcggctaagaccgggtcgagctgacccggccagctgctccctccgttcccccccgtgcgcatggtccgcggtgagccatgaggctgcgcgtgggcccgccgtatccgcgtcctcctcgaaccgcgcgcatgcgccgcgcctcccctccccaaaccctagcacgccccgcgtgcacctcgctcacggtgagccgagtcgccgacaagcgggtcccacccgggaccacgcgggatggacccggcccaccggctctctctctctcctccccgcccgcgcgcgcgctttgggccgccttcttgggccggccggcccattaagctcggccgagccgcccctttctctcgggccgcgccctagccgcccgaggaaagtataatttccctcccttcttcttttcttttcttttcttttccaaaaaggatttaaataaatccttttcctttagaccaaaaatccaataatcttataaattcaatatcttctcaaccgtaagtccgtttgactccgttcaacttctaaaattcctcaaatctcgagatctatctaatggcacgcttagaggtcaataatagggctttattttcgccgtttgctgagttgtcccgtttcgcgtgtagtttcggagcccgaagacccgcagtgcgaggatttcgaggatcaagctcaagatctcgagcaaggcaagccacctttgaacatcttgagcctatatttgaacttaagtatgttgcttgaaaaatattatgcattgataggattgcacttaatctacatgtctcgtctgcaaggcagattggcggacctacctaacttgttgcagttgacccctccattgtaattattataccatgttcccttgtaaccacctagttgcgcctcggtaatcgtgcactctgcacgaatatcgacggtcgccttcaaacttaaaatctgagaaacatcttgggtaaaacttgggttttacaaaacacttggaaaacccgacacctgggtcggtgcttgcgaacctaaatgaatttccaaattcgcggaccggggaacgtaccgggtgtacggttccccgctcttgcacttaaggaccgtttccttggaatttcatccgaacataagacaagtacgaccacatgggtggaatgggacacccctggctgagtaactagctaatcgggggagccatgatgccaagagacatgtggattcaacggggtggtgtcggggaggacccccgggtttcctggcacagtatggtctgggatccctctcgttggcatatggtgaacctgtgtcggctttcgaaatgccttgtcgtgaaagccttaaggtctctagtcgtggccgttctgcacgggctggatgatccgggttagtaatatcgtgtgggtaaagtgtacccccctctgcagaggttattaaactgttcgaacagccgtgcccacggtcatgggcggatgtgaggtgattcctagcgtagttttgtttgactactgctttgtgaaatttgctgatgtggtttgggttcgatgtttggaaaacctgcggctgatgggatcagccaggcccgggtggccgtttaaaagtcgttggccgggtgccaaccttgaccaattcaaaagactgataccttgcacatactccgaccgggcgagacgcactgtctcatccgtgtcgtttgagaagatctcacttagttgtttcagaaaagagtttaaataaaatcaattgcaaaaacaacagcctttccttgaagcctgcattaaacacttatttcccatggcttgctgagtacttctgtactcatccttgccctatataaataatccccccccagttgctgaagaagatgaagcggatcccgctgacgaggagttcttccaggagcaagccggctacgatgagttttagggtttcagcctagttcctaagtcgcgcctgtgatgtatggtccaagtcttggcttccgtttcccttttgtaatgcagttgtgagctcgggatctgtccgcagcccaacatgactgtactcctactctataataaagagacctctgttgctgtgatattctgtcttcctgtgataccagcactgtttcctgggactggtatcgattaacaggttaatttggagcgtcacgggctagtcccgctcggggctagttcggggcgtgacaagagatggtatcagagcccaggcttggccctagggcgaaacccgacgtttaggacgaccctaaggatactaagttcaaaactacttgcgaaaagctaaggcttttttttttggtttctttattttcaatagtttgttgctaaaatggttactgatcttttctccctctttcaaaattgtagatggtagtgaacgccagcttcagttcccacggttttggtgagggtcaccacgtcgctcagcttcgtgacctcgcccgcttccttggcttttcgtgtcccgagtacacggggtactccgtggaccatgttccccctcgctgtgagctctctgtgtacctttaccctcgtggaggtatacacggagctggtcttcgcccacaccacttcactgtggctaggcccactctccagatcgcgtaccaggacctctcctggactgcgcttcgtcgcttcgcccacgactacagccaccgtctcgggggctctgccttccggcagcttccacgccttccttctggccacgcagacgccaggtacccttgtccgtacaacgagtctcagctagtgctgactcgcatggttgagctttcggaggctcaggccactcagcacgacctactcctcgaggcttaccgctcccttgcccgccgctacgccgctctggaggcccgtctggccgaggagggagtcacctcagttgacactgtctcttgggactcaggccgcctctgccacgccagccacctatcctcccacagctctcgcggctctgcccgcactcccagtggcccgcgctcccccagcttgcgtgcgccgtactcaccagtgtactccccctacccacacccagttagcccctcctacacccccggacacactcccgttgcttcctcccgccgtggcccacgctttatccgcactgcgcggaagcgtgttgttggttcttccaccgtgttccgcttcgactacccagctcccccaccgccagcggcccgtgctgctgacggctctcgacaggttccgctggtcccttcgcgtcagccgatcgacgtttcttcgactgaggagccgactacaggaggcagccaggcagacgaggagtagaggaggcagtcttcagcagccgtccgtgtgttaggcccttttgttccaccgccaactcctttggagtcatggcgaggtagtgcatgcgtgcgtttgatgtgggtgttgtttggtagtctggttctcctaggtggtgtgcgtacagtcaagctcggcgtagctctgtgacttgtccacacccgttgtatcaggtgtttttatgatttgaaaaatccagtttatgcctagtgcgtgctatctgagttgttatttactttgctccttgccctcctaagtgcttatctgattcttacctcgccctctcctgggagtttagatggctagccgcccccgccgtgctgctcgtgcaccagcccgctttggttttgaggaaggtagagttgagccaggagcaaatcatgagtcagctaatgagcaatctcaccacagcaaccgttcgcaccgtactgcttcccgcaatgcagaagttgagcaaccccgccgcagcaaccgctcgcatcacacagcttcccgtaatgcagagatggaacagtctcaccgctctcaccacgctgccggtcacaattctggagaggaacgcatcccttccccgcctcatgtggaaaacaacatgcaacacttgatggcagttcagacacagatcttgcaaggattagccgcggccatagccggctttcagcataatgcgtatggaaatggccaccctcacatgggcaacaatagatccaaactgacagacttcctgaggtctcgaccgccagagttctctcagaccgtcgagcccgttgaggctgacgattggctgaaggatgttgatagaaaactcaacttagtgcagtgtactcctgttgagaagacgctctacgcctctcaccagctaagaggacctgctgcagattggtgggagaattactacaatgcacaccctgaacccactaacattgcttgtgatgagtttgctacggctttccgtgcagctcatgtgcctgaaagcaccattgatatgaagaaagaggaatttaacaggcttaagcaaggcaacaacagtgtcaatgagtacctaagtcagttcaacaagttggctcggtatgcccctgaggaagtggacacagacaagaagaagatcaggaagttcttgaagggaatcgcagttggaatgagactccagttgcttgctcatgacttccccacttttcaacatatgatcaacaaggcacttctacttgaggatgccagaaaagaggctaccgaagaatacaagaaacgcaagtctaaccatcaggggaattcttcccgaggcgcaccacgccctcgctatggtcaacccatgcaatatcaccaattggtcactcaggctaaccgccagccaggctacgcccctcgtccttagatgaaccgtccggcacctcagccacagcagcatgccccaagtggcaacactgcgccaaacagtgttacctctttcaagtcaccgctaggactatcagcagttcagtgtttctggtgcaaccagatgggtcactatgccagacagtgccctcagaatcctaccaacaccaactcagggcatgctaatggtagcactgccagaactcctactctagcggcagctcagtctcgtcctagctctcaggcaagtggacaaggttctcgtgcttccaacaactttggtcgaggccgggtgaaccacattcaagccgagaccgctcaggatgctccagacgttgtgatgggtatgttctctgtcaactccgtacccgcaatagttctgttcgattcaggagctttccattctttcatatcacaagcttttgtgaaaagaaatggttggaaaacccaaaatttacgtgtaccaatgatagtacattcccctggaaggaatataagggcaactcaaatatgcccggaagttaaccttagaattgaggaagttgacttcctagccaaaccgatagtcctagactcgcaaagcttggacatcatcctagggatggattggttggctaagcacaaaggacagatagattgtgccgaaaggtccatcaccttgcaaggacctggaggaaagcaagtccgctttacctctaacacccctaccgcaagtcggtctatcctaacctgtttacaagtcacctccttggagtcggtgcccatagtctgcgattatcccgacgtatttccagaagaattagcgagtatgccaccagaccgagagattgagttcgccatagaactggcaccaggcaccgcaccaattgcaaaaagaccctaccgaatggcagctaatgagttagcagaagtcaaaagacaaatcgaagaattggagagtaaaggttatgtgcgacctagctcatccccttggggagccccagtgctcctggttaagaaaaaagatggctctgagagaatggtaatcgactatagagccctgaatgaagtaactataaagaacaagtacccgttgccacgaattgacgatttgttcgatcaacttaaaggagcaagagttttctctaaaattgacttgagatcaggttaccacaaattaaaaatcagatatgaagatatcccgaagaccgctttctcaacacgttatggtctatatgagttcacagtgatgtccttcggactcaccaatgctccagcgttcttcatgaacttaatgaacaaaatcttcatggaatacctagaccagtttgtcgtggtattcatcgatgacatcctgatatactccaagaatgaggaagaacatgctgaacacctgaggctgataatgggaaagctcaaggatcatcaactattcgctaagttctcgaaatgcgaattctggttggaccgagtagcatttctgggacacgtgatctcctccaacggtgtcgaagtagatcccagcaaggttgaagctgtacttgcttggaacccgcccaagaatgtgtcagagatccgcagcttccttggcttagctggatattatcgaagattcattgagggattctctaagctagccagacatatgactgagctgttaatgaaggaaaagaaatttgaatggtcagcagcctgtgaagacggctttcaagaaatgaagaataggttgaccactgccccagttctcaccttgccagatatccgaaaagattttgagatcttctgtgatgcatcaagacaaggcttaggatgtgtcctaatgcaagaacgaaaggttgtggcctacgcatccaggcagctcaggcctcatgaagtcaactatctcacccatgatctcgagttggcagccgtggttcatgctcttaagatctggaggcactatttaatcgggaacagatgtgaagtatacacctgacggagggtggggctcctcaccgggagaccgcgcaggcccccctttgccggttcggccgggggtgctaagtgagtttcttcgccctcgatctgaggaacgtcagcgagagaggaaatgcgcaagacacgggcgacgtagacaggttcgggccgctgagaagcgtaacaccctactcctgtgttctggtggatctgtgcgtgaaggaatacaaagaggccgagagcgaaagagagttcaggctctagaaaccattcgccagagtcccccctcccctcctctcttctccctctttttttctaggcctgggcctcctttttatctggtcaggggtcaccacatgggcctctagctgcctaagaagggaaacatgctttttacaatgagggctagtctacagccggaagtgacctctgacaagcagagcgcacgtctcctgccccgctcgcccgcttttccggtggacgcccatttcaaccttcatttaatggccagcgacttccttgccatacttgcgctgaagcctggaatggatctgaccgggactgacataccaactccaggagttagcacgccggctccggctagggacgagagccaggaagctctcatcattccgacgggacggggcgaggcgtgtgacaggccgcctgttgccacctaacccgtgatctgaccggtctgtgaccggtcacacaccccgaccagtcgcggaccggataagcgtgcgctgcaccgcattaaatgcggcgtggcgcgctcgtccaatcctgctataaatgcggttaggtgagccccgctgtgctcacctaacccacacgcgtggcgccaaaaccacagggggtcggggcgccccagccctcggggccgaaacaggggcgccccagccctcggggccgaaacgggagcggtccgacccctcggggagacagagggaggggtggccacgtcatcctcgggcccgacccccccgagggggtcaggccacgtgggtgaccgcggctacccaagcctctagtcacgatacccccggccccatgtcaccgacagtagcccctggcgttacgccagggtgatcgcccccctcgagggaagcgctcgggcgtgacgccactccttaggcccggtgacaggtggggccggtccctacaggcgggcagaaactcagcggtcgcaaatcgcgcgcatcggcaagggaaaaccgatcgacagtaatgagcggcctctttaagaccgctacattactcgagcagcgcgcgaatcgggacgagccggttcatttcgcctggagacatgatgatggcgcttttcacggttggcgagcgtagttaacgcgcgcacgatctgccccatctcaaccgccacggccgcacatctgccgcgtgcgccgcaaacgggcgagtggggttagtggaggcgtgggcgcgagaaacgagggggcgaggtagtgggcgcgggaagcgaggagccgggcatagcgttggcaagggtgtaaagacgctgaggaagggattcgtttctttcctctcgccactcttcccttgccttcgccacttgtgctctaactcttcgtttcctgtgccctaccctcgccgcactcgctcgttctcaagctcctcctccgccagcgtcatggcacggggctccgcaccgctcgatggtagcgtgctgccgccttcccgcatcgtgagcgagaggcaggccgggctgccgcaccgattcatgccggaatctgccaccggccgagaggtggtcgcgctgggcgagggacgcccggcgccacactacccggggcggtccgtcttcttcctctctttcgcaatggcggggctggtcccgccattctctatttttttcatggatattctggagttttatgatctccagatggcgcacctcacgcccaacgcgataatgacgttggccatcttcgcacacctgtgcgagatgtttatcggggtgcgcccatctctccggctgttccggtggttcttcaccgtacagccggtgtcgccgccgacggtagtcagtggctgctacttccagccgcgggggcaggtgctgaaccgctacattccctgcgtcctccgcaaaaagtgggacgactggaagagcgattggttctacacccccctcgccgacgaagcgcgcctccgacttccgagccagcccccggcgcagggctccagctggcgggcgacggtagatctgggagacggctacgacgccgttcttgaccgcctggcgggtctgcgatcccaggggctcacgggggccatggtgttcggcgactaccttcgtcgccggatcgcgccgctccagcggcgcgcccggggcgcctgggagtacaccgggcccgaggactacatgaggacccaccaggggcgcaaatgggactgggaccctgtcacaccctgtagttcccctcctaagccaaaaattgaatttataaaggaccctaagaaaaaccggtgcaaagcaagagtaaacccctgaagatcaatgcaaataataatcggatttggcatgtggaatttttcttgagttctacatgtcgaaactcactaacaggatttttagtggaattttcagagccctagaaataattttaaccaattaaaaatcaccaaagtgcaattttaattccaggaaaaaaatcctttttctttttctttttcttttttttctctttttcctcctttctttcggatgggccgctggcccatctcctcctttcctccccctcctccctgctgggccggccgcaggccgaggcccagccggccgcccgcctccctccctcccggggtcgccgacaggtggggcccacctgtcggacccgtctcccacctcccgcctctcccgctcgcgccgccccgccgaaaccgccgccgccgcacccacttcctccgctttccccgcgcccacgccacgtcgccgcgcccatgccacgtcgccgccctctccccgcgtctcccggccgcgccagcgcacgagaggggcgggattcgattttgaatccccccccaccttctctctctcctcccccacgtcgccggcgaaatcggagcgcctcccggccacgtccgcctccccctccgcctataaaatgctccccatgccctcctctctcgttttccgctctcaccgctccatcccgtgccccctaccgagctcgcaccgccgccacttacgccgccgcccgtcgccgcactccggccgtgtgccgccgtcgctagagccgccgccgcactaagccaccgccaccactagcttcgccgccgcaagacctttcccggccgctgctctacgtcgccggaataccaccgaaaccccatttccctcgcgtcgtcggtgagttctctctcccctccgactccggccggcgtggatggtcgccgtgggggttttcctccgccctaattcctctcctctatttccctaggtgtcgccgtcgctcgtccgcacctcggcatcgccggtcttcgccgcctccctcgtttttctccgccggccattgccgcccctccggtgaggtctccctccccttcctttccttctttttttttccccgtgcgccgccgccctcttcgcgcgctcgccgtcgctttcggtcgtcgccgctcgcgccgccgcccgccgcccgcgccgccgctcgccgtcgctggcggtcgcatgcccgcgccgccgccttgccatggccgcccggccggcttgatgccgggcctggccggtacatcggctcgtggagccggagccgtggggcccgcttgccagccgtgcccccccttgagccgctgccgagtgggcccgtgtaccagcgcccttcccctctctctccccgtgccgctgaccggtgggccccgcttgtcggcgccgcgccaccccgtgctggcgtcagccctggaatatattgcgcaataattaattaaggactttttctttattagtaaaaacacagtgaatcttctaaaattcataactaattcatccgagctccgtttaagcccattcaagtctcagtaaatcaagaaaaatgtgtagaatccattaaaaatggttttgttccctgtttcagtagtcttatagcctgtttgcaatgtttgctttgtatgtcgctagattccgattcctccgacgctccggtgtacttcgagatagtcgccgaggttcctccagcagcagagcaaggcaagtcatgcttgtcacttgatcatgttgatcctatattgcaaatatcctaatgttttctttcaaatactgcatttgttttgcaattatactatgggatggttacctattgttacagccatgtttttggataccatgctcctttgttagcttgggttataacatgattagactttggactaggaattgcttagccatgcttagttcaactagcacacaatggggagatctcttttaaaacctagactataggtttataggttaatgttggatcggtaccaccgctctggtgttggttaaataaaatgaataatcatggtgggctgtgggtgcatggttttgctagtcacgcccatggcaattaaggaccggttcgcgggaaaccctggaagaacgtatcgtacttaccacaagtcagcgtgggcaacggctgggcttgtagtgtagcttttctctagctgacgcatccaggcaagggtgggcgtgatggagcggggcgggccctgcgacggcctctatcgcttccggattcacctaggcacgagaggggactgcccgttgcccgctggggacgggggtgaaacctgaggtgtggtgtgcttggctagagggggttatgcgaagggtcctgtcacggcctctttccgatatgtcgtggtggcatgtcggcgcacggaaacgtgtcgtggggctgtgtcttgtgggtatagttgtacacctctgatcagagtaaaactattcgaatagccgtgcccgcggttatgggcggtcaaccagattcaccgtgattagtctcaccttagtttagtctaatgaatttggatagtttaggtggatggttgggcctgttgcaacgaggtgtggcgttggacagtggatgaataatactgcttaattttacaactgttttcgcattcaacccttgtttataaatgccagtatttatgcaaatgaacctgtttagctgttccttgttgaatccctgcatcatacccccattctggtatgacttgctgagtacagtgggtagtactgtcttgctctatttctccccaatcccagagtttgagtttgtgtcaaatggcgggttctccgaggagtaggcttcgtccgtgccgtcgaggatgcctgtggagtggtgttcccgctgcagtcaagtccaggcttagcctcagttatcttttgttttccgctgcatttatgtaagacttttataatgtttgtaagacgtggatctgtatgtcaacattgtcgtttgtgtaccccggccggtcctggacgggggttttaatgcacattctgcttggaatcctattcgggaatttctgggcgtgacaagttggtatcagagccgaccttgaccgtaggacaagccaaatggaaacctaagagccctctgaatccttttcatttgcataagttctttgcaattggattttattccgggaaaatttgggatctgctcttgtggttcaagggaaaaatcttgtcgcccgtttaaatgggatttgccaaaacgagtcagtctagggttttagtaaaaatttttttaagatttattcgtcagtcagttgggatttgatgggtgaaatgtattaggtcctagctcaggaacatgggttgcaaggtatttatgctttatttgtaattacaagtatgtatctaaattccccattattttacctctatgtaagtccgtcttatttattcgctctcatgcaaaatgatttatgcataaaattttgctcttattcgattctcttatttgagtcctttattgctttatttaaatttggatttgagcatgcattgatcctactcctttgtcttctttagatggccggtcacccacccaaccaccatggagagggcatgattgacttcgtggcagagttggcacgcatgacactggtggtaggctaccccaacgcgccggagtacacgacgattccaccgctcagtggcgagcttcctcaccgtgtccgcttggaggtccatggctacgtggggacttgccttgctaacatggtggttgaggcgtcaggaggcacagcagaccacgcatgtcaggaggcagcctacctgatgatggccagactccgggagcgccacaactacatcttccacgacacggcgtaccgcttccaccctcgtcgagcccacggcgacgatgtcagttcgttccgtccgacagctggcgagaacgacaccaccttcggtcacatgtgtgctgtgatgaggggattggataggatgcactcggacctgcacaaggcgaccaaggccttgaatgatgggaagctcatgaggatcgtcgctctgaaggacgagatagcgcgcctgaagagggagaatgctcagttgaagggtcttcccgcgccaggaggagtccggatccgcactacgccccgcaagaggacgactgcacccgtgcgcatccagctcgcgcccaggaacccacctccgcccgcagctcccgcagcacctccagttccgcccgcagttcctgcagctccagctccagctccagctcccgcgtccgctctctccttcgctccagcatcagccgccaggggtccaggcagtggtactggaggttggttgtctgctactcccagtggcagcagctccagtggctcacagtccggcagcggagggacttatctgccaggttccaggagtcgctcagagggacctggtgacgagcaggaggacgccttcgactccaccgaccgcaggagccgttccgagcattaggctcgttttcccattagtttatcgattgtctagtttctgcttgttagtttccgtgtttaggttgcttgtttggggtcagtcgacggtcgatatcatgtgcctatgatatggctgtcccaataaggatttttgcttgctgtttaaagtgttttaattcagatcagaacagttgcagtttaatttctatataataaagcttagttcctgagtatctgtttttctccgtttccccgtctgctctccctccagatggtctacaccaggactggcaaccgcacggcaggcgagggcagcaatggcgaagaacgcgctgatggtgtgcaccccaacagcgattccggcaatggtccgccaccccttcccgagaatccgacactggcccaagttatggcacatcagactcagatgatggcagccatgatgcagcagatgcagcagcagcaccagcagatgcaccagaggatgatgcagcacgccgaacaacagcaccagcagtttggtccccctccccctcaatccaagctgctagagtttctacgcgtcaggccacccaccttctccagcaccaccaaccccatggaggcgaatgactggctccatgccatagagaagaagctgaatctcctgcagtgcaacgatcaggagaaggtcgctttcgccacacaccagcttcagggtcctgcgtcagcttggtgggacaatcacatggccacccgcccgccaggcgctgaagtcacttgggcggagttttgccgtagtttcaggaaggcacaggtgccagacggggttgtagcgcaaaagaagagggaattccgggtgctccatcagggcaacaggacagtgacagagtaccttcatgagttcaatcgcctcgcgcgatatgcaccggaggatgtccgcactgacgccgagaaacaggaaaagtttatggcaggcctggatgacgagctgaccaaccaactgatatctggggactacgctgattttgaaaggctggttgacaaggcaatccgtcaggaggatcagcgcaacaaaatggacaggaagagaaaggcggcgcagttccggtccaaccaaggtagtcagcaccgaccgcgtttcactcccggacagcagggtggacctaccaccatgatcgtccgtcagcaccgcccgttccactctagcaacttccaccagggcgctagcggcagtccgaaccaccagggaggccagcccaaccgtggtgcagctccacgcccaccaatggcaccagcacagccagccccgtccgcgcaagccaagaaggagactggcacaaaaccggggtcctgtttcaactgtggcgagcttggccactttgccgacaaatgcccgaagcccaggcgtgccggaccaaggtttatccaggctcgtgtcaaccacgcgtctgcggaggaggcacaagcagcaccggaggtcgtactggatacgttccctgttaactcaatccctgcaacagtactttttgattctggggcaacgcattcgttcatttcaaagaagtttgtcgggatgcatgggttaataagagaggaacttagcacacccatgcgggttcataccccggggaatagttccacttcggtacaattcagcccttctatcacaatagaaattcaaagatcaccatttctagccaacctcattcttctcgaatccaaagacctagatgtcattcttgggatggattggctaaccaagtttaagggagccatcgattgtgcgagtcgcacagtcaccttgaccaacgagaagggagaaacggtagtgtacaaatcaccagactcaccaaagcaaggggtctctttgaatcagatcgagacggaaatcccagtggacaccgtggagaaaagcttgaggaaattggaagatatacccatcgtctgtgagtatccagaagtgtttcctgaagacctcactaccatgccacccaagagagagattgaattccggattgatttagcaccgggaaccgcagcaatttacaagagaccgtacaggatggcggccaacgaactagcagaggtcaagaagcaggtcgatgagcaactacagaaaggatacatccgaccgagtacttcgccttggggtgctccggtcatttttgtggagaaaaaggataagacgaagaggatgtgcgtcgattaccgcgcactcaatgaggtcacgatcaagaataaatatcctttaccgcggattgatgatttgtttgatcaactgaagggagctaaggtgttctccaagatagacctgcgatcaggctatcaccagttaaggatccgggaagaggatatcccaaagacggccttcaccactcggtacgggttatatgagtgcacggttatgtctttcggactcaccaacgcacccgcattcttcatgaatctaatgaacaaagtgttcatggagtttctggacaagtttgttgtggtattcatcgacgatatacttatctactcaaagtctgaagaagaacatgagcagcatctccgtctggtactcgagaagttgaaggagcaccagttatacgccaagttcagcaagtgtgatttctggttgacggaagtcaaatttctgggtcatgttattacagctcagggtgtggccgtcgacccatccaacgtggagtcggttaccaaatggaccccaccgaagaccgtgtcgcagattcgaagttttcttggacttgcgggatattaccgccgattcatcgaaaacttctccagaatcgcccgacccatgactcagttgcttaagaaggatgagaagtttaaatggacagctgagtgcgataaaagttttgaggagctcaagaagaaattagtatctgcaccagttttgattctgcccgaccagatgaaagacttccaagtctattgcgatgcatcccgccacggacttggatgtgtcctaatgcaagagggcagggtggttgcgtatgcctcacgacagttacgtccacacgaagggaattatccaactcatgacttggaattggcagcggtggttcatgctttgaagatctggaggcactatctgatcggcaaccgctgcgaggtatacacggatcataagagtctgaaatacattttcacccaaccggatctaaatctccgacaacgaagatggttggaactaatcaaagactatgacatgagcattcactatcacctgggcaaagccaatgtagtggcagacgcattaagccggaaaagttactgcactgccctatgcatcgagggcatgtgtgaggaattgcggcaggagtttgagcacctcaacgtgggaattgttgaacacgggttcgtagccgctctggaagcacggcctacgctcgtcgatcaagttagagccgctcaagtaaatgatcctgaaatagcagagctgaaaaagaacatgagagtcggaaaggctcgggatttccttgaggatgagcatggcacaatctggatgggagaaagattgtgtgtacctgacgacaaggaactgaaagatctgatactcaccgaggctcatcaaacccagtactccattcacccaggcagcaccaaaatgtaccaagaccttaaagaaaaattttggtgggtcagcatgagaagggaaatagccgaattcgtcgcactttgcgatgtttgccagcgagtgaaggcagagcatcaaaggccagcaggcttactccaacctcttcaaatcccggaatggaaatgggaggaaattggaatggactttataacaggactgccccggacatcatcgggtcacgattcaatctgggtagtcgtggatcgactcaccaaggtggctcactttataccagtacataccacctatacgggaaagaaattggcataattgtacctcgcaaggatcatgtgtttacatggagtacccaaaaagatagtatctgaccgaggtagccagttcacctcaaaattttggcagaaactgcaggaagaattggggacccgtttaaatttcagtaccgcctaccatccgcagacagatggtcagaccgagcgagtcaatcaaattttggaagacatgttgagagcttgcgctcttgactttagtggagcttgggacagatgtttgccatatgcggaattttcgtacaacaacagctaccaagccagtctacaaatggcaccatttgaagctttatacggccggaagtgccgcacacccctcttctgggatcagacaggcgagcgtcaactgttcggaacagaggtattagcggaagcagaagagaaagtcagaatcatcagggaaaggttgaggattgcccagtctcgacagaagagctacgcagataaccgtcgaagggagctcacttttgaggcaggagattacgtgtatcttcgcgtcactccgctccggggagtacaccgctttcagacaaaaggcaagttggcaccacgcttcgtgggaccatacaagatcctggaacgaaggggggaagttgcttatcagttagaacttccatccaacatgatcggcatccatgacgtgttccatgtgtcccaattaaagaagtgcttaagggtacctgaagaacaggctgattcggaacacattgatatccaggaggatttgacatatgtggagaagccggttcgtatacttgacaccagtgaaagaagaaccagaaacaaggtcaccagattttgccgagtttagtggagtcaccattcagaagaggaagcaacctgggaaagggaagatgagttgaaagctacccacccgcacctcttcgccagctcctccgaatctcggggtcgagattccgtttaaggggggtaggtttgtcacaccctgtagttcccctcctaagccaaaaattgaatttataaaggaccctaagaaaaaccggtgcaaagcaagagtaaacccctgaagatcaatgcaaataataatcggatttggcatgtggaatttttcttgagttctacatgtcgaaactcactaacaggatttttagtggaattttcagagccctagaaataattttaaccaattaaaaatcaccaaagtgcaattttaattccaggaaaaaaatcctttttctttttctttttcttttttttctctttttcctcctttctttcggatgggccgctggcccatctcctcctttcctccccctcctccctgctgggccggccgcaggccgaggcccagccggccgcccgcctccctccctcccggggtcgccgacaggtggggcccacctgtcggacccgtctcccacctcccgcctctcccgctcgcgccgccccgccgaaaccgccgccgccgcacccacttcctccgctttccccgcgcccacgccacgtcgccgcgcccatgccacgtcgccgccctctccccgcgtctcccggccgcgccagcgcacgagaggggcgggattcgattttgaatccccccccaccttctctctctcctcccccacgtcgccggcgaaatcggagcgcctcccggccacgtccgcctccccctccgcctataaaatgctccccatgccctcctctctcgttttccgctctcaccgctccatcccgtgccccctaccgagctcgcaccgccgccacttacgccgccgcccgtcgccgcactccggccgtgtgccgccgtcgctagagccgccgccgcactaagccaccgccaccactagcttcgccgccgcaagacctttcccggccgctgctctacgtcgccggaataccaccgaaaccccatttccctcgcgtcgtcggtgagttctctctcccctccgactccggccggcgtggatggtcgccgtgggggttttcctccgccctaattcctctcctctatttccctaggtgtcgccgtcgctcgtccgtacctcggcatcgccggtcttcgccgcctccctcgtttttctccgccggccattgccgcccctccggtgaggtctccctccccttcctttccttctttttttttccccgtgcgccgccgccctcttcgcgcgctcgccgtcgctttcggtcgtcgccgctcgcgccgccgcccgccgcccgcgccgccgctcgccgtcgctggcggtcgcatgcccgcgccgccgccttgccatggccgcccggccggcttgatgccgggcctggccggtacatcggctcgtggagccggagccgtggggcccgcttgccagccgtgcccccccttgagccgctgccgagtgggcccgtgtaccagcgcccttcccctctctctccccgtgccgctgaccggtgggccccgcttgtcggcgccgcgccaccccgtgctggcgtcagccctggaatatattgcgcaataattaattaaggactttttctttattagtaaaaacacagtgaatcttctaaaattcataactaattcatccgagctccgtttaagcccattcaagtctcagtaaatcaagaaaaatgtgtagaatccattaaaaatggttttgttccctgtttcagtagtcttatagcctgtttgcaatgtttgctttgtatgtcgctagattccgattcctccgacgctccggtgtacttcgagatagtcgccgaggttcctccagcagcagagcaaggcaagtcatgcttgtcacttgatcatgttgatcctatattgcaaatatcctaatgttttctttcaaatactgcatttgttttgcaattatactatgggatggttacctattgttacagccatgtttttggataccatgctcctttgttagcttgggttataacatgattagactttggactaggaattgcttagccatgcttagttcaactagcacacaatggggagatctcttttaaaacctagactataggtttataggttaatgttggatcggtaccaccgctctggtgttggttaaataaaatgaataatcatggtgggctgtgggtgcatggttttgctagtcgcgcccatggcaattaaggaccggttcgcgggaaaccctggaagaacgtatcgtacttaccacaagccagcgtgggcaacggctgggcttgtagtgtagcttttctctagctgacgcatccaggcaagggtgggcgtgatggagcggggcgggccctgcgacggcctctatcgcttccggattcacctaggcacgagaggggactgcccgttgcccgctggggacgggggtgaaacctgaggtgtggtgtgcttggctagagggggttatgcgaagggtcctgtcacggcctctttccgatatgtcgtggtggcatgtcggcgcacggaaacgtgtcgtggggctgtgtcttgtgggtatagttgtacacctctgatcagagtaaaactattcgaatagccgtgcccgcggttatgggcggtcaaccagattcaccgtgattagtctcaccttagtttagtctaatgaatttggatagtttaggtggatggttgggcctgttgcaacgaggtgtggcgttggacagtggatgaataatactgcttaattttacaactgttttcgcattcaacccttgtttataaatgccagtatttatgcaaatgaacctgtttagctgttccttgttgaatccctgcatcatacccccattctggtatgacttgctgagtacagtgggtagtactgtcttgctctatttctccccaatcccagagtttgagtttgtgtcaaatggcgggttctccgaggagtaggcttcgtccgtgccgtcgaggatgcctgtggagtggtgttcccgctgcagtcaagtccaggcttagcctcagttatcttttgttttccgctgcatttatgtaagacttttataatgtttgtaagacgtggatctgtatgtcaacattgtcgtttgtgtaccccggccggtcctggacgggggttttaatgcacattctgcttggaatcctattcgggaatttctgggcgtgacaagttggtatcagagccgaccttgaccgtaggacaagccaaatggaaacctaagagccctctgaatccttttcatttgcataagttctttgcaattggattttattccgggaaaatttgggatctgctcttgtggttcaagggaaaaatcttgtcgcccgtttaaatgggatttgccaaaacgagtcagtctagggttttagtaaaaatttttttaagatttattcgtcagtcagttgggatttgatgggtgaaatgtattaggtcctagctcaggaacatgggttgcaaggtatttatgctttatttgtaattacaagtatgtatctaaattccccattattttacctctatgtaagtccgtcttatttattcgctctcatgcaaaatgatttatgcataaaattttgctcttattcgattctcttatttgagtcctttattgctttatttaaatttggatttgagcatgcattgatcctactcctttgtcttctttagatggccggtcacccacccaaccaccatggagagggcatgattgacttcgtggcagagttggcacgcatgacactggtggtaggctaccccaacgcgccggagtacacgacgattccaccgctcagtggcgagcttcctcaccgtgtccgcttggaggtccatggctacgtggggacttgccttgctaacatggtggttgaggcgtcaggaggcacagcagaccacgcatgtcaggaggcagcctacctgatgatggccagactccgggagcgccacaactacatcttccacgacacggcgtaccgcttccaccctcgtcgagcccacggcgacgatgtcagttcgttccgtccgacagctggcgagaacgacaccaccttcggtcacatgtgtgctgtgatgaggggattggataggatgcactcggacctgcacaaggcgaccaaggccttgaatgatgggaagctcatgaggatcgtcgctctgaaggacgagatagcgcgcctgaagagggagaatgctcagttgaagggtcttcccgcgccaggaggagtccggatccgcactacgccccgcaagaggacgactgcacccgtgcgcatccagctcgcgcccaggaacccacctccgcccgcagctcccgcagcacctccagttccgcccgcagttcctgcagctccagctccagctccagctcccgcgtccgctctctccttcgctccagcatcagccgccaggggtccaggcagtggtactggaggttggttgtctgctactcccagtggcagcagctccagtggctcacagtccggcagcggagggacttatctgccaggttccaggagtcgctcagagggacctggtgacgagcaggaggacgccttcgactccaccgaccgcaggagccgttccgagcattaggctcgttttcccattagtttatcgattgtctagtttctgcttgttagtttccgtgtttaggttgcttgtttggggtcagtcgacggtcgatatcatgtgcctatgatatggctgtcccaataaggatttttgcttgctgtttaaagtgttttaattcagatcagaacagttgcagtttaatttctatataataaagcttagttcctgagtatctgtttttctccgtttcccgtctgctctccctccagatggtctacaccaggactggcaaccgcacggcaggcgagggcagcaacggcgaagaacgcgctgatggtgtgcaccccaacagcgattccggcaatggtccgccaccccttcccgagaatccgacactggccaagttatggcacatcagactcag

SEQ ID NO: 71396 - DNA, 19229 bp, Oryza sativa
  unsure (1)..(19229): unsure at all n locations
cccaaatattgtacttgtgtgattcagataaataagagcaacatcgacttcggccaacaggagtagggctattacctgtcagataaggggtccgaacctatataaaatccttgttttcatctcttttacctcaatctcgcatataccctggtaccaacgatccccataccatccaaataccctagccgagacctaaaaggtcgacatgtacgtcatcttctttccttatcatgaggattgccttgatgaattatcactttcgattttagctagatattcatcaatatatgaagtttgaccacttctatatcttcatgccacttgatgtcattcaacaagtaaagtccaatctttacccattttgcagtcaaactcgatgtgggtccacctatgaattacatcttattgatcttcaccatttcatcttgcattcttttaatggttgatgtgggttactcatagattcaactgacctcgggtggaccatcacggcaaagccttcaatcatccttatgaatgaaatggtcacggaaattacctactgacctcgtttctgaccattaccgtttctagacatatataaaatttaacttatttaacttatctaatttatttcaacatctgattgatgttgacactgaatagttcaattgataaatatcatcaattcccaattgatcgagcaacatttctgaagagatctgccccatttcatccctactcgtacgcaccaccaaatttggtcaattggtggcaatcacttgcttgcccttcaccatcgcatggctcatcatggcggacatggcttacccatcgccattttgttgtagataaataaaaagctatgtaatagctaaccatgtgcacgtcgtgtctccatgctagcacttgtagtagtcattatcaattgtggccaagagatggtaactaatcatgaaaagaacattctccaatgtagtcgtataacaagtgtcaatgttttatatcggtataataaaaggggtagcacacgggacctaaaaatagatggaagtggaagataagggtttgtagaagttcaggcctgcccaatgcaaggtattaccatattcctattttagtggattgtatctattgggtgtattgatcttgatgttgatctcatgatttgattgtgggttgtgtatctcatttctggttgccctcgatggggctccctgccaaccttatataggttggaggtgcagggttacaagtaggaaaccgaattagatattcctttggttaccttacctatacatggtattatttggttggggctatataaccttgcttggaatacaagaggtaacatggcaactgtattctactctattttatattacattgtagtcggatacctaactattgttatttgttatgatcacaaataattccacaagcgcacagatatcaatgtacaacttcaccatagattatttcaagggtatcgaatcataaggaacatgtgtgtaatatctaaaaaacatgtttgtccaaggacaataactaaatcataggcggaggatagagaagtttccgaagggtcaaaattcttgaattaagttttggtaaaagtctatcacttgctttgggtaccggctctcccctggcacaccaagcaaatctggccaatagctctgtgatgtacccgaatgtgaaggatcataatggacgaacaaggctgttatcacatgccgcctacctatacaatccgtggagcacacaacaaaccaaggtaacctctaacctagacactacgtctacgttatcaattactacactagcctcggtcaagaacttttttttcatccagagtcttaatactatagcacttaatacaaatactaagtgacgaacccacagtgatgagaatatgtaatgatctaaatcaccctaatctttaaatcgtgcttttatgcattttctagaaattgtaaaaaccaaaacgagcctcaaacaattaaaaatatcaagatagaactcaaattggcttgtgggaattgttattgaatttctcatgcctccaaatatttaaacaaattttactcgaaatttcagctcgctctaacaaattttactgccacaaacacttttattagagttttataacaagaaaaataaaagaaaatcctctcttcctcttgcgccgaatctggcccaaggtgtccttttccaccctcttcacccctcctggtctaggccagccacctctttcccctccctccttccgggcctcccccttcttggcccattctttccctccttccctccacttggcctgctcccgcacgtgccccatctcctcttcccgcgcccagccgagcccgagcactgtgtgcggcacacgcgagcgctcaccctcacgcgttggtaggtggggcccatggatcagctcatcccctacctccagccaccgccgcatcctctcactcctccaaaaactctagctgtttctccccaaatcctcagcaatcaatccatccgtggttttcaaactaaagtggtggagttaatacccattaaatcctcttcaatttccccaattgcccccttgattatagctcccaatctccacgaattggccgctcctcccttaggtcttgttcgtttaatccccaagagaggtggaacggaggggattaaggaggaataattccacgccacaataggtgtggaataaatcacctctaaatccccctcaaacctttttttatgtaacccccctcaatcctattgtgggggagattaaatgaacaaggccttaccggtttccatggctactggcgggatttacggcgccattccgccactccccttggaccgttctctccatcggcctataatacagagttctctccctcctatctttccttttccccctcccgagctttgttgccgtttccccactctgctcctctctctcctccgaactaggtgttgtccagcagcctatttctcctcgtcgacgctccacctttacctcaccgccaccttcctccactctgtgaggacgagctcgaactcggccaccgtttggctttgcccagaggccacctcaccgcgtcaccggcctctccttcctccttgttgaagaaccatattatgaacttatgaactgtttaaacttagcctttatgcaaatgaaccatattatgccattcctttgttacccctatgcattattgtgcatctccgatatggcttgctaagtaccgtgagttgtacttatcatttcttacatctaattcaaaagatggatattctggagaagaaggcttggatggctagctcgtatcaccgtcaagtatatctagttgttgtttccataagcttccgctatcattttgtttatcttagagtgtaagggcctatgctcactctttaataaagtattatatttacgcttccgcaagtgtagcttgtaatacaacaactttgtacgttgagattgtggttattgtactccgccttgctgggacagggattaatacaattagtttttgggaatatggttgtatttctccgggcatgatgaaatttatcctacataaataagaaaacaaaatacccgaaagaaatcacgtatacttatataaaaaaagcatttgtcaaggtaaaactgtggaaagagtaccaacaactccggcactcctccagagctttcngtcacgctcttgccatattctaactctattagaaggttgcctaaatatgtgttgtgttgtgttgagtgtaaagtgagaagctcctttaatagggtccaatgacggctgtggttaatcggtctcacacataaccaacattggggaccaatgggggagtgccacgtagaagaatgcgattaggggtgccattagtggttcggtcgaaccacctccaccgcccctagccacagaccttctctgtgaggattgcaagtgggcccctatgatgatgatgcacgatggataggcttgaaatatcactacaccatgacacaaaatccccaacggaaaatcggttgggaaagaccacattcaaagacaaactgtcggtcggcaaaagttttcctaaccaacttcaacagtcataagatgtctagtcggcaatgaccgatatatttttaccgaccgaccattagatcccgatgacagatttgccgacaaacattattttttccgaccaacatatttttcccaaccaaccacaattcccaaccgatgactggccaaagatattacaattgccgacccacattcagtccaagaactcagtttcttctttttttcacatatacaattcaataatatacggtgaattgtatttcaaaacttcttgaacacatggagcatagggaaaaactaatagtcacaccaaataatgaaagtctcactttattcattcaacgaactgtattacatagttcttcaaaagctacacataaatcccaatattctctaagtacaaagaagttcctagtagcaactttccatctaacaagttctatccattgtacaatgtcttcatcatcaagtgaatttgagcaacaggatcagtggttcctctaggacctcctcctgcaaaaaggaactagtttagtcaagtagctgaacttttaactaaatgttgctaacaaaaaaaatattctaaaacactatgtcaagtactctagttgcttccaatcatttggggctctaaattctccacacgcatgatatgcttcaacaagcatataggagcttcttcccattatttcagtaccatatatatatttttcaagactaagggcctgtttagatccatttggaatggcaaatggcaaatggcaaaagttttggtagcaaaagttttggcattgcaaaagtactagttggtgtttagatgcatgttaaagttttgccattctagcactaaagtgagagagagaaagagagagggagtggtcccaaagcattttttggcacaatttgctactatggactagcaaatgccaaatgccaaattgccaacttttgctactagtgtttagatccaaaatggcaaaaagtgctacaaaatggtaaaacttttaccattttagaggatctaaacagggcctaatagaagtaaaaccaagtttgtaaaatactacaataaataagtagtagatagcaagcagtaaacatcgatcggatctaaagtacaatgtccatatattatattctttccaacttgtgaatgtaaatccacggtaccaagataacaaaattggagttctcttcaaataagatacaaatttgtaaaagaaaccgcatataagtggttttggtcaccgccttaccggccggcatcggtgtcctaagattacagaagcatacaaactcaactgtggttgaaagcttgaagccactgccatgctggagcagccgatgccagtcatggaacagcaaaacaaagtcctcatcatggaacctgcaagaaacaaaaacaacagcctgagataatcctatgttcatatattttaaaatttaaattttcattaaatacattgcacatacatgattgcaaaaatatagtatctgggaacaaatctattaagacaggcattgctacgattacatgaaagagcttaaagaccacgtgtttcttaggcaagggtgatgtatatgactagtgaatctatgcttatgtggaacctatgtccaacatcagtagtcaatcttgaacagaaaaataaaactaataaatcataaagtacaatctgcacacataatgtcgaagtatcaaatatcatattttataagaaaattcaggtattataataacagataaactagaagtttaaagctccttagtccttaccttcaatagatcaaacatataatatcaaacaagttatccatcaagcatgtcattttgaggtgcacacagaactatactctattttcccacattatcaaccttcacacgaacaattaaaactgaacataacagtgatacttgccgttattctcttcatttcgaatctcaggtctcaaatcgtgtatctttgttcactccgcctctggattcctctgcaattttgcatataagagaagcgagagcatcacatcaaacatcttgacaaatctgccgcatgcaagtgggttagtcaccggaagtagtgttgcttgtgagattacagatacgtaccaactcgtggttagtaataattcctaccattaggtttggtgtttcattttattttcttttatgaatgatttgatggtcagatttggtatttaaggatcgtcaaataaccattttgtccgcaacaagataaagaaaaatagtagtttcaaattgcttgatatattttgtttacgcttttactttttttatgaaatgtttaggcttttactttttttatgaaatgtttacgctttttcctcaatctatcagggtggtggacatactgcaccagagtaccagccggggagatgctcagccatgtttaggcgctggatttcaaacatgccactgtgataaattaatgattatgctagccggctagctgtacagtgtacacaatatgatggatatgtattttctcgatttctggttaattaattaccttgcaccatgctgtaccagattctgaaatatcgtacgcggtcgaggcagataaagtttttcatggaacaagtcatgctggtgccatgtgccaatcctgagctagtgcttgaaaacaaaagcttgatctgtccaatcatttgaagaattttacttcctctttatcttcaggtgctagttttcgatgaggtattttaatattttgtgattattttattggctgctcaaagtttggcagatatattctaataaaatagatacctacgtactttggcactctcaggaaattgagacaataatctagggattttgaataaaccaagcgtctaaactatgtttataatttagtccgtttaacaggagagaatttttatgcatattgaaaaaaaaaagaaagagcactaccaatacatctgggaaaccgatcagacataaggcgtctatcaaaccggtcacaaatttcggtggtatatattctaaaacactattgttttaaacttttaaagcaatataaattatttgtctataattatatactaaaagttcatactataaacgctcctaagcatatgatgctcctgcaaatgcttcaaagagtgtcacgtggttctttaaaaaaaactactcgatttcccttaaaccataatacccattattctttaactattagatttatgtttagagatatagataactcaaatggatcggcagacccattacagggcatttagttgggggaactattaagagtgaatgggagtttgagggatgtgggtggttatggctgttgtttgtttagttgatattagtgagcgtgcacgtgtaagacatgttgccatatattgaatgaagtaaattgaaaaaaacaaatacatccatcgcttaaatcaatcttaaccctacaggtaaacagttcatactttcagagacaactcggtgtggttagtgcatcagatgcaaattatgtgcagaagaagtgttttctggcaggtcatattgagcacaaacatcttgcaaaaagcacataacattatattctaattcacatttattttttcttcaaataagaatcttaagggtaaataaaactcatagaagaataatcttagtgtgtttccttaaatttattgaacccataggtaaaataaataaaatcattgtccccactacataagattttttgaattggcaaggatctcagatcaatcttgctcccataagtatcaggcaaaatttgctacagcacacttaaagattatggtctttgctgtgagacacccgaagatcgtgtatttgcccttggacaccgaaaaatgtggtaatttgctggcggacactcctcccattattttattatttccggctgaaacggtgagagaaactttcctaaaagacattttgcccatgggccatttgtataagccgaccaggtccggctgcaaccagatatgagagaaggaggaggaggcagagcagccatggctccctggccgtgctctgccatggcggcggcgcagcggcgttcgttggtgacggcgcatggctgccgcgacgagcgtcggcatctgcaagaggagatggaggcgaacccggtggcgtggcacggggctctgggatggcgtggaggtggcgctgcggcaacggacagcgttggccggaattggggaagagagagaggcaatggcgcgaggggaagaaggcttcggccttggagctcaccggcgacggcagcgcagcaaggaaacggcgatgcccacggtgcagcaaccggccgtgatggcctccacgacgcggcggctcgccgcggccgcgccctcgtcatcgccggtcaggcacaggcagaaccgcgctctgcccatgagcttgccgtggtccacccctgccgggaggagaccgtacagcagctcctggtcatcccgcccctcccaccgcgtgagcagcacctcccgcacggcgccgctacctgtagcgaagaacacgacctgtgtcaggggcaggaaagagagaagaaagaagaacagtgtcaggggcattttggtactttcaacactctttctctctgttttcaccgaaaataataaaataatgcctcgagtgtctagcagctaattaccatatttttacagtgtccataagcaaatacacgatttttgggtgtctcacagcaaatgccacaatctttgagtgtcctgtagcaaattttgctactgtatcagctcatagccccatagacaacatggcagtcagtcaagtagacatgaagggaagatagtcttcaggcaggtcattatggaaaaacatcttctagaaagacaaagtctatggtcatcatccataaacatttccccaaaaaaagtagcctatggccatcatgcataaacaccttcctaaaaactcttatcttctagactgaatcaacaaaggcacacaacttcttctatctacccatgattttttatggtactacctagtctcgtgtccaagtttgtcataatatgcccacgcacagtgtcatatgtatagattattacgtttaggtgaaggagtgaattaggtgttttctaactactcaagtttaaggaaagttcatccctcttcctttgatcacattgaaacccatgatttgggagatcaaaagtgttgtttgcaaaattgcatgcttatttataactatcggtaacagggcaaatggtaattatgcctgttgactgctgttaaataccaaattcacgccgtcaatacctgcataaatatgagagtataaaatatccaacatagtggtagggtttatttctaacaaagtccactagcgttggtgtatatttggatgcaggtgacaaatcatcaaagttgagacaaaagatacataaagaaggaggtaaattaaacttccatatttaagcctatggagtttttgtgtcacaaacctaatcaaacacaagcaaatgggcccattcaccatatatatatgcaccgaggagtccttcaccagagcccaggagaaaattcggggcaaaatgggccagcaagggtttggccgaacacaaaaggatcccaatcggctccatttttcacgggcagatacttaccgatattctaagacccttgagaccgtttctcaagaggacacatggcaagaggagagtgaagatgccatttagatgcttagcatctccacattttcccaaagcatctccctacctataaatacctctctcttcctcacttctaaacacgctcaagcatgagctgaattataagaggctctattgtatcttttatatacattagaataggcagacagtaaggaagaaagagtcggaggaattccgaagttgtcagtattttcctctttaccttttgtaccttgtcaattactttgctttaattgataatatctttatcgagtaagtgagttttactttgtgaggattatctcttagttagttcctattagcatattggattattgttcactattgttcaataatagatagtgattactttagtgtttaactaacgctacaatagtaattaattgcatagacgcaatgtctaggtatttaattaccagtgattgctgcgtatctaacatttcgttagaggttggtgtagaggtggtgatagccctcgagatcaccggtcctccctgtccgggtatggagtaaagcgagatctggtagcagcgagcaagccaatgcctgaagtattgcgataggattaaatttaagttttctgtacacactgttcctcactaggaaatcatctctacgctttgcccattttgctttgtgtccttggttgaactttaagaggagttgaacacacacgttccccgtgtccttggttgaactttaagaggagttgaacacacatatatatatagaaaaaatgcccgtgcgttgcaacaggtaaaaacattttttatactatacaatatactcccttgtttttgtttttggaccgaacgttcattctttccttccttttcagctcagtcccagtgcagtccgctgtctctatttgctcggcctatctctctctggctcagcccacaagtggagctgtaggcccagctcgaacagtcctttgcctggcctatctctctttggctcagcccataagtggagctgtaggcccagctcgaatagtcttgtgcctggcctagtggcctacctctcttcggctcagcccgcaagtggagctgtagtcccatctcgaacagtctcatgccccgtaccatgacggagccgatcttcccaccaaatccggtaatctagtcgagctcgcataataccgtgcacgtacaatgatggagtcgatcctctccgtcaaatgcggccgaatctttctcgacctccaaaattattgacatattttaatccacttgatctcctttttctatttttttcataaaaatcgaagcaatccgcaaaatttgggataaaaaatgacgaactaaagggaatttaaggggaaaatgatgagagagtagtggggaatccgtttttcaatcaattggatgaggaaacacatggagaggcaaatcgatacggcggctagggttcggccccacaaaaaaaaaccgccaaaaaaatagcgtgttggatttcgttgaaactggaaaaatggtgaaaaaaatggcgaaaagaaaatgaaaaggaaaaaggaaaaaaagaaagggacgaaaattttgtttttttggctcttttatatgttttttctgccgtgccgggttttttttacaatcgttttttttgcggcactttttttgtccgcttttttatacggacaggaatcggtcaggtttttttttcccgcgccgttttttttcgcgccggactttttaattacaatcgaacttttttttatcgctttttttaattaacggacgaaggaaacatcttatactttttaagtagtagtagaagtagaagtgtgtgtctatatatatatatacatatatatatatatatatacatatatatatagctaaaataagtctattttacatccctactctttgagccgtgcaatataataaggctacttttcctccctattctttgtgacgtgctttacatatggttgagaataaatctgtttcgcatccctaaacttcgggccaggccgtgccggcccagcgtgctaaggtagcagcctagacacgacacggctgttgggccgggccagcacaaccacgaccggagcagctcaggcacggcacgactgttgggcttggctggcacgggaacgaccgtcgggccaaaattaccgggcctgggtacatatagctgtaccataattactgattggtcgatctagagaatccgacatcgaggtccccctttttacaaattgcgcatgttttgtaactatcgtctccccaatatgcaataaaccgcaagtaggggtgccgagctgtttgacggtgtcgtccttcaatgcgacgatggccttgctcctcccgctcatcgtaatctgcatcgtctccggcgtcaccgccgacgccaacgccgacgcgccaatgacgcggacgcatgtcgccagcctaccgggtttcgacggcgccctcccttcccgcctcgagaccgggtgcgtccatctcgtacgcccaaagttttctggtctctgctctgcatcagtcggtgagaggggtcgtgctgacgctacgtgctacaacttgccagctacgtgaccgtcgacgaggtgaacggcggcgaactgttctactacttaatcgagtcggagggcgacctcgggagcgaccccgtcctcctctggctcaccggcggcgaccgctgctccgtcctcagcgccctcttcttcgagatcggtcagcaaccatcttccaccccgagcagtgccactgacacaccgtcctccaatttatcaatctgctagtagctgctttcttgcctgcaggcccaatgaagctggtcatcgagccgtacaacggcggcctgccgcggctgcgttaccacccctactcgtggacaaaggtggcgaacatcctgttcgtcgactcgccgatgggcgccggcttctccttctcccgggaccccaacggctacgacgtcagcgaagtatcctcgtcgctgcagatcgtgaaatttctctaccgagtatcgatccacgcatgcatgcactgtctatcctatgctaattgttcgtggttgtctcgtgatcgttgtaacctgttgctcgtcttgttcagtggttcgatggccatcctgaatatctcgcgaatccgttctacgtcgggggggactccatggccgggaggttcgtcccgttcatcacggagaagatctccgaaggtgttgcaatgttacgttacatttattacccgagatccctacttgttcacaagaattactactactgctacaagcttaattaaaccagttcatgcttgatcgctcctctgtttttcagacattgaagcggcggttagaccaactcttaatctgaaggttagccaagtcttttccattaattgatttaattcctcgcaaaaaaagtcattggaattaattagttggtgcaacttaagaaataaaactgtggtctcccatatgtatcaaaatactagccaccctgtcgcgcttcgcgcgactctgagttctaatataacctgtcaatattagtaggccatctatattggggtgtcgcaaggctgatgcgagagcgagacgacggagactgcgcccaagatttggggatttggatcgtctctcttgtgtgtattgtgtcttctccggagaataggagagattatcgctggttttttttatcctctcctttcattgttgtgcaaccttcccgatacttcctttttatttatttattgtttctttgactagatttgctctaactaccataaactatctgcatatgtgcaccgatgcgtgggaactggaactctcctgattctgtgattggtttacatgatccaacggtcctgatttattcatactctcatcctaaggctattattagttcaactgacgtggctcattagtttttgagaaagcttgttgctttcacatatgtagatgtcctctgtacaatttgctcttcgaggaactgtagttgatgtatagtcagtactagtacgaatatggggttccccgaaaaaaaaattgaaaatatgagcagtagttgaaacattacttccttcatgatttatgtttgttcacagctcaaatcagtttcacctaatagcttgacaagtttgtgatcagacattcctctgttttaaggaattccagagggttaggagttagaaccgcacttactcagaaggtagcagtatttatgccttttgtacggtgcaaatttcattgtaggaactgttgttaaatagcaacgttttttttttcgcgggcagagacagcgaatacagtacctagaaacccgagaaaataaaactctatatgtcgattctagaaatcggcaatgagaaaagaaagtagcacacgggatttaaaatagatgagtaaacgaacaaaggttagactggttaatacactattcctgtttcggaaattgtatctgtcgggtgtattattgatctcacaatcttagtgtggttatgtccttggaggggctccctgccctccttatgtatataggttcgggggtaagattacaaagaggaaaactcagtcgaacatgacatggatttcattatacagttatacagtcatataagactaagatttcatactgtaccttagaatataaggtaatacagtattcaaagcttaatctctttacataatatacggacttggtccccacctcctatctctagtctacgagtaaccaatctctacatgtaaactaccatggttaggactaaaaaaatagggagaatagctcctgtagtccctaaagtttttatgtaggatcagtttagtccataaccttttaaatagttcaaagaaatccttaaactttatcataaggcctagaataatccttgagtccaccaaaatcgtcatatagatatgacatgtcatcattcatggaaaatctatgataaattgttcagtttacccttacgtatatcatagaaaaataaatgtaaaggtgaattagacataaccataggaaaaaaaatacttttccttttttcacccttttgacgtatatttttgctcttacatataccatattttttaactttttccttttgttttttattttactatgatatatgtaagggtaaattgaagaaatcatatagattttgcatagaagggtgacatggcatgtttatgtggcgattttggtgggaccaaggactatatcagcccatgtgacaaatttaaaggacttgtttggataatatgaaagattaagtactaaaatgactcatgagcgaaactttagggagcatcttggctattctcccaaaaaaaatactcatggtgatatggtgataagaataaatctcagacatttatttttatcctacaataatttttaagtttgtactgtatatttttctcgttatctctgtataattgattatgcactcgtgctgaatattttgcgttttgggagattctcagggctatctagtaggtaatccagttacaggcgaaagtattgacaacaaatcaaaggtgccatattttcatggagtcggaataatttcagatcaattatacaaaataaggagacaagtgcaacttgatttcatggagtcggaatagtaaagagtgacttgtacatttcttaatattattaactgtgacacacctggtcttcagatgatattggagcactgcaaaggggaggactacgacaagcccaagaatctgatttgcagacaagctatggctaggttcaacgaggtacaacttggttttttgtttattctcgtgcttttggaaaagttttatccttgatatcctttccagtggaaaataattatatgggaatttctgttaaaatcaacttaacaaaaattgtatgttcaaaactatatttatagtacttacatgaactagcgggaagcccgcacatatacacacttgcgcaggcaactcatttattctttactaaaaaaagcaactcatttattctttattaaaaactgttaaaagatgttatgttaccgtattttatttaacgacggtagattatcttatgactaagaaaacccgctctgagcaggagatattgtgtcctgactctcttcatcaccccgacagcaaacccatatctatcgtatttttgtttgtgacctttcttgtgcctacctgcacaaccgtacgtggtgaaaatttcaggcaagctaaatagaaaaaacttgagttccaaaaggatctcttgatatcagttccatttcccatctcaatgtacatcgatgccctcaccctttctgactgacgtaagctttttttaataaaaaacttttaaattaactatactttaactatatatttacagaacgcagagttttaaaaaaagagtgatttgtgctagaatcaagattattttttttaataattgaaatgggttaccggtctatgcccatgggcacatagccaacaagtttcagataaatatagacgtgatgggaaaaaccccacaactcctgccaataaaagagtccactgaaataatgttttcataatcacatagtttctagcatgaaatttcgtacgtactatgccatccaacctagaataaaatctccgtgtaggatcgaaacacaataattaagccaaccagagggggtgaatggtcggtatacccaaaaatcaaaaacttttagcggaaataaaagttaccctcgaattcgatggagatcggtctgtccggaataaattagccggtttgattgaagcgtagccgccggtctgaccggtattgatcttacggcctaaccgccgaaacttgtcgccgcctcctgttaccgacgccggtctgaccgccatgtgcccgccagtctgaccgccgcgatgccgccggtctgaccgccggtgcgccgccggttagaccaccgaaacccggtgaaacacaaatcgaagaactcttaaagtggatgacgactttattaattctctctgtgtttacaaagtgcaccaacaacactcgttacaaaaatttcgactaaactcgaaaccctaactcaactctcaactcaattgctctcaaaagcgatacagggaagcctcacgctccccttctatttatactcaaggtaagcagcctaaagccacgaatcaaatacatactagaagtcctaaacaccttaggaaaccctctggtacaagaaacaaactttacataaccaatcataccaaatttggacaacttacaaagtcgactctacatcccatacgcacacaatacctccattgtatgccatatggaatcttcaccaaccacgtgtattgaattctagccatagtatctcgcatgatctctgaccaccacagacgtcgtcttatccctaagccgactcccggtccatcaccgcaaatactctcctggcatccgagtcacctacatatagaacaaacaaagaaaccatattccaagaccaagcattctccaacttgactcaaacaacagtattacatacgtatagtatccatctagaggccagaatcatgaaacaatcacggatatccaaacaaacaacccaaaaccaaaactgacacagagtcggctggtcaaaccgcgagctgcgccggtctgactgcgcgatacacgccggtctgaccggcaaccactacccggtctgaccggacccattccagtagtacctgtagattcacctgtgaaatccaatcatctccaaaactacttcgtgaatgaattccaaatatcaaaaccaataatctccaatgccaattgttcatcacagaataataatcaaaaacacctttgattttacaattaaccccttgatgaacacattggcaaacccatcaaaaatgtttggtgtttggaaaaataaaaacaaaactggtaaaaagcacacttcgtacaaacgtacacatcgtgctcgaaaatccaaaagaaaacttctcttacttttgaaaagaaagaaatttgcttttccaaaaattttcacttggcttctcccccttttgacaatgatttcatcaagcataggaattatgttcattaatggataagagcttagcatacatatagcatatcatgtcatttgttgcaataaaaagaagatgaacccatctataatatagcaagcatgcattaaaatataaccatgaaccaaagagtttacaattaagcttgaatcaacaatcaaaattcatgatttcatacgaattataatgcaacatcttaacaagcacataggttgaaaaataaacactaaacatatagacctattgcatttatcactctttctcaaataacctttagcagaaaataaccaagagaatttttaactttttcttttcttgagcctttttgcttatatttttctcttttattctgggtacgtccctatcgtcaagactgtttccagggattcggcacccattattttgctcacattgaatacttccttgtcatcaagactatttccaaggattcggtattcattttttccatatttttattctcttttcacaataagaaattaaagctattcgaggaataacaattcaataaagcatatatatagagcatttagaaatcaaaccacatgctagcgtcaacattgcatatttacttaattcaaatatagaatttaagtgtcatgcatcatctcccttaaaaagcaaaatctaaatctcatgcaaagactagaatacaaacaagctatgttagagacaaataaaccttcaaagtattgctagcatgtacaagaaaataccacatgtataaacaaagctctcttttctcaatttttctcattgtcatattttttgcttgataaaaccatgaggtacaaactccccctcaaatcatgccaaaaggatgaattatccccaattcaccacgaagaaaagcaaaacgattagaatccaaaggtttagtgaaaatatcagtaagttgcaagtttgtgtccaaaaactgcaattcaacatctcccttctcaacatgatccctcaaaaaatgaaagcgaatatcaatgtgctttgtgcgtgagtgttgaacatgattcttagcaatgttaatagcactagtattatcacaaaagagaggtactttctcaaaagtaagtccataatatttcaaagtagataaaagtcaaagaatctatgaacaacaactagcagcagcaacatattcagattcagcagttgattgagaaatactagattgtttcctagaagaccatggaatcaatgatgtatcaagaaaatgacatgttccacccgtacttttcctatcaattctacaaccaccaaaatcagcatcggaatatccacttaagcatatagaagatgaagtagaataccaaattccaaactcaagtgtatgatttaaatacctcattatttacttgacaacttaacgatatgaagcacgaggagaagcttgaaagcgtgcacacaaacacacagcaaattgtatgtctggcctagaagcagttagatacaacaaagatccaatcatacttctatactcctttt

SEQ ID NO: 71397 - DNA, 2068 bp, Oryza sativa
cgatccacctctcttggatggcacagaggaaggtatcgaggaagattgtggcgtggagggttgtggagggcaatgtggaggaaggcggcaaggacaggtgttgtggcatcatatggaaactgagagaagagaggcgtgagatgacagaaagcaaggactagcctcacgcttggtttttgtcgatgcctttttaatatggttttatgattttcataggcatttctggtaccagggttgcctatgaaaataacttaatttcacacacaatcctcttacgtgaacgcttgcgaaaaacaattttcgcagcgggtttagaccacaggacctcctcaccattattacaagtggattttcaacggcctacatgtaaaaataaaatttggctctctgcaaaaaatcatttttttttagtagtgtgagcatgtagaaatcagtcacgcaacgatcagaatatcattggattgatcagtgaagttcatccctaatatgagttcatagagagacaacttgagatacatccattatatcagggatcagcaagtaggataaaactttcacatgacactcctcaatgtgttagctatatatactccctccgtcccaaaatagaagggattttgggtggatgtgatatattctagtacaatgaaccagattcattgtactaggatatgtcacatacattcacccaaaatctcttatattttaggacggagggagtcattctttatctttaaataataatttaataatataaataataaaataatatggaatttaaattaaattatatatttaaatttaacttaaagatactatgtatgatcaaatccattaattctacataagattaagttcaaaaagtttaggaaaagttcaaaaaaaaggacttttggaataaaattttgttcagaaaataataatttagaaaatgtgtagaaaaatatcgtaaagaggtgaaggttgtcaaacttgcaaatgaaaggctttcattcatgcctaatctacaaaattaaaacatctcgggttttatttcaaagtctctagtagaagcaagatacacatgaagtaaactgtgggtcctatgacggcggagtttgatagccaagcgttcacgtggctttttcccgcccgtcgctcccatgcaaaaccaagtatgcatttagatcatgcagatgtcccaccacacatcacatgattacggctccctataattagtgccaaatgtagttaatgaacttttacatgcaaacacaatcaaaattttcatgataaacttttgtatagcaaaaatttagaaactttttatatatagtttctatgtataaatttatgtgtataaaaactttcatgtatacactttagtacataaatcgattaatacactttaatttatgtatagactttcggtgtataaacttatatgaacaaaagagagtatgaggacgcggttgcctaaaacaggctatcggggtgcattcatgagggcacaccgcccgcactcgttagccctttcaatcaacttatgatgcctcctctagcacaatcaggctataacctagcatggttgcatcaacaacaataatccattatatttcatagcatattaattagactcattattacgataccatcaaagactgaaaaaaaatctgggttaacgttgctcgtaactgaatctattttgtgaatataattgaactaagggatagattgaagttggtgatcttcatttaatagcgatatagtagagaactctcctatctttgacggatagttaatacctaaaagatatccgcggaaggaaacaaacatgcaagcaaaagtaattaattgatcttttaagacaaatttacttgttgatagaggctcacaatttttaaactgtactttgccctttctaatcaactcaaaatcgagacaattgtccggcacattttaatatcaagataaaccttttcaaacctccttttatttaaccctttttagagaacacttcagattatcatacataacaattgcaagatatatatggacatttgtagtataattgatggaataagaatta

SEQ ID NO: 71398 - DNA, 1926 bp, Oryza sativa
atcgccgtggttcgccccgccgttcacagccgccgtcggccgtccgttccggccggcgcccttcttcaaccttccgccggcccgtgtggcagccacgtaggcgccacgtcggcgccaactcggcaagaccgggtcaagccgaccccgatccgccgctcccctctgccccgctcgcgcgcgcggtccaccgcgagccgtgaggctgctcgtgggcccgccgcatccgcacccaccgcgagccgcgcgcgtgtaccgcgccccgctccaaaccctagcgccacgtcgcgtgctcctcgctcacggtgagccgagccgccgacaagcgggtcctactcgagaccacgccagatggacccggcccaccggctccctctctcctcccctcccgcgcgtgccttgggccgccttctcgggccggccggcccattaagctcggccgagccgcccctttctctcgggccgcgccctagccgcccgagggaagtctgtttcccctccctctttcttttctttttcgaaagggtttaattaaatcctttttcctttagaccaaaaatccaataatcttagaaattcaatatcttctcaaccgtatgtccgtttgactccgttcaacttccaaaattcctcaaatctcgagatctatttaatggcacgtttagaggtcaataatagggctttattttcgccgtttgttgagttgtcccgtttcgcgtgtagtttcggagcccgaagacccgtagtgcgaggatttcgaggatcaagctcaagatctcgagcaaggcaagtcacctttgatcatcttgcacctataatttaaatctaagtacttcttttccgcaaatattgcatgaataagtttaacacaagtatttcggccgcggcttgcgagatagcctgccagccccaatcctaattgctgcaattaccctccttgaattattgaacacttgaaccacctttgtcaactgttgtgcttcgatgcatgggcctacaggcacgtgcatcggaacacctcccctcaaatttaaaacatccaacgatgggtaaaacttggggttttacaaaagacttggaaaacccgacacctgggtcggtgcttgcgaactaaaatgaatttccaaaatcgcagaccaggggacgtaccgggagtacggtttcccgctcttgcacttaaggaccgtttccttagaatttcatccgaacataaagcaagtgcgaccacatgggtggaatgggacacccctggctgagtaactagctaatcgggggaaccatgatgccaagagacatgtggattcaacagggtggtgccggggagaacccccgggcttcctggcacagtatggtctgggactaacctgatgtcggtctgggacccctctcgttagcatatggtgaacctgtgtcggctttcgaaatgccttgtcatgaaagcctcaaggtctctagacgtggccgttctgcacgggctgggtgatccgggttagtaatgtcttgtgggtaaagtgtaccccctctgcagaggttattaaactgttcgaacagccgtgcccatggtcatgggcgaatgtgaggtgattcctagcatagtttgactactgcttgtgaaattactgttgtggaatgggttcgatgtttggaaaatctacggctgatgggatcagccaggcccgggtggccgtttgaaagccgttggccgggtgccaaccttgaatcaattcaaagattgatacattgcacatactccgaccggacgagacgcactgtctcatccgtgtcgtttgagaagcactcacttagttgtttcaaaaaggagtttaaataaaaccaattgcaaaaacaacagcctttcctttgaagcctgcattaaacacttaattcccatggcttgctgagtactcctgtactcacccttgctctata

SEQ ID NO: 71399 - DNA, 3254 bp, Oryza sativa
tttctttttcgatgtattggtttacacaatatgactcccttatatactccccatattcaggctcgtaggcccatgcaacacctaggctctcataggcctagcttacacagcctaggcgacaccaccccaggttatctacattcttcaagtgtgacaaggcagcgatcgacgctagggacgggaagggagcaacggaggcccgacatagagaagaggaggaggagtcagcggcgctccttgcttactcacagaggtggccagggcggcagagaagacgacgtagagaggtaatggtagttgcaaatacaaagatgattactaccatctgtaatggcttgaaaaaaattgacccattatagatgtccttaggtcatcaataatggctcttaaataaggagctgttatagataacatatgtaatgtggcaaattatcacattttttagtgtattcggacaaattcactatcttatagtgttcccagtaaagatcgtattttttaagtgtcctgtgacaaattttacccatgcagtaccacataattatgttgcaaacatattttttcgtgcataaaatagacaatggcgaacataaataaattcataaataaaacaagggcgtataaatacattgtgtctatatccgtgactagctaacttaaaagggaatcaatattaaaacattggtgcatatccagctaatccattctcttcaacatatggcgtgcattaacctagcgagtaagcgagattatatagatgtcaccatttagacacactctgttaattaacaacgctgctttggcatgtgcaacatcaacccctggcgtcgaagatcacgaatcctatctcacattagacattaatgtctcgtcgaaacattaattacatgtttcctgtttgaacataggagtagagtcctagctatataaagccggcatgctcgtgcacctgagcacctcgctagctagctaacgctgcttcacacctcggcgccgtcactcgatgggcagcactgtcagcagcgtcaggttgaatgttatatccaggataattgtcatcctgaaattcttttatgactaactaatgaaaagaaggaagtaactaatgcgcgcattaacacatgaattaatatggcgagctagtagaagttggtttaaatcaaaggtaaacttgatcaatgataagggggatacaaattttattatgaatagtgcaggtatatagacatatttatctgcatttatttcttaatggatgggttgtgcttgtttgaaaaactaaaatatggtggcagacacaacttatattaggataatttgtagacatggaaggcctaaatgtgtgcaatacacttatacttggccctaaacaaggaagctttaaatgtgtgcaatacacttatacttggccttagacatggaagccttatatgtgtgcaatacacttgatcgataagtactgtcttttaattttcataattttgtgcataatattcaaagaaatttcaggatttatcttttaagtatctagatttagaaaaacctatcacttttcaggaagggctctcacacacaacgatggcatcccatcttatgagtcattttacatagctattacgtattcagagatcatagggaggaagaaaagaggtccttccaagcagagaccacaaatcgatcatctaccttaagcctgtctgcccagagtgttgcatcctcaatacatttcactagcaatcgatacaaggatacagtttcatttcggaacactactccatgacgatgattccacagattccaaaagcaaaggaggtagaagaccttgtagtgtcttgctgggatttgcgcaggagggagtagggcagctagctgcttggtcgtcgagatagaaatttgaatgttgaggagctcccataattcagcagtgaaggggaaatgtaagcacagatgcgaagcagtttcagttgctgaattgcacagatcacacgaaggggactgcacaattttcttcttatgtaagttgctcttggtatgtagcctttctagagctaacagccaagtgaagaattgcactttcagaggcgctttgttattccaaataaacttccaatttgcacaaggctcaatatcattacatgcagcaagatagatttgtttcgacttcaggatgccacccccacctcgcttactcctaacatcttgatctagtgagctgatgtgtccttggaggagagtgcaaagctggaggaactgatcctctgccacagacgagaggcacgggacgaagtgattccgcaaatcttcagcaagaacctggaacaccgatgcatgtttattcggggagtgggtatagagaggatttaacttatatgccagaacgtcttctccacaccagcaatcatgccaaaaggaggtgtgtcggccatcgccaatctgaattgaggtgagatcctgcaagactgggagaagaagcttcgttgattcccagtgaggatctagctgtttctgttcgttgagattcggacttgcatgttccgcccatatccatttagaccaaggcaagtctgaagagtgaagatggtgcagccttttaacgagcagagcattgttctgtcggccaacatccttgataccaaggcctccaaattgctttggaatgcagattgaatcctaggccactaagcatctggctccaatgcagctatcctcccctgtccagagaaatgctcttctcatccaatctaagtcttcaatcgttccttttggaagcttgatggctggcatcgcacatgcaggtaagctgtcaaggatcaggtaagctgacatcccatctatttaaacaaccccaactagggtcagtccgatcacccaaagcccttgggcataaagctaagggcttattcggttcacaggatttccaaatcacaggaacaggaaaaacgtaggaatagtgtaggaatgcatgtgcaaaacaaaggattgcaacacaggaatttttactacactgagttaaacaaaagatgatagagtggatgttttcattcctatggaattagtacattttggaggattggcatagtgttcctatggaaaatttttctttgaatcctacaaaccaaatgcatgaatagtgattattccaaaggaattgagatttcctttaggaatccttcaaaacgaataaggcctaagttggctcctggcatccgctaccacggatgcttccaacaattgtatagcacaaaggctgcagg

SEQ ID NO: 71400 - DNA, 7215 bp, Oryza sativa
ttaggcctataaaggagtagaatgttggcggttgatgggattctaaaaactataaacaaaaccccaaataaaatcccagtgatgatgggcatgccgttatgcaacatggtcatgacggttgacgggacatatggagagtaaaataaaccccaataataatcatgtttgattttaaattctcaataataataaggaggggaagcaacgggcgggctgtagagcagtatagtggcgaagccactaacgatttgacgagacttataaaaagtaaaaaagaacacaaacaataattatgtttgatttttaaaattccaatgacaataaagagaggtggcagcggacgagccgtagagcagtaaattggcgatgtttgacgatacttctaaaaattttgtaaacgaaatccaacaagacaatgaactctaaaaactataaggcctattttttaaaaaattttaaagaggatgaatagaagttgtggtaaatcgagtaagcaaataaaaaggtgacaaatgagtaaggggtagtgactgatgtggcttttaagaatataaaattattagaataacggaaatgataattttaaataaaatcatgtgtaaaaaaagataattttaaattgatgctacccgcgcaattgcacgggccgcccaagtaattaatattattcatgtttctatttatgtttgcaatgttggttaattttgatcaaaagtatgttttccgaatgtggattttaggaaccagggagcacatgctcccgtcatttgcctgctctttccaaggtcgacgatggaaggctgagcctgactaccgaaggaggggctaacatactgaaaccaatcacctaagctagctagctaaacggactggtttcggaattttggagcaaaattcgtgctaattcgatccccaatattaccaacagtgctaaaaataatttgtcagaataataatcctcaaatttcttcatattttcttggttccaatataccgttatatatattattgtaacgcgtcaatatataaacataactatagtgatgacagaattgtcaatctaaaatgagcaaaatatattgaattagttctcagtatcggcttgatgaatccttgttgcatcaaatagttgtacacaactcattggcatgtgtgtgacgcagttaaccacgacatcaagtactatagaatgcagtaaactaatttcgtgtgcattcgacttctttagaaaaaaaggagagtaacttcatttcctactacatcaaataaagctgtcagagaattgtgctaacgtcgatgtatggtactgcgaatggtggtgatcagcccaaaagggccatcgaccacaataagcataaggatctccattccattatggataatgcagtatttataagcttactttgttagaatataattggttctttctagtgtttagcttttttttttctttgggtagctggggttttctcccatcacacttagtttttttttaagtaacaaaaattttattagctttgtgccatacaatatacgccgagaatgcaaaacattttcattattaaacatgtatatacatattgtcgcgttgataacttgatatatacatctatgttcataatgttaaccatacatatcttaatactccatctttcgtgttgttctaaacagattaccacatacatttatagttgaataaacaagaaaatatatcgactaatgactaggagatgtgtgtgtgtaatgtgaacatgcatgattaacgcctctatgatatactcctatgttagtacatccatgaagagttggagaatcgatggatggccgatgaaattatctatacgtactactccttccgttcagaattgatcaacatataaggtgtttacaccaagaccaaagaaaacaaaattgatccatacttcatttaattagcgtatcgatgaaagaaaaaaattgttttggtaaacgcgcaatgtactgcacaaaggtaaaacgataaagtacgtgacgcactgcatgcaaacgtacggtcccatgctcatgcattcaccgattcatttttgctactactcgcatagatagagacagaaaggtctcactgtgttcggcagcagcaaaaagtgagagtttgtttagttttctgtgcgcacgcttttcaaactactaaatgttatgtttttttaaaaaaaatttctataggacagttgttttaaaaaatcatattaatccatttctaaaatttaaaataattaatacttaattaatcatgcactaacagctcacctcgttttacgtatcttcctaatattctctatcccctttctcaaactcagttgtttctaaaaaatatcaacgaaaatttatatgataattatttatgcatggagggagtacttaatttcgtagtgcaatttagttaatttgggattagcatttatgtttcaggtgactttttatctctaaccgcgtgaagagatgatcatatagctaactttagcaatcagtttatcttctcttaatttgctgcttcgtttgcattcagtagtcagtagtgatatgtaatagttaatagaggtaatatttgcactttttaattaagaagggattcccatccaatttaatcctagagagtccgaggacatcccatctatttataaagggccctagatgtacagcaccaaaccacaaaacacacaccagagggagtactcccccacaaaacaccgcagaccgtgcaagcattttggccacgaagtccaccaccatggcttctttaggcaatggagcaccaagttttcggccaccgcgtgcaccggtatctgccggaaggctatatcgttgtccggtgtgcccgggtcctgtgatctggtattcgtgcaagatctagggaccatctatgtataatcaccaaacgaggctgtagagttggtacgccgtttatgcggtacataaaggcttctaggcgtggaagggtcggcctcccgccacggccaccgacctcggccccagtggtgccacaagcacggatgccaaccccaacagtacaaaactcgtttgtcccacttcctcccaaccttgccttctgggaggagtaccgcaagggaggaagccgtcctgttgagatagacttcttcgtaccagtcattgttgtgtcggcgcttgagctggttgcaccggccatggtgagtggctcaaatttatcagactcagagtcatctgaacttgatattctggtctagttcctttgaaagctactagatccagaattcatgttagctccccgaatagggatatttagttgttatgttgtagcgtccagaaaatggaagcatgtatgtttccttgattaatttcaatcatgtcatttttacagatatatgtatttgtatcatcaactttgagttaaatccagatgaataaatgataatctctttcatgcatgtttcctaaaaaaaaattctaatttgctgtatatatgtaattttcgttaaaacagaagacatattcttctgattaactcttcagatcagcataaagtcgattccacataattcttcgtaaaagcatggtgatcaaactaagcacttgagcggccgttttaattagatctagtgacaaacaaataaaaactttagcagccgatatatatcttggtatctcgcgatagtgcgactatatataagtatccaaaattgtattgcataattaattaattgttcactgtaccttgggtcttgcattgtaccatctctttggaagttggaacaaataaagaaataaaaatagctgcttaaacaatttttttaaagatcatgggctacaagtacattttagttgacagttcgagtgaacatgatatcacatatgtaaattgaattccatctcagtgtatggcatgcatgaaagagcacaagtttctgttatcaataacatcaaggtaataaaaagcacctcccctaatttaaattctggcagatctcctgccgtcgttctccttaaaaaaaataaataaaaagcacttagctagcatgcgtactcctggtctcggcataattagtctgctctttttccgttatatatatatattaaaaaaaagtttgctcatgtcattgtaatagatagcattatgcaagaatataagaaagtaaaagaaaaaaaaagaaaagaagctagacataaacacagaggggtatatggcaatagatatttgtccggtctgaagcaagtgttgtatacatatagtgtatagttttcacctctcaaatttataaaactagtaccgcgtggccagtactccaactcactattcagttcatggtgaatatatattaaatcaagaaccaaattaaatcagacgtagcgatttttcacggtcttataaaattttcaccatgcatccatatcatatctcctactagataaccaacatctcaaggctggagatagatttgtaagctttatccagataatcgtccatgaaaactgttaattaatatgatatatcaatatatctagctaccacattacatgatatataactagaacaactctaagcaaataaaaaaatgctaagaatatgacggagaagttctttgaagaaaaaaggctacaaattccctcaaaaaaaaagaaaaggggtaagaaagcaaatgtataacttaacgttattaacttgaagcaacatatatatatggcacgtgaaagtcacttccatagtttcatgaacagaaaaaaataatagtggacgctctggtttcactttcaaccatgtcccgagttagtataacattgtgtgtaatataatactgtaactacaggatatatatcattctcgttacattatattacaaatgtgcatatcttgtaattgtcatgtatgataaactgaattttcactaaaaagagaagaaggcaccatattactttggcttgcatgttcgcgccattttaatttcctagctttcaggtaagtatttatttttgtttagggtattcattacccatcacaggttgaattctatattatattacgataaaatgaagattactaacctcaatttataccctagttacacaaagtaaattctgttacgagtaaccctcctttttcagcttttttccatgatatcataataacatttattttcaatattgtttaaaagtctaattagtatgctcttaattaaatgtagctgatcatcattgatgcaaccatgcatagtttctggctagatggtgctagagggatgggtaaagggctaacgggctaacgggccaacgagcacgtgcggctgcgacaaatgctccttgacaactcattttaatttttaggtaacaatgtcgacacgtgctctttttttttcatgcaagtttatacacccaaagtgtgtatgcaaaagaatatacatgaatatttatgcaccaaagagtatacataaaagttattgcatacggaagtttatacatcaaaagtttatgatataaagtttatcatggaattttgagtaattttttgtggtaaaaatttgctaactgtattagcccaaattatacaatgacctaaccacttggtttataggtagacatctacatgatatggatgcacagtcaccattggatgggcagaaaccatgcatgctcagttgctcacccataggaggggccattgttccagtttatttcatgtgcctctcacattgggcctctctaaattaggcctaatgttaattttaattttgtgaattgcgcgggaagggaacttccattggaaatctgataattaccttcgctcctttaaggccttttgctaaacctttttttctagattattattttttgagctgattttattcagaaccatccttttgttttttttacaacttctcctaaactattcaaacttaatgttgtttattgtaatggatttgatcatatatgatatatttttttaaaaatattttaatttaaattgtagatctaaaatttcaattccttgttgttttgttatttttattttgtaaattattatttaaagagaaaaaatatgtagttaacacatcgaggaggattatgtaaaagtttcatcctagtcactgatacagtgtgtgtgtgtgtatatatatatatatatatatatattttctctttaaataatatatatatatatatatatatatatatatatatatatatatatatatatatatatatatatatatatatatatatatataggacactcatatggggcaccatggtgcccgggcaccatggtatcaaatacacaaaatcactcaaatttttcaaaattttcaaattgtgagtatatacctagttataataactcgattcatacctatacctatcaacaaaacaactcaaatttaactttatttcacaatccatgattacatacctaactaattatatgtatggatgctatatacctaaaatcaaaatctaacaaaaacaagttcaaattcagttcaaacttgctttgaactagttagtaaagtagctaatgttaatatctaagtaattgaaaaagtttcatactcatttgaattaggtatatactcaatttcaacaatggtgcccgggcaccatggagcaccaaacaaatttaatatatatatatatatatatatatatatatatatatatatatatctctatctatgagctatctctctcactgcaacagacctctcatcactcacggtctcatcactgatggctcaaaattgttgtttgtaatgagtcagccagttgttacagaattatagtcaatgatgtttatagttatctgtaacggctctaatgatgagtctttactgatgcagaattctaccccaaagaggaaaaatcagccctagcccatcaccatggcattgtcatcgaagtagaatccaccacccgatgtcgtcctcgttgtgtcgaagccagatccttcacacaccgttgtcatcgaggctggatccaacgcacgctgccgctgaagctcaagcggcccagtatctgccgctgagcatatgggagcacgatggaggaaaaggagtcacactccccgccgttaccaaggttggatctccgccatggactgccatcgccgaggccagatccatctcaccccgccatcatcaaggacagatccgccactccttgtaactgttgaggctggatccgctgctccatctagttgtggtgaatctg

SEQ ID NO: 71401 - DNA, 26039 bp, Oryza sativa
cgttaacaaggttttttctaaaatttcatgtgatcgtttataaaaacatctttaagttattaggtatctccttgattgtggaggaaacttttaatgaaagtcacataggcctttcacatcacatgcacagtttgatggtgagaaatttgatcaatatcagagcatgagacaccactcaatatcaagttgagagctttgcagttatcttcaaaatcaactttacttgtactatcagaggcatccaggataatataacctctaagaatgttttgctaaacatcaagacctgacacataatataagattgcatcttttgtttccaaaactgaaatcaactccataaaaaaacatgaggcttggttcaaaaccaattgcccatggctaatcgaaagagagcaaaaacgtgcctctcgtaccacttgtacgattgaaacgcgagaacaaattgtactagagggtgggtgaatggtaggtaaaatgagtggaagtcaaattatcgaacttcaaaccatcaaaacccactccaatctcaaaagccaaaggggcactagtttacggttagacagcgaagtgtaccacagtctgatcagacctaggtccaatcagaccacctgtacaggcctggttggccagctagatgagtgtcttttggcggaggttgggatgttttcttatcttttgacataacctaccattcaaacctcctctggtagacttggttctcatgttttgatcatacagtttcatctttatatctatagatggtacactttgagacctgtatccctattttctatatgattacgtacccaagaaaggtggttataatgatttagtatatctactatatatgaacaaccattccaactcaccagctatatatatatatatgtgtgtgtgtgtgcgcgcgcgcacgcgcgcgctactctaacatatttagagagattggttggcatgtaactgattctatatcatgtttatgaactattaaagaatttaacatattgttatgtgcagtggtgaccatgattctgttgtgccatttctcggtacacaaacctgggtgagattgcttggctatccaattgtagatgactggagagcctggcatgtggatggacaatctgcggggtgagtttgaagattgtgttattagtattgttgtttggttatgtaaccaaatctgttgcacaggttcaccatagcatatggaaacaacttgacatttgctactgttaaggtacaacatatcaatgcacaaccaattttcttatattcatagtaatttccagaggttgttatatatgaatgaagttatattatatatgactcttaaaatttcaaatttataatgcaaacagaaaccatcatgatcgatcaggattttagcgtatattggttctagctatatttacataactgattggcatgtggtaaatattaaagccgggaacaaacagatttttaattgatatagctttttccaaaaaatttgaaaataaaagcctcccaaaaattgttttctgattcaaacattgttttacgacgctatcctgaatcctcattgccatactgaaatggtcaatgcaaaataaaatagttgatgcaccctgagaaggaccttgccacatcactgtatatatatgggaacatttatcgccaaaaggttcgttgttagaaatatgttcattgaatgttttttttacaacttatacaaaataggtcaaaatatagtaacaggctgaagaactctttgtgaaactgtttatacgtttttcacaccaattaaatcaagcttcacagaatttctgagaaaatcattcgctctataggtggcacattagctggaaaattctgaggaaaaatgataaatatttaatctttccgctagtgtaatttggttgggattacatggtaatatgaaacattattggatggatattatatactgaagaaaaagacctgaatagaaataataggaaagtaggatatccaccgaccatcaatgccggccttatctatatccaccagatcgacggcatttggtagcttttgttacgaaattattgggtgatctcatccataccttggatgggattggcaaccgagtattagccatggcttagtgatcaattagaacaacttaattgtgcttcataaggggacatgccttttcaggatatgttcacatcccctcctggtctataaatatttgaaatcatccatgtaaaacctagaattgaatacaaagaaactcctcctttgctcaatctctctcgctctctcgtttcttctcaacacgttatcagcactgctcgtgaagaagataaaggaggaaatcaatcaaggagccagcatttgaaggtatgatgcctaccttgggtgtaatgcctaccttgggtgtgattcttgacgccattctcggcctccctggttggcaccagaatcaccgtctacaccaccttctatgctgctcgttgtcgtagcactagggctaccgcatcacccacatcacccacttcgaagcatggatccgggtaggtggccgccgccaccaaccccggcgccgcatggtcgctgacgccacgcggcctctgcctcgccggcctctgcacagctttcccccacctcactggacgtgatgctgtgatagttgggtttgggcaagccactattacactttgataggtatacgagttacaatcgaggatgtcttactgtatcccgattcaacccgtacattattaagttatagagatatccatcaaaatgggatccccattaaaacccatatgcataattaagatgaattttttctcttaactaaaccaaatggatatggcaaacgcagcgataaaattccatctctcacatctagattgtactagacatacattaatctcattgcacaagttgcatacagagtaatttttcaaaacgtcgatgcattccacacttggcatgatcgacttaggcaccccgatattgagatgatgagaacatttattggcaactgtattattcataatttcaacacagatagatttgtcaaaacctctgattttgtatgcactgcatgtgctactacgaaacagattttgagaccctcttaattcaaaattacagccgaatcacttaaaaattccttgaacgcattattcaaggacatatctagggaaattcctattatattagaccggccatgcagacctggtcggaccaccggtctcgacaggaagctagggacacaaatattcaaacgaaatagatgccgagtttatttaaattcagacgtgtatttcttaggattagaagatgattggagaattccctcatatattatatcaaaaatcttacccttagggttgatcggaaaattcggtggcaagcgtttaaacatatctgcttgatggtgagttatattgcataaatatggatgtggcactatttaagtgcttagatggtgatcgatccaaggttgctatgggggaagttcatgaaaggattcgtggtactcatcaatcggcccacaagataaattgttttttcaagtactatagagggtgtgatgcttgtcaatggttcggcaaccgccttgctgaatcttattatcaaaccatggttgttccaaggttgggcttaggatttcataggtcaaatttatttgtcatcctcaaaagggcatcggtacgtactagttgcgacggattacttcatcaagtgggccgaggccatgacactcaaaaacaggactcatgtggagataattcactttattttgaattttaatttattgttaatttatcttgaatcagaggatttgaaaatctatatgtgttgaaattagaggatttatcggttgaggaaaataaaaattgatgacacacaatcttgatgatgtgatcgataagagtttaaaggctttagaggagatagaaaaggagaaaaaaaaaagagtagtcaaagcctataacaaaaaagtaagagcaaagacgcttcaagtaggagacttggtatggaagacaatttttctttcggttctagatctaaggagttcggtaaatggttacctagttgggagggtccttatcgaatatgtggaatcattcgagaaaatgcatattttcttgaaactttacagggaggatgattttagagagcggtcaatgggaaatccttgcaaaaaattactccctccgttgactttttcttacatgtttgactattcgccttattcaaaaattttatggaaatgtataagatataaatcacacttaaagtactatgagtgataaaacaactcgtaacaaaataaattataattacgtaaattttttgaataagacgaatggtcaaacatgtgaggaaaagtcaacggcgtcatctattaaaaaacggagatagtacttcccgagtatttggcaagatgcttaggaggtgatatgaccggtaattagtttatcgccctaagatcacatgttatacacttttaggttcacaagttcacccaaaaggcagggggcatgtgttaactcccaaatttggcacctagattcgaagtaggaaaatattgccaaagtttggaaggcatcggatatccttcaaggggccagtctaaactccgagtatgggctagtctgaccggcggcaagtcgccggtcagactggctaaatccgagtctgaaacaaatttcgtcggatctcgggtttccttgcatggggagatattttttgaattctaattggtctctacctggaatttgctgtggagaaggtccgtaggaagcaagaccaccccccttataagggctaaggcatgttcaattggatacacaatctactttcaacacaattagcaaattgaattgctttttcaatatcgtatctactttttgtttagttctagcttagttttatccatcgctgaaagtcattcgtccacaccgtaagaatgcaattatccctttataggtttatcatgtaaaccttctgttcatccacgagacggatgtttatcctttgttcgatctaaatcggtttcgctaaccattttggtcttacaaaacccatcttgatttagttttggctagatcgaggtggttggtgactccatatactgcaagatgtttaggtatcctgattgtgattatcttcttgaaaagaaaagttgccaacagatgaatgcatgcttgaagagctctatgaaagaatgtacaacaagcaatatcagacaatagttaatatagtttatgcaaaacaagaagtatggttgtaatgctgagcactctaagtagtgtggtttgaagttaattaacagcaataaattcattttgaacaattcaatatttgagcaacactgatgatctaggctattaattaactaaattgttagcacaacaaaccatagttatatgacattcatagtcatttatcatcctacgcaagacgcgtctaataactgatcatcaaaattgatgacatgtgttgggtcacaaatttagtccaacactgataagggttcatcttcaacttttattcatcccacagataagtgcctatgtgatgggtcatttgtttccgtcacagatatcgttcaccaacgtactagtgatctttctccattaccaagataaatagcaatctcgaattgctagatctattttatttaggacttctatttttttgacggaatatttagccttttacatgttatgtctgtgctttacaatattgtgttcctaaatttaactgttggatggcggacatactgcaccagagtaccaaccggagagatgcttagccatgtttagacgatggatttccaacatgcctctttgataaattaattagttacccggcttgctgcacacttataaagatgggtgtatttccttgccgatttatggggaattgacttgcatcaatgttgtacccaattctgaattgggtaattttaccatctccggaggtaaatttaaactttgctatctctaaataatagatatcaaaatttttattgccaaattttggtatgccttctcaaggaccgtaaaagttctgatatgaatgtcatggttgttgaaaatgatatttgtatggaaccgatctggtcatatgctgtggtagcaatcctgaacaagtggttcaaaacaataactttgaccaaacatttgaagagttgtacttccacttgtctaaattaaatcaagcttagatggttattttcaattctgtatggccgtttttctttttgttgtgatgctcaatgtttggcatatatatattgtaaggaaaatagtaatattttttctataaacatggtcaacttataatatgatacggagggaatatttatgaatttggcttctatattctaaagcaactcgactgaaacactgacgcttaccttcggaatatcaactatacctaaactaaccatgtaagaaacttaaaccccaccaagaaagccacacacaatataatatacttgctctactagcctagccctactaatacgtaggtcaatatgtagcctaggccgagaaaaacctagtggataactggataactggccgagaaaaacctaggccaaccaggatctagagcatccaggatagtgtggaaggagcctacacgacaagtccacacgggtgtataccatttaatctacatggtatacccactacaagattcctaacttttaccaagggggtttaaaccgtcggccacttattaaaattgtcagccatacatattccagggtggataccgtcagcaacttcccctcagccacatgtggtcggtaattgatcatattgccgagggtaccctcggtaaccatgtacccgaggatttcatcccgagggtttacggttggtctttttttcatagaccacgcatggtctttcttgccgaccacatttcccgagcgtataccattggttattcttattcttactgagaggtttattttcccgtcaaattgtgagaatcctcggctattaaccgatggttctgtaggccttcggaaatagtatttgccataggtttttatataacgtcatccattcgttaccctcagaatagtatagctgagaggttatttaggttacatggaaaagtaaatcaaacccttggtaatttgatattttctaaaaaaaagcaaatttaaactgtacccatttttaattattcttataaaagtaacatactacgtagtcacatcaaaacaaatttcagcttaattaatccctaaatagatccatgggaagttcaaccatagatatataaccaaattgttcaaaaatatttatcatccatcaccatagcaaaactaatataccccgttggtcactaatagttatttccgagagttaaatcaaacccctcggttactaatataccccatcggacactaataataatttccgagagttaaattaaacacctcggttactaatataccccgtcggccactaataataatttctgagagttaattaaacctctcagttactaatataccctgtcggacacttataaccatttccgagtggtatcttataactctcactcactgatatatcccgtcggccacatgctaaatagccgaatgttctcgtaacaaccctcattaaaatttcaaacggtcggccacctaaatcttcctgacggtctgtaggtttttttgcttggacgcttggcaaatcttaggattctagtagtgaccacgcgctagcggtcacttgctagcagagacggtctgatcacccaggccatgcatgaactagatgtccgtggctagcttaggatttgggccagtcctgggtccacccaacattggtagggatggaaataaactgtcatagaaacggcaggaaaatagcccaaccatttctgtatgaagaggtaattgtgttttccccttgttgtaaaactcaattataattttaccccttattgtaaaactcaattgtaattttacgtttacttttctggggttgtgattcttcccttcctttttaatacgaagcttctgtttgccctcattctgtatggtagtttggtgagcaaattaagtgtgttaaaaaaagaagaaatttctgagaaaatatgaaaaggaccattatactcccaaactaaatataatacgtccattggttcgagtccatcccgatatggctcctcgccgatctgatccctagccaattaatggccaaccctaactggagcagcatggcagcagcgtgcaagctgactagtggtcggcctcgcctgggcgacggagaggcgagcaaaacacagcgcaaggggaaccaggtggcccagggcaacgagcaaaaggaggcatgggccagcaaaaggtggcatggcaggctaggtgaagctgggcggtgcagcattaatgtcctcttccacaaggagtccagactacggctggcatcgatattttcgattttcttttctcgctgaactcctgcgcgttgctcccattagtgctccctatgcattagcatctctttgttcttcggatatgggaggcaatgagttggatcttaggtttgtcaaatcatgaagaaattaggcttaaaaaattcgtctcacaatttgcacgtaatctgtgtaattagcttttttatctatatttaattctctatgcatgcatgtgtccaaatattcgatgtgataaggtgaaaagtttttgcgtaggaactaaacagggccttatgcattttataaacaaaacatttaacctccaaaacacaggggaaatataatcaacgagagtggggaggtgacttgtcttgccatggttctattccctgctcagcaacgtaatggacctctttgttccccatctaaataataagagcacacgtgacaatccataaatacaaatatgcatgaaaagtaaacatgctcaaaaatggatgctcttttaactgtgaataggtactgttatatcatgattttagtggaagaatttctgttttatcgcattccaaatgcaggttataaattttaaagttacacctcaaaattgtgatgcttatgtatatttcgaatttttgtggcaatttcaccaaatataagttcacaggattacacagcataaaaatattaatctaacaaatttttgttaacttcacttggagctataatgagtttcctatgaatttttaaatttaacacattaattttcagtacatcaataagtcctaaactattattctatccattccattaagggggcctgttttttttctaccctataattcaccaacaaagtcttacacattacattcctcattcctcattcatcaaatccaacgaaccatattcatctgcatcagattgaacgtgtgagatcgagtccccccactcccaccgctttcttcccctccactcaccaactccctccgcactgacccacggcctcgccccgctcgcgattctagccccgacatgctgcaaatccacaaaccctaactactcgcaaccccctcgccgtcccacaaaccctatatcctcatgatcccatagccctcttctgcgccgcccccgatttctgcctcgactactccatccacactgccgagtccgttgccgatatcactcttctccgcactcagccattgggcaacggacgccgctcttctccgtgcttagcagctggctacctggtcatccacatccctcgtgctgctccccatccccatcactgtttcaccgccactgatctcaagcatcatcacctcctcttgccaactaccgatctccaccgatggttcaatgtcgccctcctcgctggtctcgccctgccgatttgcttcgccgatgcgctgccatccccggagcctcagcttctctgctgccacaccgtgtcgcactcaaaccattccttcgatccaagaaatctgtgattggggcattctacttattcatcaatttctgtggcagtgcaatgtacgtttcattagtacaacgaaatatttgcagcgtttaatttcattcaacagggtcatgtatggtggatgtatgtacggtttcagatcgtggttttggatgaataaattgcgttcaggttttctctttttttggaaaaattggttctatagcattagaagttcatattgttggtttaacagcaccaaatattaccgattcattttaatagcactgaaagtttcatccgttcatgtttctaacacttctgttacttttgcactttttgccgttagctttgaccgcaattgacccagcgaactacactgattaaaatctgtgcccttacgtgtaggtcttcatccctcccagcctgtcctctcacttgccacaatccagccctcacctagctggtgtttggatgtagagactaaactttagtacatgtcatattggatgttttgatactaatttagagtattaaatataaactaataataaaactaattgcataaatgagagctaattcgcgagacaaattttaaagcctaattaattcataattagcaaatgtttattatagcatcatataggctaatcatggattaattaggctcaatagattcatctcgcgaattagtctaaggttatagaatgggttttgtaattagttcatatttaatacttcaaattagcgtccaaacatccgatgtgacaggacttaaaaatttttagctccatctaacctatatacgctgctgccgccacccccgcggccctgtcacgcggaaggcgtggacggccagagggtttgtccggcagccttgccctgtcgatgttactgccccgttcttcgctttagcctcgcactgtgcagaacatgttgccgccacccaatccatcagcagcacgtacatacgtctcgcaaccttgccctgtcagcacggatccacgtctatgcctagcacgagctcctcttccaaccaacagcaatctgacgcatcatcctgcaagtttaaacgaattatcaggtattcaacccttcatcggcaattatagggcaaggtagttcttacaatcttaaccataacatactacatcaaacctaactaatgcaacactatgttataattaaacccaatagatctaagcaagctgataattatatattattctaacataacaaacttgtttaagccataccggtctaatctagatagatcggccgataagggtaaacaatgatgtcaatttagattaaacaatgcatatgatcaatgtccgattccactaagattggatcaaactagaactctatgtctaatttaagaaaactattataaactctgactcactgacgacttgtagcggctaaacattaccaaacacacttggtccgatctcaacacgactccaccaacttagaaaacaaggaaactacgatatactctccttaattctgaagctaactcaaacttgaaaatctctgagattatgacatgaaagcctccttcgactctatctttgtacagttactatttccacatggctcggtcgattgccaaatttctgtgactattccacccctgtcgcgcccttcagattttcacacctaaatgcacgaatcttggaccaaatataccttctaatccttctctcccctatttccacttctaccggcgaaaaaaaaatcaatggatcaggtcgctaatcacggacacgcacacaatgcggtggtggcagaccgcagatggacgaacgcggccatgggccggtggtggccacttcggacacttcgtcgtctgtccactactttccgctgtcaaatttctgtgataatgtcaggaacgatgaagatactgcacataatcagttaagttcagacaagacagaggctgtgtttagatccaaagtttgaatccaaacttcagtccttttccatcacatcaaccagtcatacatacaacttttcagtcacatcatctccaatttcaaccaaaatctaaactttgcgctgaactaaacacaaccagagctaaagatggcatgaattgatgaagaaagtgcaccaatgtgaaaactatccaaaattctggagtaatatttgtgtatggccagccaagcaaagagcttgttgtgcagaagatgaaggaagcaagaaatggccaagaaatagtctgattcgcccggtgatgagtcggcggtcccctctacttcatcggaactcgcaggggagaagtgccctaggcgacgaacatccgatgtctccgccgccttttattcctacgagcgcgattaacgggctagcgctggatgatcagtcaatcaactttttggttcaacctatgacatattcgacagttttaagggaaaatacattcactgtgaccatagtgtatttacgttgtaacaagggtgcagttaaactggtaacagcgtagctaaggtacagttacagtttaactatgatgtagctttagtttgtactccctccatttcgttatgtttgacgtccgtattcaactcaaaagcagttttaatatttgacgctggtatacacccaaaaactctctttccaactttgcccttcgcccatatacatcagtcataccactgcttccacaactgttagattcggtgccgccgacgacatccatcgcgctgtcgtagtccgagcgccgctaccggcagtcgatgctttgttggtgtcctgcctcctaactcccctcctcatgctccctgccaatgcggccttcctcacgtagtcgctccatgctcgttgaagagatttgtggcggtgtggcctcaccctctgtcgaaacatgaattcggcaataataaaagagggtagcacacgagacctaaatgtggatggatgcggagacaaaggatttagacagattcaggccttctcaatgagaggtaataccctactcctgtttggggatttgaatccgtcgggtgtgtattgatctgacgatctagttgtgctcatgccccctagagggcctccagcccaccttatataggatggggggcaggattacaagatagaaaccttaaccaatacggtatcggttttctaaatctattttacaatattatcaaattaggactttaggccgctccataatataaaaggaaacataatacccaagtcatgatctgttacatattccatagatataagttatcccctataaccagtcggataaccatgccgtgtgggtatgtggtacccataatctccacagtagcccctgagaccttcactgtcgaaaagataatcttctctcgacccagattactccaaagccaagtgcttcaatcatctttgccatggtctcccgagtacttttaccaaatatgaagactgtggagggctgaaaaataaagtcaagtacatcgactatatgcacctaataggtgtagcccccgactatatatgtggttagctaaacaaactaagcatatagtcaagtaataaataatccaaccaaccgagtggttttgataattgtaatcaaccaagtgacttgatatcaatatatagcatatgcggtgtgaatcccccaaataacatgatccaagtgatataccgactgctttgtaaaaattgatgcgagcaacctaaagttgactacatcattgaaaattcacatagcaaaacagctataaaaaagctcgaatgctgtgaataaagaaattaccaaagtattgggcatacgccatgcgcacactgctttaacagatgtgcttaagtccctaaaagacacatgttttcaccacacccgaaaatatacggcatatgtggtgtaaaatccgagtaaataaactcataaaggatttaccaaccgcctgaaaaatgaccaagatatataatcagcctaagccataatattggtcaataaaaatgcacacttacgtggcaaaaagcaacgatattgtatccaatcaattgcttaaaaactcaaacagtaccttgacttatataaaaaagtcagcgaggcagctatataaagctttactatttgacaccttttaagatgcattgtaccaactcctaaaaagttgagtaactgcggtataaaaggattttaagatatttggcactggatcacgcgcactttggcctaagcaaaaagtgcctaagtccctaaaagaatgtgacatgccacacctaaaaatatgggctgcagacatattagacctaggccaaaaaatatgccttcgacaccctttaaaggatgacgcatgtatcatgctcccgagtaataaatcttccaggtgatatagaccaagtgtaactcatatgaatagcttctgatctgagtgattatcccttatgggatactccaaaatagatataaaaattgaatctcgactagcgcaagtactcagctgttagccctcacgacaaataatgagtggtccagtcgttgagcatgagaaatcgactcatgaccatgaatccatgttgaatgtatccggaataaatccaaattgaagatataatcctcgcgcttgtgttgatgagcccctaagcatgtagcttatccttctgttgtagtcacaattgtccattgatagtagctgacaccatcggcatggagacgaaatgaccaacatgaagatgatatcacccatcaaagctgacgaaaatgttggtagtagtaaagacaatgacaccaatcaaaggtgatgaagtcgcatagccatggaggcgaagaaaccagtcggcatcagataagtcagccagcagagaagacgaaggtgcccagcaacggtgacagagttgtgcagccatggcagcaaaaataatcagtcgatgacagacgagtcgctcggtgcagaagacgaagactcccaaaagtaggggcataataagccagccgtgaaagcaaagacaccatgggcggcagtagaggcaagctggtggtgaagacgtagacgctcatcaaaggcaatggcgcaatccatcaatcatgaagatgaagaaaatagtcagcgacggcaaacacatccgacagtaatgatgattagcggcaacagagatagccggctatgatgacgaagttgcgcatcaaatggcagcagagtaggcatagccaaagaggcatggtaggatgttaatgaagatgacgatgtcagtgatctggtcaatagtagtgttgcagctgatgataatgatgagatcttttatcagcagttgcatagtaagccaaccgtgaagacaaaataacaagtcggcgaagtcgtagtcatccattagcaacggcggagacatcagggccaatgaagtagatgtgctggtgatgatgtcagtaacaacaatccatcaaactgttgagaggaaatccatgctcaagtattttcttaatgttggcatgtgtgtgacgaagattgatgcaacgcctcttgatttatgaagatgacagtagaacttggtgctatagctgttgcatatgcttcacttggaggaaagtagatgttgttgtccttttatgatccgagtgatgttgttggcatgaagaagccaaaattgccggtgtaataattggagtcgctgaaattaaatgtcggctctgaagcgaagacgaagataataactccccaaattgactcgttgattgattgattgcttcatcttgacataaagcttgtcgaattttttgagagtcttgtatttgtgtagcccccgactctttggttagttgagaaacaactgaacatagagtcgagaactgtagcttcttgtcgtcgagtagtcattgcttgagtgaacatacgtgttgaaaatgtctgagtagaaatattgaagattggaacaccacttgttgtagtaaaataacacggcatcatatttcatgacacatgccgagatgtcgagtctcttgtagacgtcgtggctgatgaagtagcaaaacttgcaaagtagcagcaattgagtttgccggtgccgaagataataaagatgaagtcgctccactatggtgacaaagttgcaaagccgtgatgaagtgaacacgagtcagcggcaacagtagaaaactggtggcgaagacgtgtagttgtgaagatagatactccagtcggttgagcggcggcataataggctagccatgaagacgatgacgtccatcagtagtggtagtggtataaactagccgtagaggcgagggcactagtcagcagcagacgagacgaccggcggtgaaaacaataaggccaatcaaccctggaagaatcatgcagccatgggagtgaagaaaccagttggtagcagatgtagatagcttgcattgaagatcatgacgcctattagtggtggcggcgacgtggccaaccgtgaagacgatagcaccagtaggcatcatacaaggcggcccgtcagtgaagatgtagacgtccaacaatggtgacataataggccagccgtgcaggtggaaacaccaatcggcggcggacgaggcagccggtcggtgaagacgtagacgaccaacattggtggcataataggccagccgtgcaggcggaaacaccagtcggcggcggacgaggcggccggtcggtgaatacgtagacgcccaacgacggcggcatattaggccagccatgtaggcggaaacaccagtcggcggaggacgaggcggccggcggtgaagtcgtggacgcccatcaacggcagcataataggccagccgtgcaggcggagataccagtcggcggtggcgaaggcagccggcggtgaagtcgtagacgcccatcaacggcggcataataggccagccgtgcaggcagagataccaatcagtgacggcgaaggcagccggcggtgaaagcgtagacgcccaacaacggtggtgtgaccatccatccgtataggcgagagcaccattcggcgacggcgaaggcaagccggctgtgaagacatagacgcccaacaacggtgatgtgaccatccaaccgcataggcgaagacaccagtcggcggtgacgacagcgagccggtgataatgttctgactgatccattcctgaagcataggagataagcttaaagccatgaatccctattatgcatatccggatctggatcttgcagaacaaacatataggatgagtagtatctgatgtaaatacggtactcggggaaaattcaagtattttaaaatgtttataaatatgtatttctcctcttatcaattttgatttccccgagtagatgactcattacgtttaaacactctgcccaactagtcatagcccccacgcatcgggagtcggcctaagcacttcccaaacatgcatatgagtgacatgagttcgtcattaatggaacaaagtttcacgaatcagaatttactactcgggtacttttgcaattgttaagagcagaaaataaatttatcttatctctatgcttttgatttattccgaataatacttagcaccttgcattacccagtccatccaacaagcccccgggtgctaggaatcggcccaaaggcaactatccatcagcaaaccaaacggaaagcataggaagatagaactccataactcgataggcacttttgtactcagattatattgcaagcaatcaagataaatattataaaaattgtttaaaaaatatgatataacatctgtagcccccgactcactagtcaacggcgaaccagttgatgtagtgaggcagaggaaaaggaaaatatcatataaacaaagttaatgatgacttagctttgtaatattccccttgatgatggcagaggtggccaatgtgggaacaaagtcgtccgtcaataacaatgaagacaccagtcgggggcgaaagaaggcggtcgacggtgaaagcgaagatgcccaccaacggcggcataataggccaaccgtgtaggcagagacaccagtcggggcggcaaaggcaagccggtcggtgaagacgtggatgcccatgaacggtggtgtgactaatcaaccgtataggcaaggacaccagtcggcggcgacggaggcaggccggtcggtgaagttgtagacgcccaacaacggcggcataatatgccagccgtgtaggcggagacaccagtcagtggcacaacggcggcataataggctagccatgtaagtggaaacaccagtcggtggcgacgaaggtaggtcggttgataaagtcgtggacgctcaataatggcggcataatagggcagccatgtaggcggagacaccaatcggcggcggcgaaggtaagccggttggtgaagatgtgcatgcccaacaacagcggtataataggccagccgtgtaggcggagacaccaatcggcggcggcgaaggcaagctgtggatgaagatgtagacgatagcaccagtcggctgcggcgagggcgagcaggtcggtgaagacatagatgcccaacaacagtagtgtgaccaactaaccgtataggcgaggacaccagtcgacggcggtaaggcaagccggttggtgaagatgatgtcgccaccagcaacggcggcggagaacaccaaccatggaggcgaagagaccagtcggcagcgacgaaggcggccggcggtacggaatcttgataacctgatacgaggctgtgtggcttgatgcaatttttggcccatcttaattaggtcttagccgagtaggataaccagacaatgtcgtagccaagcaagagtcaggttagcttgttctcgatcggatttggctgttaataaaacaattttgccgatggaacacaatagctcgatagtctgggacttcgatttgtgcttgacaaagatctgtatacataagcatatatacggccatgcaatctgaggactccatccaattggttggcaagattgccatgcgtgcatgcatgtatatgtagatggaagaatacacttgcatgattggttggcctggtatccatatatgctttaatgcgtatgggctggatggatatactagttggtgtccattatcaagggtagctcatgatagccgattgacgatgtatatgtatagcaattcttctcggatgtagttgcaaaaccattttgtatatttgtatccaataaaacatgtgtgcttgactgcttgattccgcttttctctgccaaggagcgatcgatctatgcccatatgcttgtacgtctcgtcgtcttacgtagctctggatacctctggctttgaattgacgtgaacgagcggagtcaggctgatgggaaactcgccgaaggcttgtcatgatgaggaacgaattcagacgactgattttcgacggctgcaatgctatccatgcttccgtacagaaaaacttggcttggaaaaagatgagtcgacgatgctggtggcagccatagtagattgaatctaaaactcgctgtggtagtctggtagagtggttgttatcctctgattggatcttcttcgactggtttgaaatcaagtcagagaaaaagagcttgttgaaattgtcggcggcaaggaagtcaaagctggtgaaccgaaggcgaaaaccggcgactcatgaagttgattccatcgcacttgtcaatagaaactcgacgcgcccctacctggcgcgtcaactatcgaaacatgaattcggcaatagtaaaagggggtagcgcacaagacctaaaagtggatagacaggttcaggccctctcaatgagaggtaataccctactactgtttggggatttgaatccgccgggtgtgtattgatctaacgatctagttgtgctcatgccccctagagagcctcctgcccaccttatataggatggggggcaggattagaagatagaaaccttaaccaatacggtatcggtttcctaaatctattttacaatattatcaaatcaggactttagaccgctccataatataaaaggaaacgtaatacccaagtcatgatctgttacatatttcatagatataagttattccctataaccagtcggataaccatgtcgtgtgggtaggtggtaccctcaatgcctcctctggtcctccctcgttgatgccccgacgtcttgcgtgaacgcccctgcgtcgatcagctccaatccgctagttatcctcatggcagaatcgccctgctcaccaatggggtagggacaactggcgaggagatgaagggagaggagaagatgctcctgttgatgctcaggtgtggcttcgtttccttgttcttcttcatcacaagttgtcaacttcccccaaatccttttcggatgaaggcgatatttttctctttttctgtccacagaagatgttcttgatttctaacaacagttcagtgcaacaatttgcaccgctgaatcatctgcaatcttcagagaaagatgcaattctgctgcttcaccagctcattcaattcagaaccagaacaagaaaaagatcactgggtagatcactgggtgttcaatggtgaactgaaactgaaccgaattgtccataacacctgtatgcagcagcagaccgcattctgctacattcatacaacccaaagatcctgatgaaacatttcttcattgtagtattgatctgaatatcttgagtaatgtcacttcaactcaacagcacgaaaagcttgtgcaattttgacaatactcttgtaaagttaacaatatggtttcttgtgaactgtgacttcttgtaaagttaacaagggtaaaattatggtgcaataaaggatgccgattttttctggatatcttgtgaattttgaataagaatgaacaattctgtgtctttgcatttgtgcaatgaggttgaccattaggagcaaagccagaacagggtgcaattagcattcaaacagagagaggagggaattccaaaagaaaaaaaaatagaggtgaatttgttttcttggctactaaatgttgaatctatataggatgaatttggctaccatccctccgccgccgcatgcctcgccccgccgcaacctcatgctgacccgccgccggtgacgccatgggctgcttgcacggccgcccctccaccgcagccccgccgcgaaggcttcccgtcgccgcctcctactgttgctgttgcggagatgtacaagcagggagcggatgcttctacggaggcggaggctaacgagaagggtgagcagccggccgtcgccgccgcaggtccgctggtgaagagggagaggcgtggtcgtcgaggtcggctgccgcacgtgcacacgcataccaaggtgcgccatcggggggagcttcgcatacaagacgcgcggtgagcaggtcgccgctgggtggcccgcatggctctctgccatctccagcgacgccatcgacggctggactcctcgccgcgcagccactggtgctctgctccatggtcacctgccccaccggcgcggtctggatgaacgcagcagcaggggagaccgtagaaataactcagcaacgggagggcaaactcgtcaattcactagttccttaattttgtcgaagctgtcggaaacgacatatataaaaaagaagggtgaggtatcagaaaaagagatggtaccagaaaatagcacagaaaaagagatggtaccagaaaatagcacataattttttcccttttaaccataagtatatgtctttagtttttctttgatttgtagcatcccattacatttgaggggctaagttctcaatttaaaaatgttgcatatatctggttggatgtagatatttgccatttattgggatggaaaaaagactaatttatccttcttctactcatctttccccttttcttcctcccgtcgatcttgccagtgcgtcagtgggcagccatggtgcggcaatgcagcgtagcagccagcatgcaatgcagttgtgtgcagtgctgctgccgggactaaggctgacgctgcggccagcgcatgcggcgcaacgatggcgaggtgcacagcgcaacggtggcgaggcacgtggtggctgacatggcttatggcgcaacatttgatgtggttactcgccgtggtggtcgcacagcttcccggtagcttgcgtcgtacaacctcattggctgcacctcgtcctcatccgccgcaatcgctgtcggtcaccccgccaccgtcgccacggtctccgcttcttcgctcgctgagctaaatagatcagaattccaaattcatgtttggttacaataaaggataaatttgtcttttcacatctctaatcatggctaaccaatcgattcagatagaaaatgtgacggaagtgctacaaattgaagcaaaacttgtgacatgtgcttctggttgaaaggggaattttcttttaccggtgttttttctacatcgaattttctctttatttttttcactggtaaatagagtagtataatggtcctgccacattccttgttgagtaaatcttaaagatcgcttttcatccaattaaaaaaaagaggaaagtgcgagaccagctagcacttacagaatcacaagtacatatataggacaagtacgtgcttaattcgtactactcccggttgaatgaaatttgattctcataaaaaacaacgtaatacagtatatgatagattctagtagtataaatttggacagattgtgattagatttatagtcctacaagatcttttcatatttgtagtaataggatatgccaaatctaatgcagattcgttttctttttaagagacggagtacatgtaggacaatgaagtctgatagaaagcagttccaggcgtcactactcgtctgtacgaaatctgacgacgcagggtccagactccaccagtccaccctgtaattcatggcgaaggacgaggaaggtgagcacaggacgaacagcaacagcaagctcgaaactaatccggtgataaatgcatgcgccccaacttccaactcacagttcctcctcgtcattcaaaggaaagtggcaggcaggctagctgctcggttgacacacgagcacacacaagacaaatgccgccacgccggccggcggcgcagtgcgtccgatatatggcggcgttctggttcatcatcctcctcgtcactttcttctccggcttcgctgccgccaccaccggcgtgaccacgtccacctcgaaccagaagccgacgtatatcaccagccttccgggactcgacggcgcgctgccttcccttctcgagaccgggtacgtgcgtccgtccatgccgatgacgatggacgactgtaggtctgtagctacgtgcatccattgaaaattacattttcccgctgctctagttggtgtgcaagtcgtggtgctcgtgtcaaaatcttgtcaggtacgtgaccgtcgacgaggagaacggggcagagctgttctactacttcgtggagtcggagggcgaccccggccgtgaccccgtcctcctctggctcaccggcggccaccgctgcagcgtgctcagtggattggtcttcgagatcggtgagccatccatacatataccgattaatcaatccgcgtgcactctccgtgctactactgctgatatgacaacggtggccaggcccggtggagctcgtcagggagccgtatgacggcatcagcctgccgcggctgcggtggaacccaaactcgtggaccaaggtggctagcatcctcttcgtggactcaccggtcggcgcaggcttctcattctcccgtgaccccaacggctacgacgtcggcgacgtctctgcttcgctgcagctcatcgaatttctctacaaggtactagcataaacagtctgacatgcacctacgtgcatgcacggtgaatgtgttgccgttggtggtttcgttgtttctgctcgattcatgcatgatctctcggtcgtttgacatagtggttcagcgcgcatgaggattaccttgcaaacccattctacctcggaggaggttcatacgccgcgaagctcgtaccattcatcacccagaagatctcagaaggtacgtatatatgtaacttcgctttcattttctttctttgggagtttttaggctcttttgcagcgatcaggttttccaaataaatgctgtaaattgtttacttacttatgattatctattaaaatttcactggctactctgctttcaggtattgaagctggagtgaggccgattattaacctcaaggtactcttctagttacctataagttttgcaataacaggcgaggccaattattgatcagcaacacagttagcaaactcacattatccaacttacaaccaactatagtatgaagcttataatctagtaaaatagttacaattgagtatggaccaatttgtatttctgggtgatgaacagggctatacggtcggtaatccccttacaggtgatagcattgactttgattcgcgagtgccatactgccatggagttggagtaatttcagatcagttgtataaggtaagaaccttactcttttaactcaataatcaaccaccatatattatagcctagtcctcccatgaatcgctaggatttgcccattcatgtgtcacggagatgtgggtgattgagagttaattactgacacatgcaacttcaaaccctaatgaattaatttgctccatctgtgcatgctacacttgagacttcctccagtaagattaagtgatctttgtttctcacatgcatgtggtcgactcaagacgataatggataactgccatggaaagggttacagtaaccccaggacttttatttgtgcaaaagctatgtccaagttcaacgaagtaaggaacattacaatttacaaatacctaaccgattttgcaataccctatgtcgacttgtttcgccagtggttcaagtcatctttttaattactgttggattgctctaagattcatgctgtcagtttctcactgaggactactaccgtgtgtttcgctaatatatgatgttagtttctaaatgtttgttgaccattcattttaaacttactctgttattgcagccacacaaagtggcggcaagaaagaaaagggcaagaaagactgatcatcctggcctgtctccctcttcgtagaaaaaaaattaggtatcatgtttgttttatcaattaaggtactacaaacattacttttagttttgcatatttatattaaaatttaaaaaaaatatgtacactggataaggagaccttagacataaggtctcctgtaataggcccaaacacttatctttaacgggtttgggcttggtcagtgatcagttgtcactggtgagtccagtcacctttgatgggtgaccggcccatcggcccatcagaggcacactcacctctgacgggtccgtattttccggcccgtcaaaggtgaggatctccacaagccaatgtgtagttgcaacccgtcacaggtagacacctttgacgggtgcatattttccaacccgtcatacctgagactcacctcctacgagttcaagatatgaacccatcacaggaatagaaagtcatcttaaaaaaatggtgcccagttgcaaccatagaaaattggtaatagaagccgaagaactaataattaaccccaaacatttcaaactaattcctttcaaaagatggcaagaagccgaagaacttacaaggtttacaataggaaccgaaaaacaaactacaaaactaaaaactactgggaaactacaaggtttgagacactgcatttcagggaaaatgttaagattctaattttctagctacatcacaataaaaacatctctagtatcttcaagaaaaacaagacaaaagttcaaaggtcttcttctagaatcaattaatctccattggcaacacatcatggggcttcaacaagaccacacccgattcagaaacttgtaatcgatgacttgcaacatctgaaacaaaatcgtaagcacataaacacattgatcagtacttgggagtggattaatccggaggaggaagctacggcggtggccgcaagaggatggaggaggagggcgcttggggacggaagagaaggctgtccggcgcggacacggtcgcctcctagaggtcggggttgaccggatccggcgtcccctgacctctaggaggctggatccagtgt

SEQ ID NO: 71402 - DNA, 9008 bp, Oryza sativa
  unsure (1)..(9008): unsure at all n locations
tcttcgcgcggttagagattaaaaaaacacctgaaacatatatgctaatcccaatctaaattgctctgcatcggtacgtacagataatatatcatcgagcaccaagctagcctccatggatgcatgtatcacactccatccatccaattcttttgttggttagtttaaagttgaactagccaatatcaaacgttataggaaatggggtagctatagtatatctatcacagaatatattaatatatgtgcatacagttacacgttataaatttatgtgtgtatatatcaacgcgatagtacatattttttaatgatggaaaaatttatattctcagtccctattatcacatagctaataggttttctactgaatagaaaagaaaaattaagtgcaatggggaaaaaccccccaggtacccaaacaaaaaaaaaaggactagctaaaaggttaaaaggcggaccacattattctaacaaagtaagccctataaatactaggcttatccatacagttgaataagtactatccttattgtctacaaaatacaagaatataacatcaatgtgcataatatcctatgaaagaatcactaaattggaacacctcattattgaaacccgcccatcactgtcagattctctagaacgaacactaataatactatgaacagcgggatatataggaaatgagtatcactgggcagtcttgaatgtcgaaactacagtgatactcaaataacaactatctttagaaaaaaataacttttccatataaagggcaacattttagaaaaaaaaattcatatgaaggcagatgaagataaaaattcatataaacgttgtagcgctctactccctccgtcccaaaataaactatgaggttgatttatttaggacggagggactatgatatctataactttgtaggagactattttttcatttgagatcatttatctagctaaatatgtgtaaaaagttctcatgtctatttggacaaaatgattttttgaatttgtaaaaacttcagatttagacaaactttgtatcaaagttgtagagctcgacaagatatacaactttgtagtaaaaaaactatttaattcgaagtaatctaaaagagatttactccggtcgaacaaaaagtatctcgagatatcggtacctcacggtattaaattgttccgatcattagatctagctaggcaggatggacattgttaaatccaacgattggaaacgatttgatactgtaaggtaccgatacctcgaggtattttttgttggaccggagcaaatctcaatctaaaatgtcaagtacgaatattacttttttggactaaaagagttcaaagaataacctatgctattcaggcacgaagtgccctataggtgagatgctatataccacacaccttcatattttgtgcgaaaaatcactgatttccaacgcacgctaacagggttttctgctatagtgtatcatatatcaaatagaagcgtcagttgtaacttgcatagagttaactaacttttgttttcaaaaaaaattatttctataatgccaaatatattagacactcccgtcatccggttactaaatatatttttggcattttaaggtgagagtattgaaaggaaaaaacacatcatgcaccgggcgaagagagcaacatgacattcaaagaggtgccggtgtctctttcctattgcaaaagcaaacattattgcttatcacctcctatatattacattttgcgatcctatatatccattgtcagcttccattatctaaaaaaaataaatccattcttagctaggatgcgtgcggcagtatatatgcagggcaaatgtattgcttaatcgatcgtatacattatggaagataagaacaaagaacacatctgcactcgttagagggatcaaaaacaaaatccagcaactagctcgtttatttaattttctgtgtacaaaactttttcgatcggttcagttttcttatgcatatattatatatatgttatagcttggtcgaagagattctttcaacatccatttcttcaccccaattctttgttaaagactgttggaacagtcctgctaactcctaacagaccggcaactaacaagggcttgctgacaaaaaatcaattagttaccctttgataaggagtatatatttcaagtattggagccaattctgcatctgattcatatacagcgagtactgttccatagaacactctgtgtgtgtgtgtgtgtgtgtgtacggttaattagaacactgcatgttaaagttgtttcatcgcctgagacaatcaaatcctcaggtaatatatgggaccatgttggggtatgctttgaaagtatttttttttaaaaaagaaaaaagatgtagtgccaagcttggaaggatgaaaccgaaggaaatcaaagtctcaagcagtaatgttcaagtgcaagtatattatatgcacaggaattcaaagctgaactacatatatacattaattttctagttttctactaataattttcttaatgaaaccacagcctttagtacccttgatcatgcagctatcgttcatagaggtaaaacaacataccatttcacatcttattgtcgatggcccttaattttgagctgatcaccataatctgcagtacaagtaggttagcacaatagttgacagtctcatttgatgcagtgtacgagacaaagtttctctctccctctctctctctctctctctctctctctctctctctctntaaagtaaaactggatgcacagtaagttattcttgcaactttactgcatatggtactagctaattcgtgttgtgcatcatataggtagaggatatatatgcaatagagtagtttatgagctcgctaatttagctagaaggactacgcatagtgttgtttggagggtccaagtccatgaacttatccttcgggattgtaagttatctactccctccatttctaaatatttgacactgttgatttttaagcacatgtttgaccgttcgttttattcaaaaacttttgtgaaatatataaaactatatgcatacataaaagtatatttaacaattaatcaaatgataggaaaaaattaataattacttaaattttttgaataagacgaacggttaaatatattttaaaaagtcaacggcgtcaaatatttagaaaaggagggtttatttcactaatatattgcaccatttcctcgcagaaaaaaaaatcatgttgtgcttagatatgtgcctgtgcctcaacgcccatgaactgtagctatcaagggttcatcaggctaggactgaaatttttgaaattttggaattcaattacaaatgaataattattcgaacaagttcgaaattccaactagaaattatttttatgtattgtatttgctcattttagatcgacaaggttatgtcaccattgtagtcatgtttatatattgacacgtagatctaatggtaggaagaaatcaagaaaaaaaaaagggaggaaatattttggtcagtgggtaaacttttctgaatgatatatggatatctgaaccaatttttttattgaatcaacttctagaccaaattatttcaagggatacatgcaacaagaagaattaaagctcggttctgatacaatacaacaccaaanaaactaacgaaatcgaaactgagctagcccccattgaaacgggaaaagtatactagctaattaaacttaaaccaaatcaaaatattcagaacacatgcatgtccctttttattcaagctttacctctagaaactgaatggcgctttgttttgctactggctcgctagttgctcccggcgaacgagccgccgtcgacgtcttcctccgcctgatcccccaccgactcctccccgtcgtcatcagccgccgcgagcacaaccgccggcgcaggcacaggcgcattcgcggaagcagcgacgtcgccagacgatatccccgccgccgccgccgccgccgccggcggagcgcccggcaaatccagcatccccgccccctgctggacaccgagaccgagaccgaggaaatcgatctccgcggggtgggtcccacgcaggcggtgcgcagcccagaacgcgtggttgggggacagcgccgccaccatcatgccacggcggcgccgccgccgccggtcgcggcggatcctcctccgcgcctccctgctgtcgcggaacgccgccgcgcggagcacggcgaggcgcgcccgcggcgccagcccgccgcgcaccatgcccctgacggccgcgcggtagtgcctcctcaggtgggagcggaagcggccccgctgcggcccttccgggcagtaggggcagcagaacctgcgctccggcgccggcggcggcggcgcgagcgcccagaacggcgggtggtcgttggacgaccagacgctgtcaacggtgctccccatcgcgcgagcgagtgtgacggcggcgaggtggtgagcttgagctggtgagggtgcatgaagacattcccgttttatatctaggtcaccgcgcttaaacgggaaagagggtgaatgtatcagcgagacggcgcataaatgctcctgatctcttccatttcaaggtgcacggtcgaacattgatagctgctcagcctgcagtcgaacattgcgtgcatctgacacgcacggccggcgtgggtgacggcggcttcgcagcggcgggcggcgcgcgacacatgcagcttcgacttcggggtcgcagcgcgtctaacgacaagtcaatgcatggcaacgggagtaccggagtagagactgccatgcgacaaacaaaactaacagtacgtacgtatgccatgcgactatgcgagacatggtctgatcgattgatatgagatttaccgttgcatggctcatccactagcttccgatagttggccagaagatatacaaacgctacgatttgggcttagattggttactctggtaggagaggaccgagcgtagcattgagcgtgtatggctcgctcgctggtctacgataacgcgagcaacaggcggtcaattcgatcccaggatcgtgtcatccggccgccggccccctcacttcctcaaaaggagtaaggagtttacatggagtatttttgtctaattaacggtattttttcagattttcgaattagttactttttaagtttctttaaaaaatcaaataaatcaatttttaagtttgtaatggctaatattcaattaatcatgtactaatgtgtatcctcattttgtataccatggaaaagctgagccgatcctcttccaacgaagcctaagacttgttcggttaatcccgaagagagagattgaggggaggataacaccacagcataacagatgtgaaatttgaggacttttacggtagaatatactagtagtatatatgggggtgaaaatgggtcgggttgggtcggatcccacccttcccatatgctaacacatattttacaatcggaatcaggtcagacacggatagtgccaaatacatatacaaactcggatattgtcgggcaaaaatacgaaacgaatacgtaccaaaatggatacgtacactatcggttacaaatacttattcggatatcaagtctaagcaacaatcatatatatcacatagacaataaccattcagcaattccatatatccataatacgattatatatgaccttaggaaataaatagggtgcaacacctcgcaattgaaaattatttcatatatgacatacatttaagaatattaggtcgttaaacacgatatatctcacagttgagtcacaatgccaatatatcaccccatacaagctatcggtaggcatcattcataggaccacagaggcatagactaatagatatcatttaaattatcaccaatagactaataggtactacgttcccgaacctgatctcatatccgccaaaaaagacctgtattcgacccgatatctatgaaaagtcccagatacccgaatttgtcctgaagtaatatcgtcgggccgagcgggcggaaaatacctgccccattttcacccctaagtatatattgatagtataaataaataagattgcgttgggactctctcacaaaatagaaaatgatctttagttatttcatgttagatcttaactccgattgtaatccaaatattgtttgtgggtcagattggattattgacctgctacgtttgaatagatggcacaactaaatcctcctgatcggatttatggattcatgaaacacataaaaacattaatccgtactggatagctagagtgggagaaagtatctaacataaagaaagaccattttaacccccccccccccccaaaaaaaaaaaattaattttcactgcagtcaatttaagtcgtgggtaggcaaatcaatgtacgcccttgattgtttataccagtagtatatggagtactaccaatatattgtaccgtaaaagttctctaaaatttatcctgtccatatccccttcaatcctcttaaggggagaataaccttaaaagacctaaagaatttgatttggtttgttaatatttgagaaatttttgaattgcattagacgaaactgagtaatacggtttcgattagtgtgtcaatttgtaaacttcttctccacgagactgtaaatgtaagcaacactatcattgggtaattctagcaccagtgatcgatcgagacaaccatgctacgttcggtcctctcctaccagagtaaccaatctaatcccaatcccagcgttgtatatcttcggctcgcctagtcacatggcacacgcgctgttagatttgtttgcccgatccccttcttcctctagctagctagtctactcccattgccatgaacatgtcgttagacacactgcgaccacgcagtcgaagctgtgtcgcacgccggccgccgctgcgaagccgtcatccacgccggccgtgcgtgacaaaagcacgtaatgttcgacatgctgcaacagctagcaatgcttattaccaggtgcactatgaatggaagatcaggaatacttgcattaatgcgtcgtcatcgaaacatttaccttcttccgcgctggcgccggctgatgacggggtggattcggaggcggaggcagacatcaacgatcgcttgtccgccgagagcaactagatcaccttgttgtcccaatatagtacactccccgcaacgaaaaaaaaaaaagtggttagtacacaatcaccatacatattagttaacgggtctccacataaatgatacatatagtgtgtgtatatataaaaggagacaagtggacaaataaattgacatgcagcaaacaaaagataaacataatgaaagtggaagtcaaaagattaaagatctagcattatgccacatccagcatataagtcataggcaacaaaagtagttgctacacaattatatctaatgtgtcttcacattaatgggacgggacggggtagggtgattctagttttgtggttgtttggttggagcgatacacggatgtgtcccattagatcggagaccagctcgtccccctaaatcaagcagcaattcatccctcttacatctctctcacgtgcattcttcctccttacggcacacagcacaaggcttgtgggaggaactagcatcgtggcaaaacctgatgagcagtggccggtgtttgcaccagtttgtgggaggagacatgcgacgttgtgcagcaaagctcgtggcagcctctcgttaatataactagctcttacataaatatgtgagggacattttctattgtcttgttttctaacttttttgcgtgttgcattgaagctaacttccatgttaacattcaatcgaccttgtttattttgtgtttaaaaaccaaaactagcttgcatactaccatacaagggctgagttactcactgtgaagggtgggttggctagcccagctacaacccattcactgcacgccactagaaccctgtcctagtactaggctacccacattagtcatcactcaccagcccataagcaactccaggccagtgattagatatggggcaatcgaccgttgtttctcttccaatcttgtgactacatgccccttcgtcatgacccataactgatcatctttattacttatcgctcaacgctcgtaccctttgccgcgctggtgactatgccagcaccagtctgcatgtgttggcattgtgccatttgtggttccacggtgcacggtcgtgcttccaccactatgcgctataacctctagccagcaactggctagagctaggtgactccataactatattctattatttatcttggatattctcttgtgccttcatttattggttgtactttattttttatacgattacattatgtgttatgttcggttattttttttattgagcatgtgcaatccatcgaaatgtgaccgccgctgctactatgtataacattgctcctttatccattctcaaatataaaaactttgcttgtcttaaccaaattatattcatattttgcttgatttgatcgagactaattatattttcagctcctgctgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatggctagttgatgacaattagttgctccattcctctttctattccatgactcttactcttcatcttccattcct

SEQ ID NO: 71403 - DNA, 65913 bp, Oryza sativa
atttcggggttataatagtccgggtcgaccagtattgttctacggcggtgctgctcaatacgcaagcatccgaggcattgggtcatgtagatgaagtgatgtggacacgcatgctataaaaaccgtatttgggtgtggtttgtcacccctgaccatagtcatggggttaacacacaaatattgttggttcagcataggtggaattcgaaagcagggatatgggtgtttgtacgaaacccagttaggacgacatttataatggggggtttaatcgccctgcacatggaatgttttctacttgtagcttggaatggtcaaccccccacaggtggtagtgccaaccgcggctagcttcagtgggtctaggttagatggttttcattttttttggggaggaaacgggagcgttttttttccccgacccctcggggagatagagggaggggcagcctcatcactctcgggcccgaccccccccgagggggtcaggccacgtgggtgaccgcggctgccccaaacctctagtcaagatatccccggtcccatgtcaccgacagagtcgtataagaatctatttaaaaaaagctcgcatgctaacttgagatgaagtacagactcctaattgaaactcatgattttataaaaaaaatatccaagcgaatttccacggtgaattttaccctacctaaaccctataacaataataaaattaatatagcatttacatgttacaatgtacgggcatttttctagtgatttaataaatttgtgctcacatggtgagaaacccgaccttttaaattcttaccaattctctctcaaaaagtccggtttcccaaacagtagtaaaccatctctgctgttgttttcttgatttaatttactccggtacccaagatagcacttaccccattttaaaatatagtaaattagtatcgatacggacataggagtattatactatcacgaatatggacggacaaggttaaggttatgtcaaattagtacaggttgctactcccttcaattagttccagaatttcactcatctcacacatactaaaacaaaaatagaaaaaagacaaatacatctagtgcatcaaatcctaaaaaaaatattctttattttacctatttcgaatgcaattattttctcattcacaaacttgatacaactattacttaaaaataaacttattataggataaatgagaagccagaaaacttgtcagaattgaatatttttttacatataaaggtatattttacttctttgtccgtcttaaaatataataacctttaaacggtaaaatacgttctaatattataaattttgatagatgttatattttgggatgaaaagagtatgagtgggcaagtgctccttccatcttattttaaacgcagtcacgagtttgtgtctaactttaatcgtccattttattttaaaaaataaaagttaaaaaagtaaaataatgtataaattaatataatattttatcatttaataagaaaaatatattaatcataattttttttaaataagacgataataaaaaataaacacagaaacacgttacctcttttaaaatgggagggagggagtatatataagtcaaggagtaattgctgttggtgacgttaacctacgcggtagtacgtgcgtgtgagcagctggagcattcaagtagttttggcttgtggcagcgcctctcgagcccatgcaacgcggagacagcaagctgccgcgcgacacggcacgccgagcgagaactcgagtctattcaatgcgctagctgcagcgtccgtcggttgcattggctacgagtaaaaatttacctctttccttgacttcgccaatagagagaaaggaaaaaaaaaaggcgagagatggtccgggagcggcgagctatcggcgcgcgctgtagcggcacagggcgagcagtagtcgtcgtatgcgcggtggtagtgatggccctgaatctgagcatgcttgttggtcgcgtcacgcacgctcgctcgctgcctacatacatgggctctcatcatgccgcacgcccccgatcaattggctacaggctcctactatacacagcgtcctcgtgacggctcgtcacacacgtacgctacgccaagcagcgcatgcacgtgccatgtttgacatgggcgcccgcatgcattttggtaccatatctagcggacggcgttgtgtccgcgctgctacagtcgtcggtgcaggagctgctttgcaatatgtgtagttttctagcgaatccgatcaatacatgcatggatgcgtacagatttagtggttcatctttttttttcttttcctctgctcgactcgaccatggctttactacatgtgataggctttttagttcgtgcatgtagcagcggtagcacactagcatgacatgtctggataaccaccggtcgggagtggcccaccgggttaggccgccggccggcatggggcgtacatgcatgcatggcttttctcgggaattataatcgtgtgatggtccgctgatcggatggatcgggccgtgcgcgcgtgagcctattatggttggattgggacgatgcgtactactactacgtacactacgtacgggtagggttcggcgatgatggtattgatgtatactggacatttcatgatacacgtaccaccaaatgctaaggatctttggacgagatggctagtgtttggtgcaaagatctagtgactgatccggccggtatttaggaccgtggatacttcaaagccgccaagtaacaggaggggcgcctatccgtgacaggagctgtctccacatttcgattgattattgcatggcgaaggcgtgatcagcagggattgacaggatgcgagtagcgcgtgctgtgccaggaaaggttacacaagttccccgcacaaaaaaaaaaaaaagaaagaaaaaaagagagaagggttacacaagttgtccgcgccgggtcctacacacatatggaaaaatgaaacagtatgtattgtttcacaaatgttcctggcttaagttagatatagtatataggaacaaattaatgtcgtgccccttaaaatacatgataaaaaaacacagagaatatgaaataaaccacataaatgaaagtaacatgtttttttaatccagtaatagttaaaagcacaggtaataggaatatactcgctccgtcccattttaagtgcaatcataaattttcacgtccaactttgatcatccgttttatttgaattttttttataattagtatttttattattatgagatgataatacatgaatagtactttatatgtaactcatgtttttaatttgttcagaaatttttcaaataaaacgaacaataaaaattgtgcacggaaaatcatggttgtacttcaaatgagacagagggggtatgttcttcgattgcaccataggacggaattgaccataggaatacaatcctataaaaattcacatccttttcataggaaaaatccgtgtccttttcaaatgaatcaaaggagcatatgagaaaaaaatattaagggaattgaattatcaaaaattatttgtcaatcctccattttaaagggaccctcattgtagagatgtgcatgtgttcaatatacacagggagcacatatatatagcctttcatagtctacttgcagatttatcgctcgtagccaaaatttaaattttggaaaataaattttagagttgatttcttttacccgtactctatattttaatttttcttttaaactgtaagtaaacatatataaataaattgtttctcctactttgtttgtttttctatggcatatcaactacttcgtacagctcaagcgacaagaggcataaagcaaattaaccataagtgtttcccacaatatacccctaatagacgacacgcatgataaaatttatgaaaaaatttatgatgatctctacggtaatataatcaatatatactaccaccaacaatcttaaactatctttcattgatagtataagtcataaatcaatgggttatattatttaactaataaatatcagtagatatcaccgtaaaaatacttttcagattttttttacgaattacacgtgtgtaaatacatgcgtgaattttaatgggtacaattacacaataaaaatatacaaattactgaatctgtctcagaaaaaaaaaacaagcacatcagagctactccctttatctcaaaataaactaacatatgaatggatttgacacaatctagtataacaatttagacaacaatcgtcttctaagttggtttattctgattcggatggagtacaacctttttgtcatgggaaaggccatgtttacccctccagctgaagttaattaaatatcatcccaaacattaaagagtaaaatacagttactcctatttgctagccattacaaattcatatgaatataatatcctgatatttattaaatgctggcccgttgacatgacagcgctttcacgaacagcggtttctcattggcgctgagaaacctttggctgatctaacgtgaactttcggtgaaaactattggcataagtaaattcacgctgtgtttagatgcaaagtttggatccaaacttcagtccttttccatcacatcaacctgtcatacacacacaactttttagtcacatcatctcaaatttcaaccaaaatctaaactttacgctgaactctcgtaccaaagttaatctacagggtgatcccaacagttttgggctaggtgggcctgagtccctgttccgttggctaaaccctttataaaatgttgagttaatagaggaaaaaagcactagtttgatagaagaaaaacgatgaataattgaaaggtaattacttttacttcttttttaaataggtagttgtataaaaatataataatgtttgtttttttcttatatttagtcttgtcatgttacgcactatattattctacgttcaccgtcactgttaatatatccccatgtagaaattaaggatgaaaaatatatactttttactatctttttaaaggaattataaccctggcctctaaactacaaatgcacatcattatttgaacttggagtaaacctctagaggaaaatttgcaaaaaataaatagaccaagactcgtattggttgagctatatatcctagaaataggaatggagcaacaataaataatttgtcagaaaaaccttttgtggtttaaaaaccaatgttgaaacaaatcaggatacccccccccctacaaaatttagtactccctccgtcctataatatatgtattttaataatttgcttacactgtttaagcactcgtcttattaaaaaaatctgtgcaaatataaaaaacaaaaatttgtgcttaaagtactttggataataaagtaagtcaaaaaaataataattctaaattttttttgaataagacaaatggttaaacagtgcaagtaaaatatcaaaatcccttatcaagagacggatggagtaggcaacaagcaaacaacaagacactaaaatatctatataacctaaaagcatagtaattaagtgcacaaccatcaccggttagtttgaaaatatagagaaaaccaagcgattatatatatactttataaaaccagtcgactttataaaaccggtcggttctgatcaatacttcatccccggtagtatgatgccgtgcagtctatccccagttgtaggagcgttaagtaccagcatgtcaacggtaaaaggaacaacgatacaaagagctcaagattttgagaaatagttgtttggtagctatgtttcctaagttctggtttttatttcatctcctagattctataactacaaattttaaatctggttaaaaatctactaaactgatggtagaatctaaggacccctttgaatcacgcgaatggaaaaacaaagcaatagaaaaaatataagattctgataggattgtaaatccaaaacgagaacgcaagaaaaacacatcaatgatcgtttgattggatcgtataaaaacgcaggattcatataagaaagatagactccaaggatattttccaagatgttagttcttattaaatttcctctaaaatctctataggatcgtttatttcatagaaatttcaaataatatgatatgatttaatctattatttcaaagaccttcataggaaatttttaaatagaattgaaatcctccaaagtttccatgtttttcttccaaaagttgttgctgatagaatctctctcgaacaggacatctcgcgaagtgtatactggcccactccacccgtttcggccctagttacatcaacgataggtacgtgctaataagatcagtacggaaaatagttgcggaggcaggtaatcttacatactgccctctattagttgaaaacggagaacatgtactaatggcacccaatcatcaaattcgctattagctgctcttatcctcttttgcctacctacaagtactccacaacaggaacaatctccccgctgttaccagctgtgttgcttttgttactactgctagttttttagagtagctagggagagtgcaggcagaggcagggcaggggtggtgaatcggtagaggtcggcagcgtggtaggccacggagcagctgctcatagtcacatctgcatttccaatccaaaagcaggaagcgtgaacgaccgtgcaaaaatgaatggagtcaggaggcttggcgtcccgtagatgcagaacgcctttgatggatggttgcagcgaaggtgcgtagtttgcactttgcaggtggttgatgggaggccatcagctgatgtgaagtccattagtatgacacggctggggcttcatgtatgccatgcatgtcaagcaacagagggctggggctcatgtatgccatgcatgtcaagcaagcaacagaggccgagccaaacagccaatggtagccaaacagccattttattgacaacaagggtactggagcgatcaataaaattggaacagaaggagcatggcactcaggctgatggagtcatgaatggatcagaaagcaaccaaccgaagaaaatttgtttggtgatagagtggaacggatgggctgtttcagagttcactgtaactccggaccagaatacaagaacggctcccatcaattatttcttcaccagacagaagaacactgcaaatatggttgttagttcccgctactaggagcaaagtcaataatatagcccgctgtcggctcttaaaaaatagccacatcatttatagcatagctcatgcttacaatagaactactataacacaattattttattatctttgtgggacccgccatcttgccttatctcattctctttcttcctcctaccccttctgtttctgtgttcgtcttgcctgtggcctgagcgtgcggtagttggagatgggcacttgggcttgggcagatggccatgcgacggatacggaactacgggagacgccggtggccgtgtagaacgagggcatcatgcgacggacgcgggagacgacgacggctcaacgaccgcggcggcgcggccacggtcgtggctggtgagggccacgaccaaggctgaagcaagtgatggtgacaacgtgatggcagtggccggatgatggtcacagctgcggcgaacgcagcgacgacgactgctgcggccgcgatggacgagagccacggttgaggatgcaagcgatggcaacggcgacggccggggtagacgagggccacagttgcggcggacgcggcgacgacgacggctgcggccgcggtggacgagagccacggcagaggatgcaagcgatggcggcggcacgacggcgacggaggcggccacagggggatgaggacgcctgcggacgcaggtgagggtggcggcgtcggcggacgcaggcggacgacagcggcggcgccgacggacgcaggtgagggcgacggcgccgagagatgcatttgacggtggcggcgccggcagatgtaggcggatgacagcggcgacgccgagagacgcaggcggacgacagtggcggcgtcggcggacgcaggtgaggcggcgacgtcgagagacgcaggtgagggcggcggcgccagcggacgacatcgacggacgcaggcaacagctgtggcaacgagggcggcatatcccgacggatgcggtcccacgaccttgggccgtgcgtagagccgggcgactaattagtcacccgttcgttctctctcttcccccctctctcctccacgtcaccgaaaaatccgacgtggacatcctatcgtcgtttattgtaccgctataagggcatccaaaatgtactacaaaatagtccatagggaataatctattccattcagccatctagtaatattgtgcaactagtccattaaaggaaatagcaaaagatatccatatgcatatggactacctatatgacataaataatattatccatctttacctctctctcttctcctaatgttacattgtatccatatacattgtgattgctatagttaaagtttatttatatgaatcctatctatatagaccatttttgccatatacattggtgatgcactaacaccggcaatgctgatatgttgcggcttgtagctagcctaggcttctagactacccatctaacagcacatctagactgtagtataaatgagtacaatgaatacagacgaaactagtgctgttccattcggacggaactggaaagcaaaattgtgctggaaagaatattttgttactaggaaagaatcagtgttacatagtacaatgctcttcaattcccccaaagtatacaagcggatgccatggtaagttaattcataaatacaaaatggaaatgttttgattcaggcaggttatagtgtacggtagaaatgttccttgtgataaggagtaccagtcatgggcttcggtatgagaagacagattatgtgaaaccagtattagcctatttggttctgcagttctgcaaaaacaaacgcttcgaaagatcttttcctttagaaaagtcttttttaactagaacagcaagaaccttttgtggcggctggagcttcagcaacgttgatcgtagttccttgcatggaacgcccatttgtagacgcggattcctgagctgcaagtgctttcttgcttacaatctggtgaatttcactcaatacagtatggaatgctttctccacattaatcgcttccagagcagacgtctcaaggaaggagagaccttctttctcagagaacgcatggccatcttcctcggggactgatcgtagatggtttaagtcagacttgtttccgaccatcatgacaacaatgttggcgtctgcatggtcccggagctcccgcagccacctctgaacattgtcgaaggtttgcctctttgttatgtcgaatacaagaagtgctccaactgcacccctgtaataagcactcgtgattgcacggtatctctcttgacctgccgtgtcccatatctgagccttgatagtcttcccttctatctgtctcaagacaatagtagacttttactgagatgaactgtagacacgtatggcttcagcataatcataaacagagaaaaatggatagcattccagatctatgattggcaataacaattatggtgactttaacatgatgaaaatgtcttcatgacaatatacaaacaaatcagtactaagaacaatatatttttttctttgattggacatgggaagatctatggttgaagggtatatatcaattgattaatcaacaaatatagttataccacactaacattggtggcaactacaaactgcactgcaatcccaattactgaatgctgattgaagaattgtgtcacaggcttacaagattctttaaaaatttgggttaaagtttaacccatgttattcttttccatttactgatgtatatgtattaaaagctgaaatgctgcaaaaagaaagtgatggcgtgctagaaacaaaaaaaaatcacttaaaatgtttgatcaaacaaaaagtaatagatataaccttctttgtctaattattgatactctcagaagaggatcaggaaggacaaaacagagcataatgacatggttgtgctcaaggaatgtaaggactgagaaaaaaaaaacaaaaaagacatttccagccttataataactgcacataaatggtatggaagtgatgaagtcatctgaatgcaattaattcagagacaatacaatgatcagtgctatgccaaccaaacggagaagatggtcatactagtcaatctatgttgcccacaacagctattatgcattaggattatgaatccggcagggattgacataacctctttgacgaaattgacgttggaaggccagcatattggtgcggtagcatttttcctccaatgtagtataaaagtatgatgaatctactcgtatttttggcatttcttaacataatgtacttttggcatataatctactctcgtatttgcattgctaggaaggaccaagagggaacaaaatgcctgcatgaataggattgctcgaaagaattgacaatctagtgttaacctagaaatgacacgtatatccgttctctaatctctatcatctccaacacaaggaactcgcgaaaacataaaagaaatatgcgcggcattaccaccggtaccatcaccgcgatatcatgcaaacaaacaaagtgccgtattgccattgtcagcccaatcacgcgaccataaaaatcctgtgggtgtccgagtctgcagtcatggatccgggatctcaattcctaacgcacaagaacccgacgcgacatcacgacgcgcgccaatcgcaaaattgtacaagcaagcaaggggatcagggggggggggggggcgggtgggcgtcgcgtacgcgggtacctgcagggtgcgggtggcgaactcgacgccgatggtggacttggactcgaggaagaactcgttgcgggtgaagcgggagaggatgttggacttgccgacgccggaatcgccgatgaggacgatcttgaacaggtagtcgtactcgttgtccacccggtgcgccatgatctccccctcccgcctcccctcacgtcccgaatctggaacgaacgaaaatctcccctccgatcctcgcctcctgaccctctcggttcgtgcgcctgggggaatggaggtttgaaacggtgggggcagagggcaggcagatccgagggggaggagagagagagagggggggggggacgaggctcgcgctcgctctgcgctggcgcggcttgttgttgttggtggtcgcgtctcggccagccaatcgacggctggcgcggcgttttgtccctggctggggcgggcttgccagatctggggaatgtggccatgtggtgtgcgtggtcgccgtggtcggtggccgcgtgtatcacctgcctcgtcggtttggttcgtgggcttgatgagttggttatgtgggcttatctatgggtcaccacctcggcctcgacggcctgctcgtgcggaaagtatggggtcggggcggcttcacggctcggcccaatgcaagcatttcacaccatgcagatatatacagtttcgtttttttcgatagatgaatactttctggaacacaatattttctttcccacatatgcaagcattcacacatactgacatgcaaacactattacactgtcaccactaacgttacatacacgtggccacgtgggtgcaacctagcagtagcaacacgtctaaacgtgagaggttagcctcatgcatgtagcaaatagcataggtaccctcttttttcactaacacgctaaaagaaatacacgtcaatataatagaagaagacggagtttagttacacaatgcaaaacgtctagaagggtgttgcaggggggacaggggaagaaaaaatcgaaaaaggaaaaaagtgacaaggggaaaggttacttaaaaacaaaaaactcctatagcgagggatggtagaggagtagccccactatattcctagaaagcccccaaaagcagtaccactagcagatgatcacagacggccttcctaaaagacagactccaacactactgaaaccaacgagagagagagagagagagagagagagagagagagagagagaaatcgaacaccccagagtttcactccttccacagctgccaagatatcgggagtacaagggagctgaaacccttatgaggtgctctgacaagcaggccctagtagtcggccaccagacctagagtgagcaaccacgggaggggacaaggtcaggctagccaggaggagacagaacatgatgccagacctggtgagcgaaaacacaatcaagtaggatgtgattcaccgtctccatttcttgggcacggaggggacagactgagtggctgtcaataccacgctttagaagaaggttggtcatccagcggcacttttggaacgcaagctacaggaaaagcttacacttagcagggcctttagcctgacaaagtagattggcgcaagcaaaggagtgttggccgaggaaaaatgtctggtaagccaagtaacaccaatcgcttgtccaacgctaagagctggacacaaaacaccgtgtcccagatcacgaggaattgggaaatgatagggaccgtgagaacgccacggatgtcccccacccataagttgttagagagagcagaggtgattgtgcgcgatgcccggagatgtggtggcacggcaaggaggaggccaggcaccaaggaggccaccgagcgaccctcaatccattggtttctctaaaagagagacgtgtcgttccctggcacgaagaagatgaacgacgcagacatatctctcgagggggccttcaggtcagcccaatagaggtggcctgagcgctgaagccagagctagcgaaggtgaagaatgaagccacaagtccacaatacccaaaccaccgatagctctggggcgacaaacactcgtccaagacataatgcatcgtcctccctgaactgcatccatacccgtccactggaaagcgcgacatttcttatctatggcattgacaacccagcctggcgaactaactgccatagacacatggaccggaatagaagatagcatggactgaatcagcacagaacgatcccgacccatctagggagaaagtcggtgagaaatggcatcacatatttaaaaattggagacagagcagagtaggggaaggaactctggaccagggaaatatgtgatgccatttgacgttttatagacgttcgattattcatcatattaaaagaattgtgaaaaatatgtaaaaacacgggttatgcttcagcatgtacctttactgataaaataaatcacaataaaataaatagtagacatatagtttttttaataaggtgatatgtccaatactcaatagcgtttgtattactacctccatttcatattacagttagttttgattttttttctaagtcataattctttacgttgaccatatttatagaaaaatataaaaatattatggacataaaacaaagaaactatcaaaatatattcattgttagatttagtaaaattaatttggtgctataaatattgttgcatttctactttcaaaaagtttgacttaaaaaaagtcacatcgacttataatatgaactcggaggaagtatgtatcaaaatgggcatgaatattgatttagcttcgaaccaacccaatgactattacttcctctgtctcaaaatgttgctatctaagataggatttgacctattctaggacaatgaatctggacataacctctgtctagatttgttgttttaggatatgtcaaattccatccaagatagaacatttttggatggaggaagtactattcaaactgtcaatggattgataattttttatcaatccaaaacagtcattaatccccttaaaacttcacatccttatcccatctacactcctggtcatgtttaaagataacacttatcagcctctccttctaaattatcttttcgtccggataattcagcccatccagatagaccgtcgctctcagacagactcaatctaagcctagctagaaaaactaggcagagccctcagcctgctattgattaccacttaccagcccgatttgggccaacaacgccccgaatcggttcgaacaggtggcacctttccacgacaccttgctgctgcttatccagttatcccaaacccagattagacgggccgaaaaagaggtttctaccccattcatccaacacgccgcacatcgaacttcttatctagctttccgagtacttccaagttccaagtccaaccccttctatcatgctccatgccgcgcgcatgcatcatgcacgctggacgcaaactacgtgtcgaccatggatgcgacgcgacgcgacgcgaggcttgcgtatgtgctcctcctccctctccgcggtgaaagtgaaaccgatcgatccctgcaaataattcaccgcgcgcgcactcctcctcgggcgccgatgggtggatacgtccacgacgcgttggttactttcgcggagtgcaaatctccggcttggctttccccccgtgcgagccccgcggacagggacggggtttcggccccgcgcccttggcggcatcgtcatccgcatcgccttttccgtctcgtcgccaccgagccgtccccgtccacggcaaacaggatagaaagcgggagcgagcgaggcagcagcgcccgcgcgcatcgggcgtgcgtggacctaccagcccgccgtcgcgcgtcccgccggccactggactgcggccgcgatcgagagcgctagccaacgccttccggatcacgcgctgacacttgtagaccctaagacccggacggccggatcgatctccgcgaattattgagcggaccggctatatacgtcctagttaccagtaaaggcatcgatctttcgggtgggtctcgtcgtatcgtcgcgtgcgggaggaggagagaaaaatcgggagagcgaatcgggggccgtgtggatgtgcgcgcgggggctgccggtttcacgtcgattctcggcgtcggcggccccgccgccgtgccctggccttccggtgcgtggctaatttcggcccggccggagcagatcggtcgatatccgcggccgaatcctgaggaggctatcgagataaggatgaaccgcgcgagccaggactgcaggagcacatcaatgttctggctggtgttctcgctcgcgccaaaaaaggcgggcatctttttcgacgaacccaaatccacttcagataatatctccactactcgctcgccgctctgatatggcacgggcatatttagccgtgacatgatggcgtgcatggtgacctgttacggtgtttttctctgggcccctgttacagtgaaccttggcttgatcgcttcatcatcagctcgacccctgtggaccgatggagttgacgacgactttgcatctctcgacgtacgtacaaccagccaatggcggcacgacaggatcggcatggaggatgggcaaaaaaacgcatgtcgcgtcgcgtgagccgccacgccagtgacggccgagaagcaagaacagttcagccaacttccttggaacgggctgactaacacgcacgcagaggttcctttcccatcataacctgaatcagtctcggtcattctggaccagctcgatcgctcggggccaatcaagttcggccgtgtgcattgccgcattcgggcagtttgtgccgtcgcaaactgcaactctgaaaagtacacgcccgatttaagcaagtgatagtgatccactgatcctgggttaaatccagtcgaaaaccgcaactaactctggaaagcgacgccgcccgatctaataccgggatcctttggttaaatccaatactccgtatacgtcgcaaacacacagccgttctgacaactgttgactcgtgcactgcagaaagctgatggaatcgtggagattaagaaacaaagaagctggaggtgcgtgcagggggagtagtggatattccgggtggcaaatggcctggggtaggaggcgaccagcgagaggaaaagaagaggcgacgataaggccatggctcaacatcgtccttgggacagggaatggaatcatcctcgtaggaggtgaggtcaaagtgtgagaggttggaggtatatgctacggccccatcgattcctcccgagtgcaaagtcaaataggatgcagtgcattatgctatccagaatctatctatctatctgctggtcagttcctgcacagagccggggacctccctgcgagtacacttgttgatcctctgtaaaataaaaaacgagaacgaattcaggggatcgaaatgaacaccccctatcagattggttctcgcacaaggtacaggccgctaaaacaaggctttgcacgtggtaaattttcaagtgccaatcactttcggtgaattcgatcattatagcttaaagcctgaaacctgttttttggggacggcgaactaccgtgtgtgttctagtaatcgccctgaatgcgaggttatccgcatatgatatctcctgttgattcgagagaggagaatgaaagattacatctttgactggctcaacagctgaagcacgaaacgaccttgttgtgtttgttgttcccttggattgatttgctaagatcttcacagttggcttatcatttcactaccacttgcacacgtgttgcctttgacaagacagattgttctaaggtcccaacgtggatgctatgggccccaacatgcaccatcttatccaaagcataccatatcaatttcgcatatactcctacagtcctacgttgatcagttagtcgtacaagctagcctgcatcagactgatatataagtcaccaagggttatacttcctccatctaaaattctcacccgtattacgttttctaatttttctatataaattgtatgcattcgtaatctacatgtatgcaagccttaaatgaacagcgtgatcgttcgtttagcgcgcggcgctggattaaattgatcttgtgtcccgagcagccatcgtcccactcttttttttttatttagaaacaccaaggggtttttcggctagcttcacaaggtggtgggctatacgacctggattcgaagcctcatcatttttaattatttaatattaggttcttccttaatattcgtgtctttttttagcagagacgatgaactcatgcattacgcagccaaccaaaccaacgtgcatatgaatcgatgcggatgtttaattgaatgaacgagtatttcgattcttgttggtttcagtgataaaatatgttgtagaaaacttttggacgaaggaagtaatactaacgtaacatagcacaaagggtatataaccaacacaataggtatttaatactctcatcgattcagatataaataataagagacacaagtctaattgtcaaatccatttcatataacggttttcaagatatattgatactcctataaatttatacaaatgaattgatacacttggatagtcagtcttagcatgcaccttactattattgtctctaagctccatgtgttgttgatggctaccttttgtctgggttatggataccacatacctaatagtcatcgactaagttcagcggggtccaccatatactaagtcttatacggaatcatattttttatatagaaagagttccgaataaggaaggacaagaagtgttttatatggaaactataaagactgctcggattatatttatattggtcgttctacttggacaatgagacttctatgggtataaatacaagccccctaggaggagaggagacacaacacacaagtcaagacaagctaaacatcgatattggagatagcctagatggactcaatccggtgcctgcggaggctgacaagagagatctagtgctatctctgatctcgccaagtacgtattcgacgaggaggactactctgtcgtcgactacatgttgatgatctattctgccaagtcgatgacagctagataggttatcccaattattatacttgtgtgatccatataaataaagaataacaccggccttcggccaacaggagtagggtcgttaccttcctgtgaaggggcctaaacctgtataaaaatccttctctctatcttttttaccttgatctcgcatacaccctggtaccaacgatctccataccatgtaaataccatagtcatgacctcaaacgtcgacacctatcaagggttagggatttcgtaccggtgaacaattacggacaatataagtggcaacaataaccaccatacgcacaattcttaattggcactagcattaattagggatgtagcgtccaatttctatccctaagtagaataaagtcaccatgtggtatctaacatgtaggatcgaacacaagtaaccaagcctaccaggggggtgaatggtagggaaaactaaaaacccaaaaaattttagcggaaataaaagttaccctcaaattgatggaaatctcgacgtagtcctgtcgccgccggtcggaccgctcgcacgccgccggttagatcgcctccctgtcgcctgaactcgaagaaacacaaattgaagaactctcaaagtagatgacaactttattgcttctctctatatttacaaagtgcaacaacaacactccttacaaaaatctcgactaaactcgaaaccctaactaaactatcaacttaattgctctcaaagcgatatcgggaggcctcaccctccctctctatttataccacaaaaaccccctactcaaagtaggtgtagaactcctattcataataggactcaatcccataatttcctttttctccaaaactacagccgcacagaagtcggactcctcctgccgtcgctgctgctgcttgctgcctgagccgactcggcttgcctctgcatggatcaagcctgccatcactgaagctgcttgaccacgcaacaaagccaaagtcagtcaccaccatgcatacatacatgcatcacacatgcatgcacgtactgcatgtataccacacatatatgcacgctgcacaccagcacgcatacatatatgcacgctacagtacaccacagtactgtagcaccatacataagcctcttccaatttcttccaattccctttgcgaacaccgatgcttgcacgcacacctcgtgaagcccgttgcgaagatctctcccacacggtatccatccaccgtatgccatctcgtatccaacttcgtcacccggtatccttgacagtctggacctcaactccttcctgagtctagtcctgatctccaccgttgaccgaagttgacctccaagaattctaactctagtcaccttctcacatggtatcccgaccgcactagacctctgtttttctctgaacatagtcccggtcctcgccattgaccaaggctgacctcaagtcacctacacacaatcagacaaaacaaccgtttctgggcacagatatcacaacctgacccacattagtcacacgcactcacatcaacatccacacatcttttcaaaccaattcattgattaaattatttgcatagccaattgttcatcacaaatattaatcatgacaatgatttcacataacatacctcatccgttcctcaatacaatgactcatatgtatcgtcatccatcgcttcccggtcccacactctatcaacctccggtctttcttttaaaaccctcacacaagtacaccgaagctagtatgtcgtccccatgaagctagtttggttgcgcataagttttctatgccaccgcctatcgttgccattacatccaaaaagaagtcgtcatcctactattctaacaatgtgccaaccgcttctacccatggtcagcaatctcttagcaacccgacaacatggactattctacttgcataactatgtttagtcatgtgggacaagttaacgagtgtttgtgcaactccttgttggagacacaccattgttttactatgtcttatacaacaacccgtataacttttttagatgttctgattaaaaatcctagttttttacattattagaaatgaattaaatgcagatacacaaaatcaaataaattccatgctttcaataaatgcatttgttctatatatatatacaccatatatacatttatggaagcagatttattgaataagatattcagctggaagttattaaataaagatatctttaggctgcacattttttcatatatgccctttaagcaatatgaaattaccatttatagtcttcatcatgtgcctttaaatactgccaagttggagacacttatcagtcaagtgttcttgagaatcctcatctccaccctcaccatagaaacaggactagagtcctttcacgtgtcctagatttgggcacctttcttttgatcaccgaaatggaacgcaagaatccgctccctcagcaagagtctgagcctcacgtcgaaggcaacaagtcccctgctcccaccagcatcgtcgacgacgccactaacactaccgaggacgactccgcgttgagggacctcctctacccgcaatctctcgaggtaccattcaatatcttttgtaagcatgccgttattcttttaattacgttatttgtgttcgatgcgttcttatttatttattaacttaaaaatattcacctataaatttatttttatcgattacatagaaaaccttatgtctaacatgagttttcacttgattccatggcttcaaattttatattacttttatataaatgaataaaaattataactatgcaccaagacaagaatatgtctagatgcaattgtattctagaatgtactggatgtacaaggggcaagtgggtccgtgtttcagtagtaacccacttgtccccgtttgaccgcttcgtctcgtactagtactaccgtctacagcgtcccgctgatgctccatcaaaccggtggacgtagacgatcggaggatctcgccgtgcatcgcgtgctttttcggccatgcacctctcgtcgtcttcctgatttcgccgccacttgtagcatctgcccgtggggtccatcggtcgatcgatccccgtagccagcacatgttgtcgtctagctcaagatttgttggctcgccttcccttcttttcggttcactcttgctagcgatcgagacgacttgagaacaaccaacggagatagctagccgtctcgtcaaagctgtgtcatcagccgaccagcgaaggcaaactcgcagaagccatcgtgtcataggtgtggtgtgtggagaagcggtggaccgaccgacgacggcggcaacccgcacggcgaggcgaggcgaggccgacggcggcggcgcgcgtccacgaaaagcgggggggtatctacctgtttttcgtataagcccctcaagatctaggaaatcgcggggcgtggtcctcggcccggggcctttaaatgcgggggcacccatgtaggccggagcagagcgccacgaggcgagttgttgggtgttccctagactagccgtctcttcctcctctccctctcctcctcctcccgccgccgcctgcaaccgcttcacgtggcctgatcctcctccggagctctccctttcgaccccaacaaatggagcccaagaggtcccctgcgctgccgcagcccaacgtggagaccaagaagtcccctccccgcgctgccgccggaggaggcggcggcggcacagctgccgtcggtggcgagtcgccgttgagcagcctgttccaccagccgtcgcatggggtactgattcctgacgccttttgcatgtttgatgttatgcctgtgttcaggcccgacgtgaatctttcctccgaacaagacgaaattcgagggtgttctttcgttgtttgtttgttttttttgttttatttttttttgttacggtgacgcggatgacacgggatgagtccccctccgtctgcgaggcgttgatacatgctgaatttgcctttcattccatcgctgttgcacacgcataaatttagtatgcttttaatgtagatatgcccccccccctcctctttctatttgcgaaaattagtaattttcaatgtacaggcgcctgtctttccaagtggatacgcgatagtttgtagaatacttttggaaatcaaccttagagattgtttatatagtttgatggtgatggtatttatccaatcccaaagtattgttttgccggcgctttgtttacacttagtgaattcctttacatttttccattttcaggcaaaaggcaaagaagacatatactccattttctacaaagggcagaacgggactgcacaagctgggactgcaggtagttgtggtcttgtggattgacccaatctcttccttgctcttatgtaggaaggacattcttattccttggtgccattaaagacactgttgcgaaaatggaacataataataagcacaactatatataaacgaattcaaataaacccaaagaataccagttccatataaagcttgaaaattagtagcctccttttcatctgtatttactatttgcctcctttcttctgtaattaccatttgcatctgttggatatctctagagttaaccaacgagaaattactttccatctgttactcttgtctgcaccatcatgttttttttttcttttgtggagtgtcgttgactgttattcatctttgtgatcatcttactcggttcagactttagagcactgagatgtttcacgatagcaaactaactgcatataaacattgatttgtatgccagatggtaaatcccagtggactcctcctaaaagtcgcaccgtgtacaccaaggataacaaacagtcaaatcagtatgattcggttgatacgtcctgttttggttcttctgtgaactatggtggtcgagactattatggaatctctggacacaagcaatccacagaatccaatgatgtaagaaattgccaaacccaaaactgcaaattatgtttgcaattactttttttaaaaaaagtatcatgaactggtctatacaactataccacaacaaagctttgaatatacttttgctttattgctttcagtataaggcggacaaaaaggacccttccacagattctcatggtgactggtggcaaggtatatttacttatttagatatgcatttatctctgaattcaagctccatattgttgaaatgttgattatttatttctatcaggttcgttttactactaagcgaacttggtggcctctcccttggtggaaaaggtaaaaggcacatcttaactgtttttatggtttgctgctattgtctgtttgtgcacatgattatatgctattcaacttacatttgcggcgcaatggaatatcttcttttccatctgacagttcatagatattggtgttagctcactcgacctattttatcaattatttgatactcatgttcttttttatacggaagagaacatattctcttttgttttgttttccaaaattcagaacagttatactagaattcaaactactaagcctttggaaattattggtgatgatgtgcccaaccaacgtttcaatacaaaaaagagccaaaaaaaactatttatatgaggaactgttactttcagctgcacatcccaaatgcttctaagctctgcatattccctccccctcaaacacaaacacatgcaaagtttatctattcatgtgtcaatatcaaagttccgtgcctccatttaactttttttttcctgcacgataagctgtatggttgtaaaatttgacgaggttcagtgggcgggaaaagggtttaactgtcctggagtgaaaattttagttagctcctggctttatatgtctccatcactgtattagttacaccactatccctataatttattgacctagtgtatgctacaaattcacttcgaggaagcagaacaaaattgcaatgaatcttgtgctgatgttccattaagctgtattacttgcataccgtgctgtgtcaattttgttctggtgaaacatgaatcctccataagaggattaggcccaggtcccatctggtaatgtagtttcataaaattcaggttattcataatataaggtagagattgattttctaaaggctgtttttaagaaaaacaacttaaccctaagttcaactacaaaaccaaagaggtttaacgatgaccgtctgtacgagaaacaatccgttaatcctaactccagctacattattttcactgtatatttgtgttattttatcgaatctaaccattatattgggctttttgtgccagggaatggaatgggaggggttggagctggttttgcttcactgttgctatgctggccgtatcagttacctaaatcatactagtgtgacatcgtccatcagtggtggcagtatttggatcatcacacctgggcagatgtagtgtgtctttaccttttcatttcgtagcttgtgctttagatgtgaaatgaatcgaacttacaagcacagtaagttttaggtcgcaggttgcataaatggtccctatccattctgccaaatctggtcagtaaccagattggatcagtttggtctggctctcttagatcgaagtatatgttccttgtactctcggatcttcgctccggagccaagaaggctggagaagtggagatcacttgcattgtaaacatgtactcgtttaatttcaaagaacttagcaaactgttcttataaatagtagtacttttattccaacagaatcatcaactgcattattcagaaagatccaggagaagtcacatccttgaatttcacagaacttatcaaactgttctcttatagatagcaccactattcgatagtcataaaggtactttatttcaacagagtcattacaactgcgttatttagaaagatttatgaaaagtttcacgtgacaaaggtaacatcagtttatatatatatatatcggatagtcaaagtgttcgagtgcccttccagttccatccctttgctcctcatggcagggtgtatgctgcacagttgaaaaagaaaaacagatgacttgatgcgattcatattttcgaaacagactgaaggaaaaaaaaaaagcagcaggagcagaaacttacggccacatttgtaaccgatggggcggttggcgatggcgcagcgcttggggatggtcatggccacggcgggcttgacgccggcgctccgcgcggtgttcgacagcatgacggcgcacaggcacttggggttccgcccgatgctgcgcacctgcgcgcagcagttgggcggcaccgcggcgcgcgggttctgcgtggccgccgcgcacggcgccagcttaagcgccacctggtccacggggacgcggccgcactcccccgcgccgcgcacggtctccaccccggcggccaccaccaccgcaaccaccaggagaaaccacacgcacctcaccttgctctccatcccgtgcccgccgctttccttttcttcttcgtcttctcggcgtcgtctgcaactctgagccgtgctgcgatcgatgatcctccaggcgtctcacggggcgagtatttatgcagcgcgccggagcacggagcgtggctcgaagccatcattggggggccgcttgagaattcccgcgggtcgcacggtgtgaaagcctcggaagtggaggtcgcactggcgagctctttctgttgctcgcactgagctctgttctgtccaatttggaagtgtcacctactgcactccactatgctgaggggcatgcttagcgtccataaaattctctccgaagagcctgaagatctgccacgtaaatggcccgtgacggaaagatttcgctcgccgatcggttcacaatcatcaccggtgtgtcggcggcctgcttttagatcagtgacacggccggagttcttgaaaacgcgagaaggaatccacactgcctttcccggaccgtcacagacctctccagtacaaagctgcagtaagaacttgcagccgtaaaatctgctggtgccagtctgccagaggcaagaaccgcagtgagttaagttcctcggagttcattggcttgattcctttgatgcactatacggacagtggagctttaattaaccgtgtaatcatgattttatacacttgttatacttgatcacgagcaaataggagcacacaccacacagagcttaacaccaggaatttcaggcgatacagtaagaacatgaatgcactcaaatggcacaagtatacacaaagactagtagtccttaacaaattttatgagtaaaacctagattaccctacattacagctctgtggtcgtcgagacatcgatcatcttaccaccgctgattatcacccccattacttcaggattaactagatcaattgccaaggctttctttgcgccaaaccccctgttgctgtaagaccgtctccctgcacccagtgggctcctctctttctttgatgggcttgcaagctgcgccggcgagaagctgggcgtcgcatatgcggtcacaaacggtgtgcctgaggcaggcacttggtacggtggaacagcagccttgttgcaagcaatcctgcaatctgcatcaccctgtggaaaatgctctgcatgcctgttcagttcatcgatgttcagtaggtcgtcgatgcgagcgacaatgttggacgccagactctccagcacccttgaataactctccagtattgatttacccacatcctagaaatggttcaagacataataatgacaggtgcatcagtaactagcatggcaatgtggataaaacaaacataggaagattcagagagatactgcacaaaccctgttatactgaattttgctcatgtccaagcttgtctgcgtcagtccaggaaacctttgcttcaaacatatcagtaggccctctgctcgttcggcaagcagctccctcttctccgtgtctattatcatgtctttcaccatgccccaggatgatctgccactggtggcacggcctaagacacttgctggttttgcagcaatcctccggcgccacacatacactgatgcctcgacacggttggcgatttccagtgcttggtactccgttgacaggtccaggcagtcgagaaggcactcaggagagaaatgatcagacgttatgtagcggtatatgatgtcacccaaagttgcccttccattctacatccaagatgaaggtaacaagctgagatcaactaaattacacatgaaatggcagatgaggttaggtcagggtagagaggcatggtacctttggtagggattctagatacgattcagggacctccatttcagctagagcattgctgttgatggccaaggcagccttcaagatttgattagcacagtcacgtttgtgctgcagttgcttcctcgctttgtcacgcaggcctccgggaggaacacgaggcaccggcaaccaccatttctcatcacggcggtggaaagctgctctgaaggaagctgagccatcacaatccggtgcgcatatcccttgttcaacgtaccagaactcagggtctctgaagctgtccaggatttcctgagaaatattgctctgagaaattactaaatgtccgtgttaaggttggattgtattgaattcaccgacgtgaaaaactcacaatgagcatatggtctagcttccgaagtgctggcagattgatgtataaatcagatcgtggtctgcttgtcatgacctgaaatgttgcaacaggaaaaaaattgtagcagtacattttttagtgaggaaaggcaaacttaatagaaaaactgtacagcatttgtcagttcgaaaattacacgaaatcaagaacacggaacacgtatttcactcatgtatatgcagcactaattacacgcactactgctcattgccaatggattcagtactaataggtggttagtaatcaatattctgcaatatttggcagccgcataacatgtactagagatttggtttggtttcactatttcagtacccacgaccaagggctgcttatcatcttcctacgttgtcctccgtttcatattataagtcgccttgatttttttaaaagtcaaaaattgtttaaaaaatattaacatttatagcatcaaattagttttattaaatttaacattaaatatattttaatagttttttattttatgttgaaaatattgatatgtttttctataaacttggttaaagataaagaagttcgacgtttattttaaaaaaatcaaagcgacttgtaatataaaacggaggtggtattcaaattttcaaattgcgttgtttaattagatgtatgtaaaacatgttatgcgtgcatgggtttttctattgatcccatttaaccaaggatgatactccctccgtttcaaaatgtttgacaccgttgactttttagtacgtgtttaaccattcgtcttattcaaaaaatttaagtaattatttattcttttcatatcatttgattcattgctaaatatactttcatgtacacatatagttttacatatttcacaaaattttttgaataagacgaacggtcaaacatatgctaaaaagtcaacggtgtcaaatattttgaaacggagggagtatattgatatgggcatctgttgtcatgttagcatgtccttccatgacattacattcgtttggttacagtttaggactaagttcagatacggaaaacatgtttagttaacaggtttctcctttctgtggctacagttctcgcactaaatataacaaaagctgcgtatgtacacggggtacgtgcactgtttcagtatctacggcctacggctgtttatcgtcctgctctgctgtatattcaaattttctggttgcgtcgtttaattagctctgtatgtaaaacatagcatgcgtgcacggcctttttattgggtacagatgcgaaaatatacaacagttacagtgatacagtaacatttttgtctttcttctccatgaagctgaattcagataggtaaaaacagtttgctaacaacggttcgatcccattttctagtggtccttgtgcaactaaagtcaccattatgaacctttcccgtgcagtgccatggtatcaagttctatggaaagccagcagttgcacttgtacttatatagagcaaccgctttaatagcctccaatttcagaattgaaccaacaaatcctatcgccagacagcgcagaggtgttgaataatcaaattgaaataatgggagttaaccggacaagcaagacacttgatgaaccgttttgaatttgcagctcctgaattgagccagcctacacgggttgatctgtctgtgaccgtacgctttgagtagaaaaaatggcgcggtagccgctcagggcctggagtttactaaaagaaaattttttcggtgtttggatgtttgacaggacgttggaaggggttttcggacatgaatgaaaaaactaatttcataactcgtctggaaaccgcgagacgatttttttttgagcctaattaatccgctattagcatatgtgggttactgtatcatttatggctaatcatagactaattaagctcaaaagatttgtcttaccatttctttctaattgtgcaattagtttttttaaaattttatatttaatgctccatgcattgatatttttggaattttttttaaaaaaaactaaaccaggcctaagtgataattgcagccagatcgagctgctatgctagtgcgtacctcgagcctggttccgtcggggaacgattgccaggtggggaccagttcgacgatgtggtcgctgacgcagagcagccagcccatctcgcgccgccacatggccttcttctccggcgggagtggctccagcctccacagctgcccgaagatggtggctgcaagagacgcagtagaggtgcgttagtgctagtacactgtacacctaagtagagctccacattgatcaaacggaatcatgaggtggggagaattctcaccgcagaggttggtaatggcgttggcaatggcgagcgccgtgcacacgcccttgccgctcccggacatgtcctccccgagcagcagcttcgcgaacctctccttcatcatctccatctctgctcatcaccatgcacaagtatcatcagtacgctgcacaacctgaccaaggagaagaagagcgcgcgcattgctcggtagtgccggtacctgagctgggagctctgcgcttctgcgcgtgcggcttgctgctgtccaccacctccgcgccggggacgcggccgcacgccgccgtcttcctgggcggcgccgccagcgtcacgggccactcgtcggccgaggccgcgtcggagctggagctgctcccgtcggcggagtccgtgaacgccgcctcgctccgcgcctccctctcctcctccccgctccccatccgatcggtcccaaccacgcgcgcgtgacggggtctatctaactagttacacctctccgtacgtgcgcgcttgctttcgcgggcgcgggtgtagtacgcgcttcgctgctccgttcctcggccggcgcggccgagttcagctccgcgtgcgcgacgagacgcgcgcgggcggggcgtggcgtggtgatttgcgcggcgttttggcgtttcggtctcggtcgtggcgcggtgcggtgggcgaacggaaggctaggcgcttaaaaaagttgggcttggctggtcgatggggaagagtgaccgttgggttttgagttgtctgggaggccttggcgagtttactttttagaggcggagagagagaaggagagaggttttccctttgtttttcttttgatcggggagggtgggatggaaatggaatcatggaatggaacgggcggggcggcagcggcgcgcagtaacggttagcgagtgaggtggaaggcgtgcagataataaagaggctggatcggcgtgatggaaacgctccctccttgctgctcctgcggtgctgccgttctcgttctctcgccttccccttgttggcgactttccgttgcacgctttgtgtcgctataagcacagaaagaaagtaaggaaaaggtaatggatcaggaaaaggagtattgatcaatagcacgaccgatccgtccctaacaatcataattaaggtccagtttgcatagcttagattgtgagaagtgaaaatctagagaagctgacaagccattttctagattctacatctacagttttttaaaatcttggtgaaaatctggactgcttaggagagcttctgttatcttttcaaaatgtgtttatagctggcttagagcagatacaatagcaaactataagccagcttaaacacatatcgaggagataaaagaagagagagaaaagcaacgggctacagatttgtagctaggtgtatcatggactccaagacacaatgtatatatgacaggtgagaccatgtattaatagtctagtatatatttataggtaattattgtactcaatccgtcccaaaatataagaatctaagactggatgtactagtaaatgtctcatccggttataggttcttatattttgggacagatggagtatgaattagttattagggcaacaacaatatatatggctaaagtagtacatatagatgggacccacatatatggattttaactattgtaaccttcacaatgtatatagatagtaaatagcattaagaggagaaaaaaagtagagacacataatatattttatcctctatgggcagcccatatgtttgtgggtagcttttgttatttctttgttatgaactagttccataatgttactaggtggttgaatggaatactatattgcttatgtaccagtttaggactacattgtggatgcccttaagttgactataaataatttagagttagtagttggttatattgttaaacttgctcttatttgctcttactgtaggacactgtcaagttaaggtcatggagagcaagccgttaaatatggaaagaaaacacggtggcagccagtactgtttgaatgtcagccttgtttactccatgtgagagaaccccaacgttagactgtctccaacagccttcacccaaattcattcgtttgggtcacgcgggatgtccgggtcacgcacccaattctttcgttctccaacaatggacccaaacgagcgttgagcgccgcccgcttccctccccgccgagcaccgcgcctccctccctccccgccgcggacctgcctcgctacgccggtcgctccccgttgcgggcccgactcaccgtcatcgtccgagggctcgcctcgccgcgccggcgtctaaacccgactcgtctcgtcgtccgcttccgcgtccccgactcacgcgggagctcagccacaagtccggcagcgagaccgtgcagtggcgggctgatgcagcacccgcacgagaaggatgaccgcgagcacgcggtggcggcgagcggcgagcctggatgaggcggttgcggggcgggcggcaccgatttgggtcgaggagagagacggacgcatttttgcgttctcactcgactccgacgcaaattgcgtctccggtttgggtactctgttggcctccgattttttcatcggatgacccatatgtgggtttaggtaccgtgatgggcaaactgttggagacattcttagggacccaatgtcaaagggtgcatcaattttctactcctatcttcactcactgggcatccccacaaacacataaagaacgttccaagtccgacacaacacggtcccatacggagtactgtattctgctccgataagccaaaaaagcctgtgttgatactgtgcagcagacgctctgagggccaaactccgaaggaagctacgcttgtcgcggcgtgcctgtccgtccacgcttccccactgggctgcacacaactaacccagcatgccacgccacggctcgagacgagcgtccatgcacacggcaatggcaattttctccgtggcgcggcgtgcgtcgcgctcggctcgcttcggcacgggcagccaggcaggtctcttccagagtgcaatattttggcttggcgtcatgtgacatcgcgcggcacctgatcagacctcattgcagggtaagctgagacactcttcaactggtaagtgttgtcgtgtggaccagttaagaggggaagtcaaatgcatagttcagttggaaggtcgatgtgcacctttagatacagcatttggtgttttggtccttgtcagtgtttggctatttatgtgcctagtttagttagcgtgtaccggccgtgtcaccgttgccggtggccgacctccatttgatagcagctggtagatggtcaccagtcaccaccatgctggtagctggctataagccagctataaatatattttaaagagataaatgaagagagagaagagcagcgggctacagatctgtagccagctgtagtacggagtccaagatgtaacgtgtgtatgataggtatgatcagatattaatagtatagtaactaactattatatgaattggctattaatgatttggagttagtagttggctagactattaaacttgctcttacttcaagctggagctctacacacaagcaagttgatggcgtaataaaaaccaaaggacgactgaagacaatatctgtgttgctttagaaaactctgaattttccaacaaaaggatccatgtgggcgtgctagagagtgatgagagcacacgttggtccatgaggctatatggtggtgtattgaggaaaagcatgtcctcattaaaaacgcaacccaaacataccttatcggcctcacacgccgaatgtgacacgggcacagggcgtgcgtatggactgattctcttcacccgggcgcccgtcgtgcaagcgtgtaacaatggcgaatcgtgatacaacatcttcctgtgtgacattcgtaaatgcagttgcacaactcaagcttgtgcgtgtagaccattactttccactgggcgttgggcaagcacacggttacacggggacacatagatagaaggggaagacaaacagttcggtcctattggatcgggctattatttgcaggtcgtcgggggtaaggaataagtctcttctacctccctcaactcacgtctctggttgaatagtatccctcaatcgtaaaaccgggtgtaacccatcctaaactctaaaaaccgatgcaaatcaattcccctagttttggaggtggttttgtcccacgtggcattttctgactccattgactagttgagtcatcttgtggaacccacatgtcagtgacaagaataaaaataaaaaacggtggggcccattatcagtggccactgtagtcgcacacattccccatgcggctacacatcgccttcgcacgtcccccactccaatccgccgctgccgaccgatacgcccccccacccaccccacctgccctaggcgccgccgaagtcgacgctctcctccagcgtgggcgtgcgcctcgaggacaccgtgctcctactcccacgtcatcattgtttccaccctggtgcccaagattgttaggctccacctccccggcatccacctcgatgacgacgcaaaggccactgcttccttgcctctagacaccaccatcaagcctcccccctcttggggtcacccgccagccaccgccgccgccaccacgcaatgggggcaaagggggaggaggagggaggacgcgagatgaggagtggcgaagaagccttgtcggcgcactcaagccgggtcgtcacaggagatcgatgagggtgttggccgccgccatgccgaggagctactccccccacgcagacggccgatgatctcatcccacgcgcggctatcgtccgtctggcgagctcctcccccatgcaccattgccgccaccctgcctctattgatggaagtgaaaggagaggaagagatgagagagagggggggaggtgaggggaaaaatgggatgaggtggagaccactgacaagtgggttccatctgatgacttagtaagtcaactgccatgttggacgaaaccgcctttgaaaccacccaagagtcaatttgcaatggttttgggagttaggggacaggttatacccggttttatgatggtgggatgctattcaaccagggacatgagttgcgggaggtataatagacttattgctcagggtaaaggttgttgttggtccagtccagcccagatattttattgtacaatacatatagagtaatcaggttggcctacttgctttaagccttttgggctgcgactttgcggcaatagcccatcttaaacggaaccgggccatgcatgctccagtctagctgttagaggaaaaaaagttcactctagaaccctcgatttatcacctagtttgtaattcgtccctaaaccgcattaacaaataaaacgcatccctcaacttgtaaaaccggtgtaaaccaccttccctcatccccccagcattccaccgcacctccaattccccatctctctagtgcggtgactgatggggagagggccggtgatcggcaggagaggagctagtcaacggctggcgggaagggcagcgcgcttccgcggtggactacctgccaccctcggcctttcaccgcacctctgattgcccatctctccagcgcggcggcggccaacggggagaaggccgatggccaatgggaggggagctaggcggtagcgggcttccgtgatggaccacctcacccctacccccggcctccgctgcaccttcggttccccttctctacagtgcaacggttgttgagtagaaggtcaatattcgacaacagtggagttaggcagcggcggtcgagtgagcttggccctcataactccttgagcggccgacaagagaggagttgggtggcagcgggtgacgacggcggtggccgtgtctgatggctcctccatgactccatccacgagtgcagcctctgcctttctccaagtcagcgctgtccttctccccgccgcgcgccactcgcttcctcccgtcggttgccaccctctccaaattagtggtcgtccttctccccgccaccctctgatcgggcatagccctccccgtcgggcacccctctccatgttggatgtggctcatctctccgccgctcactaccctcttgttgaccaccgctcattgccctcccatcagttgccacttgaatgcttgagaatttgagagatggggaagagagaaagaagagttggcagctaacatgtgttcccacatcagtcaaaactggacgctatattgcccatggatctcgggtacacctgttttgtaagttgagtggcgtgttatatctggtattgcgattcaggattgaattttagactcgattgcaaattgaaggacctcaagtaaacttattcctttgtcaaattaacaatgtgtaatctaatctgaacttcagttccgtgggccagacctttttcttcgacgctagacctgactacataaaagcgtagcttaaaactaatcccaccaaaaaaagccgcatttccatgccgaaaagcttcgattcgccgctatgatgatgtactcctccggccaccaccaatcaaaccagtccactgattcagtgattctctcaacaccggtggaaacgtggaagtgtgctcgatgctcgatgccctccttttccgccatctttttatcccaagagcatattttccgtgtcgcccttgccttaagagcagcatccactcttgcgctgccttctcttgttccaccctcttctctcattggccgagcagagctttgtaactgaagctgcagttgggtggtaggagatgaaggattgggcgccggcgatcatcgcgtcggcgctgttcgcgctgctgtgcccgggaggcatcctgcagatgccgggcaggaaccggccggtggacttcatgaacatgaagaccagcttggcgtccatcgtggtccatgccgtcatctacggcctgctgctcatgctgttccttgtcatcttggaggctcatctctacatctgatccgagtgtgttactgtgatttcgttttcttgatgacactgctgtagtgctgtgttttttctgttctctagtttctttagataacttctggacctgagaggcgctgaggacgcctcgagcccttgatccttcacagccacaaggcttatggaatactaataaagaagcaatgatgctttatgcttaaacagttcaagcaggagtcgtatggctctagttgactcgttgtttcaattggctaaagctcggctcatcggatgttcttgaaatcgaagagaagaattatgttccgacagtgatttttttatcagtttacatgcaagaatatagtgtctgattcaagcggggaagaccgaagatagaacagcatagtgactttgtcactgtgaactcttgtgccactttgttcttgcttgattcatacccatcccgtggcttttaatagcaactagtataatttttgcagttttgaacaaggataactcagatttcacagtgtgcctagtgcagatgtataaaatgtacagcgtacctgccagtgttgccgtgttgggctaattaatgtctttcttttaaagatagcagtaacatgttcagaactaacaacatgtattacgattccaggcttccagcttccaggtacaacagcaaacaaagacatccaggattattcaactatacggacatactccaatacagctgccaatgaaacagcactgcagtactattaggtgacaagttagggtacaacacgcaatatacattggattgtttctgtccaggatgcaggtttgcattgctgtaagagtagcgactactttgccttgacgacggtcacagggcaagacgcattcgacagcacgtagttagtcacacttcccagcagaatcctgcaaaaacaatttaaaaatcaagcaaagtactggatcagaaattcagctttctgaaaatgatgctacaaggggatattgtatcgctgcccctgatgaatctctggttgctcaaacagaaaccagaccgaaagtttctagaaacatgtcaatgctataccgtcgtatcattcacacacctctggatctggccgaggccacggctgcccatgacgagcgattcgagattgagctcccccacagcctcgcacaccttctccctcggctcgccccagtacatcttcagcaccacggacagctgatacaaacaacatcaggcctctcgacctgaaaggcaagacaaagcatgctgccatgcatgcagcaccagcatatatagagccagcctacctccttctcccgggacacggcgttgagcatgtcgaacacctcttcgtccgaaggtatatcatagcgctgcctcaccgccgtctccatgagctcctcgagcgggatcagcgctgcgtgcgatcagtacagagacgacgcgacatgacatgacaattttcgatgggagatcaaggcattcaaaatttagaatgcaagaggtaaactcggtgcgtttctctcttagtattactattacgtacgtgatccggtgtgagaccagaggacgttcttggcctcgtcgcggccgtggtgccggatgtggaggaggacgagggtgtcgcccttgcggaggaggttgtcggccgcccactgcagcgccttcttgctgctcggcgagaagtccatggccacgccgatcctgcgctcgccgcccgcctccgtcatctcgatcccggagcaaacgacgacgacgacctctcagtttcctttggtccgcgatggtctatgcggcacgtgtgggtgtggctttgtgcgcgtccccccgggtttgcgctggaatttgttgtgttttcgatcggtgggcggtggtaggccgtgggacgctggatgtggtgcgacacgagagagattcggcggtgcgcgaggccgcgccgcgcgcgcgctgggtgtgcgtcgcgtacggcgtacgtacgtttcgccgtgccatgcgtcgtgccacatggccaaccatgcaggcgaaggcgccgggggatcagacgcgtggcgcgttggccgggcacgcagttcggacggttcagttggggacttcaaaggaaagaaagtctgattgtttctgaattctgatctcacccggattcaacccttaccgccgctatatatatataaagttataaacatagattttctttctcgtgtatacgtttcctataccgccgcatctgcttcatcgccatctccatctggtacgacgataatcgactttttctttggttattaaatgtttcgaatcatttatcagttcccgttaagatcaaaagttcttggtaattagtagcaagaacgtggtactagatacaccgactctcatatttcacttcctttttccctcaccatatatgtttcctaagattggaatattatgaacgcgagattgtcaaaacacattaatagaaaaatcatagaagtagaatatcatacttattagattcttatagaattttgaaatataagaaggcttccaaattgtcgtttaattgataaacagcatgcagattttaggaactaacaatacatgaagaagaaagcatgaaatacatgaagaagaaagcatgatatgagattctatgattattttcctctattttttctagaatagtccattccatagattttaaaggaattgatagaaatcaaaccctttttttcaaatgtctcattaggattattttacataggatattttttaaaaaaaaattatgtcttttatttgtttcaaatgagatcttagagtgctgaaatgttctcgctagcaccactttatccatgaaccggaaaattttcgacattacaaaaacctagttcttttctatttcagaaaaatacctgtttcaatatctaagtgaattgtaggctgtatttagatggtggaaaagttaggaagttgggagaaagttagtagtttatatgtgtagaaaagtttttaatgtgatatgatatgatggaaagttgggaatttagggaactaaacacggccgtaaactgatggtcatgagtcataactgtattcccccgtgagtgtttgttttatgctaccaaaatactactgatggagttatcaaagcaagattaggatttttattatgtagggagaataatagataaacaagttgatgatgcgtctaatttaagatcaattcatttatgtaccaggcaaaaaaaaaatgttgggtgttcttttcctcataaaccgctgtgtgaattactctgatgcattcaatatgcctatcttacgtatacatcttttatacttatacctggctggaaggattattaatatgtcatttaaggccctatttagtttctaaaaatatcacatcgaatatttagacacatgcaaggagtattaaatatagataaattaaaaaactaattgcacagttaggggagaaatcgcgagacgaatcttttgagcataattagttcatgattagccataagtgctataataaccaacatgtactaatgatggattaattaggcttaaaagattcgtctcgtagtttccaagcgagttatggaattagtttttccatttgtatccaaaaacatcttccgacatccggtcaaacgttcgatgtgacatccaaaaattttcttttcgcgaactaaacagaccctaagactatccatatagtttgtatatctttttgcgagtttgttgtgaaatgatgtaatccagatcaactggtgtctcagtgtgaagaacccatagatcctaatgggtgcgaagacagacaaaggcaaggtttcagaataaccatccaaggttctaatcaagagaaaaccaaaaacatccaaggttaattgatactacaagattcctctctctctctctctctctatttgtttcccaacatgacaacaagtttctgatttgatctgtgtctttcgttaggttcgacgatcacaaggcagagggtttgggtatgggcacccattgccatcggtcgttggtctccctgtagccgaggcaaagaggaggataaaacaatgcaggccagatgtctacattgaggtcctttcggtaaatgcgatgctaactatggcttaccactcgaatcgcgttaggctcttagtggacagattcaacaaggtggtagaagatcctcacattggataggctaggctcatatgcagagaacatgcttttatgatagcttagtcctagcggtgtcctgcgtctggcacaatatttgttaatcgactttaggttatgcaaaactgaagttgctttgtttttggaaattattcaaccaattctgatataatttgtgttttggaggagaaacttggatgtgatattggagaggtggcctttcacatactcaactactttgggtcatatcgacctatgtgggcttctctgcttttcggccccaaaaatatcaggcttctgtaccgggcagatcgagttatggctctggttagttttcaaatttttttccctaaaaatatcacatcgaatctttaatacatgcatgaaacattaaatataaataaaataaaaaaccaattgcacagttcgcatgtaaatcgcgagacgaatctttgagcctaattagtccatgattagccataagtgctacagtaacccacatgtgctaatgacagattaattaggctcaaaagattccacatgtgctaatgacagattaattaggctcaaaagattcgtctcacggtttccaggtgagttatgaaattagttttttcattcgtgtccaaaaacccctttccgacatccgatcaaacatccgatgtgatatttaaaaattttcatttcaccaactaaacagggcctatgttgacatattctaggatgatgaatctggacatatgtatgtccagattcgtagctccccatcggatggcctaatcagctaaagaaaaaggtaaattttaaattttcaaacttaatttttagattgattttgagatattttcaacgtattttctttttcagcattggttttaagtcaccaagaacacatatataaaagttttatctataaattaatttttattccctaataagccgttttggcttatcagggaaaaaggcaaacgatggggcctgtaatactaagatgtgtcacatctggtactatgttagtttttttataggacggagggagtaagtagttggagtagtctcgacccgttgatgggttggtcacaggctcacagcagtctcctctgtgcagatcatagctcattttttttagcttcagttctctaatcattagaccatcccgtaccttgaaaaatgctcctcccgtatcagggggtgtttgggagggtcacccttaatagtcaaaaaaaaaaaaaggcgaagcatagctaactagggtatttatttattcaggcaataggaatcagacgaggtcacaggtacaggcgcctcgccaagtgtaacaagagacacgccccgttcttgtctcgtaccgactctgcttcggacggccgttcaccagttctgctcctgcatccttttgccatcatcaggtaaacacgcccagctctttgggttaggggagctattccaaaactgaccaactcgagcgatagcttgcaacagccagtggcggacttaggatttgaacccagggtagacctagccaaaaaaaatccgaatacaatacaatacaatatgattcgatataaaatgtggtaaacgatacggtatgcaactctaaatgattcaatacaagtagaaagtaacaaataagtttgaatcttacctaaataacaatgtaaataggatattacaatacttaatactagtcaagactaagctttacgcttcttcatggtcacgaaagagtgaattatgtcttcctcacttacatcagagaagatatcacgctcaatctcctaacaaccatcaaaccatgcaaaattgtcatatgaaattgaaggggtagtacactagtagtatggtttgctcggtctttcgcctctatttcagaaataggaaaatagctgattctacttcatgtataactaatcgttccaagaatttctctaaacatgtttgttgatattgttcaatgcctaaatgatagttgtcattatgtacatctatggctaatacggccaaaaagtaatgacaaaatcagctagtaggtttagaattactcaccggagtccagagaggcggagagccggagcggagaggcagtggcgcctgggcggctgccggctgggtgctggaaccgccggccggagagggtgcgctagccggccaggcctggggcacgctggtgactcggcgaggggcgaagggagtcgtggagagtgcgcggccgcggcgccgcgtgggcgccggcgcggcgcgtgaaggcagcggcgccgctgccacggctgggcgcgcgcctggcgggagccgggaggccgccgcccgccagctggacgcggcgggaggaacgacggcgcgagtagcggcctcgcgggacggcaggagcgccggagtcgcggctcgcgggaccgtcgtcgccgtcggtcgtttgggacttgggagcagtggcggaaagggaggggagattgcacgggagagagaagaagatattagggttttttttgtttgatgggccaggcttttttcgtgggccaataaaactgaatgctgggtcttctctgggccaaattctagggtagtcctaggcctatctggactaccccttgggtccgcccctggcaacagcgatgtcgctgtccgagtagaaccagaaccaaattatttgagctcgacttcgatccccggatggtcaccggttaggttagcaataaccaaaacaacgcgactgaaattgaaacatcaaccggtagcagactgcccgggcgaaagagactcctctggtcgccaataattttcggtgtgaccacggttaaagattgttcagtgcaatacgcaacacgcagtgccttctcgaagtgcagaggaattattaaagcacctgaagatgagatgaccgcatacttccaacatggtttggttcacgcgaaacgttggattggttatcgtttcgcggtctcttctggtcgatttggtgggttagcgggtgattgtggaacaagtcgggtgcagggtgctagtggtttccgtaagcagctcgacttgacaacaaatttcgccacccaatccgtaatagagcgtacagtctctgccggtgcaacagcagggagatcaacaaaaatggaatacagtaaattagacttggtgcaggagtggcgttttagacttaattcgcacttgacagctactaggggttttactttttcttagaagggtctgaaattgatttttcttaactaaatatagttgaattgtacgtacttctaagcctggaagcaactaagatgcaatcggtgaacttcaagtccagcatttttctcaagcaaagcaccttaaggacaaatcctttcttgcatctgtgactgtgagttcgccatcagacattcagactgctaattctcccagtacttggcactggcagatctgccgatgtttccagcggagcaagaggctggataactgctactagcaccactcacgcaagcgaaagaagcacatgaacgcaaagcaccaacgtatgtgcactgtgcagcgcaaatcgccgagatgccgttctgtaaagcggcgaaagatttcgcttttgctgtgccaaaaaggctgctagtagaacatccgatgccatccggaccggcctacgcgtgaccgccacgtcggccgaccaacggatcgcaagcgaccgaaagcgcgctgcgccgccgctgccgccacgagctcacgacaattccacgaatgcgaatcgaaacggcagcgaccacggcgccacccccatgtgtgtacctgcgctgtgcgtgcggccgagcatccgcgccgcgcgacgagcagacgactcgtcgctcgcttttctccccagaacatcgccgtcgctgactcgtttgttcttttctctcgagcttacgtgtggaatgttcttatatgctttgaacttactccaatgagaaaaaatatatagattaaattgaaatgcatttatcatcctatcgaaatttcacgtggaatttaacttatatagagttataaaaaagagaaatagtggtagaaaataaagtgaacctttgtagtagttcagggctagagctcagctagtgtagcagcaccgcacactaaatctaaccaaatggaggcgaaaagatgtctcgccactcatctttgccctagccatgaccgtcgtcgcgtcggcatcttcttcggcgcctgcaccagcgtctcagacaccttcacaatctttcatgccatagacattcgcgaactctgtggtggtggtgacatatatatctcatgacatacgactgttgtttggccagatggctaggaaggtgcccagggagagttgccctggccccatgctgtatacggcagtctttcttcatcctcgatgccaaccctctccagtggctcactggcgaggcctaaggcacgacgacaagttatagcaatggctcggattaaattttgtaaaattttagtgatcatataataggttttataaatagtaatgatatattttaaatagtgattttgtaatgatgtggatcaaattgtacttactcgacgtgttagctgagccactagagagatgataattgtaagcaattagcaaatgaccatccataggcccgaaaggacgcttgccatctacaagttacaaccacgatggccagaaatggagtagaatctcgccttgtcacattgttatctggagtacaccagtagagaaaatagagtatgatattaccaccgtgtgtccggaaaagatctgcgtaaggcataaaaagtgattatggcgcaatcctttgcttccacccgaagattttggattctaaacgggccgacgccctgttagcacgtaggagtagtataatgcacatggatagcgttttctgatcttctcattgatgcggcagtacagcgacatgcattgtcaatttccaaactactccagctttacacatggatgatggatccactcgcgagctaagatatttgctttctaaatggaagagatatcagtattatcttcggttcagaaaaggatatatcagtactataaagacatgatatctctacccagatccaaaaggtatcatgggaaatatcctattggactttgctcggtactacttctacttcgatagaagtacggccgttgaggcttattcagaagagaaaagtatgaattatcctatgaattattggacgagtagtactaattacatccctaaatctgaaaactagatatcttttattctcaactattaataccaaacgaatcatcccctaacctaatatgaagttgttttggttctatgtgacaattgagtcaacaactcttttttaaaaaataaaatcagcgagcccaacctgttagtctctcgagtctcaccctctctctttcccctcacctctctactacctctatctactctagctctctctgtctctctcttctccctccctgacctccatctctctctgtcatcgagacagcgacggagggggagtcgaggatattaagggttatgaataaggcataccttatattgatagggttacgcaatatataaatatggtataccctcaagtatacagaaggttatcataatcataaggaatttggtcgaagtataaggaaaccatccttctgaatgaaaggtgttagagtcttgtttagatggatgtggactttgaaatctcgtacatgtgtcactagtggagaaaccatctttggtcggtcggccagatttcacaatagtcccggttgtattaaaaactgggactaaaaacatctttagtcccggtttaaaagctcagaggtactttttgatctttagtcccggttggtattaccaaccgggaaaaaagatcgacatactctttactcccggttggtgttaccaatcgggactaaagatctatttgtagtcctggttggtaacaccaaccgggaaaaaagatcgacatgcacggggaggtgtgcgcgcggataggatcgaggtctcctcctccttcccactcctctctcctttaactcccggctcctcctatcctctaactctttacaccttatctcttcctctcctcctttctctcccctttaacccccggctcctcctatcctctaactagcttcttacaccttatctcttcctctcctcctttccctccccaatcctccccacttcttgatctgcagcgcagaggcccgacggcgcctctcctcctttccctcccatcctccccacttcttaatctgcagcgcggaggcccgggcagcgtggaggctcgggcggccggcggccttgcggcggcacggcggcgggcagagggccggtcggcctcgcggcggcggtcggcgatccggcgggctgagggccaggcgacctcgcggcgggcggcgcagcagcggcagcgggcgtttctttgtttttttttgagaatttgtgattcggatctgagatgtatttgatttgtgtgtgatgtgaatatgtgatgtgttagtgataaattttgtaaaagttgtgatgtaattttttttaagattttgtgatgtatttggatatgatcgatttgaggatttggggatgattgatttgggattttgagatgaggatggagtgaaatcaatatattaaaaataatgaagaaaagaaaagaataatggagcaactggatctagctagcctagctctatctttagtcccggttggtgttaccaaccgggactaaaaatgctctatctttagtcccggttgataacaccaaccgggactaaaaatagatttttactcccggttatttcacccgagattaaagatatcgatctttagtcccggattcgtagtcccggatagaaaaccgggactacaaagggttatgaaccggtagtaaaaagcacttctccaccagtgtgtggtcctcttcgagttctccatataaatacaagacctctagggggtacgggatcatcgaatcataatcgcaacaccagccatagcagtagcaatttggaggactcgaagcccagccgctagtcgatctcgacaaaggtctaatcggtactcgtcggttccattgttctctattgtaagctttgtggttcttcataatcctatataaattggattagggatactaccttatgagggacctgaaccaatataatccttgttttttgtgtgcttgatgtcatatcgtatagatccttactccaacatactccaacattctcagaatacggtctacggatatctcccgtcgacagatatggcgagcgacggagggggagtcaaggatggcggcgagcggagcttgagacagccgaggatggcgagcggtggaggcggccctctctctcttctccctccccttatgtcaatcggttcagatggcaagtgacgaaggcggcaagcggtggaggtggctcctccttgacctctgctggcgcgcgcctcctgcatgaccgcctcgtgagcttgtcgctgacgtcgtcgtcactgccgctgagacatgccgcacccaaggccgtccacaacggtgtgcacatgtgtcgtcgccgccaccaatgcacagctcgtcctcggcttccgtaggtacacggggctcctccttgacatatgatagagatgggtgagacagggaagagatagagatgagagagatctgacaggtgggccccatcattttattaaaagaattgctgactagacagccacgtagtaccaaaaccgcttccaaagttattggggttcatctggtattgatagttaagggagaaagatatttggttttcgggtttagaggattaattcgtattcacccaataatttagaggtgtaatttggatattttcctgttcggaatggatggatgtttttaggaagttagactacgacggaaaacatcaaaatttaactcaaattaaatttcaactggtgattacgcaagcacaacgaacgtgctgcgggcaatacacgggtggaaggaggacaactgcacttttgtagtaggagataaaaattcaaactttacaattggtagttctatattatatatatatatatatatatatatatatatatatatatatatatatatataagaacattacaattggctatcaaaccaacaagcagatgccgtcattgttgtctacaaagatgattaaattctggctagggcaaaacataacctcttaagatcatggtcatttcatatcctggagtccctttcgagctttttggtgtgagagtgcaattacaggtgcataattaacaccatgtcttagccaccaggaattaatcatggcgccggcatttccacccaggttgttgagttctactagcatataatttatagtaaacataacccaatattatcatatctattcagatttgtagtactaatttgtatctatatgatatgtagtactatgttactatggacggaataagttatcattttagcaaatataccatacttaaatacatcttaatatttttctcaaacaaatgagacaattagagttaagactgtattaatgtgtgactgcattagtaaagagtagtaagaggggatgctttggatcgtgagaacgttaagtattttgattaaaaaaaactctagcagaacgatgggtaacatagtaggttatattacccgagctccttttgttaatcaagcgtgtcatccgtacatgtaaagtgcctagacacttgaaaattttctgtccattggtacaaatagtagtagaacagactaatgttttcaaagctgcagttagtaattcttcctgcctccctcctaggtgaaaaggtcaaaaagggtatagaaattcccgagcgtgctaataatgtttttgtaaataatataaaaataatatcattttcgtttcaatgtattttaagatgtattggagtagttaaatttataatcatataaaaaatagtaataatatgaaagaccgtttttgttcctatcccgcttagtacagtactcccttaatataagagactcatcggttatccatatttcctaataacccaaaacaatttattaaagaataaaatttaatttgtaggtaaaacttttatatatttgtttgtagcggcttaaaaaccaatgctaaaaatatcgagaatatcttaaaatcaacttcaaatcaagtttaaaaattcaaattttatttagctaccaaaattttttgccaaaaacgtcaaatcgaattttagacacatgcatagagcaatataaataaaaaaactaattgcataatttgcatggaaatcgcgagacgaatcttttgagcctaattagtccatgattagccataagtgctatacacatgttaatgacagattaattaagcttaataaattcgtctcgcggtatccagacaagttatgattagttttttttattcatgtacgaaaacccctttcctacatctggtcaaacgtccgatgtgacactaaaaaaattttatttcacgaactaatactccatccgtactcgtaaagaagtcgtttaggacaatgtttaagtcaaatcttgggaatataaatcatgaataactctcaagttgttgaggttgaaaatataaaaattatataaatagatttgtcttgaaaaatactttcataaaagtataaatatatcacttttcaataaatatttttatagaaataaaaagttaaagttgtgttttggaaaccgtgtcgctgtttaaaacgaatttctttacgagtacggagggagtacaccctaaccgatgggactctattagggatggcaattgtgcccgtttgtccgtttacccgtgggtaaaaaccctattaggattgggtttgttctccattttatacccatgggtattttattgggttaaaagctatgcccgatgggtaaatggacatgggtatgggtaatcactacccatgcccgctttgcccgtttacccgcgaaatctaacttacatgtaggctagaagcaaaatccactagaatacataagccacgttctttgttttctacggtttcccttttatttcccttattatctctccctcttactctgtcgccgtcagaggagagacaccacaccgaggcagagaatatttgatgttttaagttcgatatcaaacttagaaggttgtagactttttgttccactacttttgttgtggcgggtaaacgggcacgcccgcgggcacaagacgcccgcgggcgatgggcatgggcaaccatccttacccgtcatgtagtaatgggtatacccacgggcaaaaataatctcatgggcacgggtatgggtaggcactacccgtacccatcgcgcccgattgccatccctagactctatgctacctgaactcctgaagcgtcgtgcaaaaaaactattccgttagagcaggtacaatagcaggctataagccagctataaacatattttaaagagataaaaaaaagagagagaaaagcagcaggctgcagatctgtagccagctacagtacggactctaagacgtactatgtgtatgataggtaggaccaggtattaatagtatagtaagcaactattatattaattggctattacattggctataaataagttagagccagtagttggctatactattaaacttgctcttagtgtggcatgcacggttgctagtagctgcctgcctgcgccagaaacgcactcattgccagttgacattggaagcagacgagttttctctacagtacgtgacgtgaaaatgcaaaaaagagttgtacgctacgtatcggaacagaaactagcacaacggaaggaaccaaaaatatctccgggaaggcgagtaggagtacagtgcgcggaggcccaagaaacgaccgtgaccgaccaggctccgtgacaatagccggggctcggttcgtctactctcatactacaaggctacggcgtaacgacggagaggagggaggacgtgcacagcgagaggcctgtcccatcaatcacgagccccgcccccaagaccccggtgtacgccacgaaacagccggccgatggcttccccgattcaaaagagagacgccgtagcccgtaggacgacgttaggtcactgtcgcgataacaatcgtcctgataggataatatatatctacatgtcccgatagattgttctatgataggcctcatctaatattactatgttgttccattctgaaacggagggagtatatactagagtaatttatgtccactgctccctccgtcccgaaataactcaatttagaatgggatgtgacccaaaaataatgaatttggacaaaggtttgtccagattcgttcctaaatcttgacatttaagtgtcacatcatcatccactagcaattattatctacaaatttttcaatcgcatgcaagtgtaccaactttattatccgctagcaattattatctagagtattttaaatatcatgtaaatatcatctaatattactatgttgttccattctgaaacggagggagtatatactagagtaatttatgtccactgctccctccgtcccgaaataactcaatttagaatgggatgtgacccaaaaataatgaatttggacaaaggtttgtccagattcgttcctaaatcttgacatttaagtgtcacatcatcatccactagcaattattatctacaaatttttcaatcgcatgcaagtgtaccaactttattatccgctagcaattattatctagagtattttaaatatcatgtaaatatgacagatcatttatagttttgttgtgtttttagaactcagtatataagcaatgtcaaatcattatctccagatcattttcacattatatatatatatatatatatatatatatataggaaggctattatgtactcccgggagtacatactccctaccctcataccgttgattacctttgagatttgtacctgataacgggttagcagtgaaggggacgtgcggtatctacccattagtggatcgtggatggcattttgttttaaaaattgaattaattgactgctcgtgtataactaatccctgaagaatcggtctgtacgcaggtaatgggcggtgaggaatggtatttatatcatcaaaccacatactgcttcatttgttcagggctgcaggaacttggtttggacctccgtagtccagctcgaggatacgccgccgcgcggcggtgctgatttaggatggataaacaagtgaagaaccacagaccttctgatggtacggatggatcaaggtatgttgttctgtttcagtgatttatttcagtatgtgccgctggttttttttctctgaatttcgccgtgtgaacttgagcaattctaaatcatcaattcagggaaattcttatggacgagcgcaaccctaccatggacatagtagatggtattagtcaatctgtccatgattcacaaccggatggtggtcagtcaaggttggatcgtagcttccgtgaatttaaaactctgtaaatggtagccagatactgacacatcttgattgtgttatgaagccgtgtagcaatggaggaggacgtgccgtcgcgggttggatcacatgattcagggcatggaattccagagacaaggtatgtgcatggctaggtgtcagctgagcattcactttaaagcagtatatactacatagaaatgttcagtatgtgtcacatgagaaagttcagtatatgctatcttctaggaaagttcagtatgtatcacatagaaaagttcagtatgtgctatattgcagaggagttcagtatgttgcacagaaaatttagaacatactatatgctgtcgtataacaaagttcagtacatagcctcccatagaaaaattcagtatatatgtgaaaaattcagtaaatactggtgcgtatcaaagttcagactacgaatcactatggaaagatttagtatacgtgtggaaaatgcagtatatgctatcgtctagaaaaattcagtacgtaacccatagaaaaattcagtacatactatcattcaacataaatcagaaagaacccctccattttaaaaaatgagtatatacaatcatctaacaaagttcagaacaaagctccccatatttttttgttagtagtacaacatatattttttttaaatttgcagtaagtactgattataaattaggttgttttttgtaaactacattttcagttagtagtagtatatgctatttttaaatatagtgtctccaatacagaaatttggtcccttcactggattggacagaaggaaacccatatgaaaaagaaggagctaggataccgatggaaaggtttgtatcagcatgttacggatttttacgattttttttgagccaggatattggtggtattttctgaaaactgattgtacattttcttttcagaatggtggtagataatgttgatagcagtgctgtcatacctcctgctgatcctcaaattcttactccgatgctgggacaaagatttaagactgagagggatgcctataatttttataatgtttatgctgttagtaaaggatttgggatacgactggacaaagatcacatgaatactaaaaagcagagaacaatgcggcaaatatgttgttctcaccaggtacatacattatgtaacaatatcttagtagcagaaatttacctaaataaagacttgacgtactatgtgttaatttcgaaatcttttatgcaggggaggaacccaaaaaccaagaagccttccgttcgaattgggtgcccagcaatgatgaagataaatatgtctggagctggtagtggctggtcagtaacaaaggttgtttctgcgcacaaccatcctatgaaaaaaagtgtaggagttactaagaattatcagtcgcacaatcaaatagatgaggggactcgtggtattattgaagagatggtagacagtagtatgagtcttacaaatatgtatggtatgttgtctgggatgcatggcggaccttccatggttccattcacgagaaaagctatggatagggttgcttatgcaattaggcgggatgagagcagcgatgacatgcaaaaaacacttgatgtcttgaaggatttgcaaaaaaggagcaagaatttcttttatagtatacaagttgacgaggcttgccgtgtgaagaacatattttggtctcatgctgtgtccagattgaactttgagcattttggtgatgtcatcacatttgatactacctacaaaacaaacaagtataatatgccctttgcaccatttgttggtgtaaacaatcactttcagagcaccttctttggttgtgccctgcttagagaagagactgaagaatcatttacatggttattcaatacattcaaagagtgcatgaatgggaaggttcctattggaatattaacaggtatgtgagtatttggccgaatttataatttggaatgaattcgttatactttacttattttaagtatatgatgggttattcattggatgcttattattgtccttaattttgcagacaattgtccttccatggcagctgccattagaacagtatttcccaatacaatccatcgtgtgtgcaagtcgcatgtactgaagaaagcaaaggaatttatggggaacatatactccaagtgtcatacattcaagaaagcatttcataaggttcttacgcagacactaacagaggaggagtttgttgcggcttggcacaaactgattagagattataatctggaaaaaagtgtttacttgcgtcacatatgggacataaggcgtaaatgggcatttgtatatttttcccataggttctttgctgggatgactactacacagagaagtgagtctgcaaaccatgtgtttaagatgtttgtgtcaccctctagctctatgaatggctttgttaagaggtacgaccggtttttcaatgagaagctgcaaaaagaggactcggaggaattccaaaccagtaatgtaagtatccactgtgataggtttgttgacctctttttatggatatgtgtaatcaacatttggtgtcgcttggtgcaggacaaggttgaaattaaaacaaggtcaccgatagagattcacgcatcccaagtatatactagggctgttttccaattgttctctgaggagttaaccgatagtatatcttacatggtgaaacctggggaggacgaaagcaccgtgcaagttgtacggatgaactcgcaagaatcattccttaggaaggaatatcaggtgtcttgtgatttggaaagagaggaattttcatgcgtttgcaagatgtttgagcataaggggattctgtgcagccacatcttaagggtatttgtttcttctactgtctaaacatttattttcattgggtcgtactatatgttcggtagtgtttggctttttgaagtaatgcattggtttgtccctttaggtacttgttcagtatggtttgtcaagaattccagagaggtatatactgaaaagatggacgaaggatgctcgggatactataccacctcatctacatgggtacaaagatgatgtcgatgcttcacaatcgaggagttacatacatgtaatgctgaaaaggaagactgtggaggtggctaagattgctaataaagatgtgcagacatttaagatggcaatgacagtcatgaataagcttttggaggacatgaaaaatcagttatctttggatgatggtgacaatagtagagaagctccgaagcgagcagctaggcataaatcaaggtctactgtattgactaaagatggaaacgaagatgttggtggaggtgatgaggacagtgagtatgacgtgccaagtgaggacgagggtggaaatttgactgctgatatacttccaccgttgaaaaagagaagcagaggaagacctaaggtgaataggtataaatcgggtggtgaggttgccagcctgaaaagaagaaaagaagtagggattgagaagaagaacacaaccaatgagtgtgagtccgttgaagaagaaaaccaagtcattgatcatgatgatgaagtgccctttcctcgtaggttttgccacacatgccacgaagctggtcataattcgcgaacttgcggccggacatctacgtacaagagaaaactttagaatatggttccctgtagtttagttgggactcctctgattgttagaagttgttttgttttaagtacgtgaacaaatttttgagaggcgtgtgttttttcatcctatgagcaatttattaagattatgtaacctgtggattggtcagtatatacgaccttaagtaaagtatgcttctagtagtaaattgtgtcttttttgggtagtgtatttgcaccggttaaaaatggatgtctgctgtaattagtttcatttggatgatggtgctttctctataaagagagaaagagatatagtatactggtatttatgacgatcattgtttgcaaaaggagtgtgatttggtgtggatatgagttgttttttttaggtatggagatagaaattagctgtgcaatgtattgaatcctcccgttcactgaaatggacataattatcgatagcaattgactcgttatcacgcagagtcaatgacataatttacgcagagtcaccgcatatattgaatcctcccgttgaaaatgataaatggaagtaaatgacatactgttattgtttggcatagtgaataatttccatagcacagttcgtgcaactgtcattgcaacccagacgatactttgtccatgcatagcaatgttttcatgattctgtcaagataggacagaagtgtatttcgaagattacatgaaaatgttctggtaaagctagaagtagaaaattgctaaactaattgtctttaatttgtcgaagacggtccaccacatattctggtagtattgcctcgttatcacgcagagtcaaaaggtggatcaaaaattgcctccggaggtagtacgggtcctgcgaaagttagagtattttctttatagctttatgaggacatatttatggtggagtgcggtgtgtgcggatatgaaagcattatgtacctctgtaatagggttcagaagacgacgaccatcgtagttcaccatatagttgaatacgtaaaagccacagtcatccctgtatgtttttgagaaagtagtgtcagtacaagctttgggttggttgtatttcgtttgttttaggagtcactcacccgttctgctgctctggtatattttcaactgtctcaaagtcccaattaagtatgtccatgttccaccctggagatgcaagacgcatgcattccattacacactgtgacaccatgatctttatcttgtcatgcctggtgaaacgtgattcccctagtggatcttctgtgtttagtgaatcaagcaccgataacttcttgctctccatgttaaatacgtacagcacgtaatgattgaataggtgaacaggaatcagtatctgcaaagtttaggtttttcagtgggactacttctgtactattgtttacaagagtttctacaatctacgaactgcaaatttgtactcaccaggtggctttctgaaacatcatatactacctctgggcccgagaagtgtgcaagttgatggctagcttcccaaaattcctcaccagctagcgcgtacatctgacaatacagaaagaatcattgaatttatatttttattgatgaaagaaatatattgtttattgcatgcaatgttaccccaaaatcttggttaatgaaatgcctccaaccaaggtagtttgtgttgtgaaatctctcaacttcttgttggaacattattcgaattgcaaggttgagagaatctgaatccatttggctcccaatctttatagtttcttggatgtttcgtagcgtcaatgatattatgaaaggatgggagctctgcagccatgtttttctgaaataaaccatggataaaaatgaatgtcagatttggtggggtgagatgcttaattattctggaagaagaatgatacttactctaatgatgcatcgtcagaaatagacattatataggaatacaggtcgtcagcaatcctggattccagcctctccgttgagcattgctttgacatgaaaggtgacatgagcttcctgtttggtttgactacacgctttgacttgtgcttcagcaagtgagatggtgggttttcaacggtgtatttgcgcttcttctgcccatcgctaccgaattcttcaattagcataatggaacattggttagtcatgcgagttcccgacgtaggcgatactgaagaatttggcctttttttcgaatctgaaaacattcgcatgatcaggagtaaacacattgttggttgaaatttttaatcttttggtacaccaacctggagctccattagattttggaggagtacactgcaagcctccaattttgtgatcatattgttgggtatctgatacatgaagagcgtccgaaaatttgttagagtgtcaagtagtacgagttttatttttaaaatggtgtatgtactcaacgttacctgttggttgatccaattgactagcatcttttgtagcatgtgtggagtagtttgtgggtgtgtggtatcccatggcagttgtgtctccccatggatggagaggaccttgtatatcctcaatggtatcaataactttcgttactgctgcccttatcgctatcttaactgccgttgtaatattagtcttgaaagctctcttgaataggttagatgcgtgaatagcagtttgcatggtgcttatgtcgacgaaatctgatatggtaggcaaaatctcatcgatgcggtcgaatccatcctgaacgtaagatttcaactcctcgtatgcctgttttatgttatcatatataccacatgttagtttaaaatcccttgatcatgtgaaaattacaacttaatgaagaaacaatcaagtaacatagcatacggatggttgacatacctgtgacccgacagttccacgtacgtctaacgaagagaagtgtgattccaagaattttattaaatttttaccgccatcaatggctctagatgggatcttcgaaccggagcataagtttaggggagatagctctggcacatgggggttgttttctcttggttccttcatcaactgaacagcatgtatatcggaaattagctaaattttgcagccagaaataggcatattacagccagggtatcgtacatacctggagtttcccataacgagggaaggggaatcctgggttatgtttactaactacatcttgttgaatcatcctagcaatttgatcatcctcaaactgagaaatgtgacatgttttaacacatgtgatcccaaccttccggaactggagatttctcaaatattttacctgcaaaaatgattcacaatgacaatatgtgtgttgattgtatgctgcattaacaagtcagttttaaatgctaaccattagaaagatgatacacccgttaatggatagttgagccttattcggaaagcaggtgggcattgattctgctgctttcttcacctcatctacaacgaattgggaccagttgtactgttttatattgtcaacatcagaaacagccataatatacctaggagatatgaagtttgcgcaggattgcggtgccaaaagcttcgttgtgacataaagcacaaaagccgccatgaaaaccctcttttcatctattgtcatgggataaccatactgcttctttaggattctctctaagagtgatattttcaggtgtgaaaagtttggtatctcaaatatttcgcacaatatttgtttcttcccatccaattcatcttgagagcaagggataataggttgacctgagcatggcaagccaaaaactgcattcacatcattaggaccgaatggcaactcctggttgacatctttaacaatagcgcatgatttcggatcaactttgctcagtagccatgcaccaaactgcctgtttaccttagtaagcttgatatccaaaagtccatcaaacccaacttcaccaatcaactccttcttcctatcatcgaattctttaatgatattcactacgcatttgggctgacacctgcagttgataccaaaggtagtgttgtctttcttctgtctatttaaaactctgctttgccgatacctggataccacccgtgcagcagtcttatttaggctgccccttgtgccagaaaccttcaaagcctgcagataattagtttttcatttcataaatagacaatactacatggaccagtgtatttaaaatttcaacatatacttctattttttaaaaaaaacagcatacactcatatatgtatggaaagatgaagtacaaaatactgcgtagcaaattctacctatgtgtaccctcttaattaaaaaaaaatcatgtgcactgaaagaaaagtcagtatatgcaaagtttagagaatattactgtatgtaaaaaatcagcatatacctctctatgtaaaagtgcagtatatacttcttcgtaacaaggtccagtatgtaaaccactatggaaaagcctctgtatatatgtggaaaaatgcagtatatgctatcttctagaaaagttcagtatgtaccacatacaaaattcagtacatactatatgctgtcgtataacaaagctcagtacaaagcctcccatagaaaaattcagtatatctatgaaaaattcagtaaatactggtgcgtatcaaagttcagtctatgaatcactgtggaaagattcagtatagatgtggaaaatgcagtatatgctatcgtccaataaagtagagaataaagctccccacataaaaattcagtatatactattgcctaacagagagttcagtaagaaccctgccacaccaaaaatcaatacttaataccgtctagcagattccaaaaagttcccctccaaagaaaaaatgagtatataccgttgaaaattcagtacgtactaccatctacatttttctttatgggggtgggggctaaaacagcattaacttcatccacccaaaaaaccatcatatgcactaaaaggggaaaaattagcatctgaaactgagagagtacatgaaccgaactacacctaatccctctctacaggcatacatgtattcaatttcaggtggcataccttggactgtggtgacaaactaattttcctgtgaccctgcggcaaagaagaaaattttaggcaacgtgtcttgatcttgccgtacaaaaataaacgaatactaacctgctgctttggatgaaatccactgctatggcccatcgattttgccattgttgccccgctcctgcattcagccgactctagatcgattacttctgcttcaggaacacatgttgttgagagaggatccatcgctggaggaaggggaggagtcatcactggaggaaggaacaaactgctatctctgtaccgccgccagccacacagtcgccgctgaatcgctggtccgtcgccgcgctgacccccaaaaccccgaaagctgaatcgctggtccgtcgtcgcgcagttccgtcgccgcgccgccccccaaaaccccaattttcgggataatctgtttggcctgttgggagcaaaccccaaattacggaataagcagtccggtcttttaattagaaaaactaatcggatccaccgagccaaacccgttatgatgagggagggagtacatatctgatcgatcaaatgaacggtggatgggagagggagtacgtactccctaggagtatagaactattttcccatatatatatatatatacatatatacatatatatatatatacatatatacatatatatatatatacatatatacatatatatatatatatatatatatatatatacatatatatatatatatatataagtgaggagtataaactagtaagatggatgaattgtggcaacggaaccaaccgaaatatcctgcatgactattttataatttagttgttttaaaattttattttgaaaatgcgtatataaaaaaataaaaatagatcatctctcgatgctgatacatggtggtaagttgctaacacaaaagggatcggcgtcaaaaatatgtacgtcgagggtctttttataatgttaaaatgcaattattctttcttacaaataggcctttggtgagatcgaatttgacaaaaacgacctatttataagaacaaggaaaaagccctaataccctctcctggtgaggctgcaacattgttgatgtgtcctcctccctactggtatgttcctggtagccgtacttctttccaccctcccccaagggcataatcaataaatatttatcaagtgggtagtaagatgggactcacaaaactaggttataggcccggtttagatcctccaaaattttaccattttagagcactttttgccattttggatctaacactactagtaaaagttgacaatttatcatttgccatttgctagtccatagtagcaaattgtgccaaaacgtgctttgggaccactatttatctctctctctctccaccgaaaagtgctagaatagcaaaagtttagtatgcatctaaacaccaactagtatttttgcaacgtcaaaacttttgccaccaacactttttccatttgtcattccaaataaatctaaacatactcatagttgtttctacctcacacaatatacaatatgtgggtagtaagatatgacctacatgtaaagcaatgatgggatagaaaagagagagagtgagtgagagaagagagtttaatatttttttatgcttgttaccaggtagtagtgctattgcctggtatagttattatctgctctactatccatattcacaatggtaaagtaggtagtaaggggtcttactacccacttttcatccacattgtgggtgccctaagtcatcacctgcgagggatggatgggctatgcgtgaggaacgaaacgactcggcggagagagataaagggtgtgtttagttccacgctaaatttagaagtttaaagaaaaaagttggaaatttatgtgtgtatgaaagttttgatgtgatgaaaaagttgaaaatttgaagaaaaagttgggaactaaacccggccatacactcgtgtatgggaggagggaacacgtcacatggcttgaggggcggttggggaagtcgtatttagagcaggtacaatagcaggttataacctagctgcaaacatattttaataagataaatgaggagagagagaagcagcgggctatagatttgtagccagctgtagcacgaactccaaaacgaagtgtgtgtatgacatgtgagaccagttattaatagtgtagtatgtaagccttaggccgtgtttagtttctgaaattggggagaagtttggggaaagttgagagtttatgtgagtaggaaagttttagatgtgatgtaatgtgatgaaaagttgagagtttgtggaaagtttggtgcgaactaaatatggcctaaacttgctcttatgcggtagtgcgaggggcttcctaggggcacacgaggtgcagatgtggagagaaatcttatagccaacaggttgggattgaatgccatttgaagtgttcgagagaagccggaggggaagaaacgcacacgcttcatgaacggaaaaaatctattaaaatttactttaaaaattatatgaatttattttaaaatttaaaatgattaatattatgtaatggcttatctcgtttgatgtccggtactctcatttcaattttttctcatatctcaaacaagtgcattgtgaacgggctaatcatttttttttctctggtacgatgggacagtagtaatgcttctgccacattttgtcagttgcatgcagggtaaagacagtgctttcttcatgtgtgcgcgctaacttttctgcacaaaccggctggcagagcaaagcccggggaagggaaggggcttgcttgccgagtgccttgcctgccgctgcctgcttgccttgccccgcgcagtgggagcctgcgggcttgcttggagacaaatgccatcacccaccacaatccccttcgctttcatttctttcctcagcgttacgcactcagctgcgcgattcaaagctagcgctgcgttgcaaactgctggcgcaaggctgcccattcctggagcagtggcgcggggacggcacgagctgccaaacaacgtgggccaacgtgcggcactgcacttgcgccggtaccggtaacaacggcaatggctgtcaaaaaggcgcgccttcctcgcatagctaaaaacgaatccaatgcgcacggacatttcaaaatatactacaccagaccgtatcgacagtataagctggccggctggcaagcaccgttctcctccattttgtgccttttagtacatatgaaatgtatttttcctaccgacagaaaacaaatctttttagtcagacgctcctttttttcggaatgacataaatttcagattctttgtccgctgacgtggtttaggggggggtgtttgggactttag

SEQ ID NO: 71404 - DNA, 6034 bp, Oryza sativa
ttcattgttcagtgccatatacaataatatgcaatcaagaaaaatctaaaatttatgcaaagcaaacctgaagacaatatttttttatcaagagggcagaatcattttggaggagtgataaccatggtgcagaaattttactaggaagcaattggagaatgcactcatactaatctgtgcattgtcccattctcaaaagagaaaaaaaaatcacttgagcagttatttgtactacattgagttgagctacatcaaaactcacttatttcattcctaactcctgttgataaagaaacaaccacgctaaagtataactgagctatgaccttactttacaaatcacatcatttagaatattcaaaaggaataaatatataagtagaaatcactgatcaatctcagggaaaaaaaatcatgagattaacttattcggtagtaccactgagaaatataaattatttagtcgtagcactgaaaaacaggcaaagtctaggtgtcccttccagcaaagtgcatgggttcgtttctgtatattgagaaaaattactactactcgatgagttcctttaataataagctactaacatgcatcaacagtttagcttgccctggcaaggtataataaacatagcaatgacacttcagctttgcccgactcatcacatctggacataacaacattgcaggctcactggagaatactaatgcacacaacaattaacacctaacaaacttaattaatcggacacaggagacaggagtagcaccgtaccttcacgaacaaatcaagcatcatatctgagagggatttgcaggactaatcatcagatctggaaggtatttgcagccataagaggaggggcgagcaggggacgcgttgttggccggtgctgctcacccgtcgtcgctgcgacgaggcactgcggaggcagtcggcgcttgggcaaggaaggggcagcaggcgccagaggagaagggaaacagggtacggtcgccctcacccgagacctgacgcagggacgagccggcgaggagggggcggcgaggagggaaggggtagcgcctggagtgggaggcgccgccggctcatcttgaggccggatttggcaccgccgaagctggggactgccggatctgtagcaccagcggcggcggcggctgcggcggcggatgttggctatgcggcggtggtggcggcggaggatctcggtgacgcacttgtggaggggagacggcaaacttcgtgggctatcgccgaaaaaaaaaagaccagtggcggctggggtagggaagtggggaaaagagaaggggatttagggtttagttgtggcttaattatagagagcagctacaaaacggaatcttgttgtaacgggatagtttaagtggctcctccccgctttcacgtgcactccatcttgatacctggtaccttgggtatcagttggtacctggtacttggaacttttggtaccgactgatacctttggtacctgatacctgatatcggctgcctttggtaccgactgatatctttggtacctaatacctggtaccggctgccggctggtacatgttatctagtaccgtgatacctagtacctgatacctggtagcctggaggagaaggaggagagagagagggagaaaggagaaggcagccgcgtggtggagcaggacgaggaggcggtggcgaatccggtggtcggcgaggcggagtgtggaggaggaggcagctgtgaatccgatggtcgtcgaggtggggcagcctatgagaagaccaacgagggcggggagccagagcagcgcggtaagggaggggagcttgagggcgacccttgccgaggccgcgccgtcgtcgtcctcctcggcggctagggtcctgagccgacaggagaagctcccacccaacaacgccttccccggcgccagcggcggcctccacgtcccgctcctactctccctcttgttcaccgcacccatcgccgagctcctcgtcgtcgcctcgacccctgcagtggtggagcgacggcaacagggacaacggcgggcaccggctccgacgagcgttctccacgcccaacgcgccaccccacatagctagccaccatcgtcgtcttcgtgctggtagtcacagagagataagggagaaggaaggggaagagacaaagaagaggataaggatgctagatatttagtggtagtagttgtcacgttgcaacggaagcccggggtgtaggttttctgttaattataacctatatttttttgctgacacatatttggttagtactactataaataccgacagatactttgacctcaaaatatatggaattactgacacattttatgtctcgtcaggcagtattgccgacaaatagtgtgtcataacctttagcgacagatagattctcggtgattttggtgacagatgtctgttggtaatttagtgtcatggtgtagtgtccgtcctcgcggcggaacggtggcggcggcaggccgcgggcagagcaaaggggcgggcagagcggcggccacctcgccaaggacatcgagcgcacctctgacgcgagaggagcggcggcgcgcaccagcctacgggagggagggagaggagcggcggtgcgcttgggtcggcggccggcgggagggagagagaggagcgacggcgcgcggggactggcggggggagcggcgcgcggctgccggagggagagggtcggcggcgcacatgagtcgacgggtgggagggagaggagcagcggcgtgcgccgcgccggtggagagggcagccaacaggagggtggaagaggagcagcggttcaccggcctctgcgcccttgtcactccgcccaccgcctgctgccgctccattttaccccgctgacgctcaactccgcttcctcccgccgcccaccattgctccgtccaccgccggccgctgcgccacttcgctccatcgccgctccgctcatcgtcccctcggctccgccgctcgcccttctttcctggcagtgtagggggagagagatgggggatagagagaagagggaggctgacatgtgggaccacatgggccccacctttttttaatttaatttttatgtagctgacatataggtcccacgatttttattatttttcgggataaaattgccacgtaaacgccacgtcattgccacatgggacgaagacctagtcaaaggagccacataggcaccacgtcggccaaaaccaccctccataatgccaagggacctcgtttgccaggtttcggaagttgggagaccggtcgtacccggttttgtggtaaagggacgaaaatcggactgaccgacaaatagagagacctaaagtgaacttatttctataaacaatgacgagtttcgaattccagcccatcgtcacgattacgccgcagcctgcaagcccatcgttacctagccagaactacagcccacttgcagtattggtccatgcccctttgcatgcaaggtggtccttctgggctcacggtccgtgtacttcaggtttcggcccaccataaccgtgcacgtttccggcttccccttcttgacgctggcaaaggaaagtatgggacctttgaattggaggaaaaatatagaaattttggaggattttaattctatagaaaaatttccattgaaaccctttgaaattcctatgaaatggacaatcctatatagattttggagaaaatttagcaagagcttcaacctcttggtaactttcctttgagtctatctctctcatctaattcctgcgtttttccttcggttcaatcaaacggtcattcctatattttttctgtgttttgcaatcttttgttttgcacttacattctgtcgacgtttgatgtcgcgattccggtatttgcatggtatggggatcgttggtactagggtatacgcaagactgaggtaaaagatatggagacagggatttttatacaggttcgggcccctgaattgtcaggtaataaccctacatcatgttggccgaagccgatattgctcttattcaccataatcacaccagtacaatatttggggtagcctatctaactgttgtcgacatggcggtctgaagttatgactcgtaatcgacaacagggtagtcttcctcctcgagttcgtgcccggtgagatcagagatagcgctttcatatctcctgacagtatccgaagacaccgtaggggactagccgtgcctatctttgaagtcgatatccggcgtcttgtcttggcgtatgttggcttctatattaatcttctgtcttgatctattgttccgtctatgttgactgtggtgggtgtgttgatcgtcccctctccttctagggggcattgtatttatacttataggtgtccccttgtccaagtagaactagggaaaccaatatggatacaatccgagtagtccttgtcgttttcatgtagaactctggttgtcttcccttatccagaactcctcctatatccgtaggtcgtttccgtataagatatggtatgtggtgggtcctaacgagatttagtcgactactattaggtatacgtggtattcataaccctgacacattcctattaaaatcttacgtttttttctatttctacattttctcaatcctacgatttaaatgaccctacaggttttgccaactttgcagctttgctatcgaatcgagataccgatggcgcatggatgcaatcgtgacacgcaatacgtgctaattcatggcgctttctcctgcaagctcgcatcgtaccttgcgtcgttggcacgtacagggaacgcgtgcattgtcgaataagacattatctatgtagatagacgtctatttagatttatagaattagaaaactatattcatttgtgttagttgggaaccttcttctctttaaaaaatggagcagcttattaacacatgattaattaaatattagctaaaactaacataaaaaatagattaatatgtctttcttaaaacaacattcggtatagcctgaaaaggagcgatctattgcacagtgtcagcgagagcgaaggatatgctcatactccctccgattctatattaattgacattttgaacaaagttaaagtcaaacttttataactttgaccatcaataactttaaaaatatttagtttaaaggaactagaacaacatatatagatttgtcttttaaagtactgtaataaaagtaaatatatatttatttaatatatatattataatagaaaaataagatcaaagatgtatcttatagaccgtgtcaatgtctaaaacgtcaattaaaatggaaccggagggagtatgccgctgttgattattgtacgaagtggccatcgattggcgtccggacgatgagcagttaatgctcacgtttattatatggtcatatatcgtgatcgccaattcgtcatgagtcgatcacgacgttgacagcgctaattccaaattaaattgagctggagttaagtctgattgatcggaacagtgctccaaatctctctcgccagcgcgtctccaaagcatcatcagatattctgattacgcatctctacggtaaagtttgttgcttgaagaaaggactacacgggatcattctgctccgtcagaatcgattttcatgtccaatatttgaccgttcgtcttatttgaaaaaattataaaaaaaattaaaaagacaagtcacgtataaagtattaattatgttttatcatctaacatcaataaaaatactaattacaaaaaaaattatataagacggacagtcaaacgttgaacacgaaaacttagggtttgactttttttagggagtacacgtgatcttatcactcgctcggtacatcagaaagaggcacccaacaaacacacacccctcgagacagaacaaaaacatctcaggcttgggacagagacaagaaatgctgctgcctgcatgattccagcctactccgtactccgtagtgtcctactagcgttcccatcacatgacactggccg

SEQ ID NO: 71405 - DNA, 156583 bp, Oryza sativa
gaaacggaggtatagcagttagatggtaactattacattatgaaatatcatgaacataaatattgtataaaaccaaattaaacaaaatccaggaatccaactacatgctaactttgatcaaccattcaaagctcatttaatgtgaaatggactgtttggccaacactgacagtgggtggatgtaagtatcacagcaagacataatatcagatttgctatacaacacacatgcatctagtttgacataatatcaggcattcaggttttgatgatgtcagataaaatcatacatggaaccaaacatataattactggagtcatgaagcatgaagaaagttacctccatttccattttcaacgagatgtatctcgccaacacaacagctgcagtttcctggtcaaaaccctcgactaattcctacagtcaaatagatgtcagttaaagtcaaaaccgcaacatatttgcccttacttgccctatcattaaataaattaaacagtacgacacagcatgttttggaatccagattgttcaagccaagaaacacctttttttgcagctatacgacaaacagtgtaaaagcttaaaaatattttccaaagcattgttaacatttaaccaaaattttcagatatgctgttcactgtctagccagcagagcgtaattgtccttgctggctataaaatacatgggttgttacgcacagacatgagaaataatacaattaggattgttgagatatagtttagcagtattcaacaacatagtataggaactaaagaacagattttcaaggccaacctctgtgttggtagatccatccacccattttctgcatatggtagtaactctaatcctcatttgaccttctgggtgttggtaactacagagaaaacaaaagcacaattataacatcaagccattcttacactggaggcaacagaataaaaatgaaaggtaccttgttacaaattgtatatacagatcgggattctgatgtcctggttggcttgaccgctcactcggtgagacatcaaaaaatactgttaatgaagtattcctgtcaagaccacacattttccatgctgttgtatttccttgaccaacaactgtgtcggcacatagagctcctttctacaaatgccatgatgtattaaaccaagtctcaaaataggcctttccaatttgaaatatcttagagcattgactagatggaacagatacccctaccttttccaaagatgtgcatggtccaataataccttgaaccttaatgtccttcgaacagtttatttcaagcgtgccactttaacaaaatgaacaagacaaaggatcagtcactgatgaaacaaagtatatgaaacatatacaacagtaagccatgcacatcaaaccaagctgttacagtacaaaatatatcttttgttcgcacaattggtcaacagaaagatcaaatattcagggaattttcgtctactgatatatttattgtacgaagaattaaaatgttggcaccacctccataccccagtaccagtttataaacagagcaattcttatcaagataatgatagggaaaacctattgtagtcataattcagcatttatgcttcatgaagcagaaagctcaataccacaatgcagcccaacagggggaataagcatcaaacttacttgaatgaaaggtcgagagactgttcccctccctcaaaaatacgtttaaaagaatccttaaatactgaatgcccaaagctttcagataagacaacaaggccacctgttctctcaatagcgaccttcatctcggcaaggccaacctgtaggtgttccaaccattttttgtagaaaaaacagaaaatgagttcaggtcatgtgtatcacaatcagcagttatgaaatgcctaatgattgagaattgaagtatgcaatgtatcaagtgataactgtgaactagcaagcagagtcattacgactcaattggcactaacaatttcactagaagtgaaacaaaaaatagtcatgcccgtttatcaaatattaatctactttcatgatcactggattggtatgcagacaacttgatcctcacaaaatgaactatcaataaatattttcatggactatgttgtatcaagttctacagttgacaacaatacatatatttgtatgaattgaattttagttttgctccaatgaaacgaaagctcatatcagaaaaggaaaagccaaaaaatatgtctggttatgctgttatataaagcatggtggtttcactagggtttccacctctttaacaaatgtagcttggatattcccagaattaaaatatttgaatattcattctacagtatcttgaaaggacaggcaatagtattcggaacatatgttgtgagcatagctccaaaacaacagtctggatacaaacaatgtacagttgtgagattccagcaacatgcaaactctgctgagcatagaagctttaatttaagtatgaccacaagctgctggctaaagagaatactatacatacctgatcaagagcagatgcaaaaacatctaagacatggccttgactgaccaattgtttggcaaggccatcgtaaaatttgacagctttctggaagtgaggagctgcatccttatcaagatccttatgtgatctaactggctctgacaaatctttcgacacaatctgcattgcccagtaaagtattaaattgggacttcaaagcatcatgaaaaatgaacagaagcatggagaaaatattagagggggacaaagaataacaaacagaagtttttggagttctgcaattctgaaaggtgcaattgatgttctaggggtaacgaattactttctaacaaatagcacaatctgaactatgcactttcatttttagagtttatttgcatcgtgctcgggttaattcaggggggagcatcaccaacattatccatctcaacattgataagcaggtaaaagtaaaacttgcatagtgataatgtttaagttgtatatgctttaatcaagaaactgattgaacgtataatgagatatcaaattaactgatatagtattatgcattttgaagaaaggaggaaaaacattcaatagaactgtgcctaaagtatacaaatgaaacatgctttggatacttcataagccttagtcataactcccaaccaggatattatcacacaaaaatttctaatttttagctacctaacatcaagtactttaagaactatccacaacattatcgcaaaatcaagtcaaaatgcataggtgcacaacaaagtgggatctttaccattccaggaccctcggtgcatggaccaccaagaagcgcaatgatccttgcgccagtcccaggcatacaagccccgagcaagccagccgccacactcaacgcaacacccgtgcaccggatcgcacggttcccggtctccaccggccactggtcaggctgcaactcgtccagcagctgcaaaagaacaaaaacttatgcttccttgtactgaaaaccccgaaatcaaatggccatgaacacaatttctcaccgtgctgagcgtgcattcgcagtctgacaccgggagcaagaacctagtcaccccggccgttgccgggggatgcatcccgttgatctgaggcccccctggctgctgaggcatcttggggaaacccggacgccccgcacccgccaacccaagctgatccaaaatctgctccttggagatctccttggtgccccggaagacgtagatcttgctgagatcggagaacccgagctcgtgcagatgcacctgcgtcccgaacgtgacgaggccgacgagcgcgtgctccggcaggagcgcgacggccttccgcatggacatcttgacgtactcgagctcctcctcgatgacgcaggtgtcgatcacgaagaggaataccgggggcggcggcgcgggcgggccgccctggtggaggggcacgccggcggccggggcggcgccggcgaggaggtactcgacggtggagcactgcgggaagagctcggcggggacgttggactcggagatggcggcgtagtggggcgggaagtggttgcgggagaagcagagcgggcagatccagatcttggcagcgaagtcgacgcgggcgaaggggttgaggagggccgagcaggggggcttgcagcggagcggcgggtaagggagcggcggcgaggcgagcgactcgggcgagcggaccggggagatcgcggcggcgagcggcacgacgcagcggctcgcctccaccttggagcgcggccaggcgttccaggtgaggcggacggcgtcggggccgtccgggtccggggcggccgccgcggccgcggagggatcggccgccatggagggtgggcgcggtggcgcggcgagcggcggtcggagaggtggtggggatggggagcgagcagatcggaggaggtgcgcgtggtgtctgtctctcgtcgcgctcgcgtcgcgtcgcggcttttgccttgttggaggcttggctcgtttcgtttcgtttcgtttttatttttcttttcgagtgtgcgttcgactcggacggacgtggtggcgagcccgccaagctggcgtgcgatggttggatgcgtttcgtggcgacttgccgacttggcgaggtctctccgagacggatgatgtgttcggtttccgtatcagattgcggctcctacacgatgtgatttcggtaaaaacttatacgtgattttatttaacaaaaatgttttatttatttaaaattgtaactttataatatttaatgggtattgctatatttcaaacgcatgaagatctgtgacattttagtgacttcaaaattacacatttttcggactaaaattgcaacactatggaatatgagattttgcttttttttaatatggttttactttatttttgtctgattttgaataatttttacatgtaattttgcgactctttaagtttaaatttatttcacgtggttcggtatttttttttggcaaatttttgctacagtacatacaccgtaagaagttatttttgggggaagacgctctcaaaatattgttatttgctaatggacaccgcatacaataaaaatattaatttctggttcaatgggagagataaatagtgtaaaaaggtaaaaaaaaaatgcccctgggcccacttgtcatattcttcccccacaactaactttctctcacactctggccatagcaccacctctagttgctaccggcgaccaccccgaacctccctccttgcctcctctacctccaccggctacgacatcctctccccacacacggccacgagcgacgagctcggcgttgggcaaaacggccccgacgcggagtcatcgagctcgtctccggcaagcgtcgagcagagctacggtcgggcggggcaacctcaagcagcaacagcgacgacgtcttatcccctcccatggccacgagatcggcggtagccaccggatcttgccaggcgtggggcggtgggggcaggttgtccacctacccggcggcagcgcggagcgggagttgcagccgcggtcgagcaatcgagctctttggcggcggtcaagaaggcctcctccaccgctcagatttggcggcttcattcatgttttcctcctcctcgtcacctcttccgatccggtggccttggtaaaggatgtgctcagggcgacgtcctcaatggcgatgaccccgacgacgaagcagctgcgtgtggcgtcgtcttcttgctcattcgctccgtcaccaagagtcaccgccttcgagcagcaccggcccagagttgccttcgagcggaggtggaaagagagaacgacgccagcagtgggagggtggggaggaagagcagcgctaaatggggggtaggaggaaggcaaggagggaggtccggggtggtcgcttgcggtgaccggaggtggtgctatggccaaagtgtgagagggagttagttgtgtgggtacaatatgacaagtaggcccaagggcatttttgaccttttacactgtttatctctcctattgaaccagaaattaatattttattgtctgcggtgtccattagcaaataaccatattttgatagtgtcttccccaaaagtgacttcgtgcggtgtctcacagctaaaaccacgaagtcgcgatgtcctatagcaaaatttgtctttttaaaaaaaaaacttggcatactctctcgccttacaatatatcaataatatattattttatccagccaaaaaaataatatattattttatgaaaatactttaagacaaagtttttaaagtttgataatagtcttatccaaaacaacaagtattattaacgtgaagaaaatagatttaaccttctatctaataaagagagaggagtgatgagaaaagtgactgaaattttcgaaaattttagtcacctgaaacgtaaacactcccatatttatttcattctaaaagtaaacatacgcatgctaaatcatcattctcaaatcattttcataatatttcaatccaaatcatttcatcatttctccagtatctacatatatctcgcagcaaagcgcggacgtcatctagtaattatcgttaccaataactattggactattctgcacaaagaaccataggagcctggacaatactcctactaattctaatattgcatctaatatgaagggagaataacgtccctgaaattcgctttgagataatatgatccttagcatttcattatgtataaacttgtccccaaagtttgtcttgtggtctaatatggtccttggactcactaacaacatgtggtgtcatggacttgtgctggggcggacatctagggtgggttgtggtctgttaggctcaacgtgctacatcaagcagctactataaaggagtcagacactacttgtgacataatttggctagttcttgatgaaagtgacttgttgaggaaggccatagccattgtagtgtctctccaccatagaccgcagtgtaaagattcatgggttgtaaagatctttgatatgggttttttttatagcccttcagttgaagaacaaaaaatgaagaaataagtcatattagaacaggtgaagagatagatggccaatggagttttgactagcaatgcccttcaagcttgtatagtttttcgcgttgagcttggttatcatgcttccatgtatggcttggccgggcagtttaggatagttggttgtgagtccttgtagctatgattttcagtcggttttccttaattaatatctcatcacattgctgcgggaaattaagttgcataatatgtataaatcaaatacaatatgattattaaaactaaaacaaattgatacttatgaattttaagtccaaaaataattgatattgcatgttttatgagagaagaaaaaagagatgatttgaaccaaagatctatcacccaaaaactataaataattggggtgatgtggcttagtgagaaaagagagaaataacattaactaattcttagtggggatgaacatataggattctgcatcatttctccttgaagcacaatattatatattatataaaaaaataagcttgcaatggtcggctgtcattaaaaaaaatcagatcagaactatttttttaaagtatttatcataagtggaacatgtttatgtttgataattaatttttagaaattcatgtagtttgacaacatgtaggttattatgaaagtattttttttatggtgaatctaattgatattacatagttcataaaattaatagttaaaatataacaatgtgtgtttagtataagtaattttgagacgtaggggctacaatcatcgaagaaacctaatccaacaatagtgattacatctccatctgaataggctcaaagaaacagctgaccgagttgatctgaaaaggaaagagactggcgtacgtacatgctagtcactggaagagaagatcgaggtaatagaggtagtgcaaccacgtataatatataatagaaacctaaaaactaatatagcatttaaaaagaggcgtatgatatatttatccatatcatcatgagtgtaacttttactcccatatttaaccataagtaaaagttttacttctactctgaatcatatgtattttcgctacatatttggtttgtactataagtttggtttgtgaccaatgttggccttaccaaaatttggcatgctaatttttggtaacgccaacatgtgtttagattgaagccaaattaaactaatttggctattgaaatggcctatgttatataggtatgctaaaatttggtttcaatccaaacatacacaattattgttgaggttgccaaaaaattggcaagcctaatttaggcctcaaaccaaactgcccataattttttctgggaagagataacagtggtgagtggaagccaactgatgggagcggtagctgaccaaagtaggtttcaccattttggaataaaatttttaaatgctccaaaaattgatgcaaaatgttatatcgaagcacatattttggtttttactcttatgttctaaaatttaagcatatgtactccctccattctaaaatatagtattttttgggtggatgagacatatcctaacactatgaatatggatagaaatatattccatccaacaaaaaattgttatattttgggacgaaagtagtatttctatatagaaatgttagtaatatttgttagtaagtgttggcagtgtgtatacctgaaagtttatgtgttcacccctcatcctaacttaaaaaatgcatatctgaacatagcacagagccaagagcccatttgaacaatcaagctagactcacaaaaacaggaaaacatagttttgcgaaccacaattgagagaaacttttttgtcattatactctccacgttataataaacgaatacgaaaactaccaacagtttctagtattaataacttataaatcatacctccagcatatgtaacgaatacgaaaactaccaacagtttctagtattaataacttataaatcatacctccagcatatatttaattccaagataccaatggaaacctatattatttgagatttactccggttcaaaaaaaaatatatattgagataccggtatctcattataccaaatcatttccgatcgttgaatctaacaatgcacattatacgtagctagatccaacaatcagaaataattttataccgtgaggtgaggtatcgatatctcgagatattttttattaaccggagcaaatctcatattatgttatattatgttatgtgtcttgtctacttcaagacctgcgcgaagagctccttgataacggaagggcaagtggtggtgagcagacggaagtcatcgtccagcctcgtcacctgcctcagcttcctcttgcacgagaggaagtccaggcacgccgccttgagcacgcggcatccgtgcttctccgcgaacaccagcgtcgacgccaccgtgaggacgctcaggctcctgcacagcgcgtcctcgcacatcagctgcagcctctccatcccgtacctcgccgccgccgcgtgcagccgcctcgccgcctcggccgccgccgcctcgtcctccttctccttcgtgtcgcgggcgcggggctggggcggcggcggcagcgcgtcggtgtagatgaagtggagcagcgccctgaacgtctcggcgtccatgtcgtcgtcgacgcgcagcgtcatcattgtgttcttggtggcgtcggcgtcggtgtaggccgcgtcgtcggagtcggatgacgagagctcggccgccatgaccggcgatctcgccgcgagcatccaccggtgcgccgtgaacgtcttcccctggacctcgatgaagacgtcgccgctggattggttcttccagaggagatcggcgaggtggcggtgcaggttgggcggtggcaccttgatcccctccttgatctgaacccctctgcggccgtcgccgtcgccggcgctgttgacgaatccgagttcgcagcggacgaggaagccgtcgtccttgagaaaccccgacgtctcgagctccgccctcttgatgttcatcccgaagtcgttcccggagaagtcgacggcgggcatgccctggacgaacgacggcggcgccggcctcccgtcgcggtccacgaggctgaacctggcgtcggcgatgaccggcttggcgtcgccgccgccgcggcggtaggcgcccgcgatgccgacgtagacggagacgacgccgacatcgcgggggccgtggccgttggggtagaaccggatgaaccagcggtggccgccgacggtgaagttcatggcctcgatgaaccttcccctgcggaggttcttggtgcgggagtagccgtcgatcctgacgaggtgggacaccgtcgccggcgcggcggttatggagtacatggccggagggtggctgggggggaagaggaggtcgacgagcgacactagcaagtccatgatgatggaggaggaggaggcggctacggcgacgcagctcgcgggatcgcgcgagatggatcggctcaggcggtgggcgatcgaactcgcgaggagacggggaggggagatcgagtagggtacgggagggtaagggtagttatcgatgtggggtttatatttgaagttctgaacgccctacgttctcggctgaaacagagtaatgataatttgtgttctttacggaactgagtaaactgtagtgttataaacatctcttctctacttctgcacaaaatttttggtacgacatcctattcctattccgatagaatatcagtgtacgagtacgtggtttttatttctatatctgtacttaaaaaattacggaaggcttcggtggatttttctttatgaaactctggtccggccagcatcacctgagcacgctgccaactcgcgcttgcgaaccaatcctcacggatgctcccaatgcccatctgttcctccgtggttgctgccaagatttgcctccacttttgcctaggccgtcgccgacacaggacaagcttcggcatggctaccaccaggggcatcggttcctccacctcaacttcctctgcttaagtcatcttcaccaagatcctcacgctgacctctcctaccatgttgccgccacctagcactagcgcctgtctaccccgccaccccgacaccttctccaccgccggcgcactgagggactcatcctactaggaccttgctcttccccaacctctacgcaggccgagagtcgccgttaggccgctggtgctgccctgcagccatccccaagccttgccgatgggaccctgccccttgcacgccgccccaactcctcttctacatcatccgcatctttggtgtcctcccccgacctctgtgctcaggacgccaccatccaacctccgctgcctaaggggaaggggcgtcctcctgtatccgtagtccctcgatagcttcgccgctctacgcgggtcaccaccagctgcttccttcccctgagcgtgtcgttgtcgcctgctcaaggttgggtgagggacacccatttatccggcctggtctgatctgtaacctctgctcctcttagctcccacgcttatctcttcttgtgttctttaaactgaagagagaacatagaataatctttctgcagacatctggaatttagatctttactgcacgcaaatagaatatgaaccattttagtgctctttatctccccttgcatggtgtccgcgcggtacgacaccaacgttgttcgtgtgtgaacctctcggatcatacgggatggcagaagctaccgacttctcgaagtatgtttgttgcaagcccggtcactctatttggcagtattataccggcatgtcagtgtggtatcatcacaaggttcaaaactaaagacattattacactggtttattttcaaattatcacaggctccaaacctgatatgaagctaaacttgtgaagctggaaaaaggtactccctccgtcccaaaatatagcaacctagtactggatgggacatatcctagtataacgaatgtggacatactaggttgctatattttaggacagagagtatgtattttatagggcagatccacccactccggctccaggctccagctcctcggacaagatagcggttggagccatgtcaaacatgcccataatatataaaaaataacttccagctgctccttgtctacagacaagaaaagaaatggtagaggcacggatatagactgtatagtgaatatgcttattttaaaaaataaaaataaagagcaacacttatgttagtacaatgcagcactgaatagtactacattactaaaactatatactgcaggtaagcaaatcacattgcatctaacttttcttgcaaaaagtaaactgtgtacatttctgatattgttccaggagatccactgggcaattagtatctcaattgtccgcagattcttctatggttcgtcgactaaattttctgtttgacttctaccataattccatagatcatgaagttcacctctaaaccaaccaagtataacaataagccctggaacgagaaatacatgggagtcgtcacttgcaatgacttaagagtcatatggaaagaaaagaataaaaacaatccatgattgtgtgctaaaggaacgatgcatatacttacctaatgtacatggaacaaggtacagcagcgcaggttgaccatgcccgtccatcaggaagagcgcaagataggtaaggaaaaggcctacatgaaaaaaaaaatgtaatcccattacgacatatccaaggtctccacaaacatgtgttcatgccataacacaatgacatgcatgtacacatgaatccattttgcaaaaaaaaaaaaaatcaaaatcaaaataaaaaacattcaaaataaacaagttagccattgtcaatttcattctaaaaagaaggggaagaaaacaaagataattcctgcaatggaacagtaacattctccctcgttgattggtactccctccatccacaaaagttagacatacttcacatttgagtttttccaaataagttgttcttatttgtagtctttatgcattcaagacttaaatgaagagataaattaaatgtttgattagaaccaaaggagtcatctagatgttagaacttcaatggttactctcattgagaagaggatggcactcagagtggggcaattttctggttttcttcattcacaaactcaaaagccatacctacccgagggaggttggatacatatatatagccatagctggctgctagcctattgctgcaccctcctagtctaaaattcaaaatttgaatgggatgctgtcctagagggcatccaaactgaataaagcataaaggaggcataaaggagatgctaactgctgctgtcctactaaccgcagctatcctagcaactgaaaaatatgctaaaggggtagatgctgtcctgaaaaggtgaaactacccaaaagcaaaaagaagaatcacgaccaaggaccacaaagacttatccaacactaaatactcattggttgtatgcttacattcaatccttgattttgtaatatccaagatgatttaatttcttcttggtcttgatgataaaagtaataggtgtaacttttgtggatggagggagtatagttttacagctggaaacgatgctaccagtaacatatggcttcaactagtcctaagatggtgtgaaaaccatgaccattaattaatactttctatgtttgttcagacttatgtagttcatagtcaagtaactattaggcaaactgcacaaggaaaaaaaattcaatgtcacagtacacacgatatagagcatagaacataggtaaaatataaaagtgtaaaaaaaaaagaatgaacagcttaccaacagcatatcccaccgtcagccatagaaaatacccattgaagaggccccttttgcttgctctatcaaatctacacggtatcaaattgatgtatgggggtaaacatgattgaatatatataattgaaatagtcataagtaaacacaacagatatggaaagggctaattaaacctcacagagaaataatgaaaccatcaaacaaacgccggcatatataataagatgcctggccccaattttctatgttaacaagagtgaaatccattatgcaaggatgaaaataaaaacaggtaaaatcaattacaacatgaatcgattaccacataaaaacaggtatttctaacttcggaatcctaaacagttaattatattctgcttgacaagtcaaattatagcatgatgaattgattacaacagaacatactttatttccaacataccaaataaaggactaaattagccaacagtacgaaaccattgggagaggtttttatgccttaaagttgagtttcaacattaacaaaaaaaaaatggtgatataaggtgtatttgttgtcctaccaacaagaataccaccaatgtgttggcgaaatcaaaattttggtaaggttgtataggtaatgtataactctgataatccaaatagactctgattccattggcaagaccagtggtactattggcattaccaatatttttggtaaggcaaattttggaatcaaccactggctcattgcctttatgttccttgatgacagaacagtgtaaaatcaaaggtcattaattcaaacagaaacatggtgtttgatcctcttttccaccacgtaacatcttggtaccatggtacactaacttaattagcaatcaaacaaatcatgaaacgtgataggaactttcaggagccaattagcatattgctttcatatggtgattggtgaattccattttctgctaacattctcagtatcatttgattttaaataaaactacaccctacggtaagtgttcctaaagttttcagatggtttacaacttcactgttttgatttgggattatgttttcctcatcaacagtatatttaccaacctaccgacactttagcgtccagtgaaaccaaggcatcaaaagagaagttacaacttatattgcagcaatatatatagtataatacctgtagctgaatgcaactagcaatccagggaaaataatgtcaccaaagcctatcatgtcatagccaccccatggatcaaagaaacgaggtattcttaagagcatcggaattgcttccccagagttatcaccacgagcaacctgtgcagtatggatagaatcatatctaacactataacacttcataatagataaaaggtatatcttacaggacagatctaactgaagatacacatatcaaacttatatgaattgtcttatcaccaaattttctaacctccaagtgaatgctttcgaattagattgaaacatagaacaaactaacaaaatagtacgctattactattagtaagcatgtgctactatctggttttgaaaataacatggaaactagtagattcatgagccacgtatgcagcatattatggtactattatcaccactggataaatccacagtactaaacagtaagtaataaaaagattgttgcaaaaaaataaaaatcatgcacttactgcaatcatgacactttcatggaatataagaggtgaaatgaacacccagaaaacatcatacacaaatgcagcactaagaagagctgatgcaacctgcaaagttatagtcatgatgaataattctgatacacatatgaaacatataggttttgcacgactacattaaacttaaagacatggcaataccctgatatttggtaagcgtgccatttgaagcacagttatcatcaggcagattccctgaggacaataaacaaaccccatggttaataatatctaattgattttgcaaaggctctgctcacatgtctcaaaacacagaaggcaagaaatttaacatctcacgtatgaattattacaaatgtgcaactaaaacatagatttgttataagactattccacacttcaaaataaaatcatctcaaaaataaaaataaaatggaacaaccagacaacataaattttgacacatgcatgaaatgttgatacaatatccaacttggaaactgtggtatacaatatccagcttagaaactatggtatacaatatccagctatggtatcttatccaaaaccagtcagaatagtgtgaaacgagcatagtggtgtctacattttgcaaggaaccaaacaatcaggctaatatatattttttttttgtaaaagcaatgttaattattggatatttatgcaaaaaaaatcttcaaaccaaatatttttgaaaggaacaaaccacgttacagtgcgcaaattttacaaggagacatgttagctgacccactggaaatatacaacttggatccagattgatttcagaagtaacactatgttagcctttacagtatattgtaatatacttatattatgtgaatccagacttgcttgctggtacctctgaaggcatgtacagttagttgcatacttttgaatggtactgaagcaaaatatagaaaaaaaaatgcacctcctagtgagaagcacaccatacaaggtcatatataaaatatagaaagaccacacaagaatgaagataaattagtcttacaaggatgtcttggcctatccaagcaaaagaagcatgccgatagacagcccaaagaattgcaaagatagtgcaaaatggtacaatcagaacagaaagggtcaacacctccccaaaaaaggggagttgtacagtcttctgtccacaatccttgcaaatcctgttaggtgaagtacatcaaataagaaaagaaaggcaaataaagtgaacagcggtgaccaaattcctatatccaaattagttcatttgttacctagtgagaagtgtgaccaagcaaacatgcataccctgtaaaattcatagtcagtctcatagctgaatctctcaacaaaggaaaatgaaaaaaaaaaaaaaggtatacttcaacattcaatgaaaacaaaagggaaagaagtgttaagatggtaccaataagaaatagcacaatgcacataacaaatgtatgagaaaatacctcaataccaccaatgcagaataatacaattagcagccagacgaaccaagaagacatgaagtagaagaggaggaggaggaaaactgaagctactaaaataaaaacaatagcccccttggcactgatctcgaagatttctttatcttctctgttggttgttccagaattaggcccatcctgtttagcacgaaaaggaacaaatctgtcagtaaaacataatccagtgacgaactacaaaaatatgatataacagaacctagatatgttctaagcagcaaggacgttcttggcaaggcaacaagataagttgttgtattttgaaatgctgaaaggcaggttacataaaaacaacatccaatgattgaaaagaatatacttggaagacatgtgattttattttttaaaagaatacatgaaaaccaaaattgaacacaaggcatattgtaacatgattccattaaatagtgaactcacagcaaaattttccgaagacatcatagagttgaaattggtctttatatgcttcaattatatattgcatgttttatcaataacttatctattttctatatgtgatgcattgtttagtggcactgcagtctgcatcacatattttgccacttgtgcaaagtattcaagccatttcacttaaggacttaaggtggtaaaaaaaactattcacatcgtaagaataaaaattgtagagtggtaccaagagaaaatgggtatgaatgtgctaccatatgtgtgtgaaaatataaaattaaaatgacataatttggatagaaaggtaaagcacaaaagtcaaaaccttccgtgtcaactgattataacgctcatcaacttgctcgcatgcaacaaattcagtccagagtgaagcacaaactatggttcctatagccattatccacaagaagcatgctgaaaggtctacaactggtcgatttggtgaatatagctgcacctccactgcagcaaaagaacattcttgttagcatgcatactttgtattaccataaactactaattcaaaagtacaatttcacttcaactagtcaacatttatgcaatcacagcacccaacacaaagatttccaatttatacagggagtcaactgagcgactttgcttgtgtgagcgtgcatgcatgtgtccacacaggtccaggtgggaagcttgcccattttgttatctcaaaaggtagcgtgcaggatttctggagagcaaataaggcaccaggacttctagagaggaagctgcaccgtcaccagcttggagatctagcatagccatgagtttctccaccaccagctctgcctgccagtccaccatattgttggaatgctgattattctgcttcaagcaggtcgctctatttcaagccagctgctgctttgcttcaagatccctccacattgctccttccgtgtttgctactcgcctacctagatactaggtgtcaacctttactagcaataaattagactgcagaaattgttcactccattggtatggataaaggttttaaaacccagaaccaaatgcaaaacaggatgcacacagttttagttatcagtgaaaagctgtcatatcagcaatttgtctttctttttcatatgatctttgtttagaaaatgttggttttgacatatttgaagtttgggatataagttagatgacattaaaagtagaacttcaaagaaagatccagggtcaggattcacgaacctgatgagcgaatatctctagactcctttaaaagtactccaatggtgatggcagtgaatatgctaccccacctactcccattgtagtttttacataatacaccttgaacttcttaatattatatgacaactaaatctaaatggatacccaaaattaaggtgagtatcccaaaagcaaaagggtgggcaacatatttaataaaaaatatgtttttatttattttaggcaatattatgattttttttccttttatacatagtaaagcacaggcatttaactagtatgccaaaattcttccatttataatctgcaaaatggtcccagcaaactctacttaaagccgatttcttcctttccttttttttttccaatacacctgaagatcagctcatctgcaggcactaactcgctcaagagagcacgggacggcatgctcgagagattaaaacttcaacagtcaacacagataattgccttgtacagttgataacttagtacaatattggaatattaagcgctcagtactctaattgatgtattgccaagaggattttcttacaatatggtttattgcatcatgtttctttgccatactggataaatataaaaatataagttagaatgaattcaaaccaacattaattctgtttttagtcagacaacatatacctgatgaaaaatgcaattggccatcacagtagatggaaccatggaagtaaaaggcttgagatgtttaagtaactaaaccctaccaattggcaacataagcaggaaaaaagaaatatgaatgaagcttagcattactgaggataattaagaatgtgtaactaactgacttacgccttgctccctgatccaagaggcccttcatcttttttccagctgactgtggtatcattacaacaggtattgtaacattaatggaagtatcgttgtcactgcaaaccatcttgtaaagttctgaaagaatgaagtttaacagataaatacgactatattaacaggatatatataataatatatttcatattaaccttttcataccttcattatcattgataactagtaaaccaactgcacctccagtctgtgcaatctttgctttagcagtgaaagcgcattctccacgttgtgctatagcaatataatttgttagctgcaaaagcgagaattagtttagaaaatatttacagcagtcattcaaagaaccaaacttgctaataagtttattatagttgatgttaaaatcaaacctttgatgtcgaattggaacaacaatcaagtggatttgcaaggacagcaaatgttttctgagcttcatgaatatctcgaggcacggaggctccaaatcttgcactcaacccaacaacaattgtaccttcagttccatttacccaattcttcaccttaacctggataaaatctcaaggatgagaacccttgtggaaaaacttaaggacccctttgaatcacaggaatggaaaaacagaggaatagaaaaaacacatgaatgaccgtttgattgaaccacaagaaaaacgtaggaatcagatgagagagttagactcaaaggattttttttccaagaggttggacctcttgctaactttcctccaaaatctctataggactacccattccataaaaaatttaaaggataggataggattcaatcctttacttcaaaggctttcataggatttttttttcccataggattggagtcctctaaaattcctacattttccgttcaaataaaaggggccctaaaagtataggtaattttctttgtaacttttattgcgcaccaacagggtacatgcaagtatatgagtctcatgcaaaatgactaccatagacatcactagaaggaaaaagattgtttaactccctcaacattgttggttgtctgtctacttaaacccccaaaacaatgagatggcctaaatggcacccttgaactatccaagcctatcaaaattccattactagaaagagattggcatgtgcacttggtagccttatatgacagaacggcatcaacagtaaataagaactatattgttagtttttaaattcaatattttacttgggtctttgtttgcaaacaccaggaatagaactgagagcttgacccatggtgaaatttcacaagtacgctgtggaacatttaaatgaaaagggtgaaaggttaaagggtaagccctacacagttcaatccaccgggacaagataactactatggtgacaaaaattgttcaagaaaatatcttgttttatcttcttggttcatggttcacgactagtcatgtgaagatgtctatatgcagcagttgcccctgcttctgtgtaccacatgtagtcactgtgttgcctccagacaatgccactgcattactctgtaccaatgccacctgaagtgagaagtgaccatgcaactgaaaaatacattttagttgggataatcgatcatatgccactgttcagagattgcactctaggatttgccattctctggaggccaattgttttcttaccacttcttagttggtttaacacattgccacttttcaccgaaaatccgaaatacatcattttgcccccttttctttgctaagctaagcaccaggtggtgcatccgttatcctcttgcagtcttgctagacacaatgcatcatatgcttgtccggctcaaaccatcaagcagctgagcccatctcatctctctaatctacaaggcgattcagtggcagcaccatgtcaacgaagcaggaccgcctggaggaccagagcgaggacaagtacacaccactgcagcccagcccaacgcttgttatttctgtactgcctccttgtatccttcgccaccataaccgttgttgccatgggtcatgccactgtccgcctggtaacatgttctgttactatcttccttgcttcttgtaaaatctattcgtttttttctcatcatttgagaaagttgttcaatggttcctgcaggaggggaacgggttcagctgttcgatggttcaagccggaccaagtacatgatacgtcatggacagcaggcgcaaaacaggtacatcgtttggtgcttttccaaaaatataaaatgaaaaaaaagaaatagaccaattcggtctaaagtggctatttctagagataatcagctaagtcaaccaaaaagtggcaagaaatcaatgctatctctacagggcacatgatcaactatcatttttagttcaagctatcagaaatgaactaaatggaactccataatgaaacgaaatcacagtccaactggatccataattccagtacacaactaaagcgtgcagctcggaaattcctcctctccttacccagcatcacaatccatctgggaacaactcaaccaaattctcaaggtcctctgccattactaaccagcactcacggaggcagcagatccacaaatccccccctccacaaccaaagagagatccccatcccttccccactaggtcacccccataagccaaccagcaggctaagcaccctaccaccaccaaccaccaaaccctgaccaaaatcaggaagagaaaaacgggaacggattgggggcggcggggggggggggtgtggggcgcgcgttaccagctggaacttgttggagcagccgggcgacggcgggacgcccgcgtcgtcgtcgctggaggcgtcgtcggccgcggagccgccggcgaggaggacgagcaggaggacggcggcggcggcggggaggcggcgggcgtggtgggtcgccatagggcgtcgccgcgtcgcgccgctcgcctttccgtggctcggacggcagtggcagagaggaatgaggagaacaccgacgcggtgggcccgggctggcagtggaacatggatgggggatgggatggggcggcgcccgggagagagtgatgtttcgtcaatccaatattcgtaaagatcggtttattagcgaaagaaaaatataatgtgtgcttatattggttttaaaataaaaatactgtacattaaactagtatgaaaaaaaataaaaattcgaatttgaaattaaaattttggtttataacataagcaaaaggttgtatgctttataactggtacccactaactgatgagggagttaggtcccgatcttccgataggtattgataaacagttaatttgggcggagttgcgatacaactcgatccggcttctgaacgaacacgctactgagccccgcaatcgcagcaccacgtctcctctggttatcaaccgtgccgaaacccggttgacctcgccgagaaggctaatccctgcatgcgaatcgaagaacacaagaaagaacaagatagattgcaaccaaattacatatgaatgattaagcactcggatttggggtttcacaaatcgatctagcggcgaaactgttcttgataaaataatttaagcaaaacccgactctaaacgatgacggctaatgaataaatatgattaaggacgtcctagggttgccctagggcgcacacccccttgggctaagcccacgacacagttacaaggcccaaaacgcaaatcagattcggactggatgagatacgtggcttgttttgcagtttcccggcagcttggtaggaattttgatgtgggaccaaatccatctgaaagtagactccataagctttccaacaagtactcatgggccccgaaattccttctagaacagcggctagatctatttgaagttgatgctgtcaggagacccgaatctaaattcaaaacgtgtataactttatctcttgtcttctatggaccaaaagtgacgtggtgagatgaaataagacttgaagaaggtcttggtttggttcccaatcaacttcttcaatcatctatgcattccttacgctcggtctcttttctttcgcccaagcaagtacctctgcaaacaaaaacacatgaaactcattgtgtagcaatgtttgttcaaatatataacaagtaaatctaatgtagaacatatgcacctttggttgattaatacataaggtagtcatggttatatccgagctagttgtgtcctcatcactaatgatgattaagcttagtatgtatattaaaacagctttgaaaggagacaccatattcgctgtggggactagaaattcccacattaatcgaagaaaaatagaaaaatctgaaccgttaaatcatgatgagcctgtattataacggtcgagattgattagatatctatagtaaaggaaactatctagagaaattaatcctactagactaggtaaaaaacaattgctactctacacaacaaaacaaaaatcatgttggaattatgtccaaccacccaatcagacaaggtctcactactactccatgtatttctttctatagcatacgttttccttaataatatatataatacacgtatacggacaccatggatacaatagtaacacaaggcctcatatgcatacacgtttatggataaatatatatatggtggactgagaatatatattattaatttagttgattgatgattgataaaagggcatcaaagttggaacgtacatgcggcctgttactgcctaccctagacagcaacaaaataattccgaaaataaaataaattttgaaaaacaaataaaataaatttagaaaaacagaaaaataattataggagttcaagtaagaaaataatttataaatagaaaatatcataatgaaaaattaagtaacatgcctgtaaaggagtagagtggtgatggttgatacgacgtataaaaactgttaataaaacaccaaatagaatcctaatgactattaaaaagagggaagacaggcaggccatgaagcaaacaggcaaggcggttgccgagacttctagaaagtaaaaaaaacatcgataataatattcgatttttaaaatctcaatgacaataaaaaggagaagcagcaggcggggtgtatagaagtatagttgcagagctgccgacggttggcgggacgtctagaaaataaaaaattgaattccaacaatagttatgttcgatttttagaatcccaatgacaataaagagtaggtggcagatgggccgtagaggagtatagtggtattgtttgacgggacttctaaaaattataaaaaaagaaacccaacaagacaataaactctaaaaactaaaaggtccaatttttaaaggttcgaaacttctaaaaagtaaaaaaaaaaaccgatgataatcatatttgattttaaaatcttaatgacaataaagaagggaggcagcgggcatgccataaaggagtacaatggtaaagccgctgacggtttggcgggacttctagaaagtaaaaaagaacccgaacgataattatgttcgatttttaaaatcccaatgacaataaagagaaacgacagtggacgggccgtagagaagtataatggcagcgtttgacataacttctagaaattataaaaacaaaacccaacgagacaataaactctaaaactataagatctaatttttaaaggttctaaggagaatgaataatagtagtagatcgagcaaagcaaataaagaaggatatgacagaagtaagatatgacataagtaaggggtagtaactgatgtgacttttaaaaactatttaattagaaatatgaggatgataagatttggcctttcaaagtcttaggacaacaatatatctatttaataaattttaagtaaaattatactgaaaaatatatgattttgtttgggtgctagctgcgcaattacgcgggccacccaactagttgattataactaaagctacttttcccttgtaccacgctatcttaatttgcggaggacgcgcgttaatcttaattcaatcatagagaaatgcccaggggttttccggctagctccataaggtggtgggctagacgacctaggttcgaaatctcgccccttctaattatttgatattaggtcctttcctaatattcacttttttttatcttaattcaatcatatatattttaaacaagtcctggtaagtaacgggctagtttgattttgataatttattgttgagcaagttattaccacaaatcactcaattatagtgataaatttaaaattataagaaataatctttaagaaaaaagtttttcaaagtgtggaattatctattttaataatccgatgaataagttgaaaagataggcccagctttgtataagtttcaagcttacttatacaacctcatgatagatggatgacgcaacctctctcaaaactactgtttttcaccgtatcttctatagcaaccgatggtatttaccgtagtatcttatatagctatggatgcgatgggtaagaagcaaagagtccgaaaaaccataatggcaaataacgtgggttgccatgaattactatgtaatctctatattttattttatattataagatattttgactttttcttgatcatatttataggaatacgtagcaatatctataacacaaactagtttcattatatctaaccgagtatattatactatatattttttttaaaatattgctatgttttctataaatttgattaaaattaaataaatttcacttaaaaataaatcaaaacgtctcattattataatatgaaatgaaatggaggggtagcatgtgttggttagttgttagataaacatgcttttctcagctaaacaggcttatattaccaccaactttgtagacaaggtgttatattcatccctggcacatttggaagcagatggtgtcatatttttttttacgaaacccaacatggtgtatttgtgttaagtagggggaaaactgtacaatagcctcaggctaggaggttacaaaaggagcaataaattgaaaggcgagaggagggggggggggggttgggggtacatgtcaagatggtgtcatgtttgaagaccatacagccacgatgactactttagacatctttttaaggtggatctccaaccactcctgtgtatagctgtgttcggatgccccctttcccaacccctcctattcgttttccgtgcgcacgcttttcaaaccgttaaacggtatattttttaaaaaagtttctatacgaaagttgcttaaaaaaatcaaattaatccatttttgaaattttttagcaaatacttaattaatcacgtgctaatggatcgctccgttttccgtgcacggtgtttgggttagagattgcctcctgcgaacacagcctaaaagacttaagagacatcaactcaagtgttgactttccttgtaatctaagggcccctttgaattgcagggttgaaaaaacggaggaataggaaaaatacaggattctgataggaattgaagtgtaaaacagataattgaaaaacacaagaatgatcgtttgattagtccacaggaaaaacacatgaatcgtgaaagagtcagtgagcaactggtggctatggcctaattgcatcatgcaaaagagctgcatgactagctgataaggaagtcagaaaaatgatggaaaatgatggattttaacgcaaagcaatcactcgatccatgggtagcgtacatggagtcgggcagttgcccgcgctggctgggcggtataactgccactgtacggaacggaagagtggatggtacgtgaaggatgaaggcgaaacttagcggctatgttaccggtaagaatactctcatagaagatgctggaagaccattccaaccgctcttacatgcactagtgatttatggagccatctgattgtactgtctgactaacgtttccaattcttcaaggatataattttgcaaaattacaattaatgtaattttgcatgaatatactgtggcgataaaacccagcctgattctgtagcaacacgtattatatttttactgaaacagtaactgtgacaaacactttatcgagtagcaggggaaaacattttctcgcatatccctattttattcatgaccttgggtcccaacaggtgccattgtttttgggagtaatttccttgacaccaaggaaaaaaatatctggtgagtacagcattaccggcgccatttccttgtggtcattactcattacccgttccagagaacaaactgaaaaaggaatacttacaagatttcaggattattatgattccggcctttccgtgaaaaataacagctgcatactttggacatgtcaatatggacagaattaagcacatttaacttgaaaatcttaacaaaaaaatcatagctatacttgtttcgtcttacatttttttgcattttttttcatatacaagtgtgacatgtctttggacttattatccaccattttggtctgtatagtagcatagggacaaccatataggttaggaaccacactatagtatataaaattaacatccaacaaaatgaaatacaatcacttaggagttaataggaggtagaggactcatatatttttaactactgctagaaaaatcgtcttgattctccaggaacagataaagggaaagcgaccacagaaaacatgcagcttaatcttgtacaacttgtgtaagcccatttgattcttcatgaacagatcaaggaaaactgataacataaaccataaccttaatcttatgcaacttgtataagcccaaaaaataattattttttcctacgtccatattctaaatccatgcaaagaaatgaaatcacctgaatctcagatcctccaataagatggcaaaatatatttcttaacagaataatgatcagtaaagaaagagaaaaaagctaaccttgagttgagatgtccaattggtatactgagtttagcccccagaaacacttcgaaattaccctatggcaaaaatcatcagtttctactttctaatgtcctccattcgcataccacccccgaactggaatgccaagaatataaaggaatcaactaagccatttgagatctggataaatgcactagtcaccattgcactcctctttcatgttgggtctcaccatgatccagccttaggtttccctccatggcacagctcattgccgcgttgagaataacatattttaattcaaagagcacaacacctgctgctgtgcagattttcaatggtggcggagtcctggagcacatggcttccaaagtcgtaaaactaaaatgatccgactttcctgcacatgcacgttgcccatgaaagacaaaattttaataaatcagcatacaaaagcagtcatgcattcgaaatctaccatacagaaataattgatgactccttaagagcaataaacaaattcatgacctattaacaagtcaaggataatcatgcttataaatacagatacatgtagatgatccatgtaccataatacctgatagagaaaatcccttgtatacctccgaaattttagctaatcccttctatgcctctaaattttgcttactttcttgtataccctaaaatttgatttttgatccctaccatgtccctcctgtcagttaaccgtctaatttctataaaaatgttcattttaccatttggatgaacataaaagtttacgaattacattattaaaaatgtaaatgtttgccacatgagattactatagttatgagtttactgtgcgatacattatttatgacaatttatttttagataatgaaataaaaaatatttatttatttatttttaaaaaaaacataaaaaatgaggagcattcatacagagatatgactaccaatgctcacgatattgtttttatgaatactcccgatcaaaaaaaatccattatcctattaaaatttcaaacacaatttttaatttattacatttgttttattttcaaaattttttgctctaataatatagtctcattagtttcataaaattcacatactgtgcactcaaacaaaaactttaatcgtttttcaagcttatattcaaatctaaattaatcatcaagggcacaacagacatttgcaaccaaacataacaatgaaaagaaggaaaatgtaacagcaggggcatggaagagatcaagctaaaatttcaggggcatagaatggatcgggtaaatttcaggggtatgaaagggattaagtgagttttcatgggtacatagggaatttactctatctgatacatattgattatccatgtatcgtagaatttctccatcagaaatgttatttttgacaatttctcacttgatatctataaacaatacattgccttaatcttgttttgattcacacaatgaaaatgattgattgccatttatattagttcagtggccaatttaaagaatctagttgcagttacagttttaaatatgaaggatccttaaaaaaaagaagttaattctgcgattgaaccattcgtccaagcagtaatgggaaaggagcaggatagacaaaacttagacttatgaaataattctaaacaaagaaacagaatagatgatattacaggagtaaactttcaattggtattctggtaaataacatacttgggaaagcaggtgctgtcagacaacaaaaaacagctaccactgaatcagcaaagtagaatccaagaattatgtcacgccggaatatagaccactatattccgtttgtgagtgcattattccttgtcccagaggtaaggtacacataacaaattggtaaggttaaggcttctgcaaagacctacctcacatatatcacccagattgatgaataaccagaacagagcacatgcgcatgctgctaagaatgcaaataaaggattgggctgtgctaggggaggtgtcaaggtaccactgtccgcacaggtccaaactcctctaaaagctatgctaattcttgtgctggaaaattaatcggacattcatcattttatttacttttaaatccccactagctccacatcaataagcatatggtccctgggaacagtaccagccattctcataatgcgatgaatatcctgcagcagatcattgatcaagtcagattcactgtgggatttatcacgggaaacaaatacatgaaccttatttgccacctcgatccaactacaccctggctgtttctttagccctcgaacattcatctctgacctaatttctgctgcttctttccatttaccagctgaagcataaatgttacacaagagagtataagttccagcattatcaggttctgcttccaagagatgtttagccgctaaatcaccaatactttcatttccatgtgaattgcatccacctagaagggcactccaaacggtacttgatgtaggtttaatcttgaaccagctaattaatcttttagcatcctcaagccgtccagctcggctacaaagatcaaccaagcaagtgtaatgttcatcacgcactacaatggagttatcctttaccatggattcaaagatcttaagcccttcatccactaaaccggcgtggctacatgctgagagcaatcccacataggtagcatcattaggcttataaccattttcttgcatatttttgtacaaatgcattgcttctatgccaaacccatgatgtgcatatgctgcgattatcccattccatgagattaagtccttctccattgagaaatcaaacacatttcttgccagcctaatttcaccacacttggcatataagttcattagagtggattccacaaaagtatcaaactgagatggtgttttgcatatcatctgatgaacctgctgcccttcacagagtgcagcaaggttgctgcacgcatcaagagaacctagaaatgtcacttgatttggttggattccttgaacaagcatacagttaaataattttagtgccatttcactctgcatgcattgtaagtaaccattcatcatggtggtccaagtgatcacattccttttaggcatctcatcaaaaagttgccgtgcactcttcaagtctttgttctggataaagccagtgatcataatgttccaagaagcaacatccctaataggcatcttcgtgaacaaatcaagtgcttcctcaatcctgtggtttcgtgcatacccagagatcatggcattccaagaaacaacattcctctctggcatggcatcaaacagaacccaagcgtcgtcaacgcttccattccgtgcaaggccagaaatcattgtggtccatgacatgacatccctcactggcattctctcaaacatcttacgagccctctccaaactccctgaccgcacaagtccacacagaagaatgttccaagagccagcatccctcaccggcatgcgattgaaaagggcagacgcatcctcgacgcggccaactgcggtatacgcctccagcatcgtgttccaagagacgacgttcctctccgccatgccctcgaagagggcctcggcctcgtcaacgcggcgtgcgcgcgcgtagccggagagcagcgccgtccaggtgaccacgttccggcgcgcatcagggcggtcgaacagcacccgcgcctcctggagcatgccccggcgcgcgtacgcggcgaccatcgccgtccacgacaccacgtcccggtcgggcattccgtcgaacagcctgcgggcgtccgagactcgcccggccgcggccagctccgcgacgcgccagttcgagtcctgcacatggttgaccccagcggatgcggccggggcggcattgttgctgatgcaattgaccgtggcggcaaggcagagccgcggcgagcggagacggcgcagcgcgggcgcagccaaagctgccattagagaaccaggagattctgcaagtctgcaacctgagagctcctgattgagtcctgaatccttataccctgcgcggctgtgccctgcggtgctcgtcgccgctaggggcgcgcttagaatttttaggttgggtattcaaaatgggaagggataaaaaaaaaaaaaacaacacctccccgcgatggcgattggcggcgcggccgcggtgtttcagcggggcgaagttgggaccaggaggtggtctagggtgacttaattttggggccttcttggctactgggcctgcataatgaggagaggaggccaggctttcttattgggcttttctttcgattaataggcctcttttctatatttttcatattcatatgagacatatatctcatacaaatatatttttttttcaaaaatcttagatattcacctgaatacccttaaattgagctgcgcccgcagcaacgggcatgcccgcggggatgtgcgacaaggagtgcggaggctatgaaacacgagagcgagggcggcgcgtcgtcctttggagtgatttgggtggagttgtttggagcactggaaacctgggctgagaactagaggggctagtagttattagtaattatctactattaagcttgttcacgcttaagaaaattcttggatccgcggactgacggtgtgaggctgataaggtgaagatccctggcgctgtcatgtcgcagctcgagtggttgaaccacgcgcaggaggaggaaggcgtggcagtgttattttaccatgtcattttggctgacgtggtagtattgtcttaccatgtcatttgtactagtgtgacaagataaaactggcacgataaaaccgtgacatgaattactaatgacgtgacaatgttgttcgccacacatcaggcggagtgaaatagaaaaaaaatgtttagatctaaaaataaaaataagtattgagatgatcgatttttaaaattaaaagtttaaaaaagttagtgggtttgttggcttggatatgggccctgctgaagggtagtaggtagagttgggccttcaaatgagaaaccagaactgctagaggtgtttttgttagagtatattgttgaaaatttggtcataattcggtatattttaatccaaaatattatgacaataaatatggcatacacaatgagaaacgatctggtgatgagatgtttaaggtaaaataagtatagacatcgttgatattcacataggattgaaatcctatggataacattgtgaacatgtaaataataagaagaaaatcaaataaagttacaatcttatacccagagaacggtgcagaagatgttgaggaattcgtattgcctctgttgatgttgtctcctttgttctctccagtagaagctatggtgaagcagaagcagaggaagatgcaacgttgtcgtcgaagaaccggagcagtcgcgcttgaagtgctacccaaaaacttgatcgcccgcctacccgtacaggttctcaagcggacggaattccggaggcacctgctcatcccgtacacctgtgcgcgcaggtgaacagaaccagggaaggattctgcagcgcaagaacagaggaggaggaactcgaagcacaagagacgtcgggaagaacttctccatatccttctggtcgctgccgagtatatatatgtgatcgcgagagtaacattcggagtcatcaaccgcggtgtttaattttgtaaccgacgcgctcgttaatacggaatcaattcacggcgtttaattccgtaaccgacgcgctcattaatacgaaatcaattctccatgtttattacggtccgttacatcaaccgtggtgtttaattttgtaaccgatgcgctcgttaatacggaatcaattcacggcgtttaattatgtaaccgacgcgctcattaatacgaaatcaattctccgtgtttattacggtccgttacatcaaccgcggtgtttaattttgtaaccgacgcgctcgttaatatggaatcaattcacggcgtttaattccgtaaccgacgcactcattaatacgaaatcaattctccgtgtttattacggtccgttacaaaatgagagagagagagagagagagagcagctacctgcctcgcctcgccctgcctgctgtccgcgcaccatctcaatcgatcaacagagactctccactagctccgtatttaagttgaggcctcttcacatagatttccaaggtggtattattacccatagcatttaatgtgggccaatggaatttattaggatttaattgggcctagcccattaatctaacatatatgatagttagaaatgtattaggatacgattgatttgtgtgaactccttccttatctttgatctttctttatctctaccaaagtattattctatatataccggcccctgagccttaatacaacgtgtctaatattcagaatatctcctttcttgtactattcaacttggtattagagtgggcgatctagcgcctctctcacacttccactgccatcatccctaggagggttctgatctcctggggcggtgatccttttttttctctgccgttgtcgttgttgtcctagagagatcaatctccgagcattctaagcattctatgtcgttgtcttcgtgtcgttgaatcagtagcaacaacgccaactacctccacgccgccaccctcttcgacctccacccacaccggccagcccctttgtggacatcgccacgcagaaagtaaagaactgcaaaaacttacttcctctcctactcatgtggttggtgaagatcttaatacaagctagtatttgtgcatgattgcgtgagcgaggctaccatggctgatggtgtagcgcacgggttgggagggtgcgaacagagtgaaacttgccagaggacggctagcggcttggcgatgcccaagcttgactcagcggaggtgcttgggggacgtcaggttgggttagccaaagtggaacatgtcatagacaaccgatggcatggcaatgcccgcctgggttctcactggatatactgcatgggtgtgttcggggagagcagtggcggcgcatcagcgcccaccgtagggatggaaggcaacgcacaaagagaattttcctcccccgcgcaccaaaaaaataagccgaagcggaacatgtcataggacaaccgacaacatggcaatgcctacctggttctcactggatttgctgtgtgggtgtgttcggggagagaagcggcggcacaacgcccacggtaggatggaaggcaacgcacgaagagaattttcctcccgcgcgcaccaaaaaaatgtagatggatgttgtgggtagagcctctaggactgggactctatggagagggatttgaggtccttcctattttgaggtcttaaatgagatctctgctgaatctagatttttggcctcaacccttataaaattgtttgggggcttggtttagggttcatgctggaaatgctcttttatatatatatatatatatatatatatatatatatatatatatatatatccaacaagagctccaaccgatgttaaaatttaaaattaggatttgagagctggtgttctaccatactataaaatcttcatcagtcgggttttatcttcaactattacgccaccttctcaccaactctcagatgtatggtcaggggcggagctaaaacgaaatggagggtggtgccacttgattaatttactctactttaatcaagtttaagctgatgcgagtatctaagtttgtattgaaaaatatatatatatatgatgaaaataaataaaatatagctaaaatttttttaccctctaatatcctctacctccaccccctgtgtatggtcatctcgccaccgcgcgccgccctggccttgtccttgtcgatcgccgtcaggcttcgacgatatcacaacgacacaaccccatcgccttgtaacaatgcctgatgtgagcgtgccaacgtcgagtacgtccgtccatcgctcctgccatgtctttgtccatgcacagttgctaaagccgtcgcagccacgcatccctctcgtccacacccaccacccaagtgcccaagcggtggccgcatatatgcatgcattgcatagagtacgccgcggcgcggtggcacgcatgcacagcatatatcccccttgactctcgaatccaagtcctggggtgactccaatccaagttctggggcctcgcgttgttcggcgctgtgctaggctgctagcttctgaaaatatcatgaaaaataaaaagcaaacaaaggccattttcagttctcacgcaaaaacttttcatcatatcacatcgaattatttggacacatacatagagtattaaatatagaaaaaaaactaattacacagattacgtgtaaattacgagacgaatcttttaagtctaattgctccatgatttgacaatgtggtgttacagtaaatatttactaatgatggattaattaggtttaataaattcatctcgctgtttacagtcggaatatgcaatttttttggttattagactacgtttaatacttcaaatatgtgtctgtagtccgatgttacacgctaaaacttttttttttaacagtcagactgttgccgatgatttatattaaaagaagatattctgtttaaagaagaacataccgaaacttttcaaccctgtaacaaaaccgggccaaagaagatagcttctgaaaagatgagcatcgttcatgtgcacacagtgcaaacgcacgcctagtttggtagtggtagcgcaacgaataaatgacggacatgtattttcatcgtcgattggacgtcaccacttttttatatatcatctaaataagaatttttttaaataataaattttatatactttatccgtttcatattaaaaatcgtttgacttttatcctcatcaaatttctttaggtttgatcaaatttatagaaaaacataatattattttcaacataaaacaaacatattatcaaaatatatcgaatattagatttaatgaaactaatttaatattttagatgttattaaattttctataagaaatattatgaaaaactgagggaatatcatctaaataagaatattttaaaataataaaataaattaatagatatatcccttcacatatatatataaggttaaacttaacttgttttatagtgaatttaactaaatttataaaaaatagcaatattttcaatttaaaacaaatgtataatcgaatatgttaaatgttacattatgaaactaatttattgttgtaaatgatacaattatttttgataaatttaactaaacttaaaaaagtttaactagaaaaaaagcaacttataatatgaaaatgatggagtaatttttttttcatatttaatagctaacgctacgacaacgcttgaatggctagctatcaaaacgctatcaaaaccagaaattgataagcagtaattcatgtgacatagcaggtaaagaaatcaaccaaattggtagtaggaaaatcatatcgatattgtgtcaaaatgcatgtaaagatcattacaaaatttcgtcattgacatcgtactacatttcatcaaagttaccgaagaaaaataatgttatgtgggtataaagacaaggcaaccaaaataataaacggatgaattcttataattgaaaataagaccttgttttgcccaagtcattgaagatggtaattgatggctttgctgcgttctttcgcctcccttccaagatcaagtcctaagcaaccatcataaatttggaaatttggatggcacatgaattaaaatctgggtaagcaatttgaaaggatttaaaaaaaatggtgattatggcccgagtcctagtaaaatgtaaccaagagatccttctgcccgatacaccgtagaatatatctttcaacactaaacgcatatcagagtgacaattacaaaaaaaaaaaatgtagtagcagaccactgaaacttgaaactcatctgactcacccaaccaccacaatagaataacaaacttctttaagaaaactgcatcgtggaataacataatgatgaggccctgtgcgttccctaagctttactccctccgtcccaaaataactcaattcctgcgtttccgtgtccaacgtttcaccgtctgtctcatataaaatttttttatgattactattttcattgttgttagataataaaacatgaataatactttatgcgtgacttatcattttaaattttttcataattttttttaaataagacggacagtcaaacgttggacacagaaactcaggaattgagttattttgggacggagggagtaggtgacaccaaaactggagagtgctgcttttttagttcttcaccaaataaaagtcttgcgtatgcaaaatcataatatgaacataccaagcaatagacttagaaatctataaaatttagttctaatttgaaatattttaaaaggttccttaaacaatcaaaacatgtgacatctagattagttaaatatgtaccaaccgtacttgttcacctaatccaaaagtttcatgcctgagatgttatgttacgtgtctatccaaaaggattatattataactctactcagtgcagaataaatcaaaaagcagagatacctcaggattatattattataactctatttcgttttacattataagtcgtttgattttttttaagtttaactaaatttatagtaaaatttaccaatatctaaaataaaatctaacattgaatatatattgataatatgtttgttttatgttcaaaatactaatatatttttatataaacttgatcaaattcagctagaaaaaaaagttaaacaacttataatgaaatggagggagtagaaattaaacacggagcgggcccataaaaagcagaggaccgacgaggagcttcttgtgcggtagcgcacctgcagagtgcagacagagacaaaggcgacgtctatcatgtccctgcgactgcgtctcgccttccgtctcctcttctgctactgcctcctcctcgccgccgctcatccgtcgtcccgccgcctcctccccctcctcgtcgtctccgccgccgaacgcacgaacgtcgccagcctccctggcctcgatggcgcgctcccttcccgcttcgaaaccgggtaaaaaaaatcgaccaaatctaagcttcgattcttttcttgtcctgctctgcatcagccgaagctgagactgagagaggattgtgctcgatcgatcgatcaggtacgtgaccgtcgacgaggagaacggcggcgagctgttctactacttcatcgagtcggagggcgaccccggcgccgaccccgtcctcctctggatcaacggcggcaaccgctgctccgtcctcagcgcgctcttcttcgagatcggtgagaacctcaaccaccaccgctcaccggccggcgcgccaccgctcacccgcctctgtgctgcaggtccggtgaagctggcgatagagccgtacgacggcggcgtgccgcggctgcggtacaacccctacacgtggaccaaggtcgccagcgtcctctttgtcgactcgccggtcggcgccggcttctccttctcccgggaccccagggggtacgacgtcggcgacgtctcctccacgctgcagctcaccaaatttgtcaacaaggtgctcgatcacaaacactaacaacagatcatctcctagttaatttacaccaagtgtgtgtgtgtccgctctaattaaataactgtactgttctttctgcttgtcaaatcaagtggttctctcaacatcgcgaattcctctcgaatccgttgtacgttggtggagaatcctacgctggaaagcttgtcccatttctcctgcagaaaatctcagaaggtaatagtgttctagcccctgcttgtatggctatgattcatcagatgtgcattttatagcttatgaattgatgctctgtatttaaaccagatgttgaggctggagtcaagcctgtgcttaatctcaaggtaaatcatttgcaccatgtacctataaaggatcagtgttcaagagattggctctgctaatgaaaaagttcagggctatctggttggcaacccgggtaccggcgaaagcatcgattacgagtcgaaagtgccttatgctcacggagttggaatcatttcagatcaactatatgaggtactacttcaatttatttacaaacagtagcaactagcagttaactagatgtggaatgccaatagaacgggcttaattctttgtgtctccattggcatgcacttaatcgatattaagactatactggagcattgcggaagagaggattatgccaatcccaagaatgcaacctgcgctcaagctttgaacaggttcagtgaggtaagcaggcttgaacttatgctctgtttttgaggaatactctgcagttattcaggagttttgtcagatattctttatttaccatgaaataaattctagtgcccctaacgcaccattctctaattctcttgtgtaaagatttgtttttcccgggtgtcgctgcacattttcctcagtttgcagtttgtgcactaaaattcaaaaagaacaagaatatctaaacagagaacatgaagtataatggtatgagtattgtgaaaaaagaagaagaaacgaacatcttgaaaacgagataaaatacttaattcaaccgtttaaagtcaaaaagggagtagctacatcccacagcaccagccggtctttgtttaaaggaaggaagaaaattccttgcgtaccttgagtattttcactcaaacccttacatgtgcttaagttttgtgttatcccttaaatgttagtccctactatactcactccattaactaacattacgtttaagttgtttgttagctttttatgaaatgactatattatccctccctggagtatgagtactaacttgttattatcttcatcggttataaaaaatgaagacaacaaagttgcttgaaccaaattttgaaaactgaaatttaaatttcccactgaattgtaattaaatttgatgaaatttcagatgtagaaattacacaagtcaccattttgtctttcatttcaaatcaacttcaaacaatttcgaagaaatctcgcgagagagagagggagggagggagggagggagaggtgaaattacaattttaaattttgtcaaacttaattaaaggttgtttcaaaatataaattttggttttcaaatttgggttaaataatgatgtcccttttgatgttttagagctacattgttttcgttatgtgaaatatgctttaattaagctagcatttctataaaaacaaggggtaatatagtttatccaactaatggaatcaacacaaaggggcttaaacgaaaatttaggagaatgtaaggcaaaacttggtatagttatgtttaggtaaataagaaagctgtctattatatactaaaagtttattaaacctcttacaaacgctctcaaaccatcatgtgagactactacaaatgctgttaaaccacaagtctaataatttagagaaaatcttaaaaatctgaggaaaaaaaatggaaaacttccttcttttaattttcacatttaatttgtgagtccaatattctaaaccgttggattagattagattgatttaaacaaaccacaatattaagccccaaccagcactcggtaaatcttaaatatctatagatgttgcacgtctggtcagggaagattgcgctgggaaggatgtggaggttcactgctagggtgggatatcgatgatactatgctcagttgatcagctctacaatagatttgcagtcaatgtaatgtaaataatttgttcgtggacgcgtatagtggatgtgtaattaaaaagtgccatcaaaactaaaacaaggctaaatgaagagtgccgaactaactaggagaactaaagatttccacaacacatatgcataaaaacacagaaagaatcatctatagcatcaacaacatgagcaatcacatcggtgttcccatgttacagtgctaaaaataatatagcatgtgggacctccatatattatagactacatgttcaacccttcaattccaaacccattatagcagacaattcaatatataaaatataattaaacaatatttcataaagaatcacctaaaattaaaatttcaaatttttacggtaaataagtttatgaaatctaaatcttgattgagagttgtttcattttggatcaccttttaataaatgttttaacttaaaacctgttaaatttacctttatggcactttggaccaccctcgacttttttatctgtctacattaacttgtcatatgcgaaagcaatagtctaaatatagctatgggagtccattaaagagtagaagccgatgcaacttgtaatcattcatatgcttaagaagagagtcagggttgtccaaagtggaatagaggtaaaattactcagttcatagtgaaatattatctaaagggtggttcaaagtgaaacatcgctaacaaaaggtagcccaaagtgaaactttcaaaaagatgcacttcatttcttgcaaaacagatgatggcttcaatccttatcctatggctcaaaaaattacaaaacacattttcccccaaaaataattaactaatctgagataccaggtcacgtgtgcttcaaatatggccgtaccgcagcaccaaccggcagcaagccgcctccccgcaatttcatgtcatatgcacaattctaaatacgaggactccagatctctgacactgccgccacttcggcttgtttagttcgcgaaaagaaaatttttgggtgtcatatcggacgtttgaccagatgtcggaaggggttttcggacacgaataaaaaaactaatttcataactcgtttggaaaccgcgagaagaatcttttgagcctaattaatccgtcattagcacatgtgggttactgtagcacttatggctaatcatggactaattaggctcaaaagatttgtctcgcgatttcacccctaactgtgcaattagtttttttttaaaaaatcaatatttaatggttcatgcatgtgttcaaagattcgatttaatgtttttggaaaaaactttttgggaactaaacaggcccttatattggccttttccgctcggacaccactcaagtcacttcctgtcctatgagctcctaaattgtgaaagcctatgaaaaacctaaatgtctgtaaagttcatccccactaaaaaaatgttaatactaattctctatcatatcataaaaccacattatctaaattgtttttagcctttagatgattcatcaagggtgcgaattatatctcttctcccccaaaatccataccatgcaattgaatcatttataacctttggataattgatgaaggcacaaaatatataagcatatgaacaaaaatcgtatagcaattaagaaagaaaattttacaactcacatatactattttaaagcacatgtaatcttaaaacctatactacaaattacataaatacatgctcagcctttataaatttcacaccctatagtacacagttagatatatcaaatataattaaatgatattttaattaaaagtcaacgaaaattaaatatttaaattttgatggtaacagatttatgacacttcaaataaagtgcttgcacagatgcgcgggttacctttgtagttttcttaaatgactatgggacctggtatagttatgctttattttttcttagaaaatgattatgctttaataaagtgactagaattgatgcttcgctgcagctcatgggagaagtttcagaggcacatattttgtataaaaaatgcatctatgtatctcccaaaccagatgatggtactattggaagaaagattctggaggagattgtagtgggaaaccatcggccaccacgtcctccaatggattgtagtgtaagttgatcttaatgaacagcacacaattttcctgtgatataattacctttttccactcaaggtgctataatccatgctatcaaacattcattcatttgcatcggttggtaatgttaaagataattctctagctaatatttatttaaaataagtttaattaactggcatttgttagggactattaattcaaagttttttttacggagtcaaattattattatttaaattcagaaagaaccaatttagttataccaatttaattaattaaaaatatactcttgctttccaaattatatataatccatccaaatactttggaatgctttgattcaaactgccatcttgctctattttttcctttagagagaaggctcctaatatttatgttaaatgaagataggtgacaaacatatagagagcattattggttagttaacgagataccttacattcaaaaagatattgtttacattatatatatataccttatttgtggataacccccagtaccaaaaatagaacgtagtatatactatactaggtgaaactccgtacgttgctgtggaagtttagtataataacaataagtaagtaatgtgtaagatagctagataacataagcttacataagttgatgtagtctatggtaatttaaatttaaatagtatatatagaatgatgattcaaatgtaaaagatgatgtggcttcgtgagagaagaaaaggagagagataatttggaccatagattaatcatctaagggcaaaaacaattgatatgatatagctaaatgagaggagagaaataatattaactaagtgaggatgaactatataggtgtatgggatgatgatttaacattcgttcattttaaagctctaaagttcaataattataaaataaaattatagataatatagcatgcttgtacgatgtttatatgtaataattattagtgaaagatgatgtgtcatcattgcatgtagagttttagaatttagtgggttatagctttatagtaagataagaattatgcgggatgatgatttaacattcttgcattttaaagaactaaaattcaataattataaaattatagataatatagcatgcttgcatgatgtttaaatgtaataattattagtgaaggatgatgtggcatatataagatcttgctacgccatcaaaacttttgcctgaatcaatacattacttcttctatcaacagacctatcccaactatttgtcatatttctgggctaacagcaacaacacacgggaaaatcttggaataaaaaaggtatttaaattaatattatttttccatatcgactggtagtgtttcacttttgcagtttacatcacacttttcttgtttctcctgatgttcataacatatatagggaactgtggatgagtgggtgaggtgccatgacgatggactaccttattctcaggacatagagagcagtattaagtaccatcaaaatcttacatctagaggctatcgtgtcttggtatacaggtaaccaagttcttgtatgttcacatctcaaaagttttatgattatgaaacgcctagagattatgtgcatgtctcttaacaacaattaataattaagaaccgatctcttattattggtgcttccgctaatacagacagaagcaccaatagtagtagattaaaaggtccaactgttgggaaggatttctcagctcatttctcggcttataacgttatagaccctctaacgtataaccattcgaatttatactattggttgttttcttttctttttttctatgtgttgtcaacttcttatttttgtctttcatatagtggcgaccatgattccgtggttccatttttgggtacacaagcctgggtaagatcactcaactacccaattgtggatgactggagagcctggcatatcgatgggcagtctgcagggtgagaatttataacttgcagatatatagtttgttactgtaacaaaaggcataggaaataattatctgagtatgcaaacttttttccacaattacactttcattttaaagtattattgatttgcagattcacaatcacatatgcaaatgacttgaccttcgctacggtaaaggtaacaacataactacaagttacttctccctctctctcaaaactaagaaagagaaacatgcaattttttttcaacaagaaacaaataccctcatccctaactacatgcaagaaaagaaaatgcatgttgggtatttgatgcttttaaggtgggctctactgctctagtgttatttccagtatgaggcgttgaaacttcacaacaaataactttttttaaaaaaacagaggaactttagttgagctggcagggaaaatttgtcaatttactgctctctgggactttctgataagactgaattgtcttaattatagtgtccttgttaattactggacaaacgtactaatgtgacataacgcacaagaatagatgattatgcattacgtatacaattgcaaataactcggctgtaacgctatttaacccagggtggtggacacactgcaccagagtaccagccggagaggtgtcttgcaatgtttgggagatggatttcagagaaatcactttgacgattgtgtatatcagttatgatgagagctgctttgattattatctaatgaatgatacatcccttggccagttcattgggcaaggaggtagctcaggtgaggcgcattatggtagaacatgccacagaggaccagaacaagctttagatgattactaaagtgaatatgaaaggatacaaataatcctgagatctctcagtgatactctcttcgtttttttaatagatgacaccattaacttttaaacacatgcttgatcattcgtcttttttttaaaaaaaatatgtaaatgtataagatataaatcatgcttaaagtattttgagtaataaaacaagttataataaaataaactataattaaatagttttttttgagaaaggcaaatgattaaactagtaataaaaagtcaacaacatcattcattgaaaaacagaggtagtatatatttgaacatgacctctcgataccctgtggttaagccacgtgacagtttaattgtcagccgttagatctaatctgaacgttcgcacaagcgtgaagcccagcccacatttctttcctggtttctccccatccgcatcgctcacagccgctgccgccgccggacgcggtcgcttcccctcccccgcccgcatgcgtgcgtgccagctgcgcagcgggcccgctagccggcgcactcgcttctccttctcccctgcgcatgtgctcgcttctcctccccgcgtcgcactgccttcctcatcccgcacgcaccagccacgccgcggagccgcgcgtctgtagcgtcggctgcaggtatcgcgagatggagatatgcgccgggagccctagcgccatgctggcctcaaccgcccctacaatggccttcgctgcctcccctcccctctcctccctcgccgctgccgccgccgtgatctcctcctcctccccatcaaaacccctctcacgagcaaagacccctccaccagctctcctccaggctattctccccactgccccccccaaacaccattccctctcctgctctgggtcacaagccccacgtgccaccacaggcgaaggatcggccgtgggggaccgcgggagcggctccggaggaaacaacggcaagggtggcggcggcgacggcgatggcggcgacaacgactatgaggaggccgagttcgggcccctgctcgggttcgatgaggtgctgcgcctcaccgcggcatgcggtgtctcgctcccggccgacatgatgggggcggccaaggatgctagcatccgggaagtcatgttgctccaccacttcgatctgcaggtaatccgaattgcagaagaattgtttgtgacaaggtaaaaaaaaatgtttgtgagaaggtattttcagtccccttttcatctcttaggcagcaccatggcctctagccgcgatgatccgggcattcttgatgctccgcaactgaatgttagcggacccatcattcctcttcaaatttggaaccaaggtgcgtgcatgattgatttgttgtttaagctgaggagttcagattgtcgtcctacggagttttgaggattttgcattcgatgcaggttgtgattgactcgtgctgcgctacgtttgcggaggtgtttgagctgtacgatccatggacagatatgcacgctacggtttgctcgctggcccatgttccttcatcagttatacttcatggagtagatccctaatgcatgaagcactgcttttgtcttatctctgagactctaactaatacttcggccaatccttttttttttgaagcatgctttaatttcgtctaatcgctcgaagtttctttcacattgttaggatgttttgttatcactgtgtgcagaaattaactttgcactggctaagtgaatttgtttgatctgctttgtagggattcatggatacagccatcacccccagtttccattctcttatcctgcacagttcattggatgacatatttgtgattccaaaagagtaatagagggtttgtgtttaggtgttccagcaattgatgcgaatgtcaaaatttatctgctttgcgtccacttaactcttacttcagttctttcttttacatgtaaatattggttgcataaaatctatttttggttgtttacgagtttaccgacattctgaaatcgtaaactgtagggatttttcattttgttcttaccattgtgacttatcttatcaatcttttgtctcagccttttaggtctgaattaaacgcagagagttggaacagtcaagacatcaagtagtagcagattatcactacgtttcaaggtgttccagaaatcctgacacaagatcaaatttataattctgattaagcactgtagcacatcatcaccattagttgtttggcacatcgtcttatctattactgaaggttgcatatattctgatcctgtattacctgattattcttttctgcgaatttctaaataatatttattgtgttcgtggttatacttagatcagtcaaacacccatcacaagagctatatatatataacatgtggatagttggatgagaagacgatgaaatgaattggctacctttgatagaacaatataaattgtcactggatacattgcaaccttctatatgtaagctacatcgtgacagcatttgatgaataatacactaatgaattgtatgttaactcatgacctaagtatgtagtatccttttgaagttttggctcaaatgttgatcaaaaagtccatttatttatctctttaattttctaacttgaggatggatgcacatcctatccaattgcataatattgagtatgtcctgcagcaacgcacgggtttcctctagtttccaaacgaatatttctcggcaaggcaaacactgcagcttgtccatttcttccctttgcgggagtagttttcaatgattgcgatggtaatggaaagagaaccgtttccatcgttgtcattgccgttgccgttgttgttcccattctcgctgccaaccatgatgaagaggaaatagtgattagtgaatgtagtcgttcacgaacaacagccaacagtcgcacaatgtattttctaaaaacttgactcgccttatcttctcggtgcaagatcagggaggtggggggagggggttccgaaccgctgtcccaacatccatggacgcagacgtcgggatgggaaaaccatatagtaatagcgtggaaaatagagagttgtgtgttgtcacgtgctcttatatgggagatatttagtgccttctattggactcaagtaagaggaagagaaaaaaaatagccatgaataataagtaaccgacattggctttccattttgaattaagtagacgttttaataatcaatccgttggagagttatatgtgttgtaggattgaaacaagaactaggcctaccagagaggggtgaatggtaggaacacaaaaatctgaaaacttctaacaaaattaaaagttaccctcaaaccagttggagataggtcttactggtgtagatgcgccggtctgatcacctgactgccatcgatctgaccgattggagttgctctagtccgaccaccctacacatcgttgtcaccaatcgctacacaggttcctccacttctcgtcacaacttttggatctgagtctactatgtacccttgggttcagcttgggcatagctctaccatgtctgaacatgggcctagggaggtgcaggttctgattcactcattggatggctctgatttctccgataacaatactatctatagctccgacgactctaccccactccgtgaggtgttcatggctttgaaaggagccaaggatgaacaagctcgaatctagagagaagcggaagaggaataccttcgtaaggaggtagaagatcgtctgcgtcatgattggcattgtgatctaacaacctgaggatgcacggctcacgacaatatcatccaaatgggccacgacgaccacaatgttcgtcgccccacggcacaatgttgttgcgatagtcatgctgttggaccttgtacttgaagccatacccgaccaccaggtgactccgaccctcaacaaagacaaagccatgatgaccacgacgtcttcctagcaagtaggaggatcaagttgcaattttcgccgtccaagccaattacattccaatccgtcgctgagttacctaaaactctagctggcaatcaccctaaccaagagctgtctgggcgtccctctgcgaaaaaccactcggtggcaggcaacaaaggacataccgcttcatccctaaggtgacgtcaaaatggaaaccgtcgaccagctccttcagtagcggacaggcttttaatcgtcaggatggaggatatcgcattggtaaccaccacgacgatggacgccattgtgaagaaatacgcgatcataggaacaatgaggacctcagagatgagctcaactgatggcactgggagcgtgaaaatcatgaccaccatggctatcataattccccactcactatgagggatcacaggatatgatgccgatgaagggattcctgcgttcactcctaaccttcaccgagtggattggcaaccggattcaagcctacaagtatcgagaaatatgatggtaagaccaagccagaatccttgttgacagtatacactttagcaatcagagcagctggaggagatagcaaggccatggtaaactacttaccggcaacattcaccgactcatagaggaactggctttggggattccatggggatctaatgattcctggtgcgagcttcaggagcaattcattgcaaatttcaagggtacttacgagaggcctggtactcagttcgatctatagcacatccattagaagaaaaattaatccctaaaagattacatcacgcggttccctgaaacaaaaaaaaagacccaatggtcatggatgacattattatcgctacctttcaaaagcgactccatgatgagaaccttattggcaagtttctgaccaccgtgacgaagctatttgagacatacaatccatatgccaagtcagcagatgcaaccaatgatgctcacgacgataagccaccggatgctccatgcccaaaggagagaagagataacagagaatttaatcggagagagatcggaagcgtaggccagaataattggcagcgactattgggaactaccagccgcagcaccctcctcacaacaattatgatatgatctaaatgggctctacaagaaattcgctgaagatcatgccaaacaactccaggcgccagccggtgagggtagctccggcaaggataaggccaaggacaaaccggaccacatggacccgagtggattccaggatcaccgagtcgagctaaaccatatttttggaggccccttggcatgagtagaaggggaagcaaaagctaaccgactgtgaaattaatatggttcagccgaatgtaccccaatacatacgagggtcgatgttcgcaatcatgtttgaccactcggatcattctgaccaagtggctcgcccggggcggtatcccttagtccttgacccggttatcaagaaaatcaaattcagagggtcctcattggtggaggcagtgcgctttatattttgtttgcaaaaacactggatgagatgaagattctggatgagatgaagattccaaggtcagagttgaagccaagcactgctccatttcacgggttattcccgggctgtcttcaacaccactcgtccaaattactctagagtaatctctatccccacagattacaccactagacaatggtttatatcatcgccctcttcatctttgtcaagtgaacacacctctactaataaaaggctatggacaattctgctagtgcttcgcttgctcatgcagttatggtatactccctccgttctgaaacataagacattttggctggatgggatatatcgtaacactacgaatctagacaggtaaccaaaatcccttatattttagaacgaagggagtattatcttcactctggcatcaaaagctattgcttgttcttgcaaatgagatagacctgccagtttctcatgtcagtttctcctatttttagatgttgtgtgactaatttgtctatggcagttgctatgagtagcttcatactcctcctatccaaaataagtgcagttgtcactagtatagatccgggcatccttgatgagccaccagtgtcgggctagtgcgactcgtttactttagtgctttacctaatgccttcactcggatgagtcattcctaacagttcaaaaagtatcccgtttaagatatgactatcggggatgacccctcaccgatataaggtcatctttattggcttgtagttctaacacgtcatatatgacttataacgggtctcaattatatcccatcacggataaaatgtcatccgtgacgagtgtaatgggatgacccattaaagatgagagcactcatccgtgatgggtcttaattaccatccttcacggataacattatttgtaaaggatggtagttactaaccatcatggatgaagaaaaatttaaatttttgaaattttcaaataaccttagatagagacataccatatataaaagttatagatctcgatgagatctataactttaaagcggacaatattttaatatgagatagtttatatgcccaagaatgcattataagtggcaagatatatttttaaaagacataattttgaatttttaccttgatctcggatggagacgtttcctatatcaaagtcaaagggtttgatgaaatataattgacaatattttcatttaagattgttttcatccccgaatatgtttataagtgatgtgatctatttccaaaatattttttgaattttccaaacaaccttggatggagacatatcctacattaaagagttgaaagcgttctcgtttgaactcatctagggtttcaaatttttgtttcagatttggataagaatagttaaaaaaaatagcatcgatccctgatcaacatgtggtctataggtgagatggcacgattgattttcattcgttaagaggtcttgggtttgaatcccacttaagacatgcatgcatatcatttgaaaaatcatgaatttttatctagtgatgtgtgaccatggttggaatatcctaatgatatttttaggggtttctatgcatttaaaattcaaaaaacataaattcttatccgtgaaggtttgtaattatgaactgtcacgaataactctcatccacgacaggtcgtaactaccacccattacggatgagagttatccatgatggtcttttatttacacccgacaaagatgactgttatcggtgacggctgccagcccgacacaaatgagttttcacatcactaaccaatgatctatgaccaagccactcaccgacactgatgtggatttccacctgacgcagatgaccaaatccacactagggcgtgtgggatggagggaatactaagattcatcatcatattttacattgtttatttctcgattacactgaatggaaaagtactaataattccaactcgcacaaaccaataaaaaatagtgctagaggtgcaaacaaaaccactacccaaagttcaaaacaaacactaaatgccattccattatattcagcacataactcatcgaagtatatactactacccaaatcccagattgatgtatatactattttgttcgaatagattaacacacacttcacaaaaccaacatttatggcagtttaactgaatccatgatcgctctcaccaagcagaaccttcatctgatttctcttccggattccaacctggagacgccatagattcagaacagaatctggcagtagagatgcaaagaaccactggatcgagtggcgccagtaggggacacatcttggctcataaccgatgcagcggacagcagccttggcgtactcctcgggtgatggtataaacggcgagttaccctggacaggtgacatctttgtggcgacatataatggtatctgcacaaaaaattggttagggcaccacttgagatgacaatggagaaatatgtgatgtacatatgggtagtggattttttattttacgtgatggggtaatgagaggcacatattttctggtgttaatttgtagtgcatttcgatgtcttctgaagaagagtaaaacactcaatccattatgtaatatatgtttggaaacaagatataagttttctagaagttaaaagaaattaagaatatcggtaggttaattttatactttttataatattgtagcaattttagtattttattttacaatatgttaaaaatgagctatgcaatattttcaaagcctaaataatgtgctcataactgccttttattttcacctcgctctagaaatgatctttataaatgtcgaaaacccatttttgcaaaggcctcccactattgtatgaaaaaaaatcagtatcttttcaaccgtgcgacacaaccgcacgttagaacccattttcataggccgcctgtaaaaaattatttttaagcgaccaaattaggacgttcaactaaaagaaaacaaaacgaatctagacaccccagttagggccgctgtcaccgccactaccgggcaccactgtcatcatcacgcagttgatgtcaaggtcgtcgtcatgccgttaaggctatggtcttcgtctacttggctcctccacctccactctcagtagccgcagacggcaaatccacccgtccgaggccgctaccgatggatccaccgccgcctacaccaccacacgtgccgggaggtagagagctaagaggaggggaaagtgacagtagtgatagatccacatcacccatggccacgaccgtcgtcgtcttcgtgtatccgccgctaacagccccacactgctccaagctaccggatccgactggtggtgccaaatccgccccttctcacctcgccagatgtaatgcctttggccccacccctccctacccttttgctgccgccactaggtctagccgacacaaggtcgttggggccggatctgcccatcaaggtgccaggcgatagcggatccacccgttgttgcagtggctcccaccgctgtccaccgaccccgcactcctctgcagacctcttgtggcaaaccgccccttctgttagggcctgctggctgctccttttgtcggtcatcaaggagagcagatagagggaggaggggagaacagaagagggacgagagcactaaggagaggagtagacatgacagaaaaggacttagcgcaaggaggagaatataggagagggagccggcatgtgagaaaattcatacgtaggccgtttaacagtcctgtctataaaaataaaccttttattttgcatgcaggcctcttccagatctgcctatgagaatgaattttcgcacatagttctttacaaggcaccttcgaaatacatagcttcttttagcccgtccaaaaagaaaataaaggggtgttttattaaactttgaagctgaaataaatgttcaggcaataaacattgtaaaaagataacaaatgttacctggcattgcacatccactccgtgatgcttgtattcaacatgtagacttcgagacaattggtcaacatacctaaaaaaagggtattagaaaaatggtatcagagcaggtacaataacagactattagctagctacaaacatattttaatgagataaaagatgagagagaagagcagcgggctacagatctgtagtcagctatagtacggactccaagacgcaatgtgtgtatgacatgtgggaccatatattaatagtatagtaagcaatattgtataaattagctattaaatcggctacagatgaattggagctagtagtggactatactattaaacttgctctcataagaaatttaagttagagcagtcatattaattacctagagattagtacgtacctaaacttatattatcttgtttgcccctatgtattgagtaacattcccaaattgttacggtccctcttatgtgacgctcatttggtatgtgacatgcacattaaagtggcataccacacggatatttcggtcccaaatttttttctttgttttttccacacgaacagaagggaagaagagaagaaaattagaagaaaaaaagataaaatagaatgactcaacaccgatgttccaaatgagcatcatatcggtgttccaaatgagcatcatgtaggatctcgaggcgtcatgacaattttaaaaatatattttaaaagttcatagatctggatgatatacttagacaaatcttatctcatatatatagtgaaagaagtgaatcagctttcttgcacaatgatgtggcacaacatcaaaacatattggctaagcatgcattaatacaaatagagcatatgggaattaataaaaaaacacaaactgactaagcatatgggaatttatggatgtttctggtgattcatcttggacacatgatacaaatagagagagggggcaaaagacaacgaagaaaaaaaaaatccagaagactttctagtgattcctcatgtgaacatatagtataacttagctaaatctataattagttaggccaatgaatattttgtaaataaattaacttatgttaaaaccttctagaagctaagataaactaataaagcatatataaaagttcttaaacatgatcaaaatttgtgcaaagcgcgactatatggttagtcattgatgatatatatagacaaacaagtttaaaggccgacaatacactttacccaatatgatatttaagttactttgagatgtgcttttcttcaattgtttgttttcagcattatattcaaatgattattgttttctctgaaatatcaatgagaatataccatctggatatatgcatgattgctatattaatttattatttatgtcgtttctcaatatataattattggccggtcctccatgttattcgccgggggaacaaagcatgaacttttccgtcatatacgaacggacattaacgagcattcatatgccatgtgcatttggacggtgatcaatcgttggcttgcacttataatgggaagtttggttcaacgttgaaatatgccataccacggccatatcttagacatgacgagactaaataatacgaggtacttttttatctcaaaataacttcatctcttccttcaccaatttaactcataaagactttatttttaaataatcaaaatattaggacttgttaaagttggcgataaacgtggtgggcttggacttgataaagttaaagacaaaagtactgaaaattaataaagtaaaagatattttaatcttctaaatcttatattggtaattgtaacatagattaaaaaataaagttaatttaaaacagaaatagcatgagaatagccagtagaatttgtggcttaaaaaactatatacgacgacatacatgtgacacctaaacaaacaactgcatcaaaatgttgcaccaaaccgctcaacaaatcttctcactgtagattttgcctttttttaagagtgaattgcacttagtttcatgttagaccatccctagttcaatctttctactttccactagctaaatttatgatggttttactttgtaccgcctaaaccacttcggttctagtacgctagcgaaatccttcacctatgaacagaacatatcatgttatttgtctgagtataggatggacataactaagaaaagattcgggaggtctgaagcactactagaaaaacgatttttagcaacattggccttttatttttccaagcgggtatgaccatcggacccaaatatccgcctagaaaaatataaactgaggtgaattttcgtcatccgcctacgaaaatcgatttatccaggcggaccacttaagcgatccggctgcgaaaatacctttaattttacaggcggaatgcttaagtggcccgcttggaaaaatcgattttcacaagcggaaccttacgtggtccgcctgagaaaatcatacctccaccgaaaaatatctaagtcacagactcaagtactcaatcttatcttcaactcaaccccgccccaccactcaccctctcctctccatctcgcatattatcttcaactcaactcagcaaggccgcggcagggcgtcagcagcagcgtcggcgtcggcgttggcgtcgccgtcgacaccaacgagcggtggcggctccgagaaggagcggtgtgtgcgcgacgagcggcggcgtaggctcgtctcctcaccacctccgctggccgcttccctcctcgccccctccgctgccggccactaggagcgacgacaacggctctcctcctccgctgccggcttccctcctcgccgcctccgccggccgcttccgctcctcgccccctccgctgccggccacgacgaacgacgacgacggctcgcctcctccaccgctggcttccctcctcgccggctccgccaccgatcacgacgggtgatgatgacggctcgcatccggccgctggctcccctcctcgttgacgcgatgacgacactgacggtgttgatgcgacgatgatgatgacgtcgcctgtggaggccggcggacggaggagacacggcggctcggctcctccctctcctatgtggaggcaatggcggacggaggagagccgtggccggaaggtgaggccggtggcggcgccagtggttaggttggtggtttttttaaaaaaatttttctaagatgattttcgttggcgggccacgggcccgcctgcgaaaatggtctattttcgcaggcgatagggtagcggcggtccttccccccacctgcgacacatgttttgggccgcctgaaaaaaccttttttctagtagtgaagtgcaacaaccctaaattcaactataaccagtccaaagtaaaactacaacaataaaagatcatgcaaatataattcactttttttgttgtttaagatcgaaacttcctattaattaattgcttatatgcatgcacccatatgatgcagtctttttaagcattgattcttctcacataaaaaattaaatcaaattggcattaacatttaattttctgagaatcaatcacttggcttttcaaaagtataaatttgctacaattttgcatcggtatctcacagaactaagagaatagcaaagcaattttatcacagagccacagctacgtacctttagccctcttgatctatatgatatatgggtcttgcatacaccaacataaatattgcgtgtgtgtaagataagtaggcccaaaagttgtcaaacaaataaaatttatagctttcagatataaccgtacattattgttgtatttctccaaatatttgtaaaatgtatatataaaattattgtaaattggtaatttttaataaaaatatagttgcaatcatctgaaatttacttttttgaaaacaactgataaagaaaaaagtaaatcaatttaaccttttattgcatgcagtgaagtttgggatgtatactctctctctctttcaaaataattaaacctaggataggtgtgcatttaactatttgctacttttaaaatgtgacaattaagaatttatcattggcagtttatgacacgtaggttcagtgacatatttaattgccacttgtaagagtggcacataattaaatatctctagtacaaagtatgatatattctagtgctcttatatatatttatagtaatacgaaccatcacatatcgtattaggttattattttggttattattttagacgaaggaagtactccacatattgcatgaatagtgatagcactgcaacgtgccttttggcgcctgccaccactagatgatacacttgtgttgacttaaggtggtgtcatgccatcctgccaattgatgggctattaatgtagaactgtactccatacatgccagtagatggttgtttctagatgtcaaattgcacaatttgttccgatgatagaaaaacatttaattagagtcaagtttctgcatggatcaacaaagtcaaattacgttgggagtatcttaaaaaactgctacaagtttttttttgactgaaaagtcgaaaaactttgaaaggtaactatattataattgtaactacactgtaactttttttaatcaagctatatataactatgatataacttatatttagttggctagcaccatgatcttacacgtgacgtgtgaaaagaaatttgtagctacttttttccttcatgcatatataaatctcgaggcaatccaatagttacaaatatgaaagttcttggagcaaagaaacgtgcgaaagttttgtaacacttttccttcttttaattactcgtcgtttgttgtaagtaagacatatatctttcactatcacttttttcaaatccaggccatgtagtttaccaataattgaattatatatttaaagtattttcataaatcttattacattaaattatatttgtttataggagtagatgggttaaagatttaaaatgtttgacttagaacaaacgtgaaacgatcagtaattttctaagacttgttttaagaaggttagttgttaagttgcgctaattttggtcagctttagaaataaatttaggattaaactagaaaaaaatacttatgagcatgacacgatagctttgaagattggaaggatggattgacttacgctttggtcgctgcgtacacggcgtagagcgggaacgccggcacgacgacggaggagccggagccgacgttgacgacggcacccctccccttcgccgccatggccggcacgagggcgcgcgcgatcctcgtcgccgccaccacgttcacccgcagcaccgcctcccagaccgcgtcgggcacctcgtggaagtacgccgcgcacgggtacgtcgcgccggcgttgttcacgagcagccccacgtcgagcccctccacggccgccgccaccctcgccacgccgcgggacagctcgccgcccccgacgtcgtcgtcccctggggcggcgaggtcgaacaccacggtcctcaccttgcacgccggcgccgctgcgcggacctccttgcagacgcccgacagcttcccggggttccgccccacgagcacgaggtggagcccgcggcgagccagctccagcgccaccgcgcgtccgatgccgtcggtggcgccggtgaccaccgcccactcgccgtaccgccggcacaggcccttcccgggccggaggaacgcgcggcggagccacgcgaggaacgtccccgcccacacgaccgccgcgtgcaggccgacggcgaccagcgccacgaaccacatcggcgtcgccggcgccggtgcagcggccagatctccggccaccaccacggactccatgttcttcgcgccggcggccgaacagcttgctatatcagggcattcgcaacgttagcagcggttcttttttatgagcatgagcggaagccaagtgcaagcatttgagaactgcaacagtggagtggtgcttgcgcctacgccctacagttggtaggtccgtcagtaatggcgagtgaatgcaagcaaaggtggtggatggctagctttgccgtgtggagagaaatctctctacatatgcaagcgcaagcatatgacatcgcatatggcagattggcagcatgggtgatgatgatggctactctggtccatgggtaatcaacacgcaacagagtactactattgttgcatgatcagtactttgtacaatgtgtcctatttaatgggagagtttgttctatcgtttttatcttcgatcactactccattatgtttgtaatatgatacagtaatttaatagagtaatgtctcgatctacgaatatataggggtttttttagctttaatagtataattctatcataattgtctttggctgtgtttagttccatgccgaaattggaagtttgaataaaaaaattagaagtttgtgtgtaggaaagttttgatgtgatggaaaagttgaaagtttgaagaaaaagttaggaactaaaccaagctttttttccctaatagcttgtttgatttgaaagggattgagagggaataatttcacaccaaaataggtgtggaataaggtggtgtttggatcagtgacaaaactttagtccttgtcatataggatatttggacactaatttagagctttaaatatagactacttacaaaactaattatataaatgagagctaattcacgagatattttttaagcctaattaatccataattagagaatgtttaatgtaacatcacatatgctaatcatggattaattaaactcaatagattcgtcgtccagggttatgtaatgagttttttttattagtctacatttaatacttctaattagtgtacaaacatccgatgtgatagggactaaaattttttacccccatccaaacaccccctaaatcccttccaattaatccctccctcaaggggattaaccgaacaaggtctaagcgtgaagaaattcaagatgatacattacacatagatgcaatactaaaggtacatgtaccaaaaagatttataattttcgatgatatttttagtggatgtataacgtgtgtacatgcacaggtttatgtgcatagtatatatcccaagttagatatattaaacattatagtacacttccagaagatataacggtgtgatgattaatcatccgtcttactacacaatataaatgatcaacttttttttgacataaaactttataaaaatgatcagcttactacaagagtaatcgcgtgatcacactggtcctaggtgaagcaaggactagctgtgaatttatagctgagctatagcatatatacgaaaacagtacctacattattttgtggtcctccttaacccagatgtgcactatgaccacaccctccattggttattggagaataaatactggttgtttacggagactaataaaatgacagcgtactaaacggtaatatatagtcttaccataaaaacatatgtagaattaatttgaaaatgcattctttacttcatttttttctttatttaatttggtattcaagtcgaagaagaaatacaagaattctataattacttttttctttttttgcgggttataattacttttttcaatgaaacatcctagcgtttactcaaagagttacacacaattattacataagtcacacagaaaagttcacaatagcagaaacgaagctaagcaaacacaaactaatagacaccaatagaagaaaaagatcccctaactactaaagaattctataattactaaataattttttcattgcaatattttattcagttaatatatagttattttgttatggaaaaatagatagctaatctaatatattaattaatttttttgggaggttgatagttcatttgttggagaagagtcgattattctctttatcatttcatttatcatttcaccattgatcatctagagtactccgttggggatagaaattccataatgaagtacaagtcataagcaaagcaattatatttcattactatgatagaatatgagtttaaataaattgtatctgtgcagaatcttttcaaatagatactaaactccttttattcatatttgttcatggatagcaaagcaatttaaattagtacagaaaaccagactaattgttacggctaaaagtaaacactaccaaggatctcccctggtagatgatgattcttggtagaaaccatcattgctgtaaaatcaacatggaactaattatctgacctaaaattagagtgacatggtcgctcatactatctccatcctataaaaatctggatacacatatgttcagattcattgtaataatttattgtactataatgtgttacatcccgtcccaaattcttttttttgaaacggagggagtacgtggaaatatgtggaatgtaccgacatgccaatgtccaccatgtaagggccaggttgtagttgggttagaggatcttattccgaatcaccaatccaaatgctattggatgaggagtctttatcggatggcggcgaagaatttatttcttcggcggttgatatagtgcacggtgagttcaacaatggtgaagttcaaaaggtggtggatatgttttaggtcatacagtaattaatcaggaaaatttgactggtcattggagattgtataatgattatttttccaaggaacctacataccttgatgttcagtttagacgcaggtttgtagccgtgccttttgttttgtcaatctttgtttgcaaaattgatatagacgagaattattattgttaattactgtgcaggtttagaatgagacaacctctctttttacgcataatgaatgctattgaagcacataatgaatattttgtgcagaagagaaatgcgactggtatccttggactgtcatgtttacaaaaggtaacaacagtatcacgcatgttatgttatggaatagcaacagatgcaattgatgagtatgttcgtattggaggtagtaccgttattgagagttttaaaaggtttgtggtggctgttgatgaagtttatggagaggagtatatgagaacaccaaacgagaatgacaaagctagattacttgctcaggggggagaaagagggctcccaggaaagttgggttctttagattgtttgcattggtagtggaagaactactagaccgcatggcaaggctagtatataaagagaaagagtaagttcctactttagttttagaagccgttgcctcacatgactgatggatttggtatgcgttcttcggttcacctaattctcacaatgatattaatgtccttccacggttgccattgtttgcaaagctagcttaagagcacgctcctaaagttaattttagtatcaaagggcatgactatgggttactatcttacatatggtatttatccttcatgggcaacacttgtgaagagcatgaagctaccacaaggaaataagaggaaatattttaccaaagcacaagaagctgctaagaaggacattgaacaaccatttggagtgcttcaagctcactttgctattacccgtggaccccctcgtttttggaggagggggtgattgttggacccaatttttattttggtattcctaattcagatttttggggaatcaaatattgggtggttgatgggcatgctctaattgcccccaattaatttggaatttgggcatcggattgggggggatttggtcgggaaagaagctaggttttcgggagagagaggaggccggcggctggaggtcggggacgatcagcgtgtgggtcccacctaccagcgcacacgctgccgcgcgcgtgcatgcagcgcccgtgaggggcacgtgaggcacgcatgtgtcacgcctggaaattcccgaatagaatttcaagcagaatgtgaccggccagggtacacaaatgacaatgttgtcatcaatggttgcagtctatcagcaaaaactttacaaataatttttacaaagaaattcatgagggagatcagcctgaagtcattaggggattgaggactaggcttctttgggaccaaagttttgtaagaatatttgattgcagataagttaacggtacttccccagaaatcagtacaaagtctacagaagtcttgagcaattattccctagcaagatttaaaaaaacacccatcgaagccatctggttcaagagctttgtcaccaggcatttttttcacagtctcatcaatctccttagtggttatctgtgcacataaagaagagagatcccctttgtcttctatcaactcagagacatcaaaaaccatttcaggattatcagtaagccccattctatccttgaaactttccaaaagatggcaccctttccttcatgatcactcacttgattgccatttgaatcttgaagaaaggagatgtcattatttctaaatctttcagtggccatggcatgaaagaactaagtgttttcccctccaagaagaaccagtttctgtttaaatatttgcttccaatattgttactgccaacttagaagagaagcaacttggcttttaacaatcattttgaatcttagctctggaacattcaataagcggaattcatccagtttatcaagaaacaagatcaccttgttacaattctctgtagtcctggagagtttagccaaacaagaactccactttttaagagagcttcttaatcttttgaaattggccgaaattatgtttgcctgatcttgagtaactctgaagccctccaacacatttctgacttgatcatgaaaacctgcctaattcagccaaaagttttcaaagcgaaatacatttgatttggggattgtagtagcaatttggactttaatcgaagcatgatcagaggcacttctagccatcaccaaagcatgagtattaggtaaaaacctactcaagttgctcaagaagaggatcaacttgcatgttgctccatgtataagaacggccttgcaaaggaatttctagaagcccttgagagctaatgacttcattaaatataaaattatcgttcatattacctcctggcttatttctgttctcgactgatcagtagaaattaaagtccccaaggacaatccaatagtcattatcaatctgtagatcttgcaaccaatttacaaagtcatctctaccaggaccatgggaaggaccatagacatttactaaaacccaagttaacccattcatctttcaggtaaaacttatcactagggcatgttgagtttgctccacaagagaacccgaaaagacataactacaccaaccaactaggacacccctgaagcacccactgagggggagaaaagatagctatcaaatctttttagggctaaagatctaatgaagctgtggtcaaagagatccttctttgtctcttgcaggcaaaaaattgaacatgcgctttcatctattttctgcttaacagcatgacagctagctagagaatttaacccccttacattccaacaaagaacattccaggattaaagaacagaactaaaggtccatgcatagcataacacccacagtgaccatgtctgacacaaaaaaatccaaatatccaggcagacacaagagaggagctggtactgaataagaaaagtatgacagcaaccccacaggctttaattacaagtctagtcccacaaaaataaacagcaattcaacccattaagcaaatcatggagaagcatcaacatgtttcccagctctagtctgggaagtcaaggcctcagctgacacctcctccttgccaagaccacaaagatcaacccctatctgctgtagaagctgaatagaacaatcaaagggggcagcgtcagtgtcatcaccagaattaggaggatcagtgaattccaggggcaatggattaagggagaataaaataccactctcttcagccaaagctttaagcttcttagaactcttggcctttgtttttctccttaggcttacccacaccctgattgggatcaggggacatgaagccatatgtcaacttgttgattcttgcactccttcttctaccagagtcaataagaaccacttttcccaaatttcttttacccctgctaggcttgggaagcagggttggagatatgtcctgttgaaaaggattagctgggagctccaagggggtaggatcagcatgagggtaaacagcttgaatgggctgaactgtcaaagcctattgagcagtccaattatccttggcccagatcaaagaagaggccagcagagcaaactggaccatctgatgaactgccagctgatagtgggctaaagcattggtctggcccagaatacatccactagcagcattcagccttggcccacccagaacaaacctatagatactgagcaatttccagaattgggggtaaactagcaaggataaaatagttccagatacatcctgcactttattgacaatggatctaccaggaattgaaacaataggtgcatgactttgcaaaactagaattatttgccaatcccctaagtattgttgagaaacaacacttatgttatgagactgctcttcatgggcttcattattgctgttctcccccatatcttcatcagcattttccaaattagcatttccttgttgatcaacttgttgtggctccagaattggaatatggtttactagggcaggtcttcatcagccggctgagcattagcaaagtccccattcaggacaaaaatagaaatagtccaggatcgcccaactcccccaaaactagtgtactttttaatcactatcttggaggggacttcttctaccatggagaagatgactttagccagaactctgcctctgaacctcgggtcgttagaccatctaagcaatcgaccaaatgtgcctactgccttgtctataatgcggtcagtttgaagatccaaaggaaaatccagaaacatcacccaactttgactaattggaggagaattacgacaagtagaagtgttgtcatggtaggagaaccttagtacaaactgataattgaccaaataggcccccctaagaactagggcatctcttaaaacaacagaagctaagtgaacataagcaaactccgaagcatgcctactagtatccaaaacatggaatccaagagtattctgaacataatctactatcatctggatgaactgggcatagagttcaagcagcgaagggggcaagaagcatcttcatgcctcttcgggggatcatctgtgataatcaaatccgcacgagggaggcgatgcatccaagcatcattgatggctattgcaggggcacgaacagggttgggtctggattaacattcgccattggagaatcttaggcactgtagattggactgggagcaagaagcaaggaagaagaagcggtggacggaaactgcctagaatcgaggcaagtaatcggacaagagctgattaaaatatttttatttacggccacatgagataacttcggagccactgagacaatctccaaaaaactgggctgcgaactgggttgggccttgtggacccaagattggctcttattctttttattccaacagaccaaagcctggtgatccagtttgtagcaagaggcacaacgcactctactaatacattcagactccaagtggcccaattttaaacacttgggacaaggaggcccagtggggtttgctttctttttagaggaaggcggattcaacacttttgaatttgaattatcaacagagtcagcaaaaaccacgcccttacctttagacttatccgaagaaccagcatcaatcactcccttgaaattagactttgaaattgaaatacttgatgatcctgcattaaccccgcctgcatgaatcacgccgtcgacagcagaatgattgagacccttaccaccgacggtgatcgccggaaaagaagaagaaagccaatcaaaaacaaacttaaccggaataagagaattgcccattcgaacactagagtgagctctaagaaaatccttcggtcatgcggggaccagcacctactacacctacaatgggtggcaatatttcatcttattttttttatgatttttctactttgattttactttgattatcttttcaaacatcgctcagagctcacgaaactttactttgatttgatttgaaaaaaaaaatttgctactagaatgctgctgagtacacagattcctgatttgtggttaaaaacctgtgacatcttttttttctttcattggactacggtccactctgcctccaaatcagttgaccaaatctcatactctttgcgccaatttggatcactgtctctccaaaggaaaaactgagcttcataatctttgcaggagaaagattggagggtgtaaacccaaagcccaactttctttgaacacaataagaaactataacatgaagatcacccggagaaccaccaatgcaagcacgcaaagcaagagcagcagatgaagaacataaacggaatgaagaacgagggaaatccaccactaggatgaacggacgacgagagaaaaaccgggaaaaatgcaccggagaatgtaacctggagaggacctcatccccaatgtgatcatccagggagaagtcccaccctcccggcggccctgggctcaccatcaccggagaggagcccgatcaccaagatcgcctcacaatcacctcaccacccttccggaaaacgcggagctccagtcttcattaattgggtaatattgacggtagaaattattcaagtaaaatttgagggctctttttagatcatggagaatttaagaaaaatactctggaccacattcgcatttttcttgtacgcattttaatgttgccaatttcttttaggattttaataaattatattattacttttaaaaaatgatttttaatttggaatgaatttatcaggacgtgacaatgaccatgcattttcgaagtctataaaatcgaggggcttagaagatgtatctcccattaactaaaagggaaatcccatctcatttattcacatcccactacatacttcatgaaaaaccctaactaccaattacggagtgcatttggtagccccaaagtgacttactttgagctacaaggattctacaccaaaactacttgagatcaaccgatgacaatttataatccttagaatgtcttatgttctgtgtatccaataatatggtctacaacttgtggacgatttggcatctctatattatacacatgagacaagattatcaattaatacctatgctgatgttggaatcatatttttccatatatgatagacactcgttgatcttatgaaaataacaagtaatatcacataaagattctcaggaataagtcacacactcattggtcaacaatgaattatctatttcaaggaacactttattattaatttataaacataatacatggtacaatcatatctatgagtaactaaaccagtgtagctcgactaatagagctccataggttgtctggttgtgaggtttaggccatgcaccaagtattatccgcgatcacatcccacaaggttctgtttattcgtttggatattgcatatgcttgcggcatggcatcttttggtcatagcccattcatcccgactaaatcccagaatcgggttgtggacccatccccaatggtaatgaaaggccaccataggttgttggcgagcatgttcttttccatttgatttgcattttccacccgttatgttgcccatacccacccagaggaagctctttctctgcttgtcaagcacttctagagattccttagtgacctctattgatgtcaaaaggtaaacgggctgcgaggagagcattgacttgaccaacgtagtgcgtccggttagcctcatgtttctcccgcgccaagttgccattctacccaaggttttttcgaaaagaggttgtaagtacaacttacgcaacgaccgacagcaagaggtagccctaggtatgtcattggcagggatgctctcaagactagtgttttctgtagcacgttattcagatctatgctctcacatctgattacttttacctgggatttctgaatgttggtggagagaccagttgcttggccgagtttgcatagcaggttgaagaaagcttgcacttcacttttgacaggtttgatgaaaactgttgcaccgtctgcataaagcaagattcgaaggcgtgcagatcgacctcccagcttactaagcagcttcaaatccgtggcgttgtcaagcagccgttgcaacgggacgatcgcaaggatgaagaggagtggcgagagcgggtctccttgccgcaaccctcatccatgtgatttgttaagttttaggtaattcacgtacctaaaagtaaaatgatatgatgatttagggggcgcttggaaatggaaatagcacaaaatttatggatgtgggtggctgaaccgaatggaattctcagatagcacctaaatgtaatacctaacacaatagatgggttgcgttaagctttcatgggcatataaggtccatggtgaattggagaataaacctacatatgtggagacaaagaacgaccgatcatatcaaatcacaaatgattatattttgtaaggatttactgctatattcatgcttcctttcagtgcacgacagaacaaaaaacaaaatcaagcaactctctctctctctctctctctctctctctctctctcaacaaaactaaagaaaagattagataaagcaacgtaataacagtgtcaaacaaatggcaaaccagtaatcaacattcaacaacgtattgttctcatggtacttggtagtcgtgttaaactgataacagtatgtaagcccaaaatttaccaagaaatgatccaaagaacaataaatgaggtgatcatttggtgtcaatggctcaaagcaccaaggaagcatataggctaaagattttgtttatcagaagcaattgctcgactatgtacacctggactgttgttatgtcttaggtaaggacagcatgaccgaaccaaccagctcttagaggcctaaacgcttctcgagcttctggatctcatttaggaatatccaagtcatctgcacaaaagatgtcattagttaagaatggtagaacatgcagatgtgatgttttctgctaagcaaggaagaaatgtgtgataattgcattaccatggcatgtggtgcaatcctgacacagtacacaggaaagccagtgtagaacttaaatgggcctccactcttcaaggtcttcatggcacaatcaagagacccagtgtatggatacttcccggaggcatcaggctgcatcttttgaatctgtgtcttcacataatcaaagggtaaactgcaagcagacgcacataaccctgaaacagcactggcccctgcaatcaaaatataaaatcaattttgacatgcaaataatatttaggttggcactactcaacacatttgttgcacacactaagcacatgataggagacttttagcaggcctactatcatgtgcttattttcaacaggtaagtagagtttaagtccaaagagcataacaaaggtagagatcatgaacaaaatataaaaatattagtggaactatatgaagacatctgaaatttttaattgatcaactttgttcttttgtgcccacaagttgatatatatgtctggaagtcgacctatagaaagttgcaagcattaagtcactctggatccacatcctcaaacgcttgagaaatgtttgatagagaacaggtaaatcagaaagattgcatgaaaccgaaattcaaatgagtattatcttaccaagtacagtagtgacttctccagcaccaagtgtgtctctaaataactccacactctgatcataggaggcaagcatgcccatatttagcgacatagctctcactacagttggacctgcgcccttccaaagtgctagaacaccttcatcagcagcaatacgataaagtgcatgaaaagcattcttataattgcgactttgggctgctggcaacgttgaatcagcctgcatcctaatgagtgccaaatccgcaggactaccaacacaggctccaattgctcctgcggtgagaccaataccagctttctggactagaggcagtggcttcccatcatttgcttcaaccgctttgtttgttagaaccctgagggaatacagtgtgaagaaactcaaccaaataacacaaccaaagtataggaagggaagatcagatcaaaacagctgaaaacattgcataagtgactttccagattgatattcatggttatggtaaagcctaacagttaacctttcctgcttggcatagagcaatgtcagaaaacttgactattgcagcattctttcttgaaaatttgccaaaggttacttctattattcacaacaagagttgatgggcaccgacacttgtactaggacattgaatccagctgggtaggaggttaaacacctcccgacaacaggacagaaggttctattattgattctctcaagaatccaacagttatattttgctgcaacttacggaattaaggcaatgtaactttatctacattagtgaccctgcttgacaaactgttcaacatgacataatcctgaaacaaaaccatcgatagattaaatggttactacaagaggagtccttcagaggtgcactacacttggtttgtttgatactctttagctgaatacctgctagtaggggtatcgggcggtaatgcacttaggctgagtttgctaggtatgaagtgtcattgcttcaaaaacaaatatatgcatctacaggacagttataagatccaagatagtattgcactttgctgttgtattttatcaaccaaaaccacaggttttcatttcaatacaagataatattgcatactgctgatttattattcagctgaaaagaacaggatgtcaagtcaaagctgttaattatttgacagtcactttaacttactagcaaaagatattatgggctaagtagtacgtacaaacctaaaggatccgagacgagcggttgtgtatgttgcttgcctgagcaaaccagcagacaagccctggacacaaagaatttaagcaataacagtttgagtgacaagaaagctgatgatttagaataatttagaactatgttacaatagatattagcagtcaaaggacaattatggagaccatgtaatagtcaagtggtacaagactacggggttccatccagatgatgtaactgcaggttccgtacgtgtgtaacatgctacagtactgggttagtgcacaacgcaaatactggaatttttaaaccacggcctcaagacaacgaaccttgtagaaggcactaattccctcatttgcaagcattttcttggtgacagaagccgccgagccctcacccaactggatcctcacctgcacaagcatcaacaaatcagtaactgcttggatcataaaacagaaaaacattgtcccacaaacgtgagctcagctgcaaacccagattcaactgctaattcagagcaagaaggtctcaacgaaagcaaccgatgaaggttagaaggtcttggcagtaataatagtaccccctccggccacggaataatgctgttttagaggccgtgtagtccacataaattgactttgaccataaaatttgtttataacataagtttgaaaaaatgacatggtcaagtttgttatgaggaaacattataatattacactagcgtaactattttagatttatgaaaaagaattaagcagccaaagctatgtcttactgaatttaaaaactccaaaatgacattcttatccgaatcgaggcctcgagggagtaaggaatctcccacgagatgtacaactacaagggacctcctttccaactgtgctaactcctcagccatgaaaaatattacaagacatcatcttctcgatgttgagctaaacagtcgaactagcattcggggccagcactaaaatcttgaagagggaaaaccttctatactaacgaatgcaaaaactgaacccaaacgataaaattcctcaaatcgacagccattcgtcgcgggtacatcaggaacaaatagaaaatacctcagagacaatcagtaactcaatatcacactcccgattccagtacgaaaatcgttaagaatcctgtctctaaccaagcaatgaaacaaaaatgttcaacagatggagacgtcggcaatgcatcaaacagctcatccgcacaccgctcatgtttcccttagaagccattccgcacaagcctagcgcaccaactagccccgcgcgcgaaccctcacaccaaacctccagcggaggcagggagccccagcccgtggggcggcgttcgtaccttgaccatgtcgatgggctggatgacgcaggtggcgagcatcccggaggcgccgccgttggcgaagggcttcaccgtcttccacaccccgctcgccgccgccgccgtcgccgcctgcggctgctgctgctgctgcttcgcctccgccatctcctcctcctcctcgctctcctgtgccgcgcgctgctgcagtttgggactcccggagaagaggaagaggcagtggtggtggtgggagtgggaaggaggcgagagagacgcgtgtccaatccatgggcgctcgcaatgccgaggagagccacgaataatattaaagtattcttctctttttttttaatctttttccgcgacgtttttctcgtctctcatttttcttggtaggatcattctctgcatggtctgtatcatccgcgtgctgcgtgcagccgtccacacaccattgaatgtttcgtcatcttaggaagaaagtttgtgttttattgttcaaataaaagtttgatgttggtacgtgtgttcgtacttacggttaatgttttgtctctacattatatccacaactaaatacaccattcacgtcagtcaaaatgtctctcctaatatttagtaaaagagatggctgtgatataaaaaaagaaatataaaatattctcaaacattatgagaagaaaataaaaagaaaaaggagaaaaggagtgtatgttcaccaatgttcttatgcagcatgagagaaatatagtttgaacaaaaatagtcatatgtccaattaggaataaaaagaatctatggcaaagtagtaccagtgggcgttcggtttttatagttttcttagttcggtgttttttgtttgaaaaaggtcggttttcgatacgtaaaatctaaatcgatagcgctctcgtttttttttcctatcgagtaacaccgatcatatgtgagagaactagtactatacatctataatttgctatcaggtcatacatgtcttttttacttcttatagaattttctgttaaaatacttatccgatttcctatctggttggactgttgtattcattgcaacaaaatctttataacaagatctcaaatgattatattctaataaaaaatatgtatgcattttaaaattactttttagacatttatgaaagaaaattcaataaaacataaaagtaatttacataagtcataaaagtaatttagcacaaatggaattaagttgtcacgatattagaagtaaatccgttctaggggtaaaaacatgagtcaatctagactttggagagtgaggtcacttgttatgacaatcgagcgcgcactctcctcgtagtcatggtctcctttttggtagttgcgaaccgaaattttcaaatataagagcaagtttagtagtatagtcaattactagttccaaatcgtttatagccaatttagtagctaattcatacaatagttacctataaatatgtactacactattaatatccggtcccacctatcattcacacattatgtcttatagcccgtgctgcagctggctacaaatttgtatcccgctgcttatctgttttatttcatctactcgatatgtgtttatagctggcttatagtgtgttattgtacctacctaacaaacaaaccgaccaaaacaagccaaaccacttcggctcagttctcggtaaaaccgagcgaagggctgatgggtgcagggcgctcctaatgagcgactggtcgcgcaggagcgtgggcgcgcgaccagttcgctcaggggcagagcccaatgaaccagggggtgcccaggaacccggcccaatatttaaaataccttgttaccctcatatctacagcatggaggcaccaccctagcccaacacagggaacccctctccttgaaagacccaaccggaagaaagccccaaaaccaaaaattacgcagtgggagacactaaaacgcctagcgcacaggagtggccgatgcggcgacgcttcccatcgaagcctcacgtgatatcaaagcggtagtttcgattttctcgcctgagtcgcctcaacgctcaatctctctcctcgctctcgtctgacctgtcgcctctccctggaggtcgcccttgcctcgccggggacctagcccggcagccccaatcggggaaatttctcatgtgtaaagcctctccctggtaggttgcctcttttttccaattttttgcactgatcaggctagggcttgcaactatagaggcatatagaggtagatgacaggggcaggaggaggaggactggaggaggacgacggcaagctgcaagctagcaacggccaatagctggagcttgccggctgccggctcgccctagcttaccgatctactctgagccccacaaaaattgcagccagcagcactagctgagggcaagtgttatggtagatatgactactacaattaaatttatccacatcattcactcataaattaagaggcaacctatacactatgtctcctctagtacacaaataccaatgtctcttatactctcacacccctcttgaaatttgtgttgaggttgccttttcatttaggggtggttcaccatctctctcctcacttctctcctccacctcatcactcaatccaatgtggcacatttaggggcagcatatggagcattatagtacttgccctgagagcaactgaataagtgaactctttctctcaatttttcttatccttagtttgtagttttgtgccaaaataaacttgaaaatttttatttggtcttaatagattgctatatagcaccggatagtacgaacaatatgaagaaatttgttttattttgtaccaaatcatttcataacttattttctgttgagaattaaactatattttcaaagtcattgtcctatggaggaatgaagacgttgacattcgcatgatatattcataagattttgttaatggaggtctttgtcaatggttgaaccattatcaactttacaaatattattagttgatttctttattagggtacgtattttttaactcttttttatgtatttcttgtggtatattatcttcaaatgaagaaataatgcttatatttattggtatgcaactatttagtataatatcgctctataactgtagttgtcattattacgtaaagaaaagtagaaacccctcgtcttttctctagctccgcccctgagttcgctcctactaccgctggtgctatactgctcttctagtagtactactactcctcctcctactgctcctaccgctgctcctaccgctagtgctgctctgctcctgctactactactggcgtgcgctgctgctactagtctactacagtagtagtactactactataacaatactatacgtgtatatatacatatgtatatactttatataaactttatattgataaaatataaattttttacatgtgtatacaaagtatatataatttttatgtgtaccaaaatattaacgtataaaaaatatacatatatacaaactttgcatatgtgtatataaactttacatatgcatatacaaactttgtatatgtatatattaaaaaccgagagaaaaaaaacacgaatacaaactttgtatgcgtacaaatacaaaatttggtatacgtacaaatacaaaacttggtatacgtacatcttaaaaaaccgaaaaaaggaagagaaaaaaaccggaaaaaccaaaacagaaaggaagagaaacgaaaaaaaactaaaacagaaaaaccaaaacaaaaatcactcgcacgggcgccgacagcgccctccgcgcgcgacacatgtctagtcacgcgggcgacacgtgtccagtcacgcggggagggtgcgcgctactggtcgccaattagctctttctgtgcagaggggagcgtgctagagttggatcgcgatggcctgggcgcaatggcttcagcgactgcggctagatgggctagcagccgtggacttcctatatgtgggctgtgaaaaattgtagtagatgggccttaatagtggtgtgggcttgaattagaaagagaacaaggaagattgcagcctagtttggattaggattatacggtatgttcaggttccaccttctaaacaccgagccgaacaccgaactccgatctatgtaaaaaacaacacctaaaaaagaacgataccccccaaaaaaccattatctccgtttggctcggctcggttcggtttccaggaaatttgtgctcacgctaaccacataccaccttccaccatatagccacacttgtacatcttaataagtgaaagggtcaattaagcctagaggggggtgaataggctaatttaaaactttatgcggaagctaaaactgagttagggtcggaaagtctgatccacagtcagactatccgaaaatatcagatagtctgatgttggatcagactgtctgatccactaaaggaagactacaagtagatctagtgcacaaacaagagtatggcgcaaacagcgactagatctaaagtggcacaaaagcaaagctaaataataggagaagagatatcaccaacaataaagttcaccgagttgttcccggagttcaaatccttgaggggattctactctccgttgaggagctcactaagagccgggtctttgctaaccctttccttaagaggtggcactaagcactcctccttccactaaggggtatctctttccttgtggagacgagatccggccttcacaaacttctcccggccaaccacacgtagatcggtggctcgggagtgacacctagccgtctaggagtcctcaacctccaagagtaacaaacaccacacaactcttggtcaaaccctagtgctcaagatcgagtgaaacacacactaggccctcaaacaccaaatccacaaccaccaagatccactacacaaagaacaaagagggatttgagagagggagagagagctcaaagatccaaagcactttagcaccaagctcaacccaaagtgaatgtgaatgaatgagttgggtaaccctagaaaagggttaggtggggggtatttatagaagcccccaaaatgtggccgttgggagagaatcttttcatcccacctcggaaagtccgaggtgacatcggatagtccgatgtttttgactcccaagcaggccagagatagagaatgaaattctggagaatttcggacaatccgatcgatcgggtagtccgatgtcatatcggatattccgttatttttgaaccaagaatttcatcctctcacagagactcaagttccattgaatttcggagtctctggatcatcggatactccgatcacatcggatagtctgatttaaaactcactcaaaaggaataaaaagcatttcaaaacagagagtgaagttctgagaaatttcagatagtccgacgtatcagatagtccgaccttatatcggatagtccgatatttttttagccaacactcagaccgaagacagtgagcaaagttctgtgaaatttcggatagtctgagcatcggatagtctgatcaacatcggatagtccgacagacataaaacaggaatacttcaaataaatgattttgagcactagtgttctaccaattatatgcatatgacatccctcttaatagtacggcatcctaatactcaagaacacaagatatacatggattagaagacaattaccataaaagatgccgcaatacttattgtgttgacatccactcctttttcatccttgcatacatctcaacaaaaagcattagttaccctctaattgtgttgtcattaacaccaaaataaatgaggggtcctagatgcactttcaataagattgtataatttgttttctcattagatcctatttttgattttgcaatatatgtaatacaagtattgtctcgttattttctcccaccttgagctccacgtataaacattttagagatagaataaaaaaaagaaggcaatactatgccttggtaaggaattatacgcattgaacgatatgcgagaatcatttgagaaactttgggttttatttgcataattcgtgaaaccctccggaaagaaagttgaataaagagtaagacaaggagaaggtaaaagccccatgggaaataaggtaagagaggtaaaagtactattatcaacttattcaaattatatatagaaagacatattctactcatggcaacattgtgacataaaacaaggtagaaactcctgatcaacaacctagtttatctttactcgagtacgagcaaaggtttagtttgggggtattgttgacggtcattaagtaccgatttcgaccatcaactacttcaataaataaaaggagaactaacacttcatccacgtatattagttataaataatgtagtttcatttgtcctggcgaattactatgtatgcaaagattatacactaaagtgaaggagaaaagagccaacatggaaataaacacacctctggcgaatcatgtgcgagtacacagatcgatgggcccacaagtcatatgaaactgatctaaagtggagccaaaccatcctcaatcgctacagagacgcacctagcagcctttggtgaaaggcagtggagaaaggtggcgcccaggggttggccggaccccttgttcggctgaaccgccatcagctccccacatctccaccttccaaccaccatacaaccatcattacaggactatttaatgatgagagtttctcacttcacaatacacacatcaaagagccattctctcattccatatattgtattctctcgagtaatagtggagttagccttagagtagtcttcggtactctagtcctctcggagattcgggtatgtgtttagtactttactcttctgtaagacaatagttgaaataaaggaattattttgtttacttattagtgttcatagttcatatacttcttactggttatgtgttttataaatagttcatactttatttatatgcttcacctgattttcttggagattcgggtatgtctttagtacttcactcttcttgtaagactatagttgaaataaaggaattattttgtttacttattagtgttcatagctcatatacttcctattggttatgtgttttataaatagttcatactttatttatatgcttcacctaattaggctagtcaatttatgctacagtaatggtccaattatcataacgggttgcagtagttcaaacttattcatttgaagggttggagttccaggggaattagtgatattatttattaatataagcatggtgctcaggttagttaaatatcattggatgcggtatgccccacggaaagtgagataggtggcaggtgatgaaagccctatccatcctttgtattcctccacatccaagtatgacgtaaccatgctagtagactaccaatggtctctcggtagtacctaggtaacttagaactaaattctaaccttgtaagcatgtatgtgttaagtgtaaataaatattagtaataacgaagtacgtatgaatcttaggtctctttagtccttctccactgtctagtgtatctttatttgagatgaatctcctacgtgtcacactacctaaactaccattatcatcttaacccctgtttagactatgataaagtaattatagcataattacgaatatatgaaaaatatgatactcccggaatactcctaagtaaaatgctaaagcagtatccgttcgtttgtggatttatctatgaccataagaaataccagcaacaagcatgatttatatagaagaaatagagagcccccagtattagaccatagttagcctaatacacgaaacgctcgcacaatagatatttgtatgaaatatgctttaggtaaatttaataattaagttactgctccgttaaattgtatttaatatgttgtgtaactttattgatatatgccggatatagattaattaatttaaaaacctaatacgaaatggacgtaactatacagctaaccactccatctataagaggcaccatccaactatacttcaaatataatttttctcttaaactactcatccgatctacgattcgattacaccgttgtgttcgtaaaaattaaatctttacaacaagatctcacatgattatattttgatgaaaaatcataaattacttttatgatatgtctaaactacttttagatttcactaagttacttcttagatatataaaagtaaattcagtaaaacgtaaaattaatttacatatattatagaagtaacttagaacaaaacgaaggtaactttagcatgtcatttgaagtaaatccgttgtagagataaaaacacgactttatctagaaattaaattaatcagcacaaattatggaattaactaaaaaaataataaaagtaatcacctcagagcatttatgaatgtataggaagtattttaatcaaatctaaaaataactcatatatatatatatatatatgataatttgttcaatggaaaaaggcattaattaaagttactttcttttgttataagttacttctataatatatgtacattacttttatattttactaaatttacttttatatgtctaagaaaaagtaatttgtgatttttcatcaaaatataatcatgtgagatcttgttgtaaagatttaattattacgaacacaacggtgtaattggattgtaaatcggatgagtaatttaagagaaaattttatttgaagcatagatgataggattatttttcctacttgctcaatagattaatagcaaccaaaacttctaaaacactagcacgtgaatatatctggttagaactaattagggagatctctccaattagatttaccgatacgaaatacatctgttgatttgtatgtgacattggaaattgatgtactccgaatgtagtcctctctagcttggtgcatggctgtgtgtgcacgtgtctgtccaagcttcatgcatagtagagacgtgttgattattctgttattactgatacagactcggagcagtaccgtgcccgtgcgtaagagcaagggcaataatatagcctgctgttaactctaaaaaaattaaaaaaattagacatgtcatatctagtgtagctaatatgtacataaatattttattattgtagtgggacccatcattttctccaaccttttgctttctccttcctttccccttccttgcctgtcttcacttctttacatggctgactccggtagagtgaaggtgatgctcggcggcggtgtggacgcaggaaatggcggcggccatgcggcggatgcggttgacaccggcggccgtgcatgacgaggaagcccatgcgcagacacaagatatggcggtggtcgcctggtcgggccggacgtcgggcgtgcagataacacgggagacaagcgagacgaaggcggcggccgcgttggcggacgcagaagacgacggcggccgattcgagcgacggttgacgaggaagacggagacggccgaggcggacgacggtggccgtgcgacggacgcggaagacgggggcggcccagccggacgacagcagtggctgattcgggcgacggcggacgacggtggccgtgcggcggacgcggaagacgggtgcggccgattcaggcgacggctaacgaggaaggcggaggcggccgaggcagacgacggtggctgtgcaacggacgcggaagccggtggccgtgtggcggacgcggaagacggcggcggtcgatctggacgacggtgaacgccgaagacagggcggccaagccggaagatagcgacggtcgattcggacgcggaagacggcgacgaccccgacggcagccgcaggcgacgacctcgccgatgagggcggacggactcatgtgatgagggcatgtgggcgccatggctgcgagcagcgggcccacgacctcgagtcgcgcgtggagccgggcgcccgctagttctctctcttcaactatctctcctccacgtcacaaaaaaaatcttacgtggtgttgttatcgctggttattatacccgctctaagccagcatgcttatatgtatctggtacttgatttgttaaggatgtcatacgcgatgacaaccccgatccgtatcgtgctgctgggcccatcgttatgcgggaatcatgattctctgcactgtagcgcaacgaactcggatgtctttcccggcaacaatccgtccactccggttatcgttagagaattttgggagaggggtctaggcgtcgggcgccagatggagtggaaaaatcgagcgctgatgtcatgctgatatcagcatatcagcatgatgcatacgtgaaaaatcacttcaaactattttttctcttaaattatttatctaaatcatgatccgattacaccattaaattcgctacaattaaatttttaaaacaaaaccacacatggacatattccgatgaatttttttagcttattattgaattatttttaaatattgcacgctgtttcaccaagtatatcgaaattgttttactaaataaatcgaaaatgtttcaatcctttaaaccggtcattgttttaccttttataaaaacaatgtttcagtaaatagcaaaagaatgtttcagttcactgtaacgttagatctatacatagtgaaacattgtgagtacacaaggtgaaatatttttttgttgaacaaaaaataaaacaaattcccttaataacgggtttccaaaatatatcggtgatttgttgcaaaagaatgtttcagttcactgcaacatttgacctatacatagtaaaaaattgtgagtacactaggtgaaatattattggtggaacaaaaaatgaaacgaattcccttagtggagggtttccaaaatatgtggatgatttgttgcaacggagtatgtggtggggacacatagcaggtagatagggacacatcgtggggcccagggcgcacatgcgcgcgcgtcgggggggggggggagcgaccgatttttcccctcccccggcgaacgaggcgtagaataatcggatttttggcagtgatatctcgaagctatgtgaatcctaaaagattaatttattggatgacgatggttctgatcgggtcgggttatattgtcacacctggagttttttcattttccgtagtttctaaatcattgctaaatcgtctatagaaaatactctgttaaccaagaggaaactctaaataataatgtggttaataattggaattgttagggagaattttttttgaattctctttactttaaatcactaacaagatgttcagcggaatatttagagtataggaagtactaatgttaatttgaaatgttaggagttgaattaataattctttcatctctctcctttggtcgtgaaccgtccccggttcactctccctgttcacagtactttgtatccgccaacccctttgctaccgcagttctattttgtatgacgagccaagtcatattctttttccggtccgttttcttttctttcccgaaacggcaccgcattggttttcctttccttttctttctggtccctcctatccgtatcctaatccctctccccatcaccctacccgtgcgcttccgcctcctccctgccgtgcgcgccacccctcccgctctcgcccggctgccgccccttcctctcccctcacgcgcccgaccccacctaacctagacctactctaattccgcctcctcctatttaagtccctataccccctccttttttctatttttcctccgcgcaaagccttagccacctcccctagccgcgccgctgccggccgccgtcgttgtcgcgtcgccggtgagctgcctcctctcccgccagtatggttcaccatcatgttttctccctagggtttaatctaacctatatcctcgtttgtatagcatcgcgtcgtctccgtgtgttgccgccgatcgtcatcgccgcctcctcctctccgatcgtcttggtttggtgaggaatccatctatgttcactcaatttaggtttaaatttcctagtcacattgtcgtcgtaaccttaatcgcgtcgccgtcgccaaaccctagctttgctgcagccgtgcgccgttgccaccgttgccgtgcacgccgccgccaccgctgtgcaccatcgccgccgctgccgagcgccactgccgctgctgtgcagctgtcgccgcgccgcccctgctgccgccgccgccgccgtcgctgtgccgcgccgccgcagccgctagccacagccgcttgttgccgagcgatgccgtcgcttaccgccggtcatgccgccgattgctgcggctgtgcagtttctaaatcgtgtcaccgtcacggcctagccgctgttcgtcgctcggtagccactttgcctagccacagccatacttccgagttgctaccgacctaccgattgccgtacctatccgttgctgcaaacagagtcaagtctaccggttgtgccacagtcgttcgctagccgttaaccattcgttcacacgtagtatagctgaagtcccgttcagttagtagttcggagtcgttctaagccaccggttcgttcgccggttcggttgaccgtttgagtggtcccgtgtcacagtggattgactcgttgagttgctatcctgtgaggcttgtttaccggtgatacatttccattgatctttttggctaaatgtgtaataattgactaaggttttatggtgaatagtaattacacagctcatattctaaaattcatatctaattcatctgagttccgttttaatccattcaagttgcagtgaattcgttaaaatatttagaatcaattaaaattggtttcttttgctgtttcagtagagttattggatgtattattgtatgctttgtttgtcgtttagattctggcagttccgacactctagtttatttcgaaatggttgctgaggttccgtcagctcaagagcaaggcaagtaatacatacaacattgatcatgttgaacctattttataaaatcccctgctttctattaaattgcattgttttagaatatcatgtgggattgagaactatcgtagtcagccttttgttaccttatgccattgataacttcggatataattgactagatgattgatttaggaatgcttagccatacttagatcaattagatcacaatgagattcactataataaaatcccctgctttctattaaattgcattgttttagaatatcatgtgggattgagaactatcgtagtcagccttttgttaccttatgccattgataacttcggatataattgactagatgattgatttaggaatgcttagccatacttagatcaattagatcacaatgagattcactataatttagtccttaattatattgatgatgtaccaccatggttatggtttaattaaactaaaatatgctttaatggtgggttgttggtgcatggttttgcaagtcgtgcccatgataattaaggacctgttctcgagaattcctagaagataaactcatacttaccacaagccagcttgggttccaggctaaatctagagtataacttaatctagtcgatatactgtggcaagggtagaggcgatggtgtagttcggaactagctttggtctctgctgtttccggatttacctaggcacgagagggggctgtccactgcctgttgaggagtgggggtgaaacctgaggtggttatgtttggttagggagggttacatgaaaggttttgtcacaattttctcgttgttcttgcgccctcactgcaccgtcactgccactgcccttctcctttgttgctccgctgaccatggtctgaccaccgtcttcatagcacagtccaacgctgcccaccctgacgtcgcccgtcaacctgaggtggttatgtttggttagggagggttatatgaaaggtgttgtcatgattttctcattgttcttgcgccctcactgcaccgtcattgtccttctcctttgttgctccgctgaccatggtctgaccaccgtcttcctaggacagtacaacgctgctcaccctgacgtcgcctgtcaacctacgtaatctccatgctgccacaccgctggtcgcgacctcggcacagaaagtccggtgacatctagcgctagctgccagttatccagatcgaaccattcatcattgtagaatatgttattttatagaaaaagattatataatgcttgtgaacttgcatatgtgtgttactgtgggaattaaattttattatgcattttgaaatggtgaaaatcttaaatttaaatttgaattatggtcttcaaaattgtaaattagggtccccattgtttcgcttattcgaggaataagctaaatgtcatatttgcaaatgaaaaataatttgtgaataaaacttttatatatatgttcttaaagttctaaaagcaaaggctgaaaaataaatttcgatgaaaaaaaaccccaagatcaactctaaatttaaggttgaaaatttaaattttggctgataagtataagtataagtgaaaagatgagactgtagatatggttgaataattctacgtgtttgaattattctagtgttaaactaggcataaatatatagtgtgtatattaaaatagaacagaaatagaaatgggaccaaagaaataggggttgttgggttgttgctgaagttctaagttaatttttatacccaaaagatgggagcgatcccatcaagtcattaagtgctttagaataggggctattgctaaaaatgttcgagttagagccatttcttgtcataggccagctatcatttttgcctttaggggcttgaggtatttattccctccgccacatagtacaagggatcttaggtggatgtgttgattcattgtactaggatgtgtcacatctatccaaaatctcttatactatgggacggatggagtattacgatggaagtaatacgaagctaacttactttaaaaatttcttcctccatttgaaaaattttaggaagacaaaataacattattggatttgttacgaacttttatctttatattgagtatattctaagaaagacaaagttgttaagggtaagcaaagtgaacgtagttcaactggttaggtttcttgtggcggaactagcccacacgggtacctagatttgacatgggtgctcgcatttgtaactaattattctgccagtggtatatgacgtacctatccacagcgaggtacccgtggtaacttcgtcaatctcaatatatgttgggccagttttttaaaggttattataaggttatgtgtgcacacgttagcgcctacatttgttgtattttgtttctaagaaaatatgctgttaaagctaggttagaatgaacaattggcatgagttttttgacggcataagtaacgaagcgagttgttagggtacgacagctgactgagtattaattattgtaaacttaaaatgaatttatttgtttgttaaaaacatagatatagaaggtttttcttaaataaaaagaacgtatagcatgttagtaaacatgctaatatatgagggagttgttcaccccttaggctgcgttcggacccctcctcaccggcacgtaaaacgaaatacgtattattacatgattaattatgtattaactattttttttaaaaagattaatataattttttaaataactttgatttaaatttttttaaaaaaatacaccgtttagcagtttgaaaagtgtgcgcgtgaaaaagggaagaggtgagttgggaaatctcaggggaagaacacagccttaacacacaaatgaatggagccgtactagtgtccagtttacttgggttactcggaccatatgccatggcttatatgccatagaaaataaaaatgtcagccaataaactaatgtacttttatgttgataacaaatacatgagatagcaaagcagtttggatgaattatttcaggtataaatttgctgattagcagtacatatctgacgaaggaaacttgatattgatacagcattactaaatgaatataaatcacaaaataacttgagtttcgcaaagactccctcgaaagagtggctgattaatgggcttctgctcagggttcatcggcttgcccaagaggcctactaggtgatgccatccgagagaaaacaagttcattttacctccctaatctatagccaagtatgattttgtccctctgtcacaaaaccagatatagatactctttcaactatcaaaactgggttaatttggtttattaacagttttatctgatgtggcactttcatagcattaaaagctagcgcaagtggatcaccctgcgaacccacttataggtcaaataagtagggttcgtgggtcgatccatttgcactcttgcgtggcatttaacctagtcttcattatacatggcatggcattatagtaagcaaacagaaaaaataaaaatactttctctctacacccttttctctatgtcattcgaggtcaacctaccagagcatcttgttgcaggagacgacattgttgcggtatacattacatcaatttggttttccacgccgtttccgttctcagtcttggctttcgcagacacatgatcgtattctcagttccaatcagggataggcggggcagaaagacacattgttcggatatcgattgaagtttttaagtgttgtaggggtgaaggttgagcctataggcacatcaggaaacactttattgacggtcgttaagtactgatttcaactgataattagagaactagcatttcttatatgcatattagtttcaaataatgtagttccacttgttcttgtaaaatactatggatgcaaggaattgctacaaaatgaaggagaaaatgagccggaatgcaaagaacacctccggccaatcatgagagagcacatggactgaagggcccaaaagtgagactaaaccgatatatcttagaccaatccatcatgcattatccctgggacctacacgtcagcctccaggagaaggtcggtggagaaaggtggtggctctggtttggcttcactaggctttgccactcccatccccacctttcacgtggcgcttcctcagccattcctaacgaaggtttcagagtcttctatatagcttcactaatctagagagtaataaaaatgagaaatagatagattgcttcttaagcgtgtgctttgagagcaagataatcaagcataactgtcatttggggagaccagaggaagcgtcacatggatggtggagatgagaggggccgtgtttggtttgacaagccgaaccctagttcggcagaaacaaagccaccacctctctccaccaattttctcctagaggctgacatgtgggcccctaggacagtgcacggtgaattggccttagatatgtcagtttgcttttatttgtgggttcttccatccgtgtgcatgcaacagtaatatacatcacctgactattcattgatcaagtccaaaccaagaagatccaagaccagactaaccttcaaaagcactaagaagttgtatttgtcaggtaactttgcaagtgaagcattacctgtggtagattaaatcgaactgatttctttgaggtgggaagtaggaggcacagtcgagaacacgcttggcgggagcatgcactggtcttccctcccggtggatctccatcgcaccgcttcaatccctgctgtcaggtctcctctcccttgcaggccctcgccgaagaccacgatcaagtgcagatgtgataatcgaagacgtggcagcctggatctgggcaaaggactatggcagggagtcctggattggagcacacctggggagggaggagtggagaatggttcccggcggtggacgggagtaccaccaggggcgtggcggatgaggggtggcgatgccggcagatgacgcaggagagcgatgaaagcggccggcgaggttgtctggcagtgatggagactaccaacaaggtggagatggggaggaggccgagcaattttgtggatggcaaaatcgagtgtaggtggtgcgtcatcgatggcgagatcaagggggaggagccgaggaagctatcggcagcgtgattgagggagggggaagcgacgatgcggtgacggagtgcggggaagagatgcgagtgggcatcgggtttagaggggaggaatttgcggaggcggcgcgaagaccctgcgcatggccctaagattctcatgatttggccgcttgattgcacagtgcaaactcctcctatttatattagtatagatgatgtgtatatgtgttttctagtttcatattgtacctgctgagtattttcgtacttactcttgtgtttatttggttttaggtacacattgagatcagcatgcatgggcgggaagtagcacccttatatacacatctatctgcacactatcaaactatatcgcttaggtccaaaatgacacttaaactatattctgggttggtcttgtaataatcttttacatacctattagtttctttcaatggatgtatatggatggatagcactgtgggaatagaattataactatctatcatgaatgtccatatttataggggacactgtcgaaattctcaatgaatttaggacttcatggtttttgtttcgtattgggtagcatccgatttttttacatgtaagcacatgcatcagtttaattccaaatataagcaagccaaacccaaatttcaatccatagacaagatgctcaggtgcaggcgttgttccataacataatgtccaagcgttgtttcataacataatgtccaacaaaataataggccattgaattgagttttgttactttgtattaatgtttgacatatttattaagtatggttcaaaaatatgttattttgcttttacaaaatattgttacactttttttaagtataattatatagcaagttaatagacctaaaaaattgctactattttacaaataaatgagtttacattaccgggctgctaacttgtggatgttatcgctagaaacgaggttgcaaaaggtccatttattttgtttggcattagattgagggattgacgtggtcatgtacacatgtttacaaatggaattacgaatatggtgtgctcagatacgtagtaaaagagctgcacgtgcttagattaaaaaaatcggcgatatgcttcgataggcctcctggtcgactggattcacagtgctcacgtgggcatgttgcctaaaattagaattccaaacaaatttgtttggattaattacattagtaattactggattgcatgtgtcactactaaaaaaccctaggaccggctttataggtgatggttcatttaaaaccgacacctatgagccttttcctaccttcgcacgttgaaaaaatatacaaccggtacctttaagaatgataggtgtcggtttattaggaaaaaccggtaccgatttttagaaagatccgacacacctataatatattatatattatagatgctggttaattaaaaaaccgacacccatacaaaactgagccaaaccaggatagctgagccggccttagctttatccgctccacgctatccttatccgtgcgaagtgagacgcggacgccttgtaacgccccgatttttgttcgggactaaaaatcattaaataaagcattttctagaaattaaataaaagttaaagcaatttaatcaagtgaaataatgggagaattaaaaattttcctttaaaaatcattggccgtgaatattttgtaatattctttgtgccctaattattctctgaaattttcccatgaatttttggagctcaagaagtaattataataatacaaagttcattaactcaattaaaataaaaagaaaacgaattaatccttccctcttcttccttttaggctcggcccagctccctccctcctccttcccggccaggccggcctccccttcccctccttcagcccactcggcccactcctttcctccctcactcggccttctctctccctggctgacaggtgggtccgtgggccctacctgtcattcccttcctccggctccccaagtccaaccgctatggccaccgttcttccccacgtcgccgccccatccggcttcctcacgcctccctcgtgcaggccacgtcgccgcccatcccttccacctcgtgcctgcaaccgcccccacttcccctctatccccgcacgaatcggcgccgtgtgccgtcgcctctctcctcccccatgatgccgccccttccccgccggttgccaccccaatcgaccacggattccctcccccgagcccataaaaacgatccccgtgctctcctctcacatttccccaatttttcccgagctccccgcgccctctcccactctcccctcgccaagccgagccgccgccgctcgccggagctgtctagccgcgggccggtgcgcgcgtggactcggtccaccgtgcacccgcctcctttgagccaccgataggtagggcccgcttgccggtgccacctatcctctcggtgacgtcataaatagtgttaataattataggaattcatttaatggctcaaaaaattcataactaattcattcgaactccaaattgggccattcaactagcaaaattcatctaaaatcgagctctacatgtttgtttacttttcatgtactgcttacttggtttttattagagtttttccttgttttgcgtgccagcgcgtagattccgccgtttcggaagttcgcgatcgcgaggaaaagtgttcggaagattctttcaaagaagcaaggcaagtcacaaattcccctcgagcatattgagcctactttacaaatgttttactgtttgcaaataaatatgcatgttttgctaattaattgggatcatagtttacctatctgctcgcttgtgccatgtttacttgatatatgtcctttgtgaaccttgggtgataattcgactagcttgtgttatgttgacctagctagaactatatgcttagccatgcttaattaccactagctcagttgatgggataattacagtattagactttctagtatcatgacgagctgcgtgctcgagacatccggccatgtttcattggtcgtagttatccaactaaaatgcgacttgatggtgggctgtgggtgcatggttttgctagccgcacccatggcaattaaggagtggttcgcgggacaccctggaagacatacaacgcttgccacaagcgggaatgggtaactgcctgacttgaagtatagctttcctttgggtgacgcatccaggcaagggtgagcatgatggagttcggatgggcactgcgatgacctatgtggctttctgattcgcctaggcatgagaggggattgcccgctgcctgttgaggagtgggggtgaaacctgaggtgtggtctgcttggtcagaaggggttatatgaagggtcttgtcacaatcactcgacatggtgacgtgtcaggcctggcgcggtgacatgccggtggattgtgtcttgtgggtacagttgtgcacctctggctagagtaaaactattcgaatagccatgcccgcggttatgcgcgatcaaccagattcaccatgattagtctcaccttagtaaatcgactcaatgcactggttagttcaggtgggttggttgggcctgttcaacgtggtgtagcattgatcagtggagatttaatgtcaccttaattactcaacagttttactgttttgctcaataaaatgttttacaaccgcctttatgcaaatagccgcaagccatccttgtatccccttgcacgtctgtatcattggtgtggcttgttgagtacggtggttgtactcagccttactattattccccctttttcagaagtatagtgtttctgagctaaagacgaagttggaggatcaaggctcagaccccagttgagttttgcctgtggagtgaagctgaagccccgctaggatcgccttttccgctgctgctgctttcgcttcggtgcgaggactaagtgcctcttctgtaagtattttatgctttatttacgtttggaactatatattacttgttgttttgtgtaccctggctggtcttggacagggatttaatacacaaaatagtctggaaatttgggttaaatttctgggcgtgacacgcttcgactcgttcgtctcgcctgtatcctcctccgccgcccttccctccccttctccctctagcacctgcagcctccccttcgctcccctctcccagccggccggctggccgcttccctccccctgcgtccccctctcctagctggccagccagccgcttccctccccttgcgtccccctctcccggacggccaaactgtgagcagcggcacctgtgaccggcgccctcaccacgggcgacggggatgtgcaaatcaggtcccctcctcttcttcttctccctctccgtcggcctcaccggagttagccatatctagggaggaggtggtcgggctggtgggttggtggcggcgacgtgcagcggcggtggtggccaagggaggtggtgggcggcctccccataggtgacggggtgcagatccggccggtctccctcctctccctcttcgtcggcctcccaccaatggcgcgcagatccggttggtgggttggcggcggcggtggtggccaagggaagcggcgacagcagcagcgggtggccaagggatcccagctacgactggcagcggcggactgacgatgacggagtgagttcgtgcatcttaattacttatgttattgatctgtgatttgtgatggattggattgttgctgacctgggactttgtgattgtcgttgttgatctgtgatggattttgttgttcataggagatatgtgatggattgtatctgtgattgttgttgttgaccgtaaaattatttttattgatttgtgatggattgcatctgcttcgcttgaatggtgtggctcacaagcatctgcttggcttggagccagcttctctattttttttaatcagggagagagcaaaggtgtcggttctacgaccggcaccaatgacctagtgtcattactgccgagcaataggtgccggcagggaaaccggcacctattgctagttcccaaccggcacctatcagtttctgtactagtgtgtttaggtataaaaaatttgggtgttacataaagtctacctctattttaccacaaagatatttactttttattgttagataatctgccgtctcttatggtgtatatagtgatatatgattttttttagcattctttttttctgaacaacaaataaataagatatctgtgtatttgcgcaggctttctttccagttgttcataaaaaataatcaaatcattgatttcacaaataattgaatgtaacccgtgaaaaaggtcgttcacaaatatacattcgcgggtggtatgtcttgaaggtatgcatgcatccaattattcttcaaggagaaaccaacagactaatcttaacaaagtgaaaagtgaaatccaaagttaaacgggaatgagccacatcatttgacaaatattagccgttggatttactacaagacaaaagagagtgaatgaatcttggaccattggattatggatggtaataaaacacattccggaggtaactactagaagtagaaagaaagaaaggaattgaagggaaaaaaaaccctcgtcctttaactaaagattcattagtcaagattgagctattcagggcatattcaaaatgtatgtttatgtgattacttttgtttgtagcaattattgttaatgtattagagaaaaaattgctacagagacatgtacattccttccaataaagaggtcatcctcacctgaatatatgtttagtgactttcacataaaattaaaaatgaatctaaaattaaaatattttcttaaaaaggtacaaaacctatgaccatgaaaaataagtggaggagaaaaaaaatcatacaatggtaaagacacatataaagacgatgaatcatacctattaaagtttacaataaatattaagccacactagtataggaatgatttttctgaatgggagtcatttttgattgcagacgaactgtaagtggtcgcgtctgtaaaaaaaatatgctccattttcacgtgcggctcattaaaatgaccgcatagaaaaatcaatattcgcaggtgggccacttattttcgcgtgcggacctattaagtgacccgcacacgaaaattgccacccacctttttaatccctccgtcgctgccccatacccactcctcccatctccctctcaaatcccatcgccctctccgccccacacccactcctccctctctccctatcgcccgcctcctcccactccttcctctccctatccccctcctcctcccactcctcccatctcccggtgacggcgacggtctcggctagggcgatggcagcatcggccatggtggcggcggcggagcggatccgtcgctggccggggaggccggatccttcgcctgccaccgcggggaggccggatccatcgccgcgtccgtggggatgatggtggcaggcctcaggcaaggcgatgacgacgacgatggcggtgacggcgacgacgacggctggattagggttccaggcggcttttgatttttttatttcgattttttattttcccgaaaatctcgcagacacctcgttccagatgggtgaaagatccgcacgcaaaaaccgattccgaccgtacggaaaaatcgttattctactgccatttactgtatcagggtaataccatcactcattttaaccaatttttttcgtagtaataagaaacataagaaaaacaaattgtcactctcacatatcacatgacggaatgtgtagagtcatgcaaatatgcgaatcatgggctagttaaaatatgacacagaaatttgaccctattgaaagatcttcatatattatttttccgggactatggttttataatcttgtgcacttcaccacagagacgtgcgtgttattgattcctccgtggggccagaccgacagtgcgtggtaaaaatactgttagaaccatgattattttcttcccagtaacccttccaattacacgcaacctgacaccaacctaaaaacggcgaacatatgttttattttgatctgatcatatcgttgtatatcgttgttattaaaatttttaataaaaattatataattatattttgataaaagaaaaatatatgtttcaaaccgttaagtttcatactcccttcatcccataatataaaagattttagagggatatgacacatattaagacaatgaatctggacaggagctcccataatataagagattttggaggaatataagagattttggggggatgtgacacaaaatccttccaaaatcacttatattatgggacggagggagtacgtgatatcgacatatttcaatgtgtatcttcactgtgtttcataatttttttaaatgtttcagttgctatttttttcgtttcactatatataagttaattttcatttgttggtcaactgcaatatttgatagtccgactcctttttttttttttttttttagaaatcaggcacccaaggtgtagtttctctctgtctttctccatagttgtactttcgaaatctaggatttgaaattttgtatatcaagccactagtctagtaggctattgatgagtcagagctatttcctccatcgtataagattttatttagatttatagtattaaaatatgttatcttttatcaggtttaattttttattgacatacttcctatatcctaaaaaaaagacaaaccctgatttccgtgtccaacatttaaccgtccgtcttatttaaaaaaattatgaaaaaaattaaaaagataagtcacgcataaaatattaattatattttatcatttaacaataatgaaaatactaattataaaaaaattttatataagagggagtactgctatagcctatagcgctgtgccatgccgtgcagcagctacatgcctcctgtctctgtgcgtcatgccgtcatcggtgagatttgaacacatacataatatattgtgtgctccgcgaggaaaacgcggggtgaccagatagccgggccaccacgtctgaaagcccatgtgccgagggcagttgcaacctcgctagctgctaccgcttgccagttgccgttctcccgtgcgaggacaaggcagtacagtacaatggctgtgcggctctgctgctgctgcttcctcctcttcgtcaccatcgctgccgccggtggctccctgacgcggacgaacgtcgcgacgctgccggggttcgacggcgcgctgccttcacgcctcgagaccgggtgagacaactcaagaatcattcccccatctgctctgacgattttccatgctccctgcatcagtataggtgagaggtcctgtggtgtcactctgtacaggtacgtgacggtcgacgaggagaacggcgccgagctgttctactacttcatcgagtcggagggcgaccccagcaccgaccccgtcctcctctggatcaccggcggcgaccgctgctccgtcctcagcgccctcttcttcgagattggtcagcaacccaacaacaacaagcctccttgtctagagtgtcaggcgtggttcatcccgttgcaattattaccacgcagggccgttgaagctggtcatcgagccctacaacggcagcttgccgcggctgcactaccacccttactcgtggacaaaggtcgccagcatcctcttcgtcgactcgccggtcggcgccggcttctccttctcaagggaccctaaggggtacgacgtcggcgacgtctctgcttcgatgcagctcatcaagcttctcagggaggtaattcattactacctggttttttttggtccattggttccaggttttcagcgtacttggttcttgctagctcttggtttaatatctcgtttgactctgattcagtggttcactgagtatccgcactacctctcaaatccgttctacgttggaggagactcctatgccggaaagatcgtcccgtttatcgtgcagaagatctcggaaggtgctgcaataatgttaccttggttactctttaaatctcaaaggaatatgctcttgttttcttatgtgtgatctaaatagttatataaaaaaatcattttataccactgaatttattcaacgatttattattgacttcatctccatctatggtatatatatctccaactttactttttctataatatatcattggggctgatacttttcaaaaatgatgcttaaaatgccttaagacttacaagagtgactattgattaagcaacatgaagatatatatacatatatatatatatatatatatatatatatatatatatatatatatatatatatatttacttacatagtcttcttacataatataatatagaagtttttttataactaatatagaagtgatatattatagagaaagacaaattcgatgaccaactgttgaactataataaatttaatggcatagaatagattttctctgaaaaaaaaactattttgacaagttagattaatgtcataaaattttaaatttgattttacaaattagcgaaacaaatatgacgtgagcacacgtatacgtaatccattctttttggtatgagttactgatactgaatttgaactcccacatatttgtggataaatatattactagtagtgtgcctgtgctaatatatcctctaattctttttcaaattctttcacaactatttaaatacaagcaacaacgaggggaaattgcctaggattaaaattccatttccagatttctacaggatctcttttcaagatcgatcagttcgcgcaccaaaaagcttgacaattttgtgctctgttttcagatattgaagctggcgtcagaccgacgtttaatctgaaggtagagctcatgtctttttctataaagctacaactcccggttaatatatatatttgaggtgttagtgataactagggtgtccatcgaacattaaaaaaaaacaaaagtatatttcctatatcaagatatagttgattatcaacttgagaccaagagatagtttaaaacccctcatttagcaatggatagacaacctgtatcatgatctgtaaatactgcaattttactaacatgttataatatatacaatataggatcatgtccaacattttctcttaaaaaaacatatacttcatccctccttaaaaaacctagaaacggataaaacctagaaacggatggtatattttctagcactacgaatatagataggcagtctgtccagattcatactattaggaaatatcttatccaattctaagttctcatattttaggacggtagagtagttgattaatgatctagcggcaattaattttatgtttgggagattgtcagggctatctggtaggtaatccgagtacaggggaacgcattgacctcgaatcaagagtgccgtacagccatggagtcggaatcatttcagatcagttatatgaggtgaacagtcgaacacgcggctcacaaaatttaattatgtcctaaatgattcctgcgtgatctttgttaactctgattgcacatgcattcacgtggtttgtctgaagatgataatggagcactgcgaaggtgaggattatgacaatcccagcaacgtgatttgccaacaagctttggctaggtttgacagcgtaaggagacaagtacactctttttttttcctcgattgtattagttgaattttcatattatcgaaaaaactatttagttgcatttttatattatcgagaaaaagaatttcttggataattctgtctgaattaacttattaactacgaatgtctaaaaaaatggcgttttctgtgtttctcaagaatatctagtccttttagtgtaatttattctttttgcagacagtagtaacatatatacagtagtaacatgtattactcacacgacagcaaatacatatccacgtgtccatcctgtatgtaggactaacacttttgcccctttggagcaaaatatgcacctgctgttataaacatacataggccctgtttggatccggagagctattaaatagcctttcggaatcttgctatttaggagtattaaacgtagattactgataaaacccattccataacccctaggctattttgtgagacaaatctaacgaggtatattaatccatgatttgctacagtgacgctacagtaattagccgctaattatggattaatatacataattaaattcgtctagcaaaatagcctaggggttatggaatcgattttgtcgttaatctacgtttttaattaatacttctaaatagcaagatttcagagggatatttaatagcccagaggatccaaacaaggccataacagagatttgctaaccagctgaatgcccgtattttgatagaaaagaaaatatgtgcccgtattaatgtgttatcttgctatagagaatattgaccttaatctaattttatatgtgtagacttgattgtttgtaacttaaactttgtatgatttggaccctagttttcgggcacattatatataggtagtcccaaataaatagcattcacgtgtagttctcaaattgatgaattttaatatttaaactaagaaggtggccagcgcgtatgcacgggcatccatattatttaaatgtaatattatattttgatatgtattataattaagggcaactcaaagtcacacgtatcttaaaaaccattcatcgaaatttaaataaatgatggattaaggtcacatgacttttgaatcgatttaatgataaactgccgtagctaattatctgtggacccctgtttttataacaggaatcattcgtgtaaacagtaccatttccctggatcaagtagtctggtacacgagttcatagctgaaataccaaaagcacatacacgagagtctagtgctaattattacatcataagcccgtaggcattgtcttaaatcatcggaccgagcggtccggaatacatccaaaagcaaaaatagataaggcagcggaattcaggcagcggcataccattgccacaggcaacgaccgtactaagacctactgagcgccattgtcttcatctccctcctggtagtaggcatagggatcctcggaagcttcatctcccgcttctgattaattttatatttgcaagggtgagtaccaaccgtactcagcaagtcaccacagcaacaatgcatatgaaaggggtatttcaaaggatggctatggctcttttgcgctaagccagttttgtaattcttttcacaaacctaagacctagcattgactgatcaaattttagtaccagtgtttgtatttaaacaacgacggttctgtccaccatccattgtgatcccaaggatagcttcccgccattgagtcgttatggttttctgaggacgcccaccttcccccttctcaggaagtggctccaacagcataaaaattcgtcatgcaacaacccatcccacataagttaagaatttagagactagccaagtgtaatacatgtcccggtgctcaataaccgcgagcacggctattcgaatagatttcgttcactcacactgcagtggatgtacactttactcgcactccgcgactgcccaacacatgagcctcgtctcaacacatgaggcgcgtcacggcaaagcttttcgataacctcgcattggcagtatccgctctatgaacttaaatcctcatgcactctaggcgtccatgtttctagcagtgtgaggagttctggcggtcccgggaaagagaagtctcacacatattaaattatggttcaagttaagttctctctctcacacactcatggcagttctaccaacggcgacaccgatgtagggcacgcctctcggccctacctcaacggttgtcccatcgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacggtactagcctttcccagataccacccaaatcatccgtccgccccagttgaaaacagttgttttcgctttattttcctttcacaaatcatgttatcaatttcatggcaatgtggtgctcatgtctccacatgccgcatctcaattaccttcccaaaggtaattgcccaagcatttagcatttgataaatatgagtatgcatgatcctagaatagcatttctaagcaattgtcataattgactagggactcatacgtaaacatggttacgaaggaataagggataaacaataatcaaggcatggcataatcacaagtaggatgttcatcattgcatgcaattttatttataaacaaaataatttcgcaattgggatcaacatgttcaaggaatagtgatgacttgccttgctcaaggtcttgggggtcttggccttcacttggatccgcaactccctcgggctctatagttacgtgcgaaaattgatttggattcgattagaattcaaataaaaatccaaatggaagtcgaacgcgaaagtcgattcttttatattaactttactattcgcgtactagggcaaacccaatttcgatttgtatatcctaaactattttgtgggtataaatattttgttatcataagtttttaatttaatctacccgagcgttatatccatataataggttggaaatttctatcgcaagctaaatatcggacggaatccaaaaattatcttataatattatacgatttaattttagtctaggactaaacgactaaatataatatacgtctaaaattcctagtgattaagtccgaatttctaccgtgaatcaattacttatagagattacccaaaataatctataatagtctataagaattcatctaatcgtttagttcttaattacatttaaactactaccgcgaattgatttcttgtagaaattaccaagaataatccataatttatattaaatttcgcaattctacgactataactaatctataactaaattctaattattttaaatttttaaaacttccctaatctccctctaatttcctatttatttcccttttctttttcttcccttctttttctttttccttcctttctttttcttttctttttttttctttctctctctcctttcttttcttttttccttctcactatcccttttcttttctttttccttctctctctccctcccggtttctctcctcgttccttcttctttctctccctcggcttctcccttcctccctctccctcggctctctctctacccggcggcacggcgacaaacagggggggaaggcagcgactcaccgacggcggcggcggcgacgacggcggcggcgacgacggcgcacggcgcggcacagcgcggcggcttcgtggcggcggcgcggtggctcgaaggcggcggagcggcgggacaacaacggcgacgcgtggagatggggagggaaaagggagaggaggaggggatggagtggggagaggggagaatggtgggcctttataggggaaagagaggataagggggagagggaagagaagggaagggcggtggagggggggtgaggtgacggcggcgatgtgacggcgcgcggcgcgcgggcggagatgacgacggcgcggcgcggctcggggcgcaaggcgacgcagcacgtggcagcggcgcggggcgcgaggcagcgggtgcgaggcgacgggacggcacgcggcgcagcagcggcacggctcgaggcggcgatggaacgcgcgcgcggcgacgggatggcgacggcgactgcgcggcagtggtggcgcgcggcgcgaggcggcgatgggacgcacgcgcggccctaggcgggacgcgacggcgacggcgcggcagcggcgatgagatggcgacggcgacaggcggcgatggcgacggtggcgcggcggcaggcgatgatggcgacggcgcgcggcggctcggggcgcgaggcggcgacgcgtggtgacgttgccgagagagagagagggggaaagaggagctgggttaggggaccacgtcgaacacctggcggccgatgaatagtgacttttcctatttgtcccgattttagtgtattttccatataaattttattccacaattcctaattttgcatatatgcattttactcaatatttgtgttatcttaactaatgaattcaccctagattaatattactcatattttatttttatataatttatttgagttttaattagggttaattcttattccatcgtatttaaatttaattgatccaaatatggtcgcgataatattttatttatttctatccacacctaatctttattttaatttgtatttattttaccaatttgtttgtaaggtttattcctaattaactattctttactcacgattaataatcttcgagatcaaatccagataaaatagacgaataagatcggcatgatgcaattaatttaaaaagtttttgaaaatccgtatttttagagttttgattttgtcggtcgaattttcagggtgttacattatcacttctaccatctgtacacatagagtgtaatatggctataagcaaaacttgtgagactaaggaaatcaaagttctttgtgttgaatcatttcatgaaggcacatgatacagtgacaaccaaattaaggatagattatatgttggattttttttctacgtagaagttcaactagttcaattttttacacagttttgaagaactttaaaggtatgttagaacacataacacccacacaattgcttggctggtaatgcaaaatattagcaattgtttcaagctaattactttgttttttcatgcttgattgttttctttgaaacaacatttgtttgaaataagatcaatagtgtataaatttgattagtgtgtgtagtgtacttataaattttgaagtgttctacagtaaagtttgcttttgtcatgtagtccaattatatcaaagaatatagttttatcatgtaaattataatcaataagttcaatataatttatatcatcataattaatgaaacttatttaaaaaatatgactacttaaaaaactatggttcgcttttttttttctccttatttactggtgcctttgtctactcggaatcaaagaaaaaagtaacacgtcatgccatagttgatatatggctatatgctatttatcagtactctatgtccactcattgctcagtagtgtcttccactcaccaatcatcttgtgataatcatatagacaatatttgtctatttgtttagtttacctaaagggcaacaccacattgctcctttctcatgcatggtcgtagactctaaaatgatttgcccaaagcatgttcttcattaacacatgtaactagaacattaattacataatattatacaagtgtggcacacttggtaattttcgttctagtttcacccctgttctggaaaaagtgctttaggaaacaatatatacataattctttttctgaaacacatcatttaggaacttgggaaatgtgcaaatgaaaatccaaaatccattaggtaatcaacccttcattttagcttacactgagttgcattttgcaaaaacttgacccactggacttgattattttccttttgaaacacacgtccaatttgttttcactttattaacaaaacaatcattattgattgatgatttgatgtgtcctcaccttggcaaactagtagcgttgtggtgatcctgatcaccttagtttccttgatctggtgcgttgcattgttgtatgtgcggaaggcaaaggtgtacgcatgtattgtgtagaggaacgaagaccaaatagtttaactaaaaaatagatccatcagtttgaatgaaaatcgatgaccaaatagtttaactaaaaaattgtatcaaataatgtgtccacttgttggtttaagtataaattagttgatataaattataaattgttaatttgatagatataaaatataatggtataaacttcagacaatgtattatttggaaataattagtccaccagtttaagtaaaatattatcttatattattaatttaatgggttaaaaatataactttataactttatttttaaacattgtagagctaatgttcagttatatttatttgtaaagtgttactttatgattatatatatagtatatgtttgtaatactatattttttaaatttattatgactaatataattattttctcacatatacatgaaaaaaggtggaaagaagagggaagctggtgtatttttttaattgatgtatataatttgtgtttttagtttttttggctttaacgttcattttttggctttaattgatgttcatttttgtcttctcacataatgttttacgatatgtatgtactttgtattttgggtttttttacgagcaatacttatgtgaacaggagattagaagaagggagttttttaaaaaatatatctaatctaacgggtccatcaatttatgtgaaaattgaaactagatgttttgcttttttttcttagaatttcaagcaatttctttaatttattagagtgccacgtgacggcttaagagcatttgtagaaagtttaatgaacttttactatataatagatagataatttaaatatagaatgctgaagcagtgttgattggatattttatatgcaagatctagtttaactgcatatatttatagagtaatatacattatttctaaatagtagaaaatactatttcaaagctcatcgattttttttcaatgacactaagtgttttttttctttactttatcgcttaggttaatcgtttttcttttagatgtatgttcgtaatacttctttttctttttccggcctataagaggaaagtattatcttttaaaataatacatctaatctaatggtgtaaaatatcgggtccatcaatttaaataaaaatcgatgatgagattaaacaatgccatgtgacgatctaggagtgcttgtatgagcgctacatgatggttttagagcgtttgtagattggttttagagcatttgtagttagtttaatgtattttgaagtatataatagatacgtgtcagggctgtgcaaccgtcggttttaattactgtagctttctgtgaacaatagcagttcatattggtacataagagtcctgttataatcttagaaacacggttgagacaagcatggtggcccaaataccaccataatttattctatttgtccttctcccattatcaaattttttgtcacataaagtagctggccggctgtgacgtttgggccaacttattgaaatagataggtggcttgcttgtcatatacatcctccgtttttggaaagaaaaacaatttttaagaatgaatctgggcaaatgttcttttttatttacaggtagtaccttaggatgaaatacggttcaatgatagggaataagatatggcattgttatcctactaggggtttcccggattatctatatattaatcattgtttttgagggtggaaaactatatatgttaattaataaatcgatagtgacatattgttgtttcactgcagctactacacgaaggttcgagggcccaaattttgaacccaaattgcatttatgtgtcccccaagccaaatcatgagacaatcgacagaaagatcttgaagggggagcatggaggactaaaacatccacctcctcaaccttcaataaaatgtggtgtaaggaactccactacacgtaatatcacgtacatatttctatatatatttaagttcatctgaatctaggtgaattttcgcatccacaggtctatgccaactatttgtcatatttttgggcaaacaacaactttacacgaagaactctaggaatcaagaaggtaatttcggggcaccttttcatttctaggaatcactcctttgcatttgccatacgagcacatttttcaaattatctaaatgccaaatatccagggcaccataaatgaatgggttaggtgccacgaacatgatctaccatacaacatcgacatcaggagcagcataaagtatcatcgaaatgttacactaaaaggttaccgtgctttggtatattggtaataaatgttattggcaagttctcagtagtacctgtacaagctattatttagaacatttcaatagaatatccaaactagatgagatggctatgacaaatatatatatatataccttagacaagtacatgccatggctatcacaggaaaagggagtatttcatatttttgataaatattcttattttttgaggaaaatataaatagtcttattatttcgtcattaccagctagagatagcattgtaactatgttttgaataaaagattgttcctaaattaaacctatacttaaacgtgttctgttcatattatagtcttggttgttcatatcagttcttgtaaccacttggtgagaattgtacttaaaacataaataaatcatacacggggataaatcgaggataaaccaaaccttctgttagaataaataaattagagcccacctcaatattgactttggttgtgcagaactcagacgcacacaaaccaatttatttatgcaaaattctccttttgttgaataaaatattagaaacaattaccaggaattgattttacaaattgatcccatcaacacgttggattatgaagcagattactactatctgtaccaagggcagatattttctttatttataaaaaaatggacagctgaaggaatttctggatgtgttacataaacacacaaacattaacctcaattgaaagaaattgtattttttatatatatttcagcatgacatttcaaaaaggaattagtgaaaaatccttttgaatgaagctattcagggaaaaaaacatcaaatttgcaggtccactcttactaacatttcgactttaaaatcttttaataggaaaaactagtggtcattggtgaaagtaatgttggatgacagaacaacatgttggatggaaactactaacccaactaacaacgaatgtgtgcatctagcaaaaatctcttgatgataagtaatactttgattcactgtgttgagctacagacacatttttaccttcttaagatatacccagtattgtaaactactgtttcatcaaatttatgtgcagtggtgaccacgatgctgttgtgccattcctcgggacacaagcctgggtgagatcactcaactacccaattgtggatgactggagagcctggcatatcgatggccagtctgctgggtaagattaatgttgcctaattcgttttcttgtttagttatgtataacactactacggggtgattaataagattttcataagtttaaaatacactgtgtttttcagttcataataaactcagtcgaagagtacattacctgaaatacgatttatttatttgcagattcaccatagcatatggaaacaatttgacattcgctacagtaaaggtgacaatatatctgtctacaaatgcatgattcttgtttttcaaaaagcaaatgaaacttttcttttttacattcattatttttactatggttattttgaatgaagttaattaactcctacagtttcaaacagtttgggagtatctaggttctaatgatttgttaaataccagatgcaaatgtttggttgcagtatgggttgaaagttgaaactgcaaaacgaaaattttgaattaagggtacaagttgtacactccacattttcatgaatgaaaacttcatgcatagtgatgagtaaaaataaatccaaccattaatgtaataaagctatgtttgttattaaagataagtgaattgttcatgcttgttcaccagcataacttttgaatgaattggcttggctggtgcacagaactaaatttacgtactattagagctagagatcttgagtatgaatcactagtgcaatccatttattatatactaaaagtccattaaacatcatataaatgctcctaatacgcaagtagcactcttacaaacaatactaagatgccatgtgtactccaataaatcaaagaaattcctaaaaaaaaaaatccaaccattgcatttcatttaattgtgtggacccattattttcatgcatttgatttattttagattagaaaaaaaacacttcccaacccaacgtcccttccatggccagcacgtatgtcgatggaaatgcgtacgtactaactactaacgtacacaactcccctcgttatcttactcctgtttactcttctatttacgtgcaatattagttaggaagcataatttctaaaaaaaaaagtttaaacagctataacatctaagttatatagctaataagctaattatatgttcctaggttatttatgactaaatttacatttaaagacacatatttacttatatttcaagtttcaaaaaaaatatgtcacttctgtcttattttttttattttcgtgtgcaattaaaaaatattaaaaaaggaagatatagattttacctttgtacgtaacttcacaatgtctttaaaactagaaaaactctaagaaattgtgaggaaataaacatccaactatcgatttttcactaaaatcgatggacacattgttttcaaccattaggtatatttttagagaaatcgcgatcatgtgtcatgtcttacgaattagaaaaaaatatttgaaattatcaagaagaagcatcaggttttcacttaaatcgtttagaaaaattagaaatacgaactactttctactttatcctactcctaaaatgcacataaaacttgccccgccccctctcctcatgactcagtctctccgatctccacctctacctttctccttgtttctatcaaactaaaagagaaacgatctataacattaacatgaccataatatttaagccatagatctgatttctaatctaactattgccatattcataactaaaataacagttaaatgtacacaatgcctatatttctaacttaaaataagaaccatgtaaaataaaaaaacagaaaatagcaaatgtcaatacagactaagttgagccatttggagaaaatctaataaattcgtaaaataatttggtttttaatttttcacttaaattgaaacaaccatagctttttccattgccataacaattttaagtgcatggtcaacatatatattaatggcctcccatctatcctatagcgtgacataagttgacaaagtgtaattataaatttctccacatattatttcattatgtggctgggacaaaagtgattttttaatctaggagacatttttatcatttaaatatattaaagtttacggtctatttcacgtcatagaaatgataagaggtgacttcttttagcgacttcttttagcattgctttcataaaacaataactaatatgcccacgcatctgcaccggcttccatcatagttaaataaaaaaacacagcccacttctatgagttgcttgtacgtatagcattggggagtgttgaagtataaaagtattattctctcttcctcattcagcttatgtttttcaatgaccaaaggcagttgatgcaactcaacacaaatatacagcaaaattacagcctaagaggcacgctttgaccgttttcgtataatggaaacaaatccaataacatatgctttgagctgaacctaggacatataattaatttattttatttctagcattcaaataatcaaacaacattgatgatgtaaactattcctttagtggcctctacagcaaggaacttctatatctaacccgtagtcattattaacagttcgatgaaagaaaccagttatatttcatccttagtcattatcaacgacaagatagaagaagaaaaaaaaattcaagaacttgacaaaagaccaactaattattgtttgtgattttacttgttttgaatatgcattgtaatactgttttactctctccaaatgtagggtgctggacacactgcaccagagtttgagccggagaggtgctttgcaatgtttaagcgttggatttccagcataccactatgatgatggatgtgcatatcgtgtaacttgcacaaatggaggattgtagtatgaatgtcatgggtgaataaaatcaattcttttttgggaaggctcaaaacaagactattttttgtaaatttgattctttttgacgagacccccactaggttccaggcggaccagaagtcctctcacctacaaaaatcgctccttggggatggttaaggggccgcatgcaaaaatttatttcacaatcgtctccttaagaggtccacctatgataataggtggggttgcccgcgaaagtatattttcgcaagcagacaacatggagagaatgtgtgccccatgcgtccccgcactgacacgcactaccttttctttcttgatcttcaccttttttacacctcctctccactcacacacacctttcttctcttctcctcccctttgctctggtggctaaggcttcacattccctctccactccctcttcctctcctcatctcttccccattcctctcccccttctcttctccggtggttgagacggaggcagctaggagcgacgctgacggcggcgacggtgactactgtgagggcggagcagaaggaaggtcgatccggtggcgccgcccttgggagcgtcatatcaaccgttagcatcacgaggtcgataagcccctcaactgccacttagtcgtcacattccaccgctagaacgcacctccctctagccagcaatgcgtgcctccccaggtcaagccggtccctgtccgccacctcctccgtctttcctgtcaccggttcgccactatcgacaccgacccggagccgtcgccatcttcctcgcgtcgccatcgtcctctcatcattgcccgctgtcgtgagccctcggtgagccgcccctcctcttcctccccttctgccgccgctccgcgcaccctccgtcgcgccagatggtcgccgtctggcaccatcgggctgtgcatgtcgcaccctcacggtggggaaggccgaccgcaggaagccgcttcccagccgtctgatatgccccacgacagatctaggccgtccaccttgccgcccgtgtggctgctgcgtcggcacaacatgtgcaccacatggtgcacctgtccccagcctagtggacttagtccactgtgcgccgccctccttatgtcaacaacgtgtgcggcccgcttgtcggtgctggcctccattcacttacgtcagtgctcgagctttcatgcgcaataattcataaagttttttttctattagtatattcatccgagctccatttatgtcctttcaaatcgcactgaattcatcaaaatgcctagaattcatttaaaatgtttttattttccatttcaaaagacttatagcatgtttgctttgtgtgcattgtttgtctcttagattccatcagttgtgaacccccgttttacttcaaagtggttgcagaggtttcagcagcactagagcaaggcatgtcatgcatcctcattaaacatattgtacccatctaacaaatgtctcgctttgtattaaatactgtattattttacaatgtcatgtggggtagtttcctacatacttagccacagtttaatcatcttgtaccattgataagttgggaattaatatgactagatgttggtttaggaaatgcctagccatgcttagatcaactacctcactatgggaatctcacatataccttatttcttggattaatgatgatgacattggacatggatcaacatggtattaattcaacgacaatatgcgtaatggtgggctatgggcatatggttttgatagaagcgcccaggcagctaaggactagttcgtgggaaacaactgggtctgtagtatagctcttccctctataacgtatccaggcaagggttggcgtgatggagttgggttggccctggtttaagcgttgatcagttgcgagattcatcgcggtgcacatggggttgcccacccctatttaaaggtggcggttgttggtatttcttacgttcacagataaatctgcaagcgcacggatattgttgtagcattttacccatgagtattcccaagggtatcgtatttatattctgcaggcacggcggcggcgtaaagatataaattatacatcattcatctatctacaattaatccaccatagtctaaaaaggagttaaagataatatgattaaggtagtggacacacagtatgttcacctctatattaatgcttagtagaacagagtattagagaactatgatacaactgtacttctatactaatcatgtctaatacacacttaacatatacatgcttacaacataggacttagttccaggcacctaggtactaccgagagaccactccctgctagtctgcaagcgtagttattgcatttacgcaatacgtcacacccgaacgtggaggaatacaaatgatggacatggatatcaccacctaccatctacctcacttttcgtggggcacacccacatccaatggcatttatataacctaagcactgtgcttgtgctagtaaataatgtcacttactcccctaggactcccaccctacgggtagacaagttagcgctagagctacctataaaggtcattagaccgttactgtagcatggatcaactagcctagctagaatgaagcagttatacaaagtatatactaatatactgcctggtgggcccttccatccgcgtgctcgcacatgattcgtcggaggtgtgtttctttgcatgccggcttcatttttccttcactttgatgtatattctctacatccatgttaattctctaggtccagtacatttaatttatttattatctattatatactaaaagtccattaaacttcctacaaacgctcctaagccgccacgtggcgctctacaaacgctcctaaaccgccacatggcactttaatatagtagagaaaatcttaaaaattctgataaaaacaaaatacatctaaccattgattttcctttaaataggtggacccatcaattttaaccattagttctctattaaaaaatccggtacaacaccccgcaccgtatttgcgcacgtacgtaatccgtactccctccaccctccgtatctcttctcctctcctattttctaacttacctttcatatttttctagctaacagttaatatataattgtaattagatagatcataactctcaaaagttatcataaaagaaaaaagaaaaagatccgtccgtcgatttcaactaaagctgatggatccactatgcatgtcaaacagttagattatatttgtaaaggggcaattgcttatttgaccccgttttgaaccctaactaccaatttgaccctactttgttgagtttgcttatttgaccctcctttttgaaaatgaagatacggtataaccctattctgttaaaggcacctaatggtgttaactgaagcacaaaatgtctcttatgcctttaatgatttgaccctattacatgtgcgacccacccgtagttctctcttctcatctcctcctctcctctcttctctcttcacctctgcttctttcctccccgccaccccctcctccctaggcgcgccggccccgtcaccactgatctcttcgcgtgtcggcgccgctgccgccgcctctctccagcgcaacgccacccctcctcccaccaccgcgccggctgccacgacctccctcctcacgccgcccccgccgctgctcctctctccgcgtgccggcgcccccgccgccgcctcctcctgctggctccccgcatcggcgtcggcgccgccgccgcctcctccttcccagtgccgcctccaccacctccttccccatgccaccgacgccgcggagatgtcaacgagagagggtcgggccctcctccccgcgccgccgcctcctcctgctcgctcccctcatcggtgtcggccgcgccacgcctcctccttccccatgcgtcatcccactgcggggcgcaggagctagggatccgctgccgcaccagctggggatctgccgtgatgaccgggcgccggcgcggatcctcctgtctcgccgccgccgcgcacgcagagcgccgccgccgccctcctctacctccacgccggcgcgaggttccgattcacgcagccaccactgccccctcggagcgccaccgccgccccctcagtgctgtcgccgcaattggcgcaggaacgagagagagaaattctgggtattatgaatactggttacatttctttttttattttaaataaaaacttaacggattagtggaagcagggttggactggagcttcgttttgaaaaaggagggtcaaataagcaaactcaaaaaaaaatagggtcaaattggcagttagggttcaaaatggggtaaaataagcaattgtcccatttgtaaaataacaggcctatgttcggccttggagctattcaaaaataacgaacctttttctctctctctaagtgtacctacatatgttaggatatgtttagatcccactttaaattttttcactctatcacatcgaacgtttgaacacctacatgaagtattaaatatagactttaaaaaaaactaatggtacagattgggactaattttcgtgatgaatattttaaacttaattgctctatgttttgataatatggtgctattgtaaacatttgctaatgacggaataattaggcttaataaatttgtctcgtggtttactaacggattctgtaattagtttttttattagtgcccaaacaccccataatcgtatataatacctgatgtgacacaccaaaactttacacccatggatttaaatacccccttagtcaaaaaataaagtgtacgtatatagtgcaagagtataccgtggttaaatacttaaaaatagtattcaaataaatataacttcttaactgtgcatgcaatttccaactggtttgtatttttatattatttttgattaaattaataatttaagacccatgttaactatattttgattatagttatgatattctatgcatcacagttatgaaatattttctaaataaatacgatatcaaatgtgctattatatattaatctagaaacgtatatgtagttaaatttgatccatgataacaatgatgacgatgctctacgtatttccatggtgtatataattttttaagtagtgtcaaataaccaactacactcatcaaatttaaaagatgataaatgtttatatactactaaaatttgatagtataatttaagtgtaccaattacttaataaaaatgtgtctccactaaataaaaaatagactcaaaacacgtaatgattccctcacggatacaatattcttttgttgatcttccctatcttcaatttgtctccgtgaatcttctcattgtcctcccttatagtccccaccaattcatcccataataaactatcataatatatatgcaattaaaaaacaccttactttttacttctgttgacatgttttccaaagaaaataagtctaccttcttttcatatgaagaagaagattataaataattgcttacagacattacttaaatatgatataatataaagctaataggttagaaaattataaaaacatttaatgtcgatgaaaaaactttatggagaaattgtggcagatgttctccggttaatatttcgcttttataagtgtctcaaacttagcatacgatatatgcccgtgtaaatgtgtgggctacctttctagttgttataagtgtaagaaatattagttatccttttatttattatgatagttgacagtcgaaattggtacttatcgaccgtcaacaggggtgaaacctcaacgtggtaagcttgattaaagggagttgtgtgaagggtcctgtcccttttttgatatgttgttgtggcatgtcgacgcatagaaacgtgttgtttggctatgtttcatgggtacagtctgcactctgtttgcagatattgaagatggggtcagatcgacgcttaatctgaagttagttcacatgtccatatttttctttttttctatagatacattcaggtgttttacacgcgatgatttaattaaataataaataagtggtgttagagataactagattgctataggttgtcgatcaaacataaagaagaacaggtatccttacccatatcaagatatagtttactatgggctcgtggccattaattaatttgcaatttgggagatggtcagggctatctgataggtaatccgccgcttactggcgaaggcattgtctacgcatcaaaagtgccgtactgccatggagtcggaatcaattcagatcagctatatgaggtaagcacttaaacacgctgctcgcaaaattttaattatgtcgaatgattcctgctcgggcttgattaactctgcttggaaatgcatatgtatgtgatttgtctgaaaatgacaatggagactgcgaattgaagttgatttgcaaacaagctttggccaagcttgacagtgtaaggagacaagtacacttccgttttttcgcgattgtatgagttgaattatgatgacaattgctagcaggaaaaaaaagaaatttccctgataattctgtcacaattaactcattaattgcttaagcctaaataacatgtcatttttttaagtttcttcaaacaaatacatacacaagtgtccaacctggatagctgaaacaggacaaacactttttccccttggagcaaatatatgcaccggtggttataaataaactaattaacattagacagaaaattaggggattgtgatcccatggatgaatttttttttcttccaagatttggaccctagttttcggtcaaattctatataggtagacccaagtaaatatcattcatgtttagttctcaaattagtgaattttaagatttaagtactggtgtgtcaggactatgtaaccgtttgttttgattaacgtagctttctgttaactatagtagttgattggtatagatgcgtcatcctgtgatatataatcctacaaaacactcatgttcagacaaaaatgggtggcccacgtatatacctccatttatcatgttttcgccgataaagttgctgcagctggttgtgacgtttgggccaatttattgaattaagtagacatttttgggttttgcttgttatatctatgccacctcttatccacgggtaattatcaaaatctaaacacttcatcttctcccccgtatcattttcataacattttaacattcattatttgtacaatattttacatatatccatcctatagcctaatgattacaagagcctcagtagcacctgaggtcctgggttcgactccccatgggagtgaattttccagtatttaacggcgttgtgctttcagtggtaggcgatgtacccgttgacaacgaggcgcctgtggggacttcgtcaatctctccaggatttgctggcccaatcttcgaagatgctcataagggtgagtgtgcgtgcgttgtgagtgtctgcattgtactgtgtaattctaaaaaaaaatttacatatatgcatctattaataccacaacaaaacacgaggtatcatccaataggaacgatgaaatgaaccaggttcagtgattggaaaaaaagtacttaaaaacctatgtattaatcattgttttgaagtgtagaaactgcataaatcaactactcctttcatgactctgtccctccgtcccaaaagttgttatattttagaatggagagagtaataaactgatcatagctaaacattagattggttagtcatatcaaactggctatggaagacattgtgggcaactttttgtgacaagtcgacaagcacgattgcagcacctaaacaccttgcggtgatatggagtcaccaacctcctcgatctagccaaatggccaaatcaagatgggttatgtagaaaaacaactaaaccggctaacggagccgatttagagatcaaaatcagcctctaagccggtttagatcgatatgaggataattacatgtttcgtgggcaaaacgaaaggttttcaggacaaacctacaaagatgtgtcacactctcgcagcggcggcggacaatttacggcacaaatcgacaaagatggactaaaactagggtaaaatagaaaacatagctaaaaagtaaagataaaagaaaaagcgattcaagtatattgtgtgtatgggagattacaattgaaccggccttgtcccttaaataggggttggtcttgccctctacaggctctcctccatgtccaacttggtatagaaaccaaaggaaatccaaaatatgccttcccaagcaagaaaacccgagacccgacgaaaacatactcagactcggaatctgacggtctgaccggacccatacctgcggtcagactggagttcaagccacggtcagaccgcccacatacctacggtctgaccggccccgtgaaggaaacccgacactttccaaactttggcaattttcccctatttcgtgcataggtgccaaatttcggtgtaaacagacatattgttgttcaactgtagctactactacaccacggttcgaaggcccaaatacgtccccccctaccaaaccataagacaaccggtagaaagaccatggaaggactagcatgttgcactgaggcaaaatatgttacaggatatccagaaaatttgtaattggctagagaacaccgcaaaaacgtgtatcaactatagagcaccgcaaataactggtaattagctgcttgttggcgctgttaatgacaaattttatgccaccaatacctgcataaatcaaagaaatagaacatccaatatagtgatagcgttaaattctaacatattccacaaagtgttagtgtatatttatatgcaggtaataaaccgccaaagatggatgaaatatagacttaagtgaaggagaattcccatccatatcaagagtgggccagaaactatcagaaaacatattcaattgggccttccactcgtagatatggatagtggaggaggaggagagacaacatgccaaaacttgggcctgttggacctggcctgggttcggccgaaccactcccacggcagttcgatcaaggttttggcatgaacggtcatgggttctgccgaaccactccaacggccgttcgatctaggttttggcatggacaatctggatgaactcctgatagcggttgaagggcaaaaaggacattttgtgttttctaaccgtcatacctacccttatataaggacttcacctcttcacttcactcacacactgcaagcttgtcacgcccagaagtttccccctttttccttgctttaaatatttgttaaataaatcgtccgaagaaattatcttaattaacctagagctaattccataattaataaatgcaattaataatcggaaatagcgtggtggaatttttcttgagttccccatgctccaatgcattaacaagatttttagtggaattttcagagccttggaaataattttaaccaattaaaaatcaccaaagtgcaatatctaatcccaggaaaatccttctcctctttttcttttcttttccttcctttttctctagatgggccatcggcccatctctctccccgcgctcggcacccctttcctgggccggcccgctcctcctttcccctccccgaagtcctccctccctccctttctctttcgggtgccgacaggtggggcccacctgtcggtcgtcccttacctctggtcgttggagccggagctccaaccgcccgcgccgccgccttctccgctgcacgtcgcgcctccactccgcgcccgcacctcgcgcccacgtcgccgccctctcccccgcatctcccccgcgcgcgcgcacccgcaagtggtgggggatttgaaatcccccaacaccctctttctctcctccacctctccacgtcgccggccaaataggggccatccccggccgtttccgcccctccctcgccataaaaaccctcactcgagctctctctctcatttcccccattcaccgtcctctcccacgccctctaccgccgtcgcgccgcgctcgccgagctccgccgctgccgcccatctccggccgcgtgccgtcgccactagggccgccgccgcgccaagccgccgccgcggctagctccgccgccgtgtgggccatcttggccaccgcctcgcgtcgccggaaccccaccggaaccgcatctccctcgcgagccggtgagctatccattcccctccgtctccggccagccactttggtcgtcgcggtcgccttctccatccctaactcctctcctcccctcctctaggtgtcgccgccgctcgtccgcccctcctctcgtcgggtcgtcgtcgccgccttcgtcttccgctccggccgccgtgtcgccggtgagtcctccctccccctcctttcctcaccttcccgcgagcgccggccacgccgctgctccggccatgcgccgctgcctttcggccgtcgccgccgcttcccgcaccgccggtcaccgccgtcggtggccgtgcctcgccgccgcctcgccttggtcggccggtcggcccttaggcagagccgagcccggccggcgcctccctcgcctcccctttgagccaccgcctggtggggcccacctgccaggcgccacctccctccctttggagccgctgacccgtggggcccacgtgccggcgccccccctttcactgacgtcagccctgggctttattgcgcaataaaatgattaaggctttttctttattagtaaaaacacagtttatcttctaaaattcttaagtaattcatccgagctccgtttaagtccattcaagtctcagtaaatcaagaaaaatgcaaagaatccattaaaaatggttttgtttcctgtttctgtagtcttatagcatgttttgcttgtgtgctttgtttgtcgcataggttttggccgtttcgtcgatccgcggtttctcgaagacgttgctgaggtctcatcagttcgagagcaaggcaagtcatgcaatacgtttgatcatattgtacccaatttacaaatatcccgcatttctattaaatgttgcattcttttacaatgtaatgtgggatgggtcctattcctcagccacatattggttacctgatgccattgataacttgggtatcaaaatgactagatgttggcttaggaaatgcttagccatgcttagttcaactagtacacaaatggggatcacattattacatagactttgtctattggcatagctttagattggtgccaccgcaagggtgtcagttaattaaaatattctgaatggcgggctgtgagtgcatggttttgctagtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccgaggtgttcggttgtccagctgccggattcaccgcggcgcaagaggggaccgcccactgccttttgaggggtaggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagtttaggtggttggttgggcctgttgcaacgtggtgtagcgttggacagtgattggttaatattgattaattactacagctgttttactgctttcaactactgctttgaaatgcctgctttatgcaaaagaacccctagcttcctttggttatatcctgcatcatacctcctcttccggtatgacttgctgagtacagtgggtagtactcagtcttgctctcttttcccccacaccagagttgaagttcttctcagttggagccgtctcagagaggttggtttcgttgctgccgtcaaggtttgcctgtggagtggagtcgcccgctgctgaagtcaagcttcccggtttagctcgctttaatctttcccgctgcatttgtaatcttttatatttttgtaagacgtgggtctgtatgtcaacaattgtcgtttgtgtaccctggctggtcctggacagggatttaatgcacattcagcttagaaattctggttcaagaatttctgggtgtgacaaagcttgagctgaattataagaggctctattgtactatgttgtatactagaataggaagagagtagagtagaagaagtcggaggaattgcggagttatcgtaatccgctccctgtttctttctgctctgttaattactttgattataatagaattatcttttgagtaatttagtttttctcggttagaattatctcttggttagttcctattcagagtacgggatcatcatacactataatcaactaaaatacagtgatttactttagtgtgtagctagcattaaagtaagtaatttccgttgttttcatacgactattttgtgatacagatcaacaatactcttagtatcagtttttactcttatactatatattgaacacatcagtaaacatattactacatggtggctatgagatcatggctatatcgagaggaaggtggtaattgttttacttgcaaaccacgaaatctcagtttttactcttatactgtgtaatgagcacatcagtaaacatattactacacagtgactatgagatcatgggctatatcgagaggaaggtagtaattgctttactcacagaccacgaaatctaaacaatatttataatattggtaaaagaataactagcgttgtaagttgtagtaattcttttaagaccatctaggtatggcgtcatacgatgtggaggcattggcgtcatatgatgtggaggcattcatgcaagtcaatttgttacttttgattgagcagatgtgggaggctgggactaaatgaaaaacttcacggagtaaattcgttacttttgaaacgtgcagagacactagaaaaacgaaaactcagaaagaaaaactagacggtaaatagtttactaaaacacgaaaatagaaaaactacatagagggaacaaaaaaacaaaaaaatctggatggttaatatttaactgggcccatgatgaagcacggatgagatggaaaagtgaaaaaaagaaacacggaaggtagagtggtaaaaaagaataaaacaaaccgagaaaaggtgggatgcggaggaaaggtggggtggtaaaaaaaagggaaaaccggaaggagagggcgtcgtgcggcgctcgaactaatattccacgctgtagagcgcagaatagcgctacctgtaacttttaatatttatttaataatcaagttaaaagtaaaattgtattaattattaacaacaaataaaattggtttgtcaaactatgttcaaagagaaataaataatgtgaacgatatatatgtgttaaaaatattgtgaagaataatgtgaaggaagatgattggatgttgatttgcataattcaattataaatgatgttgcatgcttgcataagttttgcatataatcattgctagtggatgatgaggtggcatgtttacatgttgagcttaggattagtgggttattactttatagtaagataggataacactagggctgtttccgcttcacgctccagctcccttatcttgtgagctcgccagatttgactattagacatgagaggcgtgtagaagtggagccagggaggttcgagcggaacagagagacgagagggaggaggtatgctgccgcaacccataaggagagaggtaaaggggagaggcagatggcggctagggtttgggggacggaaccaggacatggggattaggtaatatgtgtaaatttttccataaaacacccttaacttctgtttttcatagggcagtcccattttccgttctatttcgcttcgttacgtagaatattacggtttatagagagcatctagataataatgcagaaagtagaaactaagtaccagagatctaaaaaaattaacaaagaaatcaaggtttttgtttttgcaaaacatcaaatgtcgacgcggacgcacaagagctagtgaaaaccactaggcttccagcatcttgttgttgcaattaatagatgggccttagccctctcgaagattaattctttggaaaatcacaaaagcccacctcatgggatggtatgcatgggagtttagtaccacctttcttattctaggagagggggacctccttaaaagggtggatgccctactagcaacttgaagcatgtgaggtggagagaagagggggaacacgcgcgcgtgctcgctcgctcggcatggcatggcagcgcgtctgcacgacgtacgcatcgaatggtccgccaaagttggttcctcacccttgcgtagatgcagcttccttctgcagttttgttttgctgcgggaaatctggatttgtttgttttggaaacattccgaaaaatctagtgcgagaaaacggcgtggagtccggataggttacgcgcgacttatccagttcggttacgtggagtggacatcgtacgagcgccctgatcaagcgacctttctctatataaaccgagccgccacctccacgcaacgatacgaaatcaatctagggtttgcctcctccactatactgcgccgtcgctcgtagtctactccatcccactcgtcagcgtgcactggtgatcgggagagtaggtctccagaacctgtgccttcagcgtcctacaccgggggaaggcggcaataaggtttttgggaagtgctccgtgcgactgctccttgttcgaccacgacggctcgtcttcctgttcgctcgcgtgctgtgcgtcgttgtcaacgcctgcaactgctgagcaaccggtcttccactaccctcggtacgtgctcaacatactgtgcatatttgatttgttcatgttatcctgcttagtttacatgtgtagatctaatgatacgttcatgctagtttacatcttcaatgtcatgatttatttatggaataaattaaatcattatgtgcttataaattcaacaatccaaaaaccttattataggcactgtggttttactatgattggttttgccgatgcactgaagccggataaattcaccggtgtgcactttaagagatggcagatcagggtcactctgtggctgatagctatgaaatgcttctggctgagtactggcaaaactatgggagttcttactgctgaccagcagaaagaattcgatgaggccactactctctttgtgggatgcattcttaacgttcttggcgatcgtctagtcgacgtgtatatgcatatgaccgacgctaaggagttatgggatgcactgaataccaaattcggtgctactgatgttagcaatgatctgtacgtcatggagcagtttaatgactacaggatggctcatgaaatacagaccatggctaaggaactcgaactccttacatgtgtcttacccgataattttgtggccggatgcattattgcgaaactacctccatcttagagaggttttggtactgcactcaaacacaagagataggaatacgccatttagtggttgatagcgtctcttgatgttgaggagaaagctcgagaaaaagataccgcgtctaagggcgatggtggacagtctagtgccaatattatgcacaaggcccagaacaagaataaggggaaatataaagctcaacagaccaccaacttcaagaagcagaagaagaacaacagcaatccgaaccacgatgagtgaacttgctttgtgtgtggtttgactagtcatctggccaagaagtgtccacaacgcaaggggatgaaggcacctgtagggcagacttccaagtttgctaatgtaaccattggtaacactggaaaaggaagcgggtatggtaatttacctactattttttcagctaatcagtctactaattggtgggttgatacatgggccaatgtatatatttgtgctgatgtttcgttgttttcttcttatcaggtagcacgggattccaccgtcctaatggggaatgggtagatatgaagttttgttgttcatggtgtttgcacggtagatctgaagtttacttggggaaatatcgtgcagttgaagaacgtgcagcatgtccctacaatcgatagtaatcttgttagtggctcccgtctaactagagacggatttaagttagtttttgagtgtaataaagtagttgtgtctaaacatggatattttattggtaaaggttatgagtgtggaggcctgttccgcttttccctttctgatttctgcaataagtcggcagtgtggatgatgaggctaatgtttggcactcacgtttatgtcatattaattttcgcttgatgtctcgcctttccaacatgtgtttaatttctaagttttccattgtcaaaggttctaagtgccatagttgtgtgcaatgaaagcaacctcgcaagcgtcacaaggctgccgaggagagaaacttggcacctctaaaactcctacattcagatcgctatgaaatgaatggggtgttgacgaagggtggaaaatgatatttcatgacgttgattgatgatgctactagattttgctatgtgtatatgttgaaaatgaaagacgagggtctagactattttaaaatttataaggcagaagttgaaaatcaacttgacagagagataaaaagatttaggtctgatcgtggtggagagttgttcttaaacgagtttgacttattctatgaggaacatggcatcatacataagaggacgcatccctattttcccgagtctaatgggattgccgaaaggaagaaccgcacactgattgacttggtgaatgccatgttgcataccgcggaactacttaaggcatggtggagggaggcattgttgacgtcgaatcatgtgttaaacagagttcctaacagaaacaagaacaaaacaccagacgagatatggattgggagaaaaccatcactttcttacttgtgcacacgggggtgcttggcgaaagtcaatgtaccaataacgaagaagcgcaaacttagacctaagactgtggacagtgtcttcctgggatatgctcatcacagtactgcctatagatttttaatagttaaatctgaggtacattttatgcatgttggtacagttatggtgtctcgtgacgctaccttctttgagagcttttttttccaatgaaggatacacatagtacttctagccaaccctctgaaataattcccagttcaatcacaccaccagaacaaaatgaacatacacatgaacatgtcattaaggaggatggcagtgaagctcgtcggaggagtgagagataaaggatggctaagtcttttggtgatgatttcactgtgtacctcgtgaatgacactccgcagtcaatttcagaagcatatgcatctcctgatgcagactactggaaggaggttgtccgtagtgaaatggattccattatcgctaacgggacttgggaggtaacagagcgaccctatgggtgtagacctatggggtgcaattgggtgttcaagaagaagtttacgcctgacggtactattgaaaagtacaaggctcagcttgttgaaaagggctatactcagaaagaaggcgaagatttctttgacacttactcacttattgctagattgaccacaattcgcgtactactttccctaagcctcacatggtcttgtcgtttatcaaatggacgttaagacaactttcctcaatggagagctggagggagatctatatggatcaacctgatgggtttgcaattgaaggtcaagaaggcaaggtgtgcaaattgatgagatctttgtatggtctgaaacaaactactaagcaatagcatgagaaatttgatagaacatttacatttgcaagcctccaagtcaatgaggcaaataaatgtgtatactatcgctatggtaggggtgagggagttattctgtgcttgtatgttgatgacatactaatatttgagacaaatactgaggtgataaatgaggttaaatcattctgtctcaaagtttcgatatgaagaagttgggagtagctgatgttatactaaacattaggaaaagtaggggtgagaatgggattacactcttgcagtcccattatgtggagaagatcttgaatcgctttggctacattgacagcaagccttctccaacactttatgatcctagcttgctgcttcgcaagaacaagagaattgctaggaatcaattggaatattcccaaatcattgaacataaggttggtgctgtttcgtggaggtcttcacactgggtggtggtgttgtttcgtacccatgtgagttatactattgtggtaacccagtctatgtgatcggagatcccgtgaattggatcctgggaagaacaagccataagttaactgaaggagagtaccaatataaaccctctctaagtgaagatgcatgtactctcgtgagctgcaaggcaggttggctatgccttaatgagttttgttggctttaatttgcgaagatgctgtcctgcagagcattcttgaaagaactcacctttgtgagcttgactgttggtcgcagtctacggagattttggatgaatcttctaggaagcttactaaaagaccaaggagtatgacttatacgctccaaatgaggggtagtttacagacggtctagtatcagataagactctgagtaaaatttgcttgcacaagacttgcaatgcaaggcatagtccattgttcaagttgtgagtaagtgtagcttggagttctagatggatgttcaaccttaatcggtctccatcgaaccgttggtctataaaaagtacattggaaaaggaaaatctcagtgagattttaagatttggtgggggattgttggaattaacagatgggtcttagtccacttgaagattaattctttggaaaatcacaaaagcccacctcatgtgatggtatgcatggggagtttagtaccaccttgcttattctaggagagggggacctccttaaaagggaggatgccttcctagccacttgaagcatgtgaggtggagagaagaggcgaacacacccgcgcgctcactcgcctcgcctggtccaccaaaattggttcctcacccttgcgcagatgcaacctccttttgtagttttgttttgttgtaggaaattcggatttgtttgttttggaaacatttcgaaaaatccggtgcgtgaaaatggcgtggagtccggataggttacgcgcgatttatccggttcggttacacggagtggacatcgtgtggacgccctgatcaagcgacctttctctatataaactgagccgccacctccatgcaacgacacaaaatcaatctagggtttgcctccacgcaacaacatcgtgcgggcaccctgatcaagcgccgtcgctcgtagtctactccatcccgctcgtaggcgtgcaccggcgatcgggagagcaagtctccggaacctctaccttcgatgtcctgcatcgggagaaggcggcaataatgtttttgggaagcgcttcacgtgactgttccctgttcgaccacgacggctcatcttcctgttcgttcgcgtgctccatgctgtcgtcaacgcacacagtaccctcggtacgtgttcaacgtgttacacatatttgatctgttcatgttttactgcttagtttacatgtgtagatctaatgatgcgttcatgctagtttacatctgcaatgtcataatttatttatggaataaattaaaccattatgtacttataaatttaaaaatcgctgacgtatatcagcacctacagggggccacgctagtcaaaaattgctggggaggggtgaattcccagctacctttaatactttcggttgcaacgtaagacttttaacttatgtggcgaacttatgtggcgctgtattaaatgagagagatgaaaaaaaaacttggtcttatacaacacatatctcaaagggaaaaccaatacactattgctgcccccagttttggaaacaaaaaatatattttgtttccctataccaacccctagaataacagttggtacatacaaaaggctccaaaatgtaacgtacccaaactctagacctttaaaatttcttgtcaagatagttgaaagattacttttatatttttgtgagacaaaaattttcattttaaacataggtgaagataaaaccaacctttatatgtaggaaaatgagagcaaaattaaaacctttttcatttctaacctgagattaaaaaaaagtgcaaccatatgtgtaattatgcatacttgcataggacatagtttaacttgagtcttttttcttgtgcatttgtatttttggttggcatggcataataggtctgatgaacatgattaaaagctaacttcactaagcaaacctaaagtcattcttgaggtataactttaaagacatgaaaatggagttaagtaataacatgtcaggtcaagagaaatccaaatataattcttataaaatttagatgcatttatgcattggaaacacacatataaagaaaggtcttgctaattatcaagaacaatccatgcaagacaaaatcatgagaaaattcatgaaagcacaaatcaatataatcagctcactataatttttactcaaattaatatttaaatttcttagctcaaataattcagtcaaagcagtcaactataggatgtaaaatttaactttaatctgctaaaaacataactcacaaaaatgtgcattaaactgcatagaagtgtatgagtgaaataatttattcacatactaggttaattatcaagagcaaatataatttttctagagtttatttcttctatttagacctcctaaaattcaaacaaagttctggtgagcccatattctctatttgtctgacagcaaactacacataattagtacaaccaaagaaaatagaatctagataatttcatctacctccggaaaaatccactataaattattctgcacagaaattaaataattgaattactaaagtgagggagagaaataattcaggaaaatcgttggaaaacatcttccactcatgttcctacccttacctctcttacccacatagctaccatcgacctgggcccatctagcagctccttggccacgcgtcgaccggtgcctagccgtgtccgagacataggagtttcgagaaatgccatcatagaaacgattttgtaactcaacagcacggaatagacggaaccctaacagagatggtatttttagaataaaattgttagtacgatgatatttcttggaacttacacttgtccatggtgtttctgggacttagacgcttgtcaatggtatttcatagattatctcttattatatatgtaagtctaccgtctattccatctagatatttctttagaaatcgctcatggtggtgctgtgctgtcctgtccttgaatccgacgatgtccctcctcctcctcctcctcctcctcctcctccttagcttattctctggtgtgtccgccgaagtgccattgacgcggacgcatgtcaccagcctaccaggcttcaacggcgcgctcccttcccgcctcgagacggggttcgtacgccaaaagttcttcgccatcatgttctacttgaccatgaccaggtacgtgctgctgctgatgtgagtcttgtcgtcgatcgatcagatatgtgaccgtcgacgaggagaacggggcagagctgttctactacttcttcgagtctgagggcgaccccggcagcgaccccgtcctcctctggctcaccggcggcgaccgctgctccgtgctcagcgccctcttcttcgagatcggtcagcaacccaacagcaaacaagccccgttgtcacccaagagtgtcagatcatgtggtaaattcatcgcgtaagttgcgattaccccgcaggcccattgaagctggtcatcgagccctacaacggcagccttccgcggctgcactaccacccttactcgtggacaaaggtcgccagcatcctcttcgtcgactcgccggtcggcgcaggcttctccttctccagggatcccaaggggtacgacgtcggcgacgtctccgcgtcactgcagctcgtgaaattcctctccaacgtaagcccatgttctagttctacgcaattaattggctgtatttttcgaccatttttgttccaagaaacgcctctgatcgcctgtttcagtggttcggtggccatcctgagtacctcacgaatccgttctacgtcgggcgagactcttatgccggaaagatcgtcccatttatcgcgcagaagatctcagaaggttttgcatgtttcgcagcaattacgactacttcacaatttaacgattccctgtttttcagatattgaagcgggggtaagaccgactcttaatctcaaggttagccatctgtctgccattgattaatcgcagaagaatcattaccatggttaatacgcagtggctaattaacaagtaaaattgcagtctctcgtccttatcgaaatacgtcctcgtgtacaacttgcatctaactgtagttcatgtacggtcgatcttataatacgggcagtagtccaaaacgttaccatcgttcttgattaataatgtttgttcatcatataatagtacaaataagttcacctaaaagctttgacaagtttaattaggactgaccattcgtctatatggctagctatatccatttataattgtaggaactgttgttagagatagcaactgaactaaatactggcgccaattttattcagtaactagtcgaatccaataccaatatccggtctctatatccatgcatgacagattatgtactcgtactaattactttgcattttgagtgttattcagggctatgtagtagacaatccaactacaggcgaaaggatcgactacgaatcaaaggtgccatatctccatggtgtcggaatcatttcagatcaattgtacgaggtaattttaattaactaaacacgcttcccatttattatgtcatcagtccaatttcattcagactgactttttacatttcttaattacaccggccttaagacaataatggaacgctgcaaaggggaggaccacaacaaccccaagaacgtgatttgcaaacaagctttgactaggtttaacgatgtaaggtgacaagtacaacttcattttttatcatccttttgacttctttttcccggttcaaattacgtgcatgggaatttctgttcgaatcaagggaaacgtctagaattcgtccttttggtttaaggtccctaggctttcaccaaagaacagttttgctataaatctatcgtcaaattttttccttaaaatttgacgttttttcaactgtccgattagcacctgattagggcaaggcacatcccacggttcgtgcggaagagacagcagggcgcactgatgaccaagtgaagtactgtatgtatgcatctttttctagctttgccactgtatagaacgaaagcgattgaacgataaaacgtccttaatacgggtcagagatctcccgtgatgtctatttcgtatgagcagcagtgttttaaaagttacatgcaagttacactagaattaatgtaagttacaatgtaaactataattgtactatgtttctttaaaatataaaactacagtcctatataactaaaattacatttgtaaatttatttgacatgacatgcaagtatattgtaattttggtaaaaatattatgtaagtaaatatgtattcgttattttctttaaaatataaaattacagtcctatatataactaaaattacatttgttaattcagttgatatgacatgtaagtgcactgtaattttgataaaaataatgtgtaagtaaatatgtatttgttatttttttttgtagtccgttggatgtaaatctagagatatgaaaaatctgggagatttttttttgttagaaatcacccgacaaatggataggcagaagtctaaactttcgatttatccgtccttagacttctgggctgtgttcgttgatttgggttgggaatccaactcctacacacggaaaacggagcgattcattagcacgtgattaattaagcattagcttatttttctcaaaaatggatcaatatgattttttaagcaattttcttataaaaactttttgcaaaaaacacaacgtttagcaatttgaaaagcgtgcacgtgaaaaacgagggaggtgagttgggaaactggggaaaaaacttagccatgtatcagtgaacttcagaaccgaacaatattcatccctcaaattttcaaaccatatactctagacccctaatcctgaaccacggtggtttcagtttagatggcgcttatatagtactttctttgtcccaaaatataaaaacctataactggataggacgtttcctagtataacgtatcttctactagtaaatgtctcatctagttctaggttattatattttagaatggaggtagtatctcgttagcgaaaatcattcaaacgtctgtctctggtttctcttcacctttcacctttccaccttttttatccttgtgttcaacaccaccatgccctctttgtacccggatgcctgcaacctactggccatggatagaaatagatcgagtaggaagtagtaagtgaccagatatgcctcctcgtttctctgattgatgccttttgtgctccattttgtaattgatctgatctgttctgttatgaagtactagtataagtagtaagtattattttgttgtccgtggagttgagtagattactacatgtgcttctattgtgagctccggctaggtggtcgatgagctcgagctggtgcagtagagtgagaaagagcaacggaggaaaaagcagagtgaatgacattttttttttttgggaagagtgaatgacatgttgaccagctgtgtgcaatttttttatttttcgaactaaccacataacacgtaagtgccacatcaactaaaaccacaataggttaaggacaacctgtataaaattaattgtttaaaaggttgagcgatgaatagtatctggttttaactttggatgtttaggggcctaaaatcaacttattgctatttaaaacttcaaaaagtagctagtatccttttataggtcaagtatgtgttgaggcgtaacatcctgttatagcatcttattacgattaaatgaatactacatataacatccataggaaataagcaacaaatatgggatgattcccgaaaaaaaattcctatattatcttctgagcacacacaatgattcttctgtgctaccttgaaattcacgggaatatgggctactgttccattggaatttggtggaaagctagctaacacgagtattgcattgctattcctaatgtttcactgcagctactaaatgaagtttcaaagccccacattttgtacaagaagtgcatttatatgtctctcatcccaaaatttgagagcatggacagaaagatcctgaaagaggagcttggaatactaaagcatcgacctccgcgcccttcaatacaatgtgttgtaagtagaacttacctcaactatatggtaatggctagttataatctatgtaaagtgagtatagaaataatatagtcgaggaagtacattactttctgaaaatatataaaataatatatatggcatcctttatatcctaaaggatacaggaacagacgcttgtttaattttatgtttctatcttataccaatttagacctgaattaaaatgaactttcctattgcagagctattccaactatttgtcatatttttgggccaacgataacgtcacacgagagtatctcggaatcaagaaggtaaatttgtggttccttcatttttctagagatgaatacacgcttgtttgcagtttacatacaaaatgtatgaagttgtcttcgaattctatacatgctaatatttcagggaagcgtggatgaatggattagatgccacgataacgatctaccgtacaccaaagatatcaagagcagcatacagtaccatcacaatgttacattaaatggttatcgtgctttagtatacaggtaaagaaaaattatcaccaagttacttgctgaagcttacattagttgattttcagaagaaaaaaaaatctgtcatagataaaagtaaatgatgtgggatatgacatagaagaggtgttttctatttgtttcactagtggattactagtaatcatgcatttgcaaggcacgttttggttatatatattgcctataatcaaacatactattttcttatattgcaaatctgacatcaatttgcggaagcaattctacttccaagaggtaaataagtaaggtggcatagttacttcacatatattacaaactttacctcatgaatcaaacttatatggtttagcaatatgaaatgttagaaatagattctgtctaaagaataacaatcattatgcttcgaaatccacatgacaatctgcaaccaccagacatttggtgttatctcaaaagataaacaaatggcagcacaatcttgaataatcggtaagatgaaaaaaagaagagaacttctaaagtcaatcttgaatggcagcacaatccattcgcctcacttgcaccaccattcccctctaactctcctctaccctgcagcgggccgccattccccttcaactcccctctatctgcagcggacacaaacgggcaaccataaaaaaaccaagtactcaaaacaaaccaatccgagacgaaacctagtgtttgcataaatgaagaccatactaatggtaccttggtacctgcgacctaattttccggactacagaaaaggatagttagtaagaacaaatgataaaaaaacatatagaaatttcgttttctacccatagtaagatagtgaataattgaaaaacaatccaattgctcaatccgtgatttaaaaaaaagaagaaaggaaaaagtggcacagtacattatcactgaataatccactcaaaaaaatgaactcaagtaatacactgatttgaaacacatatatatatatatgagccaatgtaccctgacggagatatgggcccgggggtatgtgaagaagaggggaattactttcccttcagccacatgactctgcaagttggccccactcacacgtcacgcgagtcgtggaagcggggggggggggggggggaaggggggcggggggcctcggagcatggcgtcaccctctcgggctctcccgtagcttcgccccgaggccctcacccggctgccatgtggcggagggagagagcgagagggaagcacaggctgaatagccataaatgtgcgacgccccaactgtccctcaccgcatttaatgtggtcagggcagacgtgcggcgcgcctagctgacccctgtccatcggatgtgaccggtctgtgaccggcctgtcaccgtcatgtccgatggatagggcaatcgtgtcctcacgtcgctcctgtacccggcggagtgggggtgggtatgacccgtcacatccgagcgtcactcgaggaagggttgtcgcaagtcatcgttcatttatgagagaatgacagggctgtcccccgtgtcaggcggggggcggcgccggtttccactcgagaaccgtttgttgcttagcttccgggagaaggcacggtttgaagcccaaaaaaagtggagtgggatccccctcctatggagggtaggtagaggcggcgcatgtggtatccccttgagctataaaaggaggaccctgcccactgagattgggggacgactcccagaaaacctgagcttcagaagaaagaaagcgagtgtgctctctggagtgaagaaacctctgtaaaactctaccataatcctaaacacaggagtagggtattacgcttcatagcggcccgaacctgtataatccgacggcgtgcaagcttgccagtaatcttagggacgagcgagtggttttcaagaagcaagcctctgtcttctgaactcacaagaggggggtctcacgattccccgctttcgaggatcttccctcgacaagactacctcctttagatgtgatggggcatatctcttgtgcccagtttctcggaaaataatatatagatttcagatgactggaatcatgtacgtcacaaatatgaaactttgatcagaaaaaagtggaaattcttatgattatgtcattcagagttatcagagcatagtaaaatcctctaacaacaacatgcttaccaatgacagcaaattaggtatgtgtctatgtgaagctctagttttctaaaaaacatgaatatgtacttacctcatgatttcattaaacgcggccactacaaatctttatagtagatgagatcttatacttaatgactgtaacatcaaaatttcagttcaagatattcagtgccataataaggggtgagatttggggtacctgtaacacatttttagcagaagtttttagcagtacctgaacaatctaaaagaacatatacatagatctaaaatatacacaaacctggaatataattttagtgaaggaactgatatgcttaaaatcctggagtacatagccggagaagccacactatatttttagtgaagctacaaataaacaacaccaacacaatagagatgaaaatgattaaaaacatatatcagtaaccccagaacttatatatcgttttggtcttctcttccaaaagttgattattctccaaaaggtcatcgaaaaaattcaagaataccttataaatttgacggaagagaaagggcctgactctaaaaccaaaaaaaactcaattattttagtccattgctatgagcacatgattcaaccgaaaatgataaaaagtcgaattgttaagcattttatcaagtaacccaaaagcatgagagagccatgtgcatgtacctgattaggacacatcagaatatcagaaattcttgactttttggatatcttctcaccttgttcttgttcttgatgacagtggccatcaatctaattacatgttcttgatgtgaaatcaccttagggtaaggattcttcttccctgctataaaaagagaggaaacaattaccaaaggtaaccacctaaatagattgtccagcgaactattaaatacatgcgattgtagaaaaaggaacacatcaacaatattacaggcttttcaaatgtgcacatcttcagttttccttaaaagaagaaagtctgacacattcttgaaatcagaagcatcatgtatttacatctaaagaaaagaagaacaatctgataaatctgcactatgtatatatatcatagaatggaaacataagattgtagtgcgccatgtaaattactgattgacaaagaagcaaaccctgcaaccagagaacaatatgcagattttgtcatttagatagtgaagtaactatctcatgatgtgtccagattcatcgtctgactccatcaaggattcaaagcaaaatagcacgcatgtaaaagaactcatttcatggttcatgtctagctattcagttcttctgagtgacatcactcgtatgattttgctcgaaaacaaacatgctttctaatttgaacacaccgagatgttacatccaatttctgaactttttgagagtaaggaattagaaggttccacataattagctcttatataaacgtgatctcacagcatgctgcatctagaatctgttaaaactgagtcacttgtagttgttcaccttctccaaaaaatatcatgattgagacgttatgtatttatctattgaacaatatatcagcaattcagaaaccggcctgcgtatgcaggttgaacaatgtgattgtgaaactgtaagatccaaattagttggctgcactgcaactaatcgtgagaatggttccaaaattttatatttccatctatatatacacgcgatcattttataaaaaaggttccaataataccacactatgttggaataaatgggctaggcccaatttaattcaattaaaatctcaagagcccacaagtaatgttagagagaataatactgcgaagagtatggaattattcatgagatgacgcctccctattcaccccagtcaaacggggtagccgaaagaaagaaccgcattctaactgagatggtgaatgccatgttagacactgcaggactttccaaggaatggtggggtgaggcaatattgactgcgtgtcatgtcctgaatagaattcctactaagcataaggaagtaacaccattcgaggaatgggaaaggaagaaattaaatctctctcacctgcgcacatggggctgtttgaccaaggtaaatgtacctatagccaaaaagcgtaaacttggaccaaagaccgtagattgtgtgttccttggttatgctatccacagtgtgggatataggttcttaatagtaaattctggagtacccgacatgtgtgttggtacaattactgagtccagagatgccacattttttgagaatgaatttcctatgaaaaatgcacctagcacttctagtcaagaacctattttatcccctgagcactttgtgccgatagaacatattgatcaaacgcttgaggaaaatcctgaggaggataactacattgtaagagacaaaggactgcaaagtcttttggagatgactacattgtatatcttgtggatgatactccaagaaccattaaagaggcatattcatcttctgatgctgactattggaaggaagcggtactcagtggatggactcaattatgtctaatggtacttgggaagtcgtcgagcatccatatgggtgcaagcctgtaggatgcaaatgggttttcaagaaaaagcttaggcctgatggtacaattgaaaagtacaaggcaagacttgtggccaagggttatacccaaaaagaaggcgaggactttttcgacacttattcaccggttgctcgcttgaccacgattcgagtactactcgctctggcagcctctcatggtctactcgtccatcagatggatgttaagacagctttcctcaatggagagttggaggaggagatctatatggatcaaccagatgggtatgtactagaaggtcagaagggaatggtgtgcaagctattgaagtccttgtatggtctcaaacaagcgcctaagcaatggcatgagaaatttgacaatacacttagatctgctggctttgttgtgaacgaagctgacgaatgtgtgtactatcgctatggtgagggagagggagtgatcttgtgtttatatgtcgatgacatattgatctttgggaccagcctcaatgtgattgaggaggtcaaggactttctgtccaaatgctttgaaatgaaggatttgggagtggctgatgttattcttaacattaatctactgagaggagatgagggtgggattacacttgtgcaatctcactatgtggacaaggtcttgagtcgctttggttatagtgactgcaaggcagctcctactccttatgatcccagtgtgctattaaggaaaaactaaagaatagcaagggatcaattgagatactcttagatcgttggttcattgatgtacttagctagtgcaacgaggcctgacatcttatttgctgtgagcaagttgagccagtttgtttcaaatccgggagatgatcattggcatgctcttgaaagagtaatgcgctatctaaaagggacaatgagctatggaattcactacgctaggtacccaaaagtgctggagggctatagtgattcaaattggatatctgatgctgatgagataaaggccacaagtgggtatgtgttcacacttggagggggcgctgtttcctggaagtcttgcaagcagaccatcttaacaaggtcaacaatggaagcagaattcacagctttagatattgccacagttgaggccgaatggcttcgtgagctcctgatggacttgtcggtggttgaaaaaccagtaccagcaatcctgatgaactgtgataatcaaacaatgattattaaagtgaacagttcaaaggacaacatgaagtcatccaggcatgttaaaagaagactgaagtctgtcagaaagcagaaaaactccggagtgatagcattggactatgtccagacggctaaaaatctggcagatcagtttaccaaggggctaggacgtaatgtgatagacagtgcatcgagggagatgggcttgagacccacttacagttgcacaatagtgtaaacctgtccattgtgatcggagatcccgtgaatttggatggcgaaacaaactattgtgtagctgagagaagagaccctaaaatgagcctatcttcatgatgcacttctcttctaatctgtatggtaggatggtatacaccttaatgtgatccgagtggcttttcataaagcagagatgttggcctatagaacaccttagaaggaacacacctatatgagtctgactgctagtcacagtctatgagatctgggtgatctctagatactcatgaaaaggccaggagtatgacttatacgctcaaaacagaggggatgcaaacgacagcctagtaccagttaagggtttgagtgaaacctgaatcgcacaagactgacaattcaaggcatagtccattgttcagttgtgatctggtgtagctcttttcctaggtagaagttcaacttaacagtctccatcgaaacactggtatatctaacaggttcaattttgagaacatttcttgtgagccatgaaatttggttgggattgttagaataaatgggctaggcccaatttaattcaattaaaatctcaagagcgcacaagtaatgttagagagaataatactgccttgaaaatttaggtggaagaacctcaacttaaatagggtgatattagagattccctgttgaccggttaaggtgatggttggactgccacacgcatgcgcgcatgctgagtcggcctcggccgtgggccgtgggcgtagcgaggcgaggtggccgaccgagctgagcctgcctgctgctcttccgttttgtaacagacgagaataaagtcaccattaacaaatgaaattcattgtgttgtaacctccacaacaaatgagacattcattgtgttgtaacctccacaacaaatgagagattcattgtgttgtaacatccacaacaaatgagagatttatttgttgtaatcttcacaacaaatgaaagattcattatgtggtaaccttcacaacaaatgagattcattatgtggtaaccttcacaacaaatgagatttattttgtggtaaccttcacaacaaatgagatttatttgtgtggtaatggagatctctctctctacatataacgcaaggcagaggctctcaaagtgtgtgtcttcctcctactattgttccttggcgatactctccttctgttcctgcgctgtctctctgtttccccggttctgttcatcccgcgcgcagaggtgatcggaacgagcaggtgcctccgaaattccgtccgcttgagaacctgcacgggaaggcgggcgatcaagtttttgggtaccgcttcaagcgcgactgctctacatcatcttcaccaacattattgcgttctcttatctatgttgatgcttattctatattaagcatgctcatattgtacacatctagcactgtcactagatctactcaaattacaaatgtcatgtttattgtctaaatattttggattaaaatatggcgaattatgaccaaattttccaacacactacaactaaaagaatgtgactccatgagtaaatcacccaaaacggaagttggagggacgacttgggtttagcggcattcaatcaaacagctctggacaaaacaagagaatctgcaatcaggtaagaacttgctgctaatcattcaagttaaaatcaaatagtaaaatggaaggtagaagtgatcataccaatacaaagaaaatctagacagtggaagaaaaggagagtggaatttgttggtggagaatgccagcaggaggtagcaccgtagcagtagtggaccaccccatccgtgccgagcgagtccaatggcctctaacctcaaccgacctgatttgacatcttggacctggcgttcgatggatgaggtgacaccgggttcgatggggaaggaggagacgctggccccgggagggagctcgggggaggacgccgctgcatcctctattcctctgtgagagctcgagctcgggaggtgaagccggggaggaagtggggtcgcaaggatggaagcgggatcaaggggtcatcattaggagggcggaggcggagggggtggcgtggtttctgccgctgttttgatgctgcgggagtcggtatgtgcggatgcggatggatagtagagaattaatctgtgatttggcctgtaggattgctacagatgaactcctcctttttatattagtataggaatataactagagatgattcggcgattatgctttgaatcatgattttttttatagatattacgggatctattcagaacactcttttgtgagaagttcgaaccatccacttaggaattatactacaatacaaacacactgtggtttgaatttttttcaaaactgcagattagtagtgaactcatcattgtcttcaaataaccaagcttgtgtccattgaattagcataatttgcctctcttaataaaacagtagggatcaataaaataaagcagtggtcaaagttgcattttggtactgttaatgtcaaaatcgatatgttcactagaccagagtagtataaattctgccattatgtctttacgtggaacactttgagatctgtatgcttagtgtattaatgattttgcacatatctatctaataaattatctgcatgaccattgcagctagctagccagctatgcatgtcctctaccatgactagagagaccggttggcaaaagggcataatgcactccagtgttctaaactgtttctttatcatatttctgcattaataaaaaaataacatttcggtgcgcagcggtgaccatgataccgttttgccatttcttggtacacaaacctgggtgaggtcactcaactatcccattgtagatgactggagagcttggcatgtggatggccagtccgcagggtgagttttaattatgtttgattagttctgttgtttggcttacataatcaaaatggttgtctaataagttttcagtatacaaactgctttcaggaataacttttctaaaacttcaattaatttgcagattcaccgtagcatatggaaacaacctgacatttgctactgttaaggtaacaacccatcaatgcacatccaattttatgaataatttatatatagatatttccaaaggttgttgtgaatggagttacgttctgattcacgattacatatcgttgatacaaattcaacccgcgtcatgatgaggatttttaatctgtattactgctaatgatatttactttagttcaaagattattctattttatcaaaaatttcttatattatttaaaaatgaaatcattggtatgcgaagaaatcctcacaacatgggaaagaccttgccacaccagtgttagcaacatttgtggccccaaggttcattttttaaatataagttcattgaaggttcattttttaatttatattagaaaggttaaaagataataaaatttcaaaaactctttagaaggaccttgatatcaccaaggggtcaaattggcgttcctaaacattcgatttgaatccggaacatttggtctaagattaagagttgtgatcttatagcaaaacgtccaatggcaaggtggtaaatcaagaactaaccacttgcagatcaaacaaacaacaaatatagctaccaaaatgtgtgaaacaagatacaaagaaaataacaatatcatcaactagattaaactaagcacataggtagatgaggcaaatgaagaataataatggaaaaacacacgagagacaaaatcaaaatatttgttctgtgatgtttagatccactgattccatttcaaaggccatgtctctttccactcttatactcactaaggcaacaccaaagtgcttctgatgtttagtctttatttcttctattatggaggcaaaatcgaaatcttgacaaacatccatgccacactacataagcttgagtactcaccagcaacacccagccatctaaaagaccttaatgtccaatatagtaatacacacattacaaaatttcctataaactcaagtgctcagacgatgaagtaaactcactagcttacaacatttcaatctgtcactaatttgataaaaaaaagaggggaggggggggatatgtaagaactatatggtcatggatatgcataactctttgtacaaactcaacaactcctaaaggagggggatgagagctttaaatagcatcgttatatttctacccgttaaggtaaaaacaataggtggctgaattaaaataaccataacatctcgctctcaagtctgttttcgaaatcttgaactctatgtaaagcttaattcgacatctaggtaacacaactaaaaccacacaaagtagatgttaaaactgttgattctcttaagatagcacttggatatgtcactttgagcaccgtcaataatcaaggtacaattctgcattcctcttgacaggacataattcctaaactcaaatgcaattagaaaaataactataccaatgagaacacatgtactgtcatggttatggataccaaatacctaatagtagttgattaggcacggctggacccaccacatatcaagtcttatacggaattaggcctcacttacggaaggtattccggataaggaaggacaagtaaagttctatatggaaactataaggactacttggattgtatccatattggtctccctagttctagttggataaggggacacctataggcataaatagaccccctaggaggagagggagataagccacaagacatacaaatcgacacacaagccaggacaaaccaatacgccaccagatatcgacatcagagataagcctagacagaccccatttggtgcctgtagaggccaactaaagggatctaatgccatctttgatctcgatgagttcatattcgaggaggaagactaccctatcgtcgactacgtgttagtgatccatgccgccaagtcgatgacagctagataggttttcccaaatattgtacttgtgtgattcag

SEQ ID NO: 71406 - DNA, 2608 bp, Oryza sativa
ttgtctcaacgggacccacacttgtgctagaggagagaggggagaggggcgaggcagctgacggggagagaggagcggcggcgccgcccgacgccaactcggggaccgccgctgcttcggggaaggagctcgacggcactgggccacccgctcccccgctcccgcgccaccgacgcgttcgggagaggagaggaggggtggacgacgtggagaggagggcgccaccgtggagctcgtcgcagcccccgcttgcgcgacagcctccgcttgctgccggctgcgccactggagcttgccagccacacgccccccgatccgcgacgacctccgctcgctgccggccatgccagccctcgattcgcggtggccggaagaggaggacgggagggcggctccggccacgccgcgccctcgatctacttgtcggagagggagggggagatgaggttgaggtcggcgagaggggagaggcggtgatggccgcgaggtcgccaaccaccgctcaacctggtgccggccgccgccgctctctgcagcgtttgctctgccagtggcccggtggggaaaggagtagaggagagagagagagagggggagtggaggggagatgaaaagtgaaaagttggtaccggtggtattcatactacaaatactgcactgtggagcatgtagcttatatcctttttggtctatgtggcatgtgaagaacgccaaaatttagtggcgcactgtgaatggcctgaacatgctactcctacatatgctagccaccgttggccggaaagagattgatggatatgccggccgctgctgttgctgatgcagccatgcaggcgtgctctccctacgttttcagcaaactctgtgaccagaaaagatgggaatattgtcctatttcgagagatcaattatttcttgctagtaccaccaatggtcagtacatatctaatttggtaggagctgcaatttgcgagacagttgagggcttgaggcccgaaagcaacactgggtgcgagtgactggccctctgtcctcacaggtcaagcattggtttccaacatcgcagaggacacactctgttttagccacacaaacgagatggctttggatttgcgtccggtgctcgccacaacttccacggcccaaagataggaccacaccaaatacaccatggcaatatagctaaccctgtagtactacatgcaaatgcagaactacaaccatgtatatatgtccatatcagatccaaacgttctcttcagcaaaacagaacacgtagctagcatgctgattctgcaatgctgtacaccacacgctttttgtgtggatgggctcttccgtttccaagccggacaatcttgggaaagaaagcaagcaagaaaacatcccagcaacaaatgtaagcggagacggaaattcatcagttcccaaattcagagaccaacccaactactacgcaaaaaagttgtcattccattcgacgtttagttattccgccatgaacaccacaagcgttttacaacagcaagcaacggacggagccaactcaatgacagacaaaccgcacaagacacgtcgtccacacggacgccgaccatgacaacacctaaaccgaacaatggcggagggaaaaaaacgatggaaataacacgacagggaccaaggctgcgacaccggagctcagcagctgacacatacatagactacaaatccacaggcatgacacacgcctgatccgcctactttgcacttgatggcaactctagcaatggcactgcaatagccttcctctgtgcccaagtgccctttcctatttaaagagactaaccatagatagatgcatggatagatagacgattgttcattgggttgatggaatggatggatacttgctacgacgatttccgaagacactatcttctttcccttggaatcttcttcttcaaatttggttgctggttggcttttggtgtgggaatccgatttcacagcagcagcagttaaaacttgttgttgtaccagaagacgcccttgttgtcctcaggctcgacgtaaatgcactccttggcctcgcgccatgtcgccttggcgacgggcgtcgggtcgaactggtagtactcgccgaggatggggcggatcgccttagtggcctccatggcgtggtagtgcggcatggtggaaaaaaggtggtgcgcgacgtgcgtgtccgtgatgttgtggaacaccttgttgaggatgccgtagtcgcggtccacggtggccagcgcgccgcggagccagtcccactcgctcgagtcgtagtgcggcagcgccgggtgggtgtgctgcaggtaggtgatgagcaccagccacgcgttcacgatcagcagcggcacgccgtagacgcgcaccacccaccagaacccgaacgccgacgacagcttgaacagggcgagccccgcggacacgacgccgacgtcggagatgaagatctggacgcgctcccggtcgttgtagatcgggccgtaggggtcgaagtggcacgcgaagcgcgggtacgggcggccggacacgttgaacgccaggtacagcggccaccccagggtgagctgcacgaaaatgtgcacca

SEQ ID NO: 71407 - DNA, 5360 bp, Oryza sativa
acgcgcgtagctcgggcgtgcagtcgaggatgaccttgtagcatccggcctccttggcgatctccacgaggcgacgcacgacgcggagcccgagcccgcggccgcgcgcggcggcgtcgaccacgacgtcctccacgtgccccaccttcccgccgccgcgcaggaacttgcgctccacgaagaggcaccccgtggcgaggatccgactctccggggcggcggggtcctcggccacgaggatgacgtggtcgtcgccgagggccgcgaggtcggcgaagcacgcggcgaactcggacgcggtgaggtccgggcaggcggagagctgcgagaggagggccacgaatcccttctcgtggtctgtcgcctccaggcgacggatttggacggaacagccggtctccgcgacggcggcggcggtggagggttccggcgaggtggatgccatttgagatcgggagcttcttgggctttggccttcgcaactcacaagtgacagtccgtactagaacgggccatgcgggctggtggattccactgaaacaaacttgctagttctaacatgttcacacaatattcagggcccaattgaatcacatgaataaaaaaacagaataatagggaaaattagaattttggcatgaatacaagtttaaggattaaggacccctttcaaacatatgattgaaaaaaataaatgaatagaaaaaaaatagaggaatatgataagaattcacgtgtaaaatagaggaatataaaatcatagaaaatgtatatgaatatgtgtttgaatggggtataaaaaaacacaagaatatttttacttaagaacttggcccactttccatttctaataactaacacaaattatatccattaattgcttgttctcctgcagtgaagaaagagattaggagcttgattgcctcgagcctacgcaaagcaagtgaaaaatgagctcagactggatggaaagtttcatgtgtttctcccatagaatcagcaatgaaggaatatttccttcagttttcctatgacctattcctacaaatcaaaggctgctacagtgaatgaatccataggaactcacatcttctgtttttccttcgttgctcctttgtttcaaaagagctctaaaacagatgattgtaaaatacaggaaaacgtaggaataaccgttttattaggccgcaagaaaaacaccagaatttgagaagagataaaagactcaaaggatttttttttccatgagattctacctcatgataaaaatgtcctctaaaatttgcatgggaataggcatttcataggaattttataggattttataggattcattcctttgatttaaaaggctatataggaaaaattcctgtaggaatgaaatcctctaaaattcctatgaatttcctttgaatcaaggggggtctcatactttttcacagctgtggctttctctcaggattagaatcttctacaaatggtttagatttacgcttgtattttaagaagctgtagttatagaatacaggaaatgaactataactacgaaatgaaaaacctaactttttaagatttttataggctagctaccaataagttatttcttgaatcctaagttttctaaataggacaaaccattactccccttgatacaatgtttggtcgggttaatatttagatctctgtgaaagattacgatttagattagcgttgtaactttttgtttttcgccgggccgcgttgtaactttgataagtgcagaaaacatttacttctgcagactgataagtcataataccttgtgccatgagcccatgatatacgattatatgtggaattccagtaaaagagtccaagttaatttctagaatggttaaatgatttgttacagtagcttgaaaagaagatacaggtcaaaagattttgcatgttcaaggaaaaagggggtgaaatgatctagatattgcatacccctccgtagttggctacatcacatgtcccattcgttcattcagtcaactgaaaataaagttaggattatacgagacatacacctactccaatacaacaaaataccgaagactaattaatacatggtcctccacaataattagcagcatttctcttaacctctgcttgatgcaactgtggtgcacttttagttcgttcaacggagcattattattggtcaatagtgaatggatcgatatgcgaaacttgaacggcaatttacatcgtttctggatatgttttctagcttgtacgaagtggtcactggacaaatttacaactatctgcatgtttcattttcatgacatcaaactgatttccgtttccctaaaccatatattcatatcactactcactgattacagattagagaggttaataattgtatattcctattcgcccccagacgacgttactgcatgacagcacgctacaaccattttcttttcgtctgttcggcagtgacgtcaacgaatccacgtggacctgtaaatgaaccattttgattctgaactgttctgagaagaagattagattcaatactgcgatatcccaatgagaacgtcagccatgatagtgaggacttgacgaatgggaatctctgaacacaaagtgcatcgcccaagtctaaactggaatatacaagtcaatagaagatggttggcaatggagaacagaaacttttcctagagctgctgggatatactatacaaaccatgaacatatcagatgccatgaacatgaaagggtatctctattatcatgtaatagggtggtactattgtattcactaattagctcggctagctgctgaagattcggtttgtgtttttgttgataaacatgttataaatgcatgcgctctcaaggcgcggaatagtgaatacacaccttattcttgtaagtatttttaaaagattacacttatcactaaattaaagttataaatatgagcatatatatttagtttaccgaataaactgttttcatcgtcaaaaacctaaccagttaagctacgagtctactcccacttcgtctgcttgtgttttggtagagaaacgggggttcagaaacggtttcgagatgacgaggtccgaagaagcggcgggaatccggaactggacggcggtgatccctccctatcagcggccccacgcccgcgcgcgtgctgtctcgctcgacgcattccaagtcggcgatttccccaatttttccaagtccaccccaccaccgagagcctgcccctctcgctctcgctcgctcgcctcggctcggccccgtgccacccgctgccgataacgtgacccacgccttttcacaaccacccccgcgacgcggatcggacggctcagatgcagcgccacgacgatcgtgcggcgcgatgcgcaccgagtgagagagcaggagacggcagcgcctttaataccgtcgtcaccgatcggcttccgtttttgctcgcacacgctgcgcagcggcaaagtcgcgggaatcttcgtgggctgctccgagcggcgacggcgacggggcggcggtatctcgcgcgggggtcaacacagctagatctccctctctctgcgtgtatagaagggcggttgctggtgggaggaggaggaggaggttgagagaggtatgcccatggagcacgggaggaggcagggggtggtggcgatagagtgcgtggcgggcgggtcgagggcggaggagtgggggcccgggagcagcgagacggtgcagacgggcgacgtggtggaggagatcctcatcggggtcggcggacgcgggggccccgcggcgcacgccgcgccgttcaagggcgggcgcgccgccgtgcagaggctcctccactcggcgtacaagcgcggggacacgtccgtcgaggtgcgcgtgcggcggcccgcgcacgcgcagcagctggtgaccaccagcggggagctgctgccctcccccgcggcgggggcggcgacgaccacgacggcgaggatgcaggcctgcatcgtgccgcaggaggccgcggtcgggggcggcggcgcgatgatggccgtcgtgggccgcagccgccagtacgtgctccgctcgatccgtgacccaaactacgccgtcggcttcgtcgaccgcatggagagcgagtgcatcgccattcgaggtacgttcatacgccatgtcgttcctcctcatcacgatgcaaactactacggagaattagattttttttttcgctgaattttttgatccatgtccgtccgtacagccactttccttcggtttgtgcaagctctagaccaaccaagaaaagtaaaagtccgcgactgagctttcgttacatgccatgttggactttaattaaaaacagacaaagaaggaggatagggctcgtgtgccttctgcatacgacttttgtgcacaagttaacaagtagatggtggtagcttgataggtgacaccttctttatcgttctctctctcgcgagaggagatctttttggcgtgatcgatcacggtatcgttttcgattggcatatacttggatcaatgctgattgataatcagaaatttgccatcttgtggttgcaatacatggtgtgattgctcagtctggggatatgatcagaatatcctaggtttgatgtatgacagagtcaggattgcaagagctggtgataacattgttgttggtgttggggggtggagggcagctggtttgtctgggaaatttgaagtttctagagtagcttggcttgcacaaattaataatatggccatccattagtccaggttttttgaacgaattccattaggttattcatggctacaatgtttgtttgattgtttgttgaacaaaggctttactagaacactactctatttaacgatcctaattgcttcttccgtgtgcaagctgcgaaagtcacggttgaacacttttgagctatcatggaagaatccacagtagcctatggcagattactggtactgcaaaccacgcaactacagcaataacaaaatcataagatagctcggagaaaaaaaaatcataagataagatatttattaagcgagttaaaaacctgggtagtttgcatttgatgggtgttctgcttccacaagtaaaacaaacacgtcagtttcagataagaaaaacaccaagttgctgtagtctaagctcaagttgcatacttccaggcaacagacacggcggtgcacgttgtttggaatctgcattttgatttctttatacagaacgccacttggcggtgatgataattgaatcttccctcccctgactcggaaaaaacttgtcgctaaattccaatgcgattcagatctccctggtgactttactcctcagtcat

SEQ ID NO: 71408 - DNA, 48490 bp, Oryza sativa
ccgtgcccgcggttatgggcggtcaaccagattcaccgtgattagtctcaccttagtttagtctaatgaatttggatagtttaggtggatggttgggcctgttgcaacgaggtgtggcgttggacagtggatgaataatactgcttaattttacaactgttttcgcattcaacccttgtttataaatgccagtatttatgcaaatgaacctgtttagctgttccttgttgaatctctgcatcatacccccattccggtatgacttgctgagtacagtgggtagtactcagtcttgctctatttctccccaatcccagagtttgagtttgtgtcagatggcgggttctccgaggagtaggcttcgtccgtgccgtcgaggatgcctgtggaatggtgttcccgctgcagtcaagtctaggcttagcctcagttatcttttgttttccgctgcatttatgtaagacttttataatgtttgtaagacgtggatctgtatgtcaacattgtcgtttgtgtaccccggccggtcctggacgggggttttaatgcacattctgcttggaatcctattcgggaatttctgggcgtgacagaccctaaggacttcaggatggtggtccaacgggtgctgaatctcagctccgtggaggcatccctcatcccccaaggggtcctcctcctctgctgcgatccagagcgcgccaagatcctggccatcatgcaggtggtcggggcgtcgggggagcgggccccccgaggccacgatggcgtgggcgggagcagcaggggggaacaatctacctcgggagggggtcgtgcttctgggccccgcgacgggggcccggggggcatccgtcctgccgacactcggggaaagaggaagcaggagggtacccctcccccatctcctccccgagggggcggggcggtgcgtgccagcagcaggcgtccggagggtgccgtgccgactccgcagcccgagggggagcgaaaaaagaaacggctccgcaagatgggggggatcgtgccatgccgggggaacctcatctcgcccccgaggtggtcgtttagccaacctccccgcaggttcgtccccgcgcccaccgcggccgtattcattctcccatctcccaaggcgagttttcactcacccatttctttttgtcttctggtttttcttctgcctcagcgagatcccgtcgcgcccccccccccccccccccgatattccaagtccggccagtctgaggccgaggagacggcgactgcagaggctcggaggcgggaagctgaccggcgagaagccgcggaccgcctccgggaagccgaggaggctgcccaggaggccgtccgggctcgccaggctgaggaggccactcgggaggaggccagactccgccgggccggggagtccatccgggaggcagaggcggcgcgcgcacgcgaggcggcctgccaaacccccgacccgaggcgacgatgacttccgaggccacccacgacgaggccgcgggcgcgccgctcggtcccgacccctcgggcgacgcttgggacgagccagcttcgggggacacccccgagtccggcacgtcgatcggcgggccgagctgcgcggcacccacaccgaggcggctttcccctctgtcttccgctgccccaccgagcgcggagcccctcctgcaggccttggccgccgcgaacgtcacggtgctggacgggttaagtgcccagatggaggccctgcaggcggagcgggcggagctcgacgcggcgtgggcgcgcgtcgaggaggggcggcgctcggtggaggccatggtggaggcgggccgcatggcacaccgccggcacgcttcacagctcgaggcccgtcgtagggacctggcggagatcgccagggaggtggaggaggagcgagagactgccctcatcgccaccgccgtgctcgacgaggcgcgggacgacctccgcctccaatacgggagccgggcggcggagctagaggagaagctcgacgccgtccggggagttcttgacgccgccgttgcccgggaacggcgggcggcggagaacgaggcggcgttccggcagcgcgaagaggcccttgaggctcgcgccacggcgctggaggagcacgcccgcgcgctggacacgaaggagcgcgacctggcggaccgcgaagccgccgtcgccactcgggaggcaacactggcggcgcacgaggccgcctgcgccgaagaggagtccacactccgcctccgcgaggacgcgctcaccgagcgggggcgagctctcgaggaggccgaggccgcggcgcagcggctggcggacagcctgtccctccgcgaggcagcgcgggaggagcaggcgcgccgcaatctggaaggcgcccgtgccgagagggccgcactggatcagcgggccgctgagctcgaggcgcgggcgaaggagctggacgcgagagcgcacagcggcggggcggccgcgggccacggcgacctagccgcccgcctcgcagccgccgaacacaccatcgctgagctgcagggcgcgctggactcgtccgccggggaggtcgaggcccttcgcttggcgagcgaggtagggcccggcatgcttcgggacgccgtctcccgtctagaccgcgccgggcggcaggagggcctctggggcgggcggcacgcgaagtacgccgccaaccaggggggcctcgcccagcgcctctcagaaatgaccggggccctcgagcggctccccgaggagctcgaggagacgatcaagtcatcctcgagggacctcgctcggggggcggtggagctcgtactggcaagctaccaggccagggaccctgacttctctccgtgggcagcgctggaagagttccctcccgaaaccgaggacggcgcgcgtgcgcaggtccgggacgccgccgaccacatcgtccacagcttcgagggtacggcccctcggctcgcgttcgcgctcgactccgacgaggagggcggtgacgatggtgcggacgacagcgacgacgaggccggcgacccgggcgcgtcggagtgagccctcaggcccccgccaatcttaataacttttccttcttcttccgaggccttcgggcccccttcttgtatagactgacttaatctgcaatcaagtaaagaggaaatttctgcgtcagttctgtttgttgtgtgtatgagacgaggatggtctgtgccgcggtccttctatgtcttggcttgaacaagggctcgtgcccaggtcccagcctcaaacggcgcgggtcggggctagtgcctggggagatcctcgtgtcgagactggccaggccgggagcgtggtgaccgagggttatggatgacccgattgtgggcatttgccgattcccccccggagttcaccacgccccggggcacggctcggttctgggccccgtttggcgattttagccggcccgggccaccgagggcagggtcgagcacgagcgtgctaatttaagccaagattcttcaaaaggaaacgatggcacagacacagtcctcaggaaatcgaaaatgcttttattgaaatacggaagagaaaaaaggtaagtatatgcatgtggtagcccccggccaaccctgcacgcccgggggggtgcggggttggcccgagcccgagacatgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtggcattgatggtagcgccgcaggctctgctggtagcgcgcggctcggagggccgcgcgccgccttcgctcttccaaatagtcgaggtcgtctcggcgaagctgatcttgatcagcctcgcaatacatggtgacccgaggggacctcagggtgagctcagatgggaggaccgcctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttccgcgttggcgcgctccacttggccattgcttctggggtggggaggggaggcgaagcagagcttgatgcccatgtcttcgcagtagtcaccgaagagctcactagtgaactgggtgccgttatccgtaatgatacagttaggcaccccaaaccgagcagtgatgcccctgatgaatttaagcgcggagtgcttatcgatcttgacgaccggataagcctcgggccacttagtgaacttgtcgacagcgacatacagatattcgaacccgcccggggcccgcctgaacggacccaggatatcgagcccccagacagcaaacggccacgaaagaggtatggtctgcagggcctgggccggctgatgggtttgcctggcgtggaactggcacgacctgcaccgtcagaccaggtcgaccgcatcgttgagagccgtcggctaatagaaaccctggcgaaaggccttgccaaccaaggtgcgtgaggcggagtgggctccgcactcgccttcatggacatcggcgagaagctcgacgccttgttcccgaggaatgcacttcaggaggactccgttaaccgcgcgccgatagagggtcccttccaccagcacgtagcgcttggagatgcgccggacgcgttcactcccttcgcggtcctcgggtagagtcttatctgcgaggtacgcctggatctcagtgatccaagcaatcaatctaggggagctgggagtgctcccctcgggtcccgaggcctggactccgacgggcctcgggggccattcaggcgcgtccgtctcccctagggggtcgggtcgggccgacggctgggcaagcctttcttcaaaggcgcccggtggggtctgggctcgcgaggaagcgagccttgagagttcgtcggcgaccgcgttatcccgtctgggcacgtgccgaagctctatcccgtcgaaatggcgctccatacgccgcacctggcgcacgtaagcgtccatctgcgggtcagagcaccggtactccttacagacctggttaacgaccaactgggagtcgcctaacaccaggaggcggcggatccccagtccagctgccactctgagtcccgcaaggagtccctcgtactccgccatattgttggtcgcccgaaagtcgaggcggaccaggtatctgaggacgtctccgctcggcgaggtcaacgtgacccccgcaccggcgccctgaagagacagggagccgtcgaactgcatcacccagtaggcggtgtgaggcagctgcggggggcccgagctggcctcgggggcggagacgggctcgggagctggggtccactccgccacaaagtcggcgagggcctggctcttgatcgcgtggcgtgattcaaagcgcaaatcgaattcagagagttcgattgcccatctcaccacccgtccagtaccctctcggttatgcaagatttggtcgagggggtaagacgtaaccaccgtgacccgatgcgcctggaaataatggcgcaacttccttgaagccatcagaatagcgtaaagcatcttctgggcctgagggtatcgggtcttggcgtcccggagggcctcgctaacgaagtagacgggccgctgcacctttcggcggggccgatcctcttcgctaggggccacatctccaggacgctcttcgtccgagaggccacgcggggcgcactcggcttctgtgccgacgacctcggggtcggagggcgacaggcgcggccttcccgcagtggccccggggccatcctgggggtcgggggcgcctggcaccgtcggacaagcaggcggagggccagctccggccgtcgggggccttaggccgccattcggctcgggggcctctgctccctgctctctcccgggtcgagtcgaagcagggtggggatgcgcggagtgagggttgtcctcgtcgcgctccacggccaatgccgcgctgaccacctgcggggttgccgccaggtagagtagcaacggctcatctggctccggggcgaccaggactgggggagaactgaggtacgccttcaactgagtgaaggcccgctcagcctcctccgtccaggtaaacggcctggagcgtttgaggagcttaaataggggtagtgccttctctcccagcctcgatatgaaccgacttagggcggccatgcagccggtgacgcactgcacatccctaagcttgctggggggcgcatccactctatagctcgtatcttctcggggttggcctcgatgcctcgggcagagaccaagaacccgagaagcttgcccgcaggcacgccgaacacgcacttatcggggttcagctttatgcgggcggagcggagactttcgaaagtttccgctagatccgagagtaaggtctcttggttgcgcgtcttcacaaccaagtcatcaacataggcctcaacattgcgtcctatctggctacccaaagaaattcgagtagtacgttgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcacccagcggtggagtcgacaatctgatctatgcgtggcaaggggtaagggtccttaggacatgccttgttaaggtcggtgtagtcgatgcacatccgaagcttgccgttcgccttgggaacgacgaccgggttcgccagccactccagatggatgacctcacggatgaatccggcctccagaagtcgcgccacctcctcgcggatgaaggcttgacgttccggggcctgccgccgcactatctgccggaccggccttgcgccgggccgcacggcgagacggtgctcaatcacctccctggggaccccgggcatgtccgccggtctccaggcgaagacgtcggcgtttgcccacaggaaggagacgagcgcgtcttcctatttgtcatccagaagaccaccgattcgtgtggtcttggacgggccgtcgcccagggcaacctccttgaccgagacctcgtcgcacgtgaccatccgctgccttggggcggccgggacggaggtggcgagcctctcgtcgccacccgcgggcttggacgccgcggcgaggtggtccgcgcgctgctccatacaggcaagcgcgacttttaggtcgccatggacggtgatggggccaccggggcccggcatcttcatctggagataggcgtagtggaccgccgccatgaacttcaccaacgcgggcctccccaggaccgcgttgtagggcagactgaggtccgccacatcgaagtccacccgctccgtgcggaagttggcggaaccaccgaaggtgaccgggaggttgatatgacccagcggccaggtgtgccccggcgtcacaccgatgatcggctgggacggccggagcaccatccccggggccttgatggcgtcaaaggctgcgggggaaaggatgttgagggctgcacccccgtctatgaggacacgccccaacttcacattgcaaacggtgggggaaaccaccatcgcgatttgtcctccctgggcaacgcacggcgggtggtcggtctggtcgaaggtgagggcaacctccgaccaccgcgcccgccgcgtcgcctcatgggtaggggccacggccagaagctctcgcttcatggccttgaggctccggcgagaagcgtgagcgcacgctcccccatcgacggtggcgacggtggcctcaggctcctggaaccccaggtcatcgtcgccatcgtcgacgtcctcggcggtggccttctgcttggcctcacctcgccggttgccggcgggagccgccggggtcttgccctcacggcgctcctgcctcttctcctcctcccacttcctcgtccgctcagccaaacttttgaccgcgcggcagtccacgaggtcgtggagggaggtgttgtgcacggtacaccacttgccggttgggcgctcccacctgggagcaccggcctccttctttttgtcgctcgcaggcctcccctttcggggggcccgcgaagcgccctcgacggcgaggacatgaccctcgtcgtcggaacgggccgaccccttcttcctcctcccgtcccgccgccctgaccgagcggcggatccgggggcggccggagctgccacaccagaaccggaggagttccaggtccaggcctcctccttgcgagccacacggtccgcgagctcaaaaagttgcgcggtggtctggggctccttggaggcgatcttctcgagcatgcggttgtgccgcacgccccccctgaacgcgtagatcaccgcgtgtgcggggatgcacggtatggtgttgcggacttgacagaaccgctgaatgtacgagcgaagagactcatcgtcccttcgctgtaccgcatgcaagtccgcttcttcgcctgggcgcggatatatgccctggaagttcgtggtgaactgctggcacaaatcctcccaagagtggaccgacgcgggtggcaagttcattagccaaccccgcgcctgacccttcagggccatggggaagtaattcgccatgaccctgtcgtcacccccggcagcctcgatcccggtcgtgtagatctggagaaactcggcggggttgacgcttccgtcgtatttttcggtgatggtgggccggaatcttgggggccaacggacgttccgaaggctcgccacaaaggctcgacagccagcaccgccaaccggggacacggggggccggcccccgtgcccgaaccgaagtggcgctccggacgaggaagcgccctccgttgcgtgggcggcgcgacgagcgtcgcgccggcgctcgatattgaggcgggcatccggccccccacgcacatcttcttgggtcggaggcgttgacgagggaatggcggacgaacggcgggtaacggccgccgctcgccgcgccctccgcctcgacgacatggagccggctgcggcagcgccagaggcctcggtggcggaggaccgcccgccggcgcctaggcgccgctgcgccgtcatgaccaagtcggccacgtcatccagctaacgtcgggctggagtctctggatcggggacgacgggcgggtgacgcaagagcgcgcccgcagcctggagcgcgccctggggcgtgccgccatcgccgtagacgaggcggcgacgcgccctgtctcgccgtcctcccccgtcgcccgcgggcggcgaagtcgcggatcgtccgacctccccgagcgcctccccccgcccaggatttcggcgagagggggacggtggggtgcgagcccgacggcgcgggttctgctccccatcgtcaccgctagcgttcggagagaggctgtgcgccactgcccgttcggccattgggctgagcgggcgaagcttggcgcacacgaaagaggacgagggcttagaaagacccgcgcgccccctactggcgcgccagatgatggagcgtggggctcctcaccgggagaccgcgcaggcccccctttgccggttcggccgggggcgctaagtgagtttctttgccctcgatctgaggaacgtcagcgagagaggaaatgcgcaagacacgggcgacgtagacaggttcgggccgctaagaagcgtaacaccctactcctgtgttctagtggatctgtgcatgaaggaatacagagaggccgagagcgaaagagagttcaggctctagaaaccattcgccagagtcccccctcccctcctctcttctccctctttttttctaggcctgggcctcctttttatctggtcaggggtcaccacatgggcctctagctgcctaagaagggaaacatgctttttacaatgagggctagtctacagccggaagtgacctctgacaagcagagcgcacgtctcctgccccgctcgcccgcttttccggtggacgcccatttcaaccttcatttaatggccagcgacttccttgccatacttgcgctgaagcctggaatggatctgaccgggactgacataccaactccaggagttagcacgccggctccggctagtgacgagagccaggaagctctcatcattccgacgggacggggcgaggcgtgtgacaggccgcctgttgccacctaacccgcgatctgaccggtctgtgaccggtcacacaccgtgaccagtcgcggaccggataagcgtgcgctgcgccgcattaaatgcggcgtggcgcgctcgtccaatcctgctataaatgcggttaggtgagccccgctgtgctcacctaacccacacgcgtggcgccaaaaccacagggggtcggggcgccccagcactcggggccgaaacgggggcgccccggccctcggggccgaaacgggagcggtccgacccctcggggagacagagggaggggtggccacgtcatcctcgggcccgacccccccgagggggtcaggccacgtgggtgaccgcggcttcccaagcctctagtcacaatacccccggccccatgtcaccgacaacaccgatcacaaaagtcttaagtatatgttcacacagaccgagttatatatgaggcagagaagatggttggaactaatcaaggattacgatcttggaattcattaccatcccggtaaagctaatgcggtcgcggatgcgctaagtcgcaagacctattgcaatgaagctcaaatatggccagaccacggtcgcctgtgcagagaattggagaagttaaggctaaccgtggtacagtcaggtgtccctgccagcttgacagtgcagcctaccctagaatcgcaaatccgggaagctcagaaagatgatgaagggataaaagaattaataaaaagaatacaggagaaggaggacaccgatttctccatagacgatcaaggcacagtttggtgcggtccacgcatctgtgtaccggccaagaaggagttaagagatctcattctaaaggaagctcatgagtccgcctactccattcatccaggaagtacgaagatgtaccaggatatcaaggcatacttctagtggactggaatgaagcgagaggtcgcagaatacgtagccctgtgtgacatttgccaaagagtcaaggcagagcatcagaggccagctggtctgctgcaacccctaccgattcccgagtggaaatgggaagagatcggaatggatttcatcaccggtttgccaagaacccctagcgggtacgactccatctgggtaatcgtggatcgactcacgaaatcagctcatttcgtgccagtgaaaaccacctttgatggaaagaaactagcagaactctacatgacccatgtcgtatgtagatttggctgtcccaagaagattgtgtcagaccgaggcactcagttcacctcaaggttctggaagcagttgcatgaagctcttggaacagatctaaatttcagtacagcttaccatccgcagaccgatggtcagacagaaagagtaaaccaaatcctagaagacatgctacgtgcgtgtgccctggattttgaaggcacttgggatcgttgtttgccgtatgctgagttctcatacaacaacagttatcaggccagcattcagatgtcgcgaaatgaggcaatgttcggaagaaagtgccgcactcccttgtgctggaatgaggttggcgaagcactggtattcggtcctgacatactcaagacagcagaagaacaagttaagctgatccgagaacgtttaaagacagctcagaaccgtcagaagaattacgctgacaatcggaggtgtgaccttgaattcgaaaaaggagaccacgtgtacctgcaggtatcacctctccgtggtatgaggaggtttgggatgtccggcaagttagcaccccgctacatcggcccctaccccataaccgccggatgtggcgaagtggcttatcagcttgagttacctgaaggtctcgcagatgtgcacaacgtgttccacgtatcccagttaaagaaatgtcttcgagttccagaagaacaagttccccttggtaatatcgagctggaaaagaatctgacctacaaggaaagaccgatcaaggttcttgaagaggctgaacgtcagactcgaaggaagactatcaagttctacaaggtccaatggaccaatcattctgaagatgaggcaacctgggaacgagaagatcttctccgcgccgagtttccggagctgctcccttaggtgctgaatctcggggtcgagattcttgttaggggggttggtctgtagcgcccgttccgtcgtggcgcctagcgggaaaatgtaattcctaaaaaccctaatttcgaaatatgtttccttgcttattgtctagtgtccgtgccaattccggatctcaaatccccgatcgatcgtcaagttcaatcctgaatccaaatccttcccaaatcaaatccctccgcaaaagtctatttcacctccctcaggttcgatgggccgaattcctctcggcccatctccctctccctccccatccctctctctctctctctctccctctccccccgctctgcccgtgcgctgcgcccgcgtgcgcgtgagccgcgccgagtcgagcgcccttcgccctcgctgccgtttcctgtcgacgccgcccaaatcgccgcgccgcccgttgcttcccgcgcgcgcgcgcgccatggtggccgaccggccagtcgccgccgccgtcagcgcctgcccgcgcctgccgcccgtgccgttgctccgctccaaaccgcccggccgtcatcgccgtcgtcatcgacttggccccgcctctcctcgcgcgtgcttccaagggacggaggcagagcttccccccctctgccgcatcgccgtctctccctcctccttttcccccaaagtggcaagggggcaaccccctttctctcccccccccccttttcccttttcccttttccctcccgccggcgtcatcctcccccccccggttgccgtttgggccgcgactgccgagcactggctcgctcccttgaccgcccaaggtcggtttccaaaccgacattgccgtcctataaacccaggcgccctcccttccttttttcccctcccaatcttccccgtttttcacccacgccattgccgtccctctcgccgaccgccgccgtcgcgtgtgccggaggagccggtgcgcgctaggacgcggaaggggactccgggcgctcgtcttcttcctcttccccggcctgaggccggagagatcactcccgtgccgtcggcctctcgtcactgcgccccatcacccccgcacggtagtgcctccctccgttctccctcctcgttccatctcctccccttagactcgggtagtagcacgagtagcctccccgtagctagctagcgccgccccgaccgttgctgccgctcgccgtgtgctcgccgccgtcgccgcccgtgctccgtagcacccgttcgtcgccggcctcgctcggcgtagctccgccatatccgacgctagcaacagactcccggagtcgcgtagatgctctagctcgcccgaatcggtctcccgtcgcgccgtcgccgtttcccccttctctcgccgccggttgccgctaccacaatccgccgccgtcgagcatcccccggcaaatccgagccgttggctcgtctcccctcatcccgtgcaaccttccggtgtgctcgctttcgcctgtatcgccgtggttcgccccgccgttcgcagccaccgtccgccgtccgttccggccggcgtcttcttcaacctcccgccggtccgcgtggcaaccacataggcaagccacctttgaacatcttgagcctatatttgaacttaagtatgttgcttgaaaaatattatgcattgataggattgcacttaatctacatgtcccgtctgcaaggcagattggcggacctacctaacttgttgcagttgacccctccattgtaattattataccatgttcccttgtaaccacctagttacgcctcggtaatcgtgcactctgcacgaatatcgacggtcgccttcaaacttaaaatctgataaacatcttgggtaaaacttaggttttacaaaacacttggaaaacccgacacctgggtcggtgcttgcgaacctaaatgaatttccaaattcgcagaccggggaacgtaccgggtgtacggttccccgctcttgcacttaaggaccgtttccttagaatttcatccgaacataagacaagtacgaccacatgggtggaatgggacacccctggctgagtaactagctaatcgggggagccatgatgccaagagacatgtggattcaacggggtggtgtcggggaggacccccgggtttcctggcacagtatggtctgggacccctctcgttggcatatggtgaacctgtgtcggctttcgaaatgccttgtcgtgaaagccttaaggtctctagtcgtggccgttctgcatgggctggatgatccgggttagtaatgtcgtgtgggtaaagtgtacccccctctgcagaggttattaaactattcgaacagccgtgcccacggtcatgggcggatgtgaggtgattcctagcgtagttttgtttgactactgctttgtgaaatttgctgatgtggtttgggttcgatgtttggaaaacctgcggctgatgggatcagccaggcccgggtggccgtttaaaagccgttggccgggtgccaaccttgaccaattcaaaagactgataccttgcacatactccgaccgggcgagacgcactgtctcatccgtgtcgtttgagaagcactcacttagttgtttcagaaaagagtttaaataaaatcaattgcaaaaacaacagcctttccttgaagcctgcattaaacacttatttcccatggcttgctgagtacttctgtactcatccttgccctatataaataatccccccccccagttgctgaagaagatgaagcggatcccgctgacgaggagttcttccaggagcaagccggctacgatgagttttagggtttcggcctagttcccaagtcgcgcctgtgatgtctggtccaagtcttggcttccgtttcccttttgtaatgtagttgtgagctcgggatctgtccgcagcccaacatgaccgtactcctactctataataaagagacctctgttgctgtgatattctgtcttcctgtgataccagcactgtttcctgggactggtatcaattaacaggttaatttggagcgtcacgggctagtcccgctcggggctagttcggggcgtgacactagcattatagtacttgctcttacctataaacatgtattacataattaatgtctggtcacacctgccatacacacatgcatcttgaagtccgtgctgcagctggctataaatctgtaacccgctgctcttctctctctttaaaatatgtttatagctggcttatagtgctattgtacctgctctgatcagccacacgttgatttacaatacaagacgacgtgcatgtcattcagcagctcagcgcactcggggcataagcctgaatactgaggtggtgttcttttcttctgaagatgaagatgaagttttttacgtaaaacgatgtggtataaacgtatgattaattgagttttaattattataaacttaaaaatatagattaatatgatattttagagccactttcatataaaaagtttatatacgaaacaccgtttagtagtttgaaagcgtcaaacaggaatcttaacggagcctcagctgctgcatatggagggacgcggtcggggaggagctgcaacagcgaggccatcgatgagcgcgtgctccatcgtgcacggaacgccacatttgcgtgcgcttatttatcccgtcgtcgcacgcatcgcgggtcgcactcgcaccatgcggcagagcgcgcttttgcttttgtatcgccttcgcccgtgaggcacacacaagtcatccctcgtgagtgtcacatcctaaaaattcaaaagatataaattgttgtttaaatggaattattagaatttattttaaaaagctttgaagagaagatctaattttaattaataaattccaatataaaatggggccagataaaattttattaaatactttgcttaattctataattcctagatttttctgggatttatttgagctaaggaagtatttttaataaatggaattgcatttcatgaataatttaaattgaaaaaggttttaaaaagtcttcttttggctttgggccgaaagtcggcccaaaacccttccctctctcctcggcccaagccggcccagtccgcagccgcccgcgcgcgcgcgtccgctcgctgacaggtggggcccgcctgtcaggtcgtcgtcttcctcgcgacggccgccgcccgaaaccctagcaccgcgccgccgccgtttccttccaaatccggtcgatcctttccttctccggccgaattgatagaggggaaatgatcctcgggatctcctctaccttttcccctttggaaatatcggctaaatcggcttggaaagtgtttgattcgaagtcgaatcggatcggcttttctctctccgagcccgacctttccatctcgtcgccggtcgccgtgggccttcgccgccgcctcctagcccctttaaaaggacccccggagtcgccgctacccgtcgccaccctcgccttcgcctctcgtcgccggtagagctctagcgccgtgtgacctagcgccgccgtcgccgccgtcgctccagctgtgcgccgccgccgttccggtcatcgccgtcgctcgggaagaccgccgtcgtggtcgccaagtcgccgctgtcctcgtccgccccttcgccatcgccgaagatcgccggagcaccatcgccgccgtcaacccgaagaccgccgccgtttcttcgtcgtcgccgtcgccgtcgccgtccgttggtcttccgccgctcctttggtcaccggtgagttcgccgcgtcgcgctctacgtcttggtgccctccgttcgtgccgaagcgccgctgttcgccggcgagcatgcacgcccgagccgccgagccgccgccgccggtggtgacgtcatcgccgacgtcatcgtcgccctctcccgtgagccggtcgtggaccgttcgatctcggccgtccgttttggatcaagtcgatctcggccatccgttcgcgtgaaccgtcgccgtgcgcccggtccaccgcgaaaccctagccgctgacgcaataaatccctttttccttttcaaaaataattcattattgcgtcataattcaattgaaatccatataagtgttttaatccgatttaatcttcaaaaattcataactaattcatcttagctcggatttagttggttcaagtctctaaatttttccaaaattgagatctacatgttaaaaatatccacatgtactgttcatgcttgtttttgtgctgttttggtgattttgctcttttctgcttagattccgtcgtttccggagagtccgttttcgcaggagaagagtttgaagagttccaaggccagcaaggcaagtcacacagatcccaaacaaccctttgagcatgttgatcccgtttaaagctatcatttctattcaactattgcatttattttcgaatgtcattgggtggaattaacctattgtttgctaaagcccttttgttcttgattactttattccttgataccttgggttattataacttgactagttgagctttatatattggttcagctagatattagatataattgcttagccctgcttagaaacattagcacactattgggataacttaagatttactattatttaatgatggcttaatgataggtcacgatggtcaatcgtgattggttaattaattaatgtgccaactaaaacctgataatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgtcttgtttataagggggtgattatgatccaggaaaggtgcgctgtaatggattgtgttgtgcaaggggtattgtcacaactcctttccgaggtaccgtggtggtattgaggcacatggtgacatgatgtggggttgtgtcttgtgggtacagtggtacacctctgttcagagtaaaactattcgaatagccgtgcccgcggttatgggcgggtctaacaatgtctttcgtgattagtctcacacatctcatcataataaaagatgctataattggtaataatttgattagctcctggtttggaatggtatattcctggtttggagataggactgtgcagccgggatggttgttcagaatggttgggcctatacaacagggtatgttgtatagcgttggattaatattgtttaattattacttaactattttattaaattctgaaatgtttattaaaggctgtttatgcaaatggaaccctattatgccatcctttgttatcctgtgcacttgcatatttgctgcgtgacttgctgagtatgtcatatactcaccttgcaatcattcatcagaggaagagttttacagtgatgccgatggtgtggaggattaggtgtagccccggtcaagctgcctgtggaatggagtcgtatgcgccgtttatctttctttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagctccttgaccctaggttatgccaaatggttacccatagaagccctctaaaaatattggaaaagtagaactgttctcctccccttctcttttaattaaaccaaactaatggcacatgcatttcctaatattttttttagtggttctcgttcaaaatttattctagcgttattagtactgtacatctattactgtactaatggctcattttaccagcaaaagttttacaatattgtttagtttaatcttgctgcaatgaaataaatttatcatgttgattttataactttcttttatttcttttgaaaccggttgttcaaaagtacaaaatttgtgaccttgtttccaactgtttcaacttatcctgcaagtttggcttaccttttactttgattttctaactttattcaaattaatccaaaaacttgtgctattaattggataaatgtcttaactccctcctttcacttgtctttagatgccgcgctacaagcctgagtacttgtttggtgttgagggatttgtccaggagttgcgtacgatgtcctttgccataggatttgggactgcccctttttatgcccaaattcctcatgatcgtcacgaagaaaagtgccgagtcaaagtcaccttgaacagtaatagtgaagatatcccctcagtgatgttcgaagccggaggaagaaactacatccatacatgtcaggaggtggcaaggatcgccataggagagctccgcgatcgctacagtgatcagttggccgacactgagtatcgctaccatcctcgccaaccccagggaagtgaccgtggcagctaccttgagactgagggaattgagaatgatgctaccacaaggcatttggttgagatgctgtgggctatggatgaaacccgtgcggagactgtgttagcggctcaagatcgtgaagatcggaatcgtggtaagatttgcaagttagaggacaaggtggatcgtttggagaaggaactagccgtattgaagggagaagcaccaccgcagaaggccagggttcgtctcaccgcgaggaagagagctctatttgtccctcgctaccaattggtgccaaaggtccgtgtggtggagaaagaagttaccccagccctagcagatcctccggtcgtcaatgtaagtgatgatgaaggagatgaatcgaagcgcacccattccaagattgagtggggagcaactcaagatgatgaagacgagctgaacgagccttcaatcaactccgatgcccggaagacctagaatgccttgtcaaaccgttgtcttagatcgttgtgttagtttgcttgtttaagtttggttgtgtgggtcttgcatgtgatttacatcagtggtgggatgtaagtgcatgcgtttgtttgcttttgagtgttaggaagttggtgagtttagtggtgtgagagtcttcagttttgtaataatgaaactcagttaagatcaataaaagttaaagtaattctctgccctaagtagttttccccggtttctcttcttgtgccctgcccatgccagatggtgctcactcgcagcaacgggaatggccccaatagtaacaataacaataacaatgaagggaacccaactcttgcccaagttcttgctcaacagacacagcttatgaacatgatgatgcagcaactccagaaccagcagaaccagggaaataaccatgcacctccccagaacaagttagcagaatttcttcgtgtgaggccgcctattttctctagtaccgctaatcctgttgaagctggtgattggctgcatgccatagagaagaagttggatttgcttcagtgcaccgatcaggagaaggtctcatttgcatcacaccagctgcatggccctgcctctgaatggtgggatcacttccgccttaataggattactgctgaacctatcacttggcttgagttcaccgctgctttccggaagacgcatataccatcgggagtggtgtctctcaagaagaaggaattcaggtcgcttacccagggatctcgctctgttaccgagtatctgcacgagttcaatcgtctggctcgttatgctccggaagatgtacgcactgatgaagagcgccaggagaagttcttggaatgacttaatgatgagctttcttatccactcatgactggggattatcctgatttccagaagttagtggataaggctattcgtcaggaggacaaatacaatcgcatggagcagaagaaacgccggattgctcatttcatgacgcaacaggggaataatcagaggccgcgtcttactttaggaccccagtccatgccacagggaggttcttcgtctgttgttcgtccgcagcgtcagttcttcaacaacaatgctggcaacaacatccgcaatcaagctccacgccctgttgcagctttgacacagcaacaacctgccaagaaggagcaaggcagcaagcccgtggtgtgtttcaactgtggagaaccaggacattacgctgacaagtgtccgaagccccgacgcgcgaaggttgtccctgcccagagcaactctaccgcaccagcatcaaaggcccgtgtcaatcatgttgctgctgcagaaactcaaggtgctccagatgtgattttgggtacgttccttgttaacttagtccctgcaacagtgctttttgattctggtgctacacattcattcttatctatgagttttgcgggaaatcatgggatggaagtagaagatcttagacgtcctttgatggttaataccccaagtaatcaagcactctctttgcaacatagccccttctatcagaatagaaattcaaggagtaccatttctggccaatcttatcctgttagaatccaaagaccttgatgtcatcctagggatggactggttagccagacataaaggtgtgatagactgtgctaacagaaaaataactctcaccagcaatgatggtcgagttgtaactgtgcatgcattgtctcctgagtttttaaggtcaagactgaaccaaataactttggaagagattcctatagttcgggagtatcccgatgtgttcccagatgatttacctggtatgccgcctaaaagggatatagagttcagaatagatttggtaccaggaacaactccgatccataagagaccttatagaatggcagccaatgaattagcagaagtcaagaggcaagtagacgatttgcttcagaaaggatacatcagaccgagttcatccccatggggagctccagtaatttttgtggaaaagaaagaccatacccagaggatgtgtgtggactatcgtgcactaaatgatatgactatcaagaataagtatccgctgcccagaattgatgatttgttcgatcagcttaaaggtgccaccgttttctccaagatagatcttcgatcagggtatcatcagttgagaatcaaagaggaagatatacctaagacagcttttaccactaggtatggattgtttgaatgtactgttatgtcttttggacttaccaatgcccccactttcttcatgaacttgatgaataaggtgtttatggaatacctagacaagttcgtggtagtctttattgatgacattcttatctactcccgaaccaaagaagagcatatagaacatcttcgccttgcactagaaaagctacgagaacatcaactgtatgctaagtttagtaagtgtgaattttggttgtctgaagtgaagttccttggtcacgtcatctcagcaggaggagttgccgtcgatcctagtaatgtggaatccgtaaccaactggaaacaaccaaagacagtttcagagattcgcagtttcctaggcctcgcgggatattatcggaggtttatagaaaatttttccaagattgctaagcccatgacacgattgcttcagaaagatgtgaagtacaagtggtcagaagaatgtgagcagagttttcaagagttgaagaatcgcttaatatcagctcctattttgattttacctgatccaaagaagggtttccaagtgtattgcgatgcatccaaactggggttaggttgtgttctgatgcaagatgggaaggtggttgcctatgcatctcgtcagttacgtccgcatgagaagaactaccctactcatgatcttgaattagctgcagtagttcatgcgttgaaaatttggcgtcattatctttttggtactcgtacagaggtgtataccgatcacaagagtttaaagtatatctttactcagccggatttgaacatgagacaacggagatggttggaattaattaaggactatgacatgggaattcattatcacccgggaaaggctaatgttgtagcagacgctcttagcaggaaaggctattgcaatgctacggaaggacgacagttgccattggaattatgcaaggaatttgaaagattaaatttgggaattgtcagtacaggtttcgttgcagccttagaagcgaagcccactctaattgatcaagttagagaagcccaaattaataatcctgatattcaagaaattaagaagaatatgagaagaggaaaagctatcggtttcttggaagatgagcaaggaactgtatggttgggtgagagaatctgcgtccccgacaacaaagatttaaaagatgcaattctgaaagaagcccatgatactttatactccattcaccctggtagtaccaaaatgtaccaggatctcaaggaaagattttggtgggcaagtatgaagcgtgaaattgcagaatacgtagcagtatgtgatgtttgtcagcgagtcaaggcagaacatcaaaaacccgccggtttgttgcagcctttgaagattcctgaatggaaatgggaggaaatcggtatggatttcatcactggtttacccagaacgtcatcaggtcatgactctatttgggtgatagtcgacagacttaccaaagtggctcatttcatcccagtaaagacaacatattctggaagtcggttggcggaattgtatatggcaaggattgtgtgtttgcatggcgtccctaagaaaatagtgtctgatcgaggcagtcagtttacttcaaaattttggaagaagcttcaggaagagatgggttctaagctgaactttagtactgcttatcatccacagacagacggacaaaccgaaagggtgaatcagattttggaagatatgttgagagcttgtgctttagacttcggtggaagttgggataagaatctaccttatgcggaattttcgtacaacaacagttatcaagctagtcttcagatggctccttacgaagcactgtatggtcggaagtgccgcactccgcttttgtgggatcaaacgggagaacgtcaggttttcgggacggatatcttgagggaagcagaagaaaaggtgaaaatcattcaagaaagattgcgtgtggcccagtctcgccataagagttatgccgacaatcgtcgtagagatctaagttttgacgcaggagattatgtgtaccttcgtgtcacgcctcttcgaggggttcatcgttttcataccaaaggaaaattggcaccgcgttttgtgggaccttataagattatcagtagaagaggagaggttgcttatcagttggagttacctcaatctttggcaggagtccataatgtgttccatgtgtcgcagttgaaaaagtgtttaagggtacctaccgaagaagctaatcttgaacatatagaagtccaagaggatctgacctatgttgagagaccaatccatatcttggaaatagatgagagaagaaccagaaatcgagttatccgtttttgcaaagtccaatggagtaatcactcggaagaagaatcaacttgggaacgagaagatgaattgaagtcagctcatccgcatctgatcgccagtgcttccgaatctcgaggacgagattctgtttaaggggggtaggtttgtcacatcctaaaaattcaaaagatataaattgttgtttaaatggaattattagaatttattttaaaaagctttgaagagaagatctaattttaattaataaattccaatataaaatggggccagataaaattttattaaatactttgcttaattctataattcctagatttttctgggatttatttgagctaaggaagtatttttaataaatggaattgcatttcatgaataatttaaattgaaaaaggttttaaaaagtcttcttttggctttgggccgaaagtcggcccaaaacccttccctctctcctcggcccaagccggcccagtccgcagccgcccgcgcgcgcgcgtccgctcgctgacaggtggggcccgcctgtcaggtcgtcgtcttcctcgcgatggccgccgcccgaaaccctagcaccgcgccgccgccgtttccttccaaatccggtcgatcctttccttctccggccgaattgatagaggggaaatgatcctcgggatctcctctaccttttcccctttggaaatatcggctaaatcggcttggaaagtgtttgattcgaagtcgaatcggatcggcttttctctctccgagcccgacctttccatctcgtcgccggtcgccgtgggccttcgccgccgcctcctagcccctttaaaaggacccccggagtcgccgctacccgtcgccaccctcgccttcgcctctcgtcgccggtagagctctagcgccgtgtgacctagcgccgccgtcgccgccgtcgctccagctgtgcgccgccgccattccggtcatcgccgtcgctcgggaagaccgccgtcgtggtcgccaagtcgccgctgtcctcgtccgccccttcgccgtcgccgaagatcgccggagcaccatcgccgccgtcaacccgaagaccgccgccgtttcttcgtcgtcgccgtcgccgtcgccgtccgttggtcttccgccgctcctttggtcaccggtgagttcgccgcgtcgcgctctacgtcttggtgccctccgttcgtgccgaagcgccgctgttcgccggcgagcatgcacgcccgagccgccgagccgccgccgccggtggtgacgtcatcgccgacgtcatcgtcgccctctcccgtgagccggtcgtggaccgttcgatctcggccgtccgttttggatcaagtcgatctcggccgtccgttcgcgtgaaccgtcgccgtgcgcccggtccaccgcgaaaccctagctgctgacgcaataaatccctttttccttttcaaaaataattcattattgcgtcataattcaattaaaatccatataagtgttttaatccgatttaatcttcaaaaattcataactaattcatcttagctcggatttagttggttcaagtctctaaatttttctaaaattgagatctacatgttaaaaatatccacatgtactgttcatgcttgtttttgtgctgttttggtgattttgctcttttctgcttagattccgtcgtttccggagagtccgttttcgcaggagaagagtttgaagagttccaaggccagcaaggcaagtcacacagatcccaaacaaccctttgagcatgttgatcccgtttaaagctatcatttctattcaactattgcatttattttcgaatgtcattgggtggaattaacctattgtttgctaaagcccttttgttcttgattactttattccttgatatcttgggttattataacttgactagttgagctttatatattggttcagctagatattagatataattgcttagccctgcttagaaacattagcacactattgggataacttaagatttactattatttaatgatggcttaatgataggtcacgatggtcaatcgtgattggttaattaattaatgtgccaactaaaacctgataatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgtcttgtttataagggggtgattatgatccaggaaaggtgcgctgtaatggattgtgttgtgcaaggggtattgtcacaactcctttccgaggtaccgtggtggtattgaggcacatggtgacatgatgtggggttgtgtcttgtgggtacagtggtacacctctgttcagagtaaaactattcgaatagccgtgcccgcggttatgggcgggtctaacaatgtctttcgtgattagtctcacacatctcatcataataaaagatgctataattggtaataatttgattagctcctggtttggaatggtatattcctggtttggagataggactgtgcagccgggatggttgttcagaatggttgggcctatataacagggtatgttgtatagcgttggattaatattgtttaattattacttaactgttttattaaattctgaaatgtttattaaaggctgtttatgcaaatggaaccctattatgccatcctttgttatcctgtgcacttgcatatttgctgcgtgacttgctgagtatgtcatatactcaccttgcaatcattcatcagaggaagagttttacagtgatgccgatggtgtggaggattaggtgtagccccggtcaagctgcctgtggaatggagtcgtttgcgccgtttatctttctttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacagtgagcccccggtggactttcgcaacaacggtgccaagtggcaccccgcatcacaagctcaaatcccacatgaaaatgaccaatcggcgatagatatatgagtatatccatgccaagattaagctaagttcatcaatgtgacaatatatatacagcgggagaagctatgcttctcaaatcaacctgaaagtgttcattccataacctaagaaattgagggaagagaactagagattcgatacaagggtgcaaaactgtaatggcagcctgagaaaagtcgctgggagacttgagagttgagactctgattcctttgcagtccatagcaatgctggtgctatggcacctggctctgtctcattcatccgtgaacatattgccatggcggacagacaaaatgcaggggcagaggcacctgagaagccagtcatcatacagaggaaaccaagcattctttgtctcctagcagattcccctgtcaatgtgaaagacaactagacaagccgcctgatgaaaagcagctgatcatgtgccattgggagtggcatctgagagtgtgtggttgatgtcctcgccatgttttccgttcatctgcacacgttgccgctggataatcggaaataggtacgttaggggaaatatcaaaatggttgctgcatataagttgctaggtactatgtagaagataaaaggcttgtggttatgttgcaattgaactacaatgaaatgtagatatgtttcattgttggatgaaaattttatgacaaaataacttctaagtttgggaagttcatttggagattaaaatagaacatagagtagctgattaatgctctatgatacccgatcagtagaatcgacagtgtttccatttaacaatttatggaactcttccttcatcttgcaatccttctctagtttatggagctcttcctttgttctgccatctttatctttcgctgtaactgggagcaaagatgatccatttgtgcgatctggcatttctgtagaattgccactaacgattgttacagaatgaaccacatggataatactgcataattaaaggaagctaaaagagggtacctggtagcttattgtcaataaagaatacaaccaaattgacagtatacctgacgaaaaagaatgcaccaaagtcagatgccactacaaggcaatcatattacagaaatgaaactttatcctaccaagcaacaacaacatccacgctgtagtgttttcgagaagcaattataagaagactctgaattatagccatcagccaagcaagaatcttaatcaacctaacaaaacaggaacaaccaatgagattagaagatcagatgtcagagtactgagttagcatgcaacttgaaccaaatttatgacatattacaggcaaaaaatgaccagggaaagagacaaataagcgtgtgtgcgcatatgcattctatattttaataccttttggatccatatttatgatatgtacgcacgaaaacaagtgtaaagatcatgtgagatgaaaaaatcagatcgccacaaccaaaaagcactccacgaggaactgcaaaggaaaaaaaaaggaaattcagatgattttccacccatctggacaaaagattcaacccaacaaatgatgaaaggcttacagttgatcaggagcacttcaagtacattatggggcggtggaagagtggccatttttgagccctgcaaaatgcaaagataaatgacttcagtaagcctttaacaaagtatgacagtatgtagttcacgagtatgctttagctatgatgagaaattaaggttacctcccgacagtgataatttggacctgggagctgagtggaatagaaagtaataatccgcaaaaattgtgaagcctagaggaaagaaaagaaaaacatcattgttacatcatgattataatggttgcagagataagttaaaagacatgggacagccacttacaactaaaaaggccagcaccctgcgccagagtagaacagtgtagaaacgtttgctatgataaataaaagggtgaaaactccactgcaaaaccataaagattgtcagtcaattacactactttatgatcaagcattacatgcaagtagcttaaacaaaccaaattctgttgatgcggagaggagcaaaatacataaacgcctctgctatactacaacacaaagaagtgcatctcacattctcaccattttaacatcttaattgtacagaaaattggtgcaacaaatagcttcgaaaaacattttttgttcttacagatcatgcagacaagaccttactaaaaggaccaaactaccatactgtagtacatattggaggtggcaataatttatcggagagcaattgattaacccatggtcataaggtacaaaatcacactaagctaaattatcaaattactttttcactttcataaatcaatctggatagccactattttcaaatttatttctcactgcagctctttcaaattgtgttgtttacttgtcaatatcagcagggctgtcattgccatttacactacaagatttctggctaacttattcaagatataagaagaaagggtcattacaaaacatacatcattaattatcaaatatgtatgaactatgcaatagatgatcatatgcagtgaagcaaaatagccacctaccaacaggaaggaaatgaagatgaatgtgaacacgctctcactaacatatcctttgtcctgtccaagttcctaaaaacaaagagaagtgccaccagtggcaggaacaaatcagtaccattgttctttgacagatatgagattaatttttaccaggtcacataccggaagagccatgaatcccaagtcctggagcagtggcccaggtcgatgcaagtaatgtactcctcgagcagccagtccatgaatgtactaattataggtaaaaggattgcatgaatttccaatatcatccattaatgaacagataatattatgtaagaagtaaatcttgagaagatgatgaagaacaataaaagttggacattttattttatttttccacgctctcaaaaagagaacctgtagaaaatacaaggagaagaaagattttatttaggcgccaaccggcatttcgcattgcaacctatcaagccatatgggaaatcaaatctcacgctttcccaacagttagtttcattctttctccatcgtgtacagaaaaggactgtagatcttactgcgctctaaaatgtttactcatctaaggaagtaaatcaattataataacacaaacatggagaaaaaaagttatatgaaatcaccacagttgagtcagatttctagggaatggagcatgtctgacagggagcagtatcacaaatggaaccaactatgtcaaaggattgggtgcgcgattttattaaatatcaagaggataggttgcacctaagttcaaatgaattcatctcctatatctcaactcaaaatagaaaataatgcaagtcctattatcccaaaatgttaattgcagtattatttctgaggtcaacttatgatatttaattattatcttctcataatagagcatatcctgttacagtacaagcgaatatatctgatgacaggcccatgaatatccaattcatttccagaatggcattaataatcatctttagttcaataaaccaacctacaagttgtttgcatgagcatgattacagtttcgaggagactacatgcaggacaagaaacatcacagtaactgcataataagcgcgctgattttatgaaaagaatttcagaaataaataaatacttgcaaaatctagacaaacataagaggcaatttatctaacatattttacaagagggaccaatagcaagctaattgtctcaaactctctaagcagggaacttttgaagaagacacaaggcaacaatttctccccatgatatgacatctatcatggtatattgcttttgaccttggctccagctcaaccaagattgccagtgcttgaactgctttctgtgaatttgcagtagttgctcatccaagtatccaacatttctcaacaagctctggatttttttttctactctgaggacatatcacataaacagattgaatcatacttccatccccaatactcccctcttgattaacaacaaactaaattcacctaaactgtgcagacatatagttttcatgcaaatgttcaatcagccacacccttgctcgaggtgaggtataatttaccacacttagttcatacaactaaaccctctgggcagtgttgacacagaattcgtaccggtccccaaatccaactctaaaattagcatagattgtacgatgcagagctagctaaaattgccgttcaaaaggggtcgaccacgtgctatatcaaaatttttgaaacacacagaaaatagcagtcaagaattacaaagcacgccacaaatatggcaattatgcacacggagccacggaggataaaaaaaatcaaaggaaataaactgaagtttacctgaaacaccaatccggcaaggagcaagcgccacttctcgaaaagaagctgcagctccaccgctatctccgcacacaccttcctccatagctgcacaaaggcgggtaaaaaaaaatcacaaaccatagctagaacatcccaaccccatgtgccaacgaatccacaccttggtagcctcccgagcgatgtaaaccgccatggccgcaactcccgctcctcgcccgccgcctacaggtacaccctggagggctcacacccatgctccgatccgcgcatcactgctgggatcacggcatctcgtcgcagccaggacctcgccacctcctcgggaccgccgcgagatcgccgcccgccgagcggaggaggatccccccaagcagctagctccggggcctccaagagggggggggagcggcgagcggcgcgaatgcaattttccggcgacgaggcgagtgagggtgggggtggtcaggctcaggccgccgcggaggagagtcacgcggcgacggcgtcgacggtttgaatccgggagggggagggtgggttcgaggaacaaaagggtcagcggagtgggcgttttggtaaaatgcggtgggtttaagtaactgaccgcattaagcggagtagttgcgcttctctttcctttctttttcccctgtttttagaggattgcgctattttttttggttaccagtgcttccaatgttccaagaatccaagttccagctcatctagggttccattcatggaattaaatgtagtagtatcatattatagaaaattgatactagatcgatatatgtctcacgaaatactagtgaacgggaaattcaagaaaatgtgaggaacattcgtcttaatttttgtacttcctctgtttacaaatctttgatgtttttcgcaatatttgatactccctacgttccataataaggcacaaccacttttagtagatgttatataatataaggcatgcatgcaagcatgcaattaactatggcatcttctccattaaattattacttttttaaatcttccactctcatattatctgatcatattggatgtatgcattatatttattaggatgattcaaactacaagatgataataattattttttggtctttatgttaagagtggttgtgccttatattttggaatagagggagtatagtttttgatgaatttgttcatcaaattcgtgttaaaataactttgtaaaatctaataggtttataacattacgataataccctccaaaataaatcgagaaattattaatagtcatagtttgaaaaggtaatttgaaacaaaacagtgcattagtttttacaaccaattaccatagaaataccaaaacattattatttctgataggtaggaacagacacatccattacgtagggtgagatgactagaccaaccacgacctgtgacaccaacacctccagaaacatgccctagtatagcgtatagccaccgacccgacatcagcccattagatcaattaggtactaccttccgtcctaaaatatagttatttctagcacaatactttgtcttaaaataaagctatttttctacctatcttctcctctcaaccaatcacaaccattctttttcacctaatttctcttttcaaccaatcacccacatttttcaatcattctcacctactttcttaatacccgtgccaatcttaaaaatgcttacattttgggacggagtaatatttcatacacgaggtatcgatcatcatatgatctttgtgtatatgattgcttgtcttcatttctaactcgctcaatcttttttaatgcatcatcaagtggggtgattacgattcatgtgctacatgccgtgcacgagcacagctacgcatttgctttctgcggtttgccaatatcattgtagaagttctttggtgtttaaatgtattgattataatctgtttttatgcgattataatataaatataatatattttacagcaaaaataatataccctacaagatgtctttgccaatgatctccgtcgtcccatgtgcgccatacagttgtatgattgtatctgccactcggcaacaatggagccgcaaagagcttttggaagaagtttgcaatgtcctaatgacgtatttatcaatgttcaattagacttggctacggcagccaaccagagcctaacccggtttactcaaacttggcctgcacaaattatttagtttggcatattttactgttagtatcaattaacattatagggacatttaagtatttaactgatatatacgtctacattctggtggtgctggggaattcttttttttcatataaatcttcagtatttgtgattgaagatagcacgtgtacttgtttattccatgtattgaccgttgtccgctgtgatatcaacaaatgtacgtaccccgatactatacaaaacaattaatgtgtactctcctatgtagcacaccacaaattctttattgaaaacgaagcatagaacattatatagaggccggccggtgccatccttctctcgaaggatcaaactttgctaatccatcgttccatcttctgtgctaggttggcaccaagctagcgtacgctgtctatccgcggaataaccatccggtcatgcaaattccaccttccttgtaataccattccaagtcaaagctcggagaatacgaaagggaaccaagccaagtcttattttgtcattccgatacctattttccccatgtgaaattcgaatgttctcaacatgactcgaaactttgatactactacctgttaactgctttctcatgcagatcccagcgatccggatcggggttcataaaaaaaccgacacagctggagatggaaacatggagaaccaaacaaccccaagtgacgcgaacgtggtggtgatcacacgctgctacgggacaagccgatgacaagtgcacgtctgcgcccagcaactttgacatgtgccgttggccaagccaaatttaatactccgtatcatacacatctgtaccgaatcatctgcgtagcagtatcatggcgtatcatgcacacacgtggcggataagctggcttggacggctaaagttgtacgcgtccagagcgaggaggtgatgaaaattagaggagaaaggttgcagtcgcggcgaagcaagatggacaagcagacgccacaggggcacggcgagaagccgcggtatttgcccagatgggcgcctgttttgttcgaacccgacaggtgctttcagccggaaaggcgaggcatcatcatccgcgtcgaagacgcgtagcgatcggtagagccatcaacacacgcacgctgcggtctcgatcatgattcgcactttcacagcggttcgtttctggcgttttttttttctttttttgcgagcacgatcacgatctcagctagctagttttacatccaaaactagtactgtcgtgtacaaggaataaaatggaacggttttggggcaaaaatccttcttttccccaaggagagggagagttttgcacataataagccttcctctccgaacgaacatcaacatgagagggattgaaactgacacaagatatccagtttgcatcaggtttgatgaggatggagggcatttgtgttccttaaatgtaaggttgtcaggaaatgctggcgaattttgaatatggagcaaattcggttggatctccttgaaaatggggagttttgaaccaacagttcaagagaacaaactgaaaagataaaggtacaagaacatatgaaagtgaaactatccaccgcagttgtttcgcctacatcgttagtccttatcagacgctgtatatcgaagagaaccttgtagtgctctgtacacatatcaacagacaatagcaactatcaacaggcgacaatcacccagtcgtcattattacttcgaggatcaggatcagtaaatcaacttgttgataaatagtccccaaaatagacgctcgtggatagcgagatgacgagagatttgacaccgtgacgaacagatgattccaaatgttcactgtcatatcctgttgtgtcgcccaactctgtcaaagaatattcaggtgtgatcagttgaactaactcagatttttagttgtgtcaaaaaaaaaagaacttagattttagtaggctgcgagggcccaaagcaaaacaaatactatgactgcttaatgatgggcctaaagccatcagtggtcatggcccaaatatggattcatgcagcacaaacgggctttagaagcgaatagtcctgacatagcctcctcaccactgggccagaaaatcagagactcgagcacaacgcccgaccttcccggaggcggacctatccatatcggaaagcatgcgtgcatccactcgaataacgtaaggctagattgcactccaagtttttatcgtgtgacttgggccccggaccagcctgccgggctgccggccgccggcggcgggcgacggaaggaataatcagcttcgggcacatagggtgcggtgcggatgcgtgcatgcacgtatccactgaaccgagccgcagccgcgcgcgcagtgggccgtcactccatcgatcgcgtggcctaccggcagcacgacccggcggcacatgcaataggatgaggagaagattgctcgcaaaccaggatcatccgatgaagtgattagccccggaccaaatcagatcaaagaggattgctgacgcgagcatgtagtagtgtagtactactcctctgttgactatagcatcgggtgatcgatggaacaccgtatctgattctgctgcactatgctgatcagctgatgcggtccacacgttggcacgttgctgtatattctgggaagcatggcgtgttctacgccaacacgacgacaagtggctgactttgtgtagtactccctacgcatttcaacggatgacaccattgattttttttatccaccttcgaccattcatcttattcaaaacttttgtataaatataaaaacatttatgtcatgcttaaaaaatatttaatgataaatcaagtcacgataaaataaatgataataatgtatatttttttaaataaaacaaatgattggtaaaaagtcaacgacgtctaaattatgtatgcaacacagcagccaaggagacacaagagagtcaaataaagctttggcatccgccaccaggacttctctaaactggtgacaggtgggaaatcaagatactccctccgggttgataatacttgtcgttttggacaggggcacagtcttcaaaaagtaactttgacaactattttctattataatatatataaaaatatcaacaaacatatgattttattgaagtacttttaaagattaatctacaaatatggttttcatatttttaagataattattttagaaattatttgtaatcaaagattttaaagtttgactttacccttgtctaaaacgactaatattatcagctcggatggagtatataattacctatgaaaatacttcctccataaaaaaaaactcaaccttctaaagcattcgcttacaattagaggagggccgccaaggctagagaagataagataattggacacaggttaattccagcaccaaatctatcaggcctgtaagctcctatcgcagggctggaccatggtcccaactcccaaacgaaagaaacagaaaggctcacgaattaaaaaccggattgtctcactagattctggttgtgtgcattgctgacctgttgtcaataccggtcccctcgcagtgagaaactaccaacaccaataatccatcgctccgtgcatcctggcctcctggggaaagagccgatggcccaaggtgatggacaaatttaaatgcaagtccgacagaaaacagctggtgcaactgtactctcgtactcgtacacatgcacatactcctacctaggagccaccttttccgctttgtctacgttcaggcgctcgtctcggctctcttggcgggcagcctcaaacgctccaaagttttttcacgtggttaacaaaataacgctccaagctagtatttgactttgtgagcaatgaaaaatgaaaaagacttggtaggtaagcacaaaggctccatttgtgttccgcagacgtaattcggcttttgttaattgccatggtagtcagtctgccaggcctccagcaatcagccatgagagcgtgacataagcgcagaacataatcaagtttaaatataaccgattacagttgactaaacacattggagagaattcttctattcccgcctctgccatttcaactttcttcacaatcacaaatattccaggtccgggtcttgtctcccaggctacggatagtaccgccaaaacattttgaattctccagtacacagagtgcccctaggatctccagtacaactccatcaaatactagcctcgtagcctgttgattcaaaaatatgtttttctactacttgagtcgtacacctgcattacgacgctccgctgctggatttgatctggagaacggagagagcaatcagaggatgcaaatgacgcaaccagcgcgacaacgagccgagaccaatcgatagagagaaagtggccgtggcaccgcccaactgctggctctcggcaacctgacggccacatgggcgccggttgcaccagctcagacgcaacgcaaaacccaacctttccaccgatcacgacagcctaacaatatgtgctcgcctagctagcctcctcgtgcacattcatcagtcatgacaccaagatccatcctactagtactatactgcctaccgtacggtgcagcaaagcaagggtacaaaggcgccttcgaacaggggattaggagggggattagtattagtagtagtatcagctttgctgtaaaggcatcgttaagaaaatccggatttcccaacaaggcgccgggcaaggttctcttttaaatttgaacagaacccgaggtttcgttcgacggcaaggtggtacaaaccgaaaacaaaaggacttggcacgccacacgagataatagctttacaaattgaccggtcagaggcctgcccggccacggccacacgacacgccgcaacaaaagacgacaggaaacagccagctgccgaaacggaatccacccaaaactctggccaaacgcccggcttggcaaggttatctgtatcctaatccacacgattatataccgagtgcccgagcctaaacgatatttttcacatgatcctatcaaattttagagagtatatccagatactgcgatcgctatgaaactatcaaatattatttaaaataaaataaattgaaaataatgggaataaatatactaagtttacataaaaaacaattaaatatattaaaatcaatattactagccacctagtcggacgttgcgcgactttagatacccattttaaaccccctatacaagaaaactcttatactggaaatgttataataggttggtttgttttgaattttgatcattaagcgtcattgatggattacctaagttgataagcatatggcctcaactatatgttcaaaattttattacacaattgatgttgtaatgtacaattccatgttcaatataaactcaaaacaatcctatatcccatctatctattcacatgcgaaaacatatttgtgctgcttgtagccaatatgctccttcctccgtttcatattataaaactttctagcattgctcacattcatatagatgtcaatgaatctaaatacctatatatgtctagattcattgacatatatatgaatgtgggcaatgctagaaagtcttgtagtatgagacggggggagtactgtttaagtaaatataacaatgactataaatcatcttttactaattcaggaaaataataataggaaaatattactttaacacttattcctttagctaggaagttcttcaaaccgcctccatcctgtaccagtgttatatcaagttcatattatattatactacctctgtcccaaaataagtgcagtcgtggatatccgtgcccaacgtttgaccgtccgtcttatttaaaaaatttgaaaatatttagtcacacataaagtactattcatgttttatcatctaatagcaataaaaatactaatcataaaaaattttcaaataagacgaatggtcaaacgttaaacgtgaatagtgcaaaacagcacttattttgggacggagagagtatatgcatagcacagagctcatcatcttcccttttgaaggagataaagccgaaagtagttaagatttagaacattaatatgtcacatataatctgagatgaattggattatacttgacttctattaggactgtccttaagacacccatcaaggaaaaaaacattttttatataatgattaaaaacccatattgtgaatgaagcatttaactatacacattccaactatttagaaaggcggagtatttatgcttagaaattctgaaggttggcatgcaggtcatgtagtcatcagatagaattcagtgacaggggaaacaaccatttttaatcagcatattgcagccatggtaccatcagagtattttgactgatgtttgagattactgctgatatgaaaccaaatgaacctagctaaaaattaactgttttaatctgaacaacttcaaaatttgttgcaactgcaatgacaaaattacatgatattttatctgagctttccttggttatattatgagtatcatgagacatccaataggtgtggttaaacatatgaacaatttgagcaagctagctgtgaggaaatgtaaaagaaaatgcagagacaatgatttggtaccgtagctaatgtttgcctgatttcagaatatatgtatggattgaaaagctactgaatcaattgcaaataaaatcacatatctggttatttcggaagaggatctttgacagctctcgtcattgatggagacaaagaatcaacgaaccagcgtacctcagcttctagcttcttgggtccagttatatcaaggaatcaagatcgtggaattcactcaactttttggcaatcaacaggaacatctctagtttgctatatgccctagagctcaccggcgaggcggtgcgtctcctcggagatgtggtagaagccggcgccccatttcatggcggcgagcgggccgggcggcctcctgccgcagcgggattcggtggctagaccgatctgtgggtggaggacggggacgaggtagtggagacagaggcggcattggtagaggggaagaggaggaggaagtggtggcaggcagaggcggatgaggaacttgcgccaacgacgtggatatggagggggcgagtgggcgcggtggaggaggagggtggaagtggaggtggaggaggcgacggcaatggggaggcggcgatggaagcgaggagatgggcaggcggcggaggcagcggtggataattttttttctttttctttttcggaccttttcacctgctcggtgatttttcttttttatacggcacgacggcttctcctattcgcgacgcctcggctggaccatggaccgttggccactggagcattctaccatggtccagattttttttttcactcaactttactacttcacatctgatggctggtgttgaattcattgtgcatccaacggtcattattaaattgataacgtggcgcaatgaggtgacgaaacactttacttttttcactactttagatatgctctaattcatgacatattactctgatcctacagtaatataataatataaattttaaataagatgaacaatcaataatatgataatataaattttaaataaaacgaaagtacataagtacatagaaacccattgttacgtttaaaatgtgacagatgtaccttaactttgtggcttggtgctgtgacgggggacccaaggggaaattcacaacacaagccgtgatctcgtgatgctgtgttattaatctcgcaaccaatttggcaagaattatcggagttgcgagttcgcaagttgcagcacaagcgtcgccgtcggtaggtaatgacaggaagctgaagatgcaagatcccgggccccaaccagggcagattcttcggtggcagatgaccagttgattatgattggaactaaaaatagaccaaagaaataagacaccaccatgttaagcaactaggacgtcatatgttagacttgtcaagatacatcgaacaggttgagtaccacaaccacccgttttacctctgtacttcctactactccacatccatccaactacagaaactgtcgcccaacccaaatcagaatcccatatacatagccagagcaatatgctatgcaccaaaaaaaaaaaaaagtggaaggggaagcactgatgcacaattacacgaataaactgtatactcatgtgagttcctgactcttgaagcaacatatttcaaaaagatgcaagagagactgatgagacaaaggcaacacagcaaacgcagtgttaaaggaaatctgaagctcttattatttctttcttacaacttttcaaacatctgatgatttcttccaatcatcatacgactagagctaactggcatagagctaactagcatagtactccctccgtcccacaatataagagattttgagagtttttgcttacaacgtttgaccactcgtcttatttaattttttttcgcaaatataaaaaacaaaaagttatgcttaaagtactatagataataaaataaataataatttcaaaatttttttaataaaacgagtgatcaaatatttgcaaatgaaaacttaaaatctcttatattatgggacggatggagttccattcaattctccaaaagaacacttattattggatatatcaccgtcaataccctgaacaacctacggaagccatgtatttctcatctgttgatctgcatccatcacccaccttccaaaataaccaatatatcaccatacaaaagaacacctaacactgatgctactgccaatgccattcctaattctagcctaacacctacctagcactaataatagtagcagtaataattcttaaatatgatccattaaactgggattagaacagacgaacgaagcaaatctgcgcctcagtatgtccattcctggggaagattcacctcgcgcgcagcggcaagcgtaggcggcgccgcggtggccgcgtggaggtggtgctgcacccgcttctgggtggtgagcattgcattgctccgactgaccagagcgtctgtgagaaatgaatcaggaaactgtcaggagtactactcattggtgaaccgtaacataaaaattgtaggcgtggagtgaacttaccgtggtcgagaacgaaaccgccgggaaagcaaggacgggcaccaagatcgtcgacgttgaggttgagggcctgcacgacgcgcgcgggcagaagcacggtggagcagcctgaaggcaagcagagccgcagaattttagcccaaaatacggcgcgactcacgcaaaaaagggcaggtaaaggaagaggttcggaggaggtgcgcacttggctttttcttgggctcggcgggggcgccggcctggcgggggatgaacacgccggtgcccgtgcgttccgttttgccgccgggagggctgaggaacacggcgcgcatgccggccgcggacgacgcctgctggtgggccttctgcagcggtggccagccggaggagttcagaccaagcggcgcgccgacgccgacgccggcgcggtgcgttccccacgccgccgctgctgccgcggcgagctgctgctcccgttgctgcttcaacagctgcctctgcttcaggaggtggaactggaaacaggcggagacgaacagaacatcagaacagtcacaaaatcaaacagaaaggcatggaacagttgatttatggcgaaagaacttacatgagcgacttgaacctggcgttgggtgagcatgttgttgttgggcgcgaactggaaggcaccggcggtcttctgggcttgcaccggcggagacgggtttctcgcaggtgggacgaagcggccatggccggcatgcgcatggggcttctggggcaccgggatgctgttcatgcgcaggcgagcaacctgcccggcagcctcggagagaacgtcccaagggtccgtcggcggctgctccagcggcgacgacggcggcgagctgaactgcgacgcaccgccgttggggctatcctccccggaagccgccaacccgcacagcgtcgactgcggcgaccccgccatcacctccacctgtcacaaacaaaagaacacgatcagatttcgctacaacgaaggcgcaaacacaaagcatgtcgaacaaggccaaacgagacaccaaccaaccttggaacccgttccctttccaccctcgccggcgaggaggtcggccatgcgtcgcgcgaggccatccaacccgtcctcctcgtcgctctcgctcttggccgcaaccgccgccttctcctccacggtgaagaaatcatcgtccaagaactcgtcggggagccacaactccgcctcggcggcgccaggggtgcacacctccgccatttggcccacgaaaacacaaccccttccgtccgcgcggctgctgcaagcgtggacggaacacccactccccacacgaggaggaggggtaatataggacggcggtggtgttggccaggaattgccgcgcggggaagaaacaataataggcagcggcacgtacagggccaggagaggtgatggctgatggctcccctccccgcctccctcctccagcactagtacgctccaacctcctgtcctcctcgtctgtgtgagcgatgggggggacccaggaaggcaaaacgcgaagtatcagatgatgagatgagatatattatcccccggaaagcggatggacggaggaggggaagcggcgtgggggtgggatggaggggagaatgtccaaggacggctggggattttatcgagcggctgtggttacggaggtcaaagcggtcctcatctctgcttgtgttgggtggctttataaagtgagccggaaggagtgtaattagtgggtctgatttttatttttacggattaaccgcacaacggcacaagtacggctcaggcataggcatagcttatctcagttccatgataaacttaaagtctgtatgtaaaactataatattttaaattataaatttcacatgacatggaaacaaaatgattatccaaatgttatctacgtaatcatagatttaaatttgtaaagctaaaaatattcaactgtaacaaaaaaaattggatccagagctatatccaagagggcctacatctgccgtaaactttaaatgccaaatgaattgtttacggttaaaaaaaaagacttggagttaggactatttgggaagcaaattttggccttgtttagttcctaaattttcttttttcaaaacatcacatcgaatctttagacacatgtatagaatattaaatataaataaaaaagaaaaactaattgcacagtttgaatggaaatcgcgagacgaatcttttaagcatacttaatccatgattagccataagtgctacagtaacccacatgtggtaataaaagattaattaggcttaataaattcgtctcgcgattttcagtcgagttataaaattagttttttttcattcgtatccgaaaactccttccaatatctgatcaaacattccatatgacatctagaaattttcttttcgcgaactaaacagggccaaatgagtaaccgagtgtctggaataaggtagtcagtgtatgtgattaggactagcgtttgaaaccaccaaagataatagtaatgtgttttcctcctgagaattggtcctttttttttctgaaaaatgcatctaacttattgttgctatttttcctttggtattaagacaacacactccccccaccaaaatggtagtagtagttcaacaaatgttgacaaaaaaaccacatgataacaacaaaaaaggtttgaagttcacatcaacatctgatggtaatgtactacaccagtcctactccttgtggtacgatcggtttcttgttttccatttttgcgaggggggtgccaacctactcgataatccgggagagtactggcgagataggcgtggtacgaattaaattggtcgatgtggcgtaaagcacgatcgtcacgagactttcaccgggccgcagttctcgtagggcttcatgttcgtgtttgcaaccgcattcaattcgtgacctggttctgcacattaatgcgcgagtttcgcgccttgtaccgtctgtcctggtatgtacgctacagcagccaaacacgtcacgtatgaaaatactgcgcaacccaaagaaccggagcccagccgtatacccggctagcgacgcgttacaactgtacaagaggtactaacctggatgacatgaaactatgaaagtgaaacgcagccgaacattcgccggtggatttgcggtttcagggggccactccgtaggtgtgtgtggtgtggcccagccgagcagttgatggtcaccgctaagattgagcgtggaaacgaactacggcactgctggggtggggggcccaatgcagcagccaaaatgcgtgccatctatgatgcacatgttatacaatgtactccgtaccccacgtacacatactcctatatactccctccgtcccagaaaaagacaaacattggtttccgtgtccaacatttaaccgtctatcttatttaaaaaaaattatgaaaaaaattaaaaagacaagtcacgtataaaatattaatcatgttttatcatctaacaacaataaaaatacaaattataaaaaaatttcatataaaacagacagttaaagttggacaagtttgactttttttacgagggagggagtacgtatctctactttacaatgacattgattgtcgtacgagtaccgacagctggaatacgtggttcgaaacatacgtgccctggctttcctgggcatcaggccggtcgaggggaattccacaccgagctcgctgcccggtgggccccgctcccagggcagcaactcccgcggtttttgcaaccggcgaggcgcaccgcgcaccagccaagccacctcgcgcccacctcgcggacgcctcggccctaaaccaccacgttccgttcacctcctttatcgccgctaatctggcctcgtccgcgtgccttttcttttttttttatttttttgccttagcgggatcgcattgtttggcgggcagacgaaaatagcgtgaggcgctagcatttcgcgggagaaagaaacgtggaagcgaggatccgagaacgctggtcgctccccatgctttcgcatgcatcgtgcgtttgtgctccggctgaagtggagacataggggaaaacaaaacgtggtcgacgtgcaaggcgccaaggccggcaggcgcggccgacgtgcgtacaacctaaaagagcggagtttcgagtttaagagggtgtttggaaactaggggctaaactttagtccctctcttttatgagagggactaaagtcccaaacacccccccctaaaccacgtcagcggacaaagaatctgaaatttatgtcattccgaaaaaaaggagcgtctgactaaaaagatttgttttctgtcggt

SEQ ID NO: 71409 - DNA, 947 bp, Oryza sativa
caatgcactcgtgaacactgaaacacacacacacacacacacacacacacacacacacacacacacacacacacacacatatatatatatatatataggacactcatatggagcaccaaacaaatttactatatatatatatatatatatatatatatatatatatatatatatatatatatgtatatgtatacatatatatatgaaggttacaaagtagagagaaaaaaaagagacaaatagatatgcatatacatatgtatcacatttccttgtgttttttctttacagaaaggtgtattctgtttttttttattctgtatgatagccgtggtggaacaagaaaaaggtggcagggggaaagaattgccgatgctgctgttggattgagccttttcgcatctaggcaccctacgatgaaatagtggccttgtgtggcagctaaaatttctaataattgaacagaaaaaaactagcgaaaatatctttaaaaatgtttgtagcagaaaccaatgctcgcaaaattgttcttgcacttattattattattattattattattattattattattattattattattattattattattattattattattattattattattattattattattattataaaaaaagatgggattagtccatatttatcgcgaatatgaatgtggtagcttttagataagcgaagtggagtgactaccttccacctctatatcaactataacatctgtcctaaaataaacaacctagtacgaaatgtgacgtatcctaaacaatgtatcatatttagtactaggttaattagtttattttgtaatggaaggagcaaggatgagtgctaggcattttatagttcatataccactaagaaaacaataaaagagcaaacaaatatatgttaatattgcccgaaatatagtaaagtataac

SEQ ID NO: 71410 - DNA, 5698 bp, Oryza sativa
agtataacatcaaagagaagaaacttattaaaactatcacttttttccttatttatataccaatctcattaattcacgtgcctaattagaagtgcaaacacattttagatacaaaatttaacaacccataaaataagtaatttatggtactcattcattatttgcgatgcgatcatatcaatccgaatatatgccattgatgagttggatatgaatatatatgcattcatgaacatgtgcaactgagctttttccagaatgatcgtattcattaattgtttgctccacaatagtaggctgtatgcaggtggagacagggcaaaattttcccaggacagctcaatgctcaacaaaaatgtgtaatctataacagcttaccattttttgcgtctggtctgttgtatttgttactcttttcgaactgtacctcaatagaaagacacccgctctgatgtgtgtcctctaaaagtatatagaagctttttttttaaccaggaaaatgtttgtttgcccttcctaaaactgtcttggaaatctttccgctatgaattcactttactccattttaaattttataaataactcccgtaatattccaatatgaatgagcatgtaaactcagttccatcaaataattctgagcgctcccacactaaacaaaattccgaaaatatttgtttgcattctccgaaagggcagattcccatgaactccgctgacatttctttacgttggatgtgatgggcctatgatctcaggccatcaaaaatgcagattcctttgctattacccgactagatgcaaatagccaaagatagccgaaaatcgtggtagatagacacatggaccctacatgtttattcagaacagattctcccccaaatccctaggaccaaccaatggcccggaccaccggccatcagcgatggaaaatcctaaccctttttctcctcctctctgcaccgtcaactgggtcagagcaagcatctagcggtgcattttggataaacgaaaaaagctctcatgcacgcacatcaaaagatcttcacagaagttgtccccatcggatagcacgaaagtttttctatcaggaaataaaaagtcgacaacaacgttaagcatatctatggcaaatcagcaacctagcttactagcctgggagaaaaaaaatattccaatgatttgccatagtgatctcctgaccccttttttatattcaggccgagtttagttccaaattatttcttcaaacttttaatttttctatcacatcaagactttcctatacacataaacttccaattttttcatcacattattccaatttcaatcaaacttttaattttggtgtgaactaaacacaccctcaatagtgcaaatgccaaagaccactaattggtttctacttgggcgacagggatttgtggcgtctgtagattgttttagtggaattgataagatgggggcatgagggcatccctgttgcactccaagcccatatgcatcgcagcttttacaaggcataggaatgtaaaggatggaaatacaggaagcctgaggactgaggagtaaaatatttttgcataggctgattcagtcacaaagcaacttattctcgagtccttgaccctcgcattcaagcttgtcggagcttataataaggaaagaaaagctacaggtacaacagattattttgactcttgtggctctcatcagaaatctgaaatagaacctctcacctcccggttcaagaaccaaacccttgtatcttatatttgcgcctcacaatctgttgttcttcatcatctctataaattcaccaaaagctgtaaagcacaagaaacaggattagtaaaatcaacacttaacagtgataacacaagttgtgttggtacaacacttttctctagaagtactatattgttcaaggaaatgtacccaagtcagaatcatgcggcccgggtgaggactctggatggtactgaagagacaaaagtttcatcttagggtactgaaggccggcacagctattatcgttgagattgatatgtgttactttcaccccttctggaagtgactctgggtcaacagcataattatggttctgcagagaaaaatacggtaagacaattgcagattgcacagtagtaaatgcaagtatgacaagtaaaacaaaggggaaaatagctaagactcagaaatatgaattaaataaaaggaaaatagcaaggatgcacacatttctcttggtggaaaaacaacttctaataatacagagttacaaacaatactacctgactctcagctgatttggtgtatatgattttagtctagaaggatagacttgctacttcctccgtttcacaatgtaagtcattctagcatttcccacattcatattgatgttaatgaatctagattaatatatgtgactagattcattaacatcaatatgaatatgggaaatgctaggatgacttacattgtgaaacggagggagtagttgattaaattggatatacctaacagcttaaaggttcaaattcattactctcagaagctccaagttttcatcaggaagtgtcacagcgagaagtccagcacctctcccaacaccagtaatacggaaagcctttcaggaaataacataggatagatctataaatcaatacgtaacagaaaagaactataatggatatcaatggtttctagacttaaaaacttaaaacagcaatcctacaacaagtttctatacctctagttagacaaaacagtttattgtactgaaattcaaacggaaggctatttccctcgagagtcaaaaaacatgaatcgcattcagtatcaaaacagtaagaagtcaggtcaggaacaaacttgtgcacttatgtcgacacgtccacttcgaaggtcacaaacaggatgatttcctccatgatgaccaaacttcattttaaatgtcttcccaccaagagcttgcccaatcaattggtggcccatacagatgccaaacacaggaaccttccctattatttcttgtactgtcttcacagcatatggaactgcagctggatctccaggaccattgctaaaaaacacaccatcaggcttcaagttaagtacctcagaagcaggccaattggctggaacaacagttatcttgcatccatatgacgtcaaacgtctcaaaatattgtgcttgattccaaaatcgtatgcgaccacctaaataaaaggaagctaatgtttagatatgagattcatctgaagtgtttcaaaaaagagaaagggaccaaaccaacactgacatgaaaactttcagtcgattgacccttcttgaattcccactctgaatcagtcttgtctgaccattcatatggagcatcgcatgtgacaccactaatcaaatcaacacctgcataacatgaaataccagatcttgttttataaccagtaacttgaatagtgtctaaatatggatggaggcaatcaattttgccaatacactattctaaatgatatcattacatgtcaatgctggtgacacaatattcatcataaagtggacatgaaaaatactccagatagttactctaatagatcagtgaaggatagcaagcatcataaccatgtgtccatgtcataaacatatgaaacttcaatcgagttaacaatctgcttgaccagcaaaacataataatattcctgaaccagtacgcggttaaataataaatagtccacgttaatttcattaagcctagtactatcatgtttgcaaggtaattaattattttttaagacttaagagtaaattgcactgttcaccaggtagaattatcactttgcactgagttcagcacacactttcactttaaaccagagtagatcgaataagtttcattttgcactaggttgcttcatataactgaagggaaatcttgtcaaatcttatcaaaacgttttttttttaatttagaccatgtttcatgaagtttcatttagatttcatgaaatttctatatgtttgatgatgtatcctggtgttaagcgaaacttatttcgatgcacctggtgtaaatagaaatatgtgctaaacctggcgtaaagagaaacatgttacaatctaccatgcaaagtgcaattatatttattaaaggagacagacaattattcaaggacattactgcttgaagagagcatagcataccaacaattttccaattttttgccatttccaacaactcatcatcggtccgagattgatcagtacttaagacaccaattagactaccatcttctcgtaatctccgtgttatggcgcgtgtgtccacatcatctgcatataaagcaaattgatggtgtttattgttgcttttgttgtttgtcggacatagagagcaatgtatcaggtgacaatacttacatattcccataatgtttctcttcatcagatactcttcaagtgtttctgtgcatcgccagttggatgtactacagagaaagaataccaatttaacaacattaggtggttctcttaaagttccaattatgtcaaccaatactaggaaaaaatggtttaccatatgcttagattccttatgatcagaccagcaaggaaacatcggttcgattcttcatcatctgcatgagcattctaatttgttaaaacttacaagctattgtggaaatggcatcatatcatgattattgactaatagaaaagatacggaccaggattaacaccagtgtttccaatatgtgggttggtcatgaggacaaattgaccagcatagcttggatcagtcaaaatctcttgatacctgcagcccatttgatgaggttagttgtttcctgttgtcaataagcagtacgcgcgtctcaactatttgatgaggttagttgtttctctatcaggaagaacaataagcacatctcaaccacaacaggaaacaaatgccatcactcaaacggttagttgatttaccctgtcaaagatgtattaaataccacttcaccaacttgtgttcctgaagcaccaaaagacttggccttccaaactgaaccatcctcaagaacgagccgagcatcgctgagcttccatggtctttgcactgcacgaagaatccaaaaatggtgaaacagtattcatcatcttcttaactgtggagcacaattgcctaatcgcaaatccgtagcagaaccctgagcacgtattccgcgctgcgactgcaaaactagagcgattcgaatcagctagcgaaaaggcaacctgactcacctccatcatccaccacggtaccactctgcacgccactgacagcctgcacacggaagacaacacaaaacaactcaattttcgcgcggataaaacaaccatcgacagacgaagctgttgatggtgtatgacggattcagtcttgcaatacaacgggactaaaactatggcgaaggcttcacgggaaagcacaaaagccagatataccaatcagtacactcctcccaaacgataggtaggtaacaaggccccgccggcgaagctaaagcagcaggagcaatccactcgcgctcaccttggcagcacggacgccgaggaagcggccccgtttcgcctcgggccgacggtgcgaggccctgaggggacggcgaccgaccgagcggcggcggcgcgtgggctggccgcggacgggcgcaaggaggg

SEQ ID NO: 71411 - DNA, 1014 bp, Oryza sativa
cgcgacgggcctggcgacgctgtacaacgcagcgaagcagcgcccaaacgagacgggtcccgtgggaaagttcgtgaaccgggtgaaggtgaagacggccctgggcgcgcgtggcaatatggagtggaaggagtgcagcgacgcggtaggcgcggcgatgcatggggacgtgatgaagagcgtgaagccgaaggtggaggcgctgctgcggggaacgcgcgtgctgctgtaccagggcatccgtgacctcagggacggcgtggtgtccacggaggcgtggtgcgggagctgaagtgggacggcctggccgtcttcctcgacgccgactgcgccgtgtggcgcatcggcgaggagctcgccgggtatgtgcagcgctccggcccgctctcccacgtcgtcgtctacggcgccgggcacctcttgccggcggacaacggccacgcggcgcaggagatggtcaaggattgggtgttgcaggcggggctattcggccgccacggcggcatgaagcgcgcaggctgactccgcactcccccggggggggggggggggcgcaacctgtggcctcatctctcgcggtgtcaaactctaatctgatttgagaatcgagcagagtaaatcgaggaatacaattcccgggaaatacaagcatttgagtttataatggttcttctggtgtggttgaattcatcgtggtaaacttccctggtttcattgggattatttcctccagaaggtagcttatccgggattgtttttgttcagtccaagatcagagggcaataccgaaggatcacttggtaccaaactaccaaggcagtattcagtaacagggacttaaaagcaattcgcaaatctcagaaacacgaagctcctcatttcgaccagaaaaaggcccatttggctctctggtactctggagcagggtttacgaaaacgaaaaaaaagccaaattcatcgcgcgggcggacggcggggggaggagcggcgcgcgggctcccccgccggccgccg

SEQ ID NO: 71412 - DNA, 9595 bp, Oryza sativa
tgagttacttattagtgtatattaaggagaagaaaggagtggataagaacccttacaacaaacacaatagaccttacacgagacaaaaaaaaaaaaactgcctcagcctattacaaaatcggacaaaattggacattcttcacccccaactatgaataccggatgaattacccccctcgaccaaatccacggtggttttggtctacgtggtgtacacgtggcagtccagtcagcattctatttataaaaaaaattgtgggacccacctgtcatacactactctctctcactctctcacttctctctcttcctctctctctcgcagccccatctcacgggtcggcggtggtgggggacacgagtggcggcagcggcgcgtgaagtggaggcggcggtggcgggggatggagagtggcggtggtggcggcggcggcgcgtgatgcggaggcagcggcggcgggagatggggagctcggcgcggcttcccccctccctctcggtggcgtgcgggtgggcggacggagctcggcgcggcttccctcctccctctcggacggagctcggagcaggatgtgatccgatcgcctcgccatcgtcgccttctccggcgcgccgtgcggagtagcagctggcacgagcggtgccggccctccacggcgggagctcgtcgcggcggctgcacaacctgttcgtggcgacaggagcggtggccgagtcgcggcggctagcggagctcaacaactacgcgacggcgcgggcgcacggagctacgcgactaccgacgacgacgcacccgagccggtcaaccccgccgcccgcagcctcgcctcctactcgggccacgccatcgctgccaagaggtcccgccgtatcgtcggctgcgatggcgagtaccaccgccggcacccggtccgtggcatctcaaccccgccgcccgcgcgccgtcgccatctcccctcgagccctgcccgtgtcacgcgccgtcgtccgtcgcgccccgccaaccgcctcgccgccgctgccacctcgactcctccgccgcaccccgccgctgccgcctcacctcctccgccgcaccccgccgccccatcccccgctcgccgcctcctctgctgccgtgcgcgtgtgagacaaagagtgaaagaagagagagaggaagagtgagagagagaagagagaggaaaagtggaatatgagtgatgacatgtgggccctatattttttaataaataaaatgttgactggaccgccacgcgtacgccacgtagaccaaaaccactgcggattaggtcgaggggggtaatttgtccggtttacatagttgggggtgaagaatgcccgtttttatgatttagaggggtaattcggacaactgcgatagttcaggggggtaattcgtactttttcctttctattaatgaaaatgaaggtttgccctttgctaaaaaaaagttcccaacattcataaatctccaagcaattaaacaaataagttttttttaaggcacaggccgcttccaaaacttcttgcaaattaaagtggaaaaaaccatatgcagaagaaccagtactatctggagcaaaagtcctagagctaagtaatgagaacaatccattattcatttctcgtaataccaagtaacagtatgtcacatgaattcttctgtttagcacaaactgtacaaaattaactaaatgatgaacagtcctagctaacaggtaatcacgtgcattatcagttcatcacagaaaccgagaggccaagacggtttgctactcatggatgtagaaggaattaaaccaaactctggtgtatatacatgaggaagtttctcttttttaatactccctccgtttctaaatatttgtcgccgttaacttttttaaacatgtttgaccattcgtcttattaaaaaaataagtaattattaattcttttcttattattttattattttattcattgttaaatatactttcatgtatacatatagttttacatatttcacaaaattgaataagataaacggtcaaatatgtgctaaaaagttaacggtgtcaaacatttagaaatggagggggtatatcgttcctcttcgtctgttccaaatgaactctatagattcttctgctatttgtttctcctcctatctccaaatctaatttgaaattgctacatcaaccaattatggcgttgtcttggtatcagaagtgtaactcatggcttttgaatatagctagaaatgaaaacacattatacaaaatcagcagaggaaaagaaggtatatgaaaaaagaaaaaggctgcctactctacatttaatagaaaattccctctaaaatttagggaatattacgccattaattggattgttttgattcgttcaaacacccaaacccttaacctcagtatcctcttcttcttccctacaccgtcgccgtcagccgttggacatctagatcatcatcagagcgggaggtaaggtgttgagacatgaatcttagaatagatcggagagtccaaaatctgcaagacagtgagggggtaaggagggatttttttttttgttgaatgaaggttattatcaactagcagctggaaaagaaatccatgtattaccatacaaggacataatgtaaagcaatggatgaaccaatgcttaggatatttcttgaatggctgctagagtatctccttcatcaaaactggccaatgaaagcctagtacgactcaagcggaagtgttcagttatgtaattattgtacctttgaaactgctagccaagtgtaaacgcacacccttcaacagggaatgctttatatttgtacttttggtcctgttaatttctgtcacggtgtcacctcacatcaaatcagaaaacgcacacccttcaagagggaatgctttatatttccatatagagatcggcagtgttccaaaagtccagtgttccaaaatcaatggccatcttcatcggatgcatctgttcacttgcactcttgctgctctgctcccatgtattccagcttctctcagacgctcgccgccctctcccaccgggcccgaggccgcttccggtcatcggcaacctcctcgacgtcgccggtgagctcccgcaccgctcgttgtcgcgcgtcgcacagcggtacggcccgctggtgacgctccgcctgggcaccacgctcgccgtcgtggcctcctcgccggccacggcgcgcgaggtcctgcacaggcacggcgccagcatcaccgaccgcggcacgccggacgcgtggcgcaccgacgggcacgagaccaactccatcttcgcgttaccgacgcgccaccaccggtggcgcgcgctgcgccggctcggcgccgagcagctgttctcgccgcggcgggtcgagaagcagcgcccgctgcgccgggacgccgtgcgcggcctcctccgccacgtgtcggagctggctgcggcgtccggcggaggcacaggcacggcggtggtcgacgtcgggagggcggcgttcgcggccatggcgaacctgctgttcgggtcgctgttctcggtgggcatcgacgccgcgacgtcgtgccggttccgcgacgcggcgcgggagttcgcgctgctgacgctgacgcccaacgtgtcggagttcttcccggtggtggccatggccgatctgcagggccttcggcgaaggacggcgaggcacatcacgtggatgtaccagctgatcgacggccatgtcgaacggcggatgcgtggccgggaaacagccggtgcgctcggggagaaggagaaggacctgcttgatgtgatgctggacatatcggagaaacaggagcagagtgacgacagcctcaccatcaaccggggtgtgataagagcatttttggccgtaagtatatatatggagtatgggcctatttagttcacgaaaagaaaatttttgtgtcacatcagatgtttaatcggatgtcggaagggtttttcggatacgaatgaaaaaaataatttcataactcgcctggaaaccttgagacgaatcttttgagcctaattaatccgtcattagcacatgtgggttactattgtagcatttatggctaatcatggactaattaggctcaaaagattcatctcgcgatttccctcttaactatgcaattagttttttcatttatctatatttaatgcttcatgcatgtgtctaaagatttgatgtgatgttttttggaaaaaaaatttagggaactaaacggggcctatatcctctctctctctctctctatatatatatatatatgtacgtttttattagattatacagtttacttgtaattatcttttgactgtatgtcatattttaaaattttagtacaaatatgccaaagtataaatcatatataaatttcttttaatatataacaaaacatgcatgttagaataaaataaataatatttatttagcttttaataaaacgaatggttaaacgtcgtataaaagggtaacggcgtcatctattttaaaacgggagtacatgtttttagtgatgtttttccaatgactttacacctttataatagttaatcctttcttaacatattataaaaggttggataattcatcaccctttgatcagaacagaaaaaccacgcacaaaagtaacttttctcactgcacatatgttctagaaagaggcaaaaattgctactgagctataaacaacgtgatgttagaagacatcaatattaattaatcatggctcttctacatgacagtttgtcgcttcgtagtcactaaaacataatgtgtggacggaagcctgtgaccccggctcactagagtacgttatctctaacaaagctattttctaatttttttataactatttaggtcatgaaaaaaaagattggaagagcgaaaacactttaaaacaaactatatttcatgcgcaaggtgatttctataatcgtctgcctaggtttttgtcaagctttaaatattttctctgggttggtctattgcacgtggatgtgttttcaatactcctacaagtttgttggggatatatatttacatatttatttaaaggcaaattttatgggagggcatcacggctgctaagcagtttttgcttctacatacggtaagagctgatctttgggaacgtacttttaaagtatgcatggttatttactactggacatcgtgttgattaaaatatttatttttatttaataaaaaagagataaatagtgtgaaaggacaaatatactagctaaatgaccaaggccagtggcatatttgccttttgcaccgtttttctcttctattcaatcgaaaatgaatattttgatcaatgtggtattcagtagcaaataaccatactttgaaagtgtattctctaaagattgacttttgttgtgttcaggagctaaaactacgaaatcatgatgccttttagcaaaatttgcattatttataatatctgctaatctctttagatatttgttagtaggcacacgatgatatattaattcttatgatagaagtatacatgtaacaatactagtttttcttcagttgtaatggaaaaaaagtgagaacgccatgggtgacatctatctcgaagtaattgtgcacaatatgttaagatattcggtttatgatcaaaattacttacattgcttaaccaatttcaggatttactaacggcgggcagtgaaacaagctcagctgtaatagagtgggcaatggccgagctacagcagaatcctcaaactatgagaaaattgcaagaagagctcaaaaaggtcataggctcaaaaacttatatagatgaagaagacatcaaccaacttccctatcttcaagcagtcatcaaggaaacacataggctacatccagccataccactgctaatgtacaaagcagccgtcccagttgaaatacaagggtataaaatccccaaagaaaccactgtggtagtaaatacatgggcaattcatcagaattcagaggtttggattgaaccagacaagttcataccagagagattcctacaaaaggagatcagtttgtcatcaggtagtaccaacatggagcttgttccattcagtgccggacgacgtttctgcctcggatatccggtagcaaatagaatgctgcatcttatgcttggctcgctagttcatcagtttcagtggacactgcctgaagtagtgaagaagaacggtggcgtagacatggcagaaaagtttggactaacactgtctatggcgacccccctacatgctatagcaaagaatattgtgtagtgtgtaatttgtgtaatgtattgccgaataaaatatgtcatttgtgctgaaatataacatggatttataaatttttatacgatgattacaaattgaagtatctgaaattaaatagggaatgattgtgattgattaaaatgaaaaaatgtaagttgagaaattaaataatatatgattgggattacttaagatgagaaaataggtggagaagttattatattttaaaactaataatagataatattattacttttacggctactgttaccacaactcactactagaaaaacgatttttaccgatgttggccttttatttttccatgtggacaaaaaaaaaacctctcttataatcgtttgcgaaaatagctaaagagtctctagatttaaccccacctacaaaaatttgtatgcggacctcttaaggggtccgcctagaaaattttgattttcacaggcggaactttatgtggtccgcctgtaaaaatcatgctcgtaataaaaatatctatgtcacatccttatcttctcctccaccatccttatcctctccactactcatttccctccccccccctctctctctctctcacccctagccgatgcgcatcggcggttctgaggaggtcaaacgacgactgccacgacgacaacggcgccaacgcctgggtcccgccaccggcagcgatgacgacgacaacgccgccttgatccaccgccagctcgccacgggtgcgcggatccgccacatgccggtctcggggaggggaggggaggcggcggcctggctcctccctctctaggcgatggtgtggatcagcgacgaggaggggaggcgtcggccacgatgaggaggtgatgaggcgatggctcggctcctccttctcccggcctgacgacggcagagacgaggggggccagtattaggttggcaaaaaggagggaggtggcagcggtgctccaatcctccctcccttcctcccggatccgtcatctggcggtgtaggtgaggcggaggagaagccgatggcgacggccactgcagactgggctggcccctcccctcccagatttggagggaagagaagagccagcaggaggcggcactccccttggtcagcgctggcaaacggaggagaaaagccgttggttggagggggaggcccgcggtagtgccgacgggtaggggtggtggcggtgtatttgtttttgttcgttgaaattattttcataggcgggtggatctacctcatttgaagatggagatgccacctgcaaaaatgattttcgctggaaaaatcatctatttttacaagcctttgcgtacaggcggtcctttccctcgcctggaaccgcctgggaaaacgattttcctagtggtgactactatgaggacaaacgaatactaccaatgccaccattactacgagaacctaccattacctacaatcaccaccaccaccacatcactactaccacccatcgccaacctggtacagcaatagcgattgccactattacttatgtagatattatagtaacacactgataaccacaaacttaaagtccatccaaataatgcaagtttaatttgcaatctcattccactaggcaacaaaacaatattattagtgtagttctttctaagcatacggacagaacaagagagcaagagccaaagatggattgattgggctttggatgggctaatgatggtgaacactagtgtagacaaggccaataccatggagcgagaactatagtactacaaagtacacaagttacggagcaaactgatagcatgcactactagaaaagacgtttttgcaggtggtcaaaatacatttttgcaggcggataaaccttccacctgcatctaaacgacggtaaaaatcctcaatttttataggcggaccaaagcacaggcagccgttgccatcttctcaggcactgcaggtgctacagtagcccgcttgcgaaaatactcatggcgcccaaaaataattttcccgccagccccaccccctccgtaggtttgaaatcacaaattcttacaaatctcatccaggaaaaaaaatccaatcacaaacatccattcatcaacacaaaacattggattcaaatccacagcaatcaacatgtaaacttagaaaaaaaaacaacatcatcgtcgtcaccggcgaactcctttgcatgcggtggccgccgccgccccctccccccatagaccggatctgtgaaggagggaggtgtccgcctgttgacagaaaacacgaggcctaggagatctgcttaactccagtgcaggtccaaaacttgccttcgggtgtgtaagcgtgccaattgatctgatcctgtaatcaacaagaaatagagacaaagaaaccataattaatcctataaacgatagccgatcggctaggtgccgatgacatatcatttatctctgagccgatgtcatatatgtatcgatcggcattcatgaacaaataagaaggaactaaatctactcgatcggctgtagatattaatgatacatacttcctatatcgatatatacttaaatcaagtgattgggatagatcggacgccatgccgagacagtataaatcattagatcgaaatatatattaataatggaactatatacattcatagcatagccgatcaggtagatctagcatgtatcggctaatactccgatactactctatattaagatattaaagcaagtagaatatatcaaacaaaagcctaatatacttaactgcaacaagatcttaatgtaaagggcggatttaacatgtcaatcatgcatatagaataaaagtagttaaatcaggtaagatcggctgaaaccctgatactactctaatcggcaaccagaaggcaggctagaggttgatattctaagcacgacttaatagatcaaactcaactgatgcagcattaagtatgaaaagaagaacaatatctagacaatcaagccgctggaagtttcatagagtggtggatattttatataatctaaatcaacgtcgagatctaacctaatcggctgtactctaccgacagatgctagccgattgtaagttagataacgatattgctagagattatataagatatttgataactcgacggattacataaacaagattagagtatcataatgatggaagcactaatcccgataacgcaaaccgccataacaagttttacctcttgttgaagatcgaaaccgatgcagctcaaccggaaagcaagaactcgtcgaaataaaactaaagca

SEQ ID NO: 71413 - DNA, 1723 bp, Oryza sativa
gacatactaaatttattttattgcagcaagattaaatacaacattgtaaaacttttgctggtaaatgagccattagtacagtaatagatgtacagtactaataacactggaataaatttttaatgagaaccattaaaaaaaaattatgaagtgcatgtgccattagtttggtttaattaaaagagaaagggaggagaacagttctacttttccaatatttttcagagggcttctatgggtaaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagtgaataaaatgtcattacagaggtagatagttcctctcaaccaataaagttctaagcagcggaaattaaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcatagtagggttgcatttgcaaaagcagcatttagcaaacatttgagaatttgataaaacagttaagtaataattaagcaatattaatccaacgctatacaacataccctgttgtataggcccaaccattctgaacaaccaccccggctgcacagttctatctccaaaccaggaatgtaccattccaaaccaggagctaatcaaattattaccagttatagcatcttttactatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaattcactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcaataagccatcatgaaataatagtgagtcattagttatcccataagtgtactaatgtttctaagcagggctaagcaattatacctaatatctagttgaaccaatataaataaagctcaactagtcaaattgtaataacccaaggtatcaaggaataaggtaatcaatgtacaaaagggccataacaaagaataggtcaattccacccaatgacattcgaaaatagatgcaatagttgaatagaaacatagctttaaataggatcaacatgctcaaagggttgtttaggatctgtgtgacttgccttgctggc

SEQ ID NO: 71414 - DNA, 603 bp, Oryza sativa
ttttggtcgccggtgtgttcgccgtgccgtccgctacccgttggtgccctccgtgtgcgtcctcgcgtcgccgttcgccggcgagcatgcgccgcccgagccgtccccgcccgccgagccgccgccgccgtcggtgacgtcaccgctgacgtcatcaggatcctctcccgtgagccgccgtggacccgatcaatctcggccgtccgatttggatcggatcaatctcggccgtccgttcgtgtgaaccgccgcccgtgcgccggtccacccaaaccctagttgctgacgcaataatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgcttctttttgcttagattccgtcgtttccggagagtccgttttcgcggaagaagagtttgaagagttccaggccagcaggcaagtc

SEQ ID NO: 71415 - DNA, 3411 bp, Oryza sativa
  unsure (1)..(3411): unsure at all n locations
atatttttaacccaagataaatatattatgaaaatttatttaattatagatttaatgaaactatgctagtgttgtaaatattactactttttcctatagaattagttaaacttaaagtagtttgactttgaccaaagtcaaaacgtcttataattaacatgaaacggtgagagtagtacttcttgcattcttgcataatgctatctatttcaaatgaaaagggcagttttcatgactagtttttctttttgaaaaaaatatatgacagaaactcgggctccttcctgcatgccattatattagttgcttaagaaacttcgactatatatactgaaatgagtncaatttatcatatgcggtatcatatgatcactcgaactgacaagtaattaaaatgcatttttagcccatgatctagtttaagcagctagctagtttttctttagtttattagttgtaacttccatagagagagcaccagacccaaggtgcagtactgagcaattataatgaactctgcaatacaattttgcttatagatgtgtatactcgtactatatatatatatatagtgatgtaccaaaatatcgactgctaaaactttttatttgtttttcctagatctaattaataaattaaaacggctgtacaagtgctttgatcaccatgttttacagagaagaattatgtggaatggactttaatcaatgctgatctgaagaattaatcagaagaatgccttctcttttttacgagaattacatacagaaaaataatatttttttaattaaacaaggaagaaattcattcatctgaatttaactcaaagtcgatgatacaaatagatatatctgtcaaaaagacagggttgaaattaattaaaaaaacacacgcttcaattttctagtgctatattatagcaactaaatgccccttgatgagatcggagagctaatctgaaattcatccatatctcacagcttgcaaataaaggaacactaggtcaaaatatcaagttcggatgactccgaatccgatacgtgtaagcagcacacaaagccgatgcaataggctcagatggtggtggggcaatagatggtgtggcgcgaaaaagtctatcccaggatagctacctcccctgcggtactcctcctagaaagaaaggttgggaggaagttggaaaaataagtcttgaactattagagcaagttcaatagtatagtccactactagctccaattcaactatagctaatttaatagccaattgataccatagttgcttactatactattaatatatggtatcacatgtcatacacacattgcgtcttgaagtccgtgctgcagctggctacagatctgtagcccactactcttctctctcatcgtttatctcattaaaatatatttatagctggctaatagcctgctattgtacctgctcttacaccaacaaatcctacccggtgtatcgtgtgaggcctgcctatcagttcattgcggcgacgcggtggatgtgcaattacagtgacggtttttgtggcggttataaaatagtttaatttaccgtggatgaggccagtgaggtggagccagtcctcgtcggggaaatccttgcggatggcctcggcggtctggaggaggtgctcgatctgcggcatgtcgaggtccgggtcgctgtcgtcgatgaactcgttgagcagctcgatgcactcccagatccccatctccgtcttgtccaccctaccgtactcctcccgcatccgcctcacctgcaatgttacaatgcaccaaaataatggtaaatctcatatattaaagctcccgttcttttttacttgtcgtttaggatattatgagtgtatttttttaaaaaaagattattagatacagaatttgcacttacgaaatcatatgtctggttgatgtggttgacccggtagaactcctccaccgtctccttcctctcagactcggcctcataattcctggagatttaaaacatcaccatattattccggttaattccttttttttaagaaatatcttttactaccaccgttgaaaaagatttcaatttctagattatgaccataaggtttttatttttcgaacacaggtagtgttttatttgtccacgtgttggactttttaaagaaacatcaaattgaagtacagaattcctgaagaagcgaaaatgataacgtgcaaaaaaggaataggcaaaaggccatgttaatgcagccacagatgccacgtgggacattcactgtgcatagacacgcagaaacctttgaaatcgtacaagaaaagataagtctttattttattttatttgaccagtaagtagctggccactttggtcagcaaaattgagtttacgtttaagtagtcaaattcatcttcttcttgtccagttttatctgaaaaaaaaacaaaacctgggtttggacgtttcaacaaaaactaaaccaaacggctaatcatggaaagacaacttgaagtaatgggacaaacatgtattgtggcttgagagagaggtatgtacgatttgaatgcacaaccacaagtttcaagaatggccacacatctctttcatttcgagttgtgcccatgttctagtttactaatttcgtacgaaaatatcatgtctgtcttgtcagcctgctcgcattgtcctaaaaataagccaatcattctaatataacaaatctaaatataacgttgtactaaaatatatcatatcttaatacgatgttggcttattttagagggagcaagtaataccaacctctgtttttgcaaaggagaaaaaagaagacattccatatgcaaaatatatgattatttgcacatgtccacttgaaaaaaaacttgctgcccactctgttttttgcaaagagaaacaataaccttcaccatatttaaaaaaatactacatgattaattaaattccctaatccactagaaatattttaaatattttttcttctgaggggataatatttttaaccatagttgacactctgttttgctctgtttttgcatgatgctctgtttttttcctatgcaggaatatgtagctgacctgaaggcgttgccgaaggcgttggagtccggcacgacgaagccgccgtcgagcacgagctccgccgcgttgtcgccgccgccgccgccggcgaccttccggtcggcgatagcatctgcaagcgaaccatgtcagaacttagaaccttaattagttccacgatccatccatccatccaggaacattgctgaaccttttcttcctcacggactggaatcaagaaatcaagagagagagagaaaaggatcatgagctcaccaaggtgaggctgctcaatggtgatggtcatctcgatctaatcactctttagacagatcgatg

SEQ ID NO: 71416 - DNA, 624 bp, Oryza sativa
tgataggggcgatttagtgtcccgcacgaccgcagagcaaggctgcatgcggggttgacgggcaaaagttctgcctctggtcccggacgggagtctcaagtccctgacaggcgtccctgcgatggagaggtcaaccgcgcgcggccgaggttgacgactgcaagtgcgatgagaccgtggtgacacacacgcagttcgcagcggtttgagcccgggtctggcgtcattgcaatgccactgttccttcactccggtgacagccagtggcacctgatgccgaaacgtgggccatttcgtgcgaattgcgggtggcgtggtcgcaccggctttccgatgctggccgtcatgtttcctcaccttggagcaccatcatggaattgatcgtcagagcggtggatgtcggatccggcaacaccaagttcgtcactggcgtcaccggagccgaaatccgttgcgccagcttcccctccatcgcctatccatccagcggcgagacgccgcagtggccagccagcgaaaggcgcaagaccgtctgcatcccagtcggcccgctgttctacgaggtcggacccgatgttggcctggccgcggacaccttccgcgccaagcagttgcacgacgagt

SEQ ID NO: 71417 - DNA, 1817 bp, Oryza sativa
aaacctaattacaataatccgcaaatctccatataacagcattaaacttcggatgatcatatcttggtcatacgagctctgaatcgacccgttcaagtctcctaatgtttgtataacctaaagaaccctgtgctttcttcttatgtattgttattgcttctttttaggcttgtagctttgcttgtgtgcttcgcgtagtcttcgtcgttccggaggttcccgaagcgtggttcgcggccgtcgccgaaggttcggaaggccgttctctctgagcaaggcaagtcacatcatcctttagcatattgaatcccagtttataaaattattttgatttaaattaatgcattatcgtttaattcccgcgttatcactgttttatctagccatgcctatttacctttgttatgaccttatcattgttgttattgttactattaccttgttcaccctagaataaacaaaaccccaactagtgggtactctattcctggttccactagtatgaatttaggtagatgcttcgctgattaataggacaacattaggtggtttttataactttagactttgggaattctcatatcatttggacactatggaatggttggcttatggtggaattggacatacccctctcttcctctttcaaagcccctaaaacctgtttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctacctgtcccggaggtttcggccgtaggtggggttgggtcggtactcttgtttatggctaggatgggttgggaactatgtcacgtcttccgtccgtataccgtggtggtatgtggcatgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgcttaacaactaaaatgtggaatggttggcctgggttggcttgggacgagctgggacctagggtcgggttgccagttcggtctgaatcatcgtaggccttgggttaaggcaggttcgtgagggttcacgaccttgattaataatactgtgtagctctaggatcgtctttttaaaatggctttgggcaactaagtgacttttaaatgctgtttactgcaaaacttaacccttattattaaccccttgtacccccttgcattaatcatgcatctgccggtgtgacttgctgagtactgtggttgtactcattcttgctcaatctttccccccttcagtaagagaagcttgggagaagaagtcttaggtggagtcctggcttataccccagttgagcgcctgtgaagatggagccgtaggcccgcaagtccgctgctgtttatttttgtttgtcaggcctgaggtgcctttgtaataatgtaaatattatcgatataataaagatgtgtcttttatatcatgtttgtgtggtgtaccccggcttttcctgggacggggattaatacactagcgttcgggaaaaggcaattttctcggtcgcgaca

SEQ ID NO: 71418 - DNA, 1205 bp, Oryza sativa
tgagtggggcccaaattggaggtagattaggatgagtggattacttatttttttctacgtctaatctaatggtcgaaaaggatgcacccatcaatttaaatgaaaatcaagggttagatgttttttgccacgtggcagcttagtagcgtttgtagagtgtcatgtgacgacataggagcgtttgtaggaagttaatgaacttttagtatatcctccctctgtttctaaatatttgacgccgttgacttttttaaatatatttagatgttcgtcttattaaaaaaatttaagtaattattaactctttttatatcatttgattcattattaaatatacttatatgtatacacatagttttacatatttcacaaaagttttttttaataagacgaacggtcaaacatgtgctaaaaagtcaacggtgtcaaatatttagaaatggagggagtaatagatatttttaatataaataaatctttatttaaaaaattactccacaaatttatttttcctcttttttgaacgagctgaccatcaggagacgcttgtgggccatcttttccatgctccattttcatcgttttctattgtccgagtatgcacttgcaacctgcaagcaattttttgtctgtttcggtgggtgcctccgtggaggccaaataatccacgattttaagacttgttcataaatactccgtatctagtgccaaaaatagctggggctggtgatttgcacatgtatacatctggacaggggaccttgttagggaaggttggtgccgtacgcagacaccgtcattatcacgattaggatcgagattttcaacgtcctctcctaattactatagtgcacatggatgctaaggcatgcaattgatgtgacgtgatagtgtaattatacaatcattgagacctgcaacgcgcacattgaatacaaatatatgaacgcaaaatggatatctaaaaagaaaaagcctaccgaaagcaagtatccaaaatggcatccattttgattcgattcgaagtcagtaatagaaacggacaaggttagataatggtaaaaggtcactagttacaaactacacagcaaaattcgcgatgagaaacgcgtacacaagcgctgacaaaatgaatacaatggcatggtaacgaccaagccaaactaaaccctatctcgctaatccaatcaattaatcagcataca

SEQ ID NO: 71419 - DNA, 1257 bp, Oryza sativa
caagaacacttgaacatgaacatcaagaatattcttcccagccactgggaaccatcaaagctactcatccccatcaagaacacaatcacaaaatacacatcaagaacatatagataacacaaaaggctgccgctcaacaccaactccgctgctgccgctcgacaccaccgcccctgccgctgcctcccctccgccggatctagcggagaggagaccgctgggaaaaaaattgtatggcaccccatgccacaaagcatgcgtggcacccctatcaagatcttgccacctggcgtgcacaaatcttggagcactgatctaccttcaaaaccatactagggcaaaaactaattaacaggctatcgctaatctcgcgcgcgcggaaggatggcggcggcgatgcgcgtgacggcgacgcacgggcaggaaagacgacgtgcgtgcaagaaagggcggccgctgccggcaacggcgacgcggacgcacgcagcaacacggcggaaatcgacggagctagcgctgcccagattgatcgcgcggcagaggtgcacgggttgatcgatcatgactcgaggacaaacttcgctgacgatgccatgaaagaccaagccactgcacatcatcagttcggttcagatgatgaggatcttgaagattgcatgaatgaagaaaatgattagtgtgtgagtgtggagattatgggtacgccatacccacatggcatggttatccgactagtcataggggatagcttatatctatggaatatgtaacaaatcatgacttaggtattacgtttccttttatattatggagcggcctaacgtcctgatttgataatattgtaaaatagatttaggaaaccgataccgtattggttacggtttctatcttgtaattctgccaaccatcctatataaggtgggcagtgtcacgtcctgataaattcatcccgaaattaaaaatcattcgctaaaaggaataatagaattaattaaaattcggaaagaaattggcaaacactaaaatacgtacaagaaaaattcgaatgtggcccggagaatttttgttaaattctccttggtctaaaaaggagccctcaaattttacttgaattttcagagcaccggaaatatttattaagcaacaaaaacaattatcagagtttattaaaaagaaaaacctaaaaataatctctctccccccctttgggcagagtctggcccaaagtcctccctctctcccctcggcccgcggccg

SEQ ID NO: 71420 - DNA, 1172 bp, Oryza sativa
ttgattcatctcatccgtgtgggtttttctagtagatctcgaatgacggcattccccgttagttttttttttttttttgactttgctcggatgaaatttgctcgttttgtttcctgttcttgcgattgcaagtcattagttgatgggatagtgaaatccctgacgcgcattggtcgtgtagggagctggatctgttccatgcgttgctgattggatagaggggattagagtttacgatttagggctttcctctgcaaaaactccttgccgcagcacaggaagcaggtctcctccaaccgctccacaggcggactgctcgtttcaatatggccttatatgcagatgacgctgtagtgttccttagaccagataaacaggaactccaaaaggtccaaatgataattcaaaatttcggcctcgcgataggcatggtgaccaatttatcgaaaagcgaagtctatgccattagatgtgacaccctcgacttacaggatattctctaccccttcccggcacagatgaaacacttcccttgtacctatctaggacttccactccacatcaggaaactcagaaaatcagatgttcaacctctcatcgataggttctcagctaggctcccaacatggaaaggaaagttactaaacaagactggccggacggttctgataaagtctaccctctccgccctcccgacctatcacctcactgttttcccccttagaaaatgggctgaaaaaaagatcgacaaaatttgtaggggcttcctctggacagggtcagaacagacacaggggggacactgcctagttaactggaagagagtctgtagaccataaaaacatgagaggccttggtataacaaacctcgaactttttggtcgctctttaagactccgctggctttggcaggaatggaccgccgtcaacaagccttggcagggatcgagtcttccttgtgatgaaacagacaagcagctgttcagagcttcgaccacgataacccttggaaatggcaacaaatcaaaattctggcatgacagatggttgaacggatcacccctgaaagaactttacccttccctctatcagttggccacgagaaagaacagatcagtggcataggagatacaagggaaccactggttgaaacagatgagacgaatgaatac

SEQ ID NO: 71421 - DNA, 761 bp, Oryza sativa
tgaatcataaactgaatcattttcttcattcatgcaatcttcaaagtacatcaatcaaaattacttcaccgtcgaaacatgaattcggcaataataaaagggggtaacgcacgagacctaaaagtagatggatgcggagacaaaggatttagataggttcaggccctctcaatgagaggtaatactctgctcctgtttggggatttgaatccgccgggtgtattatagatctgacgatcatatgtgctcatgccccctacagggcctcctacccaccttatataggatggggggcagaattacaagatagaaaccttaaccaatacggtatcggtttcctaaatctattttacaatattatcaaatcaggactttaggctgctccataatataaaaggaaacgtaatacccaagtcatgatttgttacatattccatagatataagctatcccctatgactagtcggataaccatgccgtgtgggtatggggtacccataatctccacagtagcccctaagaccttcatagtcgaaaagataatcttctctcgaactagattactccaaagccgagtgcttcaatcatcgttgctatggtctcccgagtacttttaccaaatctgaagactgtggagggctgaaaaataaagtcaggtgcatcgactagatgcacctaataggtgtagccccccaactatgtggtcaattgaacaaaccaagcatatagtcaaggaaaataatccaaccaaccgagtggtt

SEQ ID NO: 71422 - DNA, 622 bp, Oryza sativa
tcgaataattttttcagcgctttgaatcctgcaattgtgtttcttgcactccattagcaaaagcttgagaacattataatttctctccagaatatcatgcatccatgctagctacgttctacctagactactacaagtaggagtagctaattaactagagttattcttctacctaaccagatctctcagaccatatcatcctgaagaaaaattcaagattttgggtagaaaaggaaccaagcaaccaaaatatttagttaaatcgaatccccaaaccctgtgggtgcaccacagtttcaggctcaaatccgttggtccctgtaaagcgttgtacaaatgtacagtgctagctgctgctttctgaatgagtggagtgcactatgcagtgtgcaggttggccaccaacttccaaacgagtaaaactccggaagcagaggtccattgaacctacccggctcgtgggtttctgcacaaaaccgtggccgcgcgccaccaagttcatcccatccactcctcgatctcctcgtacgcctataaaatcatacggcttcttgctctcttggcaatgcaagccaactgaaccaactcaagaacagattcaaacaattgttgctgattcctc

SEQ ID NO: 71423 - DNA, 2719 bp, Oryza sativa
  unsure (1)..(2719): unsure at all n locations
ttggcacgggcaacaacgttgggctctttctacaatgaagatgatggccttctctttgacctcatctacgcccgtccaaccgtcgtcatgagcacctcccatcccaggggacaatagtgtcgctggaagcgatttggtaggatcaggatctgagcgagacctctctctcatcatgttgttggcatcttgggcatcgcctatctctcccatcaaccggatgcatgagtagaaggagaccaataccttctctttctgccgccaggagcagttccatcaccgtcgcactctgtcttcttgatccggtaaaataggggttgggtgtcgatagcgggaacagatgattatggtgcggtacaaatttccatataatatatattttaaaaaaagataccattcaacaattcaaaatagtatgctcatggagagcgataaagaagtagctaattcaaaagagacaaatctaatgaagcctaagagcaagttaatagcatagctaactactagctccaaatcatttatatccaatctaataatttattcatacaatagttatctataaatatatattataccattaatgactgatcctaccctctcatacacagacaacatcttaaaattcatgctatagctggctagaaatctcacttttcttcactctcttctcttacctttttacatattcttataaagttatagctgggttatagcatactattatacacaggggcggatctacagtatatgggccggtgccagacgacaccgacgacttttgacaaaagctatagcaaaactgcttatccatatattataacatcatgatctaagcataactagcatactatgacaccgatatatatgttatgacaccaatgaattgattttctagacctgccactgattatacatgctcagtcagaaaaatgtgcttcatgatcacggtttaaaccggttgtcacactactgaatcggtgatcataaagcctataaaccggctcagtgaccggttcttttttcccaatgtctcactcacggtgggcccacctttcactcctccaatgggcgtatggatgagcatggcatccagatccaagagaaaaaaaaaaaaagcaaaacaatcccgtagcttccatttccatggccacaaaaaccggcgacctcctccaccccgccatggcctgacgcccccgagaagctgctgcggcgggaggcgatgccaacgaggggaagaggcggaggaagaggagggaaggaggcgaaggggaaggtgatgggcccgctgttcccgcgggtccacgtcaacgacgcggccaagggcggaggcccgcgggcgccgccccggaacaagatggcgctctacgagcagttcaccgtgccctcgcatcgcttcaacggcggaggaggcggcggcggagtagaaggcagccccgcgcactcgacgtcggcggcgagccagagccagagccagagccaggtgactcgacgtcctgcccgtatgatcgattcgattgggggtagtgtgtgcgactgctaaattggtactagtaggcgacaattctgtgcaaatggagctaaacgccttgcaaatcgaatcgaattagaagcctaattggtaggcaattattctgtgcaatgaagctaaacttccttgcaaatcgaatagaactaaaagctgggaagataatttcgaggcacaaatggtgccctcgacgtcgacgagctaggtcagagggggcgtttcacgccttaccctttgtagttatctcggttgggatagatgaattgatgggcgaatttagtgcaacggagctaaacacatggaaaaattggataagattaaggccgagaagcccagtttgaggcacaaatgccatgttccttttgtgctgattaatctatcatgccgtcgacatgtgattcaattacttgcaaatatagtcatacaattgtggtaggagtaacatgcttgcacgttgtcatagtgtcattattgatctttctccgtgctgataactcacttgtgttgaaggcgaaagagcagaacaaaaccattatatgcagtttacatcagctcttccgagtaagttttggaagacggggcataggttcctgccaccaatatcggatattatagcttattgcaaatttgtatatggccagatatgctatgattgtgtntgctgaggtctggtgtttgtaatatacaacanaaaggtccacatgtgaanctgcatgtagcgcaggtggcaaagagtagccgtagtgctgctcaacgtactgtgttctattctccctgacgtgctcaccttccttaaatcattgacactaggttcctccttagtgtcttgcatttttgcctgccgaaaaaaaaaggtccacgtaaaaggggaatgataaaaatggtggttgatatgctttgattgtcaggcacacgttcaacctgtatgtgataaatatcaacggttttctaatactgttttcagcaaggatttaggagtggaaaatattctttagaacaaatctgcaatagcctcccacaacacatccaactaccttttgataatgggatagttatagacatgaagtgcgaatggcaaaagtccaagtcatagatttccaaatgaagaaatgtgaacaaaataagaaagaaagaagtccatttgcagtattatgtctcttttgcccttctttgggtcgaaaataaaataaaaaatcg

SEQ ID NO: 71424 - DNA, 992 bp, Oryza sativa
atgatttttcattagtgtggaggtttatattattcatgatttttcacataaaaacactacctgcaaataatgtttattcgttcataatagtttgaggtgaccattaacatagatgatatatatttgacaccagtgaataaaatccactttctcaatcttgagagcaatttgtaacttcatttattgaggtattgcaacaaagttcttatacaaaaaatttctcacaaatactagatttacatcagaacctgaactgaagataccacaattcatattatgcaagggtgatacaaccgtgaccctacatcaaaggtgagtagtggtcgactgcaatcatatatgcaccggcctgcacatttctgacacatgttaatctagtagctttcgcgccatcagttgtgacaggagcaccaagacaccatgataataacaacatatatttttcaatgataaggcaaatctatcacttacaaaatcaagtgaaatttccaaccatccatggactccattccataacctggccaagcttgctttctcccaaaggtgacctaggatgcatagctatgcggtagtaggatgcccaaaattttcttgcaaatcttgataaatattttgaataatgcagagagagagtaagaacatgtacaagtggaatatcaccaactgaatgcatatataacaccaattgttggccctaattgtggtgaagatgtgatattagaggccattggcaactgttggccagcaatgcaccttcaaatagatataagtggagaaaccaaaactagcaaatgctaattcagtagtagcacaagctgatttatgtgtttcctatgtttaaatctgtgttttttttctctgactcttcacgtgtgttgtgttcttggccggctagctacctgtacatagttgtgttcttttgtaggaaaagggtagctgtcgagttatctattaataatcctagcaaaaaaaaggagttatctattaataaa

SEQ ID NO: 71425 - DNA, 1297 bp, Oryza sativa
  unsure (1)..(1297): unsure at all n locations
actgtagctccacattatcatatcaaggcgtaattaggctcaagagatccgtctcgcaatttacatgcaaactgtgtgattgatttttttcgtccacatttaatgctccatgcatatgtgtcagggttatagataccacatatttaatagtagttgactaaatctcggcaggacccaccacatactatgtcttatatggaaatatccttcagatataagaggagttccgcgtaaggaaggaagaatagagttttatatggaaacgacaaaaactactcgaattgtatccatattggtttccctagttctacatgaaaaatggaacacctatggatataaatacaagacaccttaggaggagaggggagagggaacaacagatcaagatacatatcaacatacaagccaatatacgccaagacgtgccgccggatatcgacatcagagatatgcctggactgaccctatccggtacctacagaggccggttgtagagatctagcgatgcctctgatctcgccgagcacggattcgaggagaaaaactaccctgttgtcgatacttcaatccactatgtcgacaacagttagataagttaccccaaatattgtactggtgtgatcatagtgaataagagcaacgaccggcttcagccaacaggagtagggttattatctgataattcaggggcccgaaactgtataaaaatcctcctctccgtctcttttacctaagtctcgcatatatcctagtaccaacgatccccatactatgcaaataccggaatcgcgacatcaaacgttgacaatatgtccaaatattttatgtgacgaaatttttaaaagtttgaatggaactanacacaaacacagcctaacttttaggaaatgcacttggtagcgttaattgtaagggatatgccaatttaatttcaactctaagatactattttcaattcctaaacaatttttttaagaaaagcatctggagaaacatttctttctacaaatctcttttttttcgaagttaagctataaaagaattcattctctataaaaccagcagcagtttagctggttgatttgggaaaacagaacttcgttcgtacatcaatcttggttactttggccatatattgagctggcgatatgctataccggcgaggtgacgtggcgtcgtcatgtatccgtaccagtctaccagatcactgtaccgttgctctgttactgtatatactagcagtactacattttctgaaggttcacatcacctttgctttgcattagtgcactctgaa

SEQ ID NO: 71426 - DNA, 2210 bp, Oryza sativa
ctaatttaaagtattaaatatagactaattacacagatagaggctaatttatgagataaatctattaatcctaattaatctataattaacacatatttaatttaatatttattttagcactgcattgtcaaataagttagttagacatggttaacttattatacatattagctcaagtagtataagctaataaataataagttagctataccattaaatttgctcttaaagataatcaggcaggctgacaaaccggccaatgtcacctgccacgtgccgctcagattcatttcgactctgaaaagtttttcttttggcagtaaaaccgataatactcttttctttttaactctgaaaatgttcaggatctactgaaaagaaggcatgtacggagcacatacatacgtacgtggagtggagaagtacgtcagagaaaacagggtgcgggaaactcttttaaatacttgggtgaacgtacatccgtttcttgcatgtcatttaaatagttatgaaaaattttaaaaaaaattgacatgataggttaatatataatatatcacttcacaaatatgtaagttcaaattcgacttctaaaaattataacaaaaataacaagacttctaaaaattataacaaaaataacaaatttgactgtgaatatacgtatactagttagagtttgatttgttatttttgttacaacttgtagaagtcgaatttgaacttgcatgtttgtgaagagatatattacatattaacctatcttgtgaatttttttagaattttttcataattatttaggtgacatgtaagaaacgggtgaacgtccacccgagagattagattagaatccatcctcaacagggggcagatcgagcacagtgccaccgaccactccagcatatgcaaccactcgtggttttcacctcaaaaccatgggtcgtctctcttcttggtgcgtgcgtgctcccccaccttgctggcttcgcatcatccgatgatcgcattctctcgcctataaatccagaccccctcctcttcaatctcatctcatctcatctcgctcagcactactgatccaaccagtaggcgattctctccacctcccagctacttcacttcaggactagtttcttctcagctccatcgatcttgctcgacaatgtcgacgacggtgacccgtgctcacctggagcagaggctcgccctcgccaagcgctgctcccggggtacgtacgcacgcacactaaaccaccatgtttaatctcgctttgtcttgcattccatggcgctaataactgaatatatacaaactgatgtatgcttcgtcgatctgcagaggcgaaccttgcaggggttaaggcggctgctgtcgcgaccatcgcctctgccgttccaaccgtgagtgtgctcagatgctactagcttcttctaattcctccttgtgttgattcttcagcagagagtaggtgtactaacttattagctgcatatgtgtgttgtttcatcgatcagctggcgagcgtgaggatgctgccatgggcgaaggccaacataaacctgacggggcaggcgctgatcatctgcacggcggccgggatggcatacttcgtcgccgcccacaagaagatcctcttcgcttggccaagaggcacttcttttgagaaccgcaacctgaacaaccttaaagaacaaccttctttcaagggcacctggctcgcccccaccctggctttcttcaggcccttgatcaaataattacaagaacacaacatatgctatattatatatacttctagctacctggctagctagctgcatatgatcagagtagtatctgtatcatgtagtagtagtagtagtagtaatacaatacaagtactacgcccctgcagagatcgaaccgtttacaacagctaggtgctcatcctggcctcttggcattaggcattatctagccacacctgaatatgaatacatgcatgtactcctatcttgtactaataacttcatgtaacactgctgcagtaataatgttcagaaatcacaacacaactagtattgttattgtactcttcctgttcagtgtattgtttgctcgtataaacagaaaattcgtgcgaaataatcaaattactgcaatggacaaatggtaagagataaaatgggtcatgtataattaaggattataagattagcattaagagcac

SEQ ID NO: 71427 - DNA, 1804 bp, Oryza sativa
ctcaccacacgccacatcgtaagctaatagctaccacaccttcctagtagcgtatcacctgcagagatgatgcatgctctcttgattgattagttaattattgcctgttcttcgctaatcgcgtggtgattagaaggtaatcagggggttaattgctattactatttatagaaagttccgcagaaatggctaggcgccaaaatagtaagggaaccacaattaatagccacacgtatgaaatgcgtggggatcagggatgcaagcatgtcgacccatgaacctgcgtacaggttatttaaatgttgcgcctaatagaacaatctagatatttagtgattcacaagtaaagtgattttatagttcttaagaaggtattagaagataccatattttttaatgtaaaatttgatacatcttgatatcttcgatactaatagataccaaaatttacactaaaataatcgatacctcttggtatctctcaaggatcgtaaaagctggcctgccttgcctgtataagtaaaaatgtaatgagacaagacgttgtaaattctgagacaatggaagagtacagaacactttcggctaggggcagttatgagcaggactaaatggttattgttagttaattagtcggcaaattctttaataattatttgaccatggttaaagacaggtaacttatctatagctaggaaagatagtatggcaaagaggaaaggtggtgattaaaaccattacaaagtgagcttcatggaggggcccagagggtgcttgccactaacaaggaatttgactccactcagttaaactaatggccaatagttaatggaaggtgaagttaagctacctccagcttatagggatctcataatgatgggatattttgatttttcctaaaggaattccattcacataattgattgtcgcgaaattcgaatatcttactttagtagttgggtggttttcttaattaggggatcacataaaagttcctcaattttttcaaactgtttaaacttatttaagctagtatagtactactttagggtaatctaaaaacttctttagacttgcttaataaacagttgctatgccaagaaaaagtcatgtcttatgcctaatcttccaagatatctgaacgttggactaacacatggtgtctaaaaagttagtgttggcgtgtgaccagaagtatttaaggttgttaattgcataattgtgaaaggagtttataataatatttactccccttacacttgcagaaaagcactaattcttttagtaattaattaatcgatcatgtgtacaaaaacatatgtcatgaagcactctaactagtatgatgagcagttctagtttggatgatctcacaaactaaacaaaaacaaagaatgtttatatcttgcattagtcttaatacgattagaccatatacatcaattaaagcaaggcgtgtgtgtggctttagaatatattctaataaagccattttcaattggaacatttctcttttcccttttgggaagaatggatctggtttggccactctgacgtgtcacctgttaagctggttgttcacatgctcatctctctgaatttcggtgtcttttcagtctaaacagaatgatctgataaacacatccattagactgttaatggttttcctctgagaaaagtaagtcatctgctttgtaatgacgctgttcctcacctggaatgattaaaaagtgtcaattaatgcgacaattccacggtcatgggaccatctcagaacaattcttcagaagatgtgaggagatgg

SEQ ID NO: 71428 - DNA, 755 bp, Oryza sativa
gggactaagaggagggcgaacgcatcaccctcgggcccgacgtccctcgggggtaccaggctacgtgtgcgattgtgtctgcctcaaacctctagtcatatactcctgatcccatgtcaccgacaaatatggttacgacggtattgtaagagcaggcacaatagcatcttataaccaactataacacacatcgagaagaccaaatttgtagccagctgcagcacaaatacaagacacaatgtttgtctgataagtgggaccaggtattactagtgtggtacatatttataaacaactattgtataaattgactgttaaattaactatagatgatttgaatctagtactattaaacttgctctaaacctctttgctcattacctgggtaagaagttaggtccccatcgtttggttttttatggaataaaaataaatttataggtaaaacttttatatagatgttcttggtggcttaaaaatcaatgttgaaaaagaaactatattgaaaatatcacaaaatcaaaaatttaaattttggctttttcttttactgattaggccatccgatgggagccttagtacttgtggcaaccagcctgatgctgctgatactacagcatagtggtgcatctgacggggctagggctgggtctggaagtatctggcagccccagcccgattgtccagctccagcgaagtgcggcaacgtcaacattccctacccgtttggcataagagaaggttgcttccgaccg

SEQ ID NO: 71429 - DNA, 1331 bp, Oryza sativa
  unsure (1)..(1331): unsure at all n locations
aatccgttatctttgttttcttctgttgtccccttttgtgcaacaatactaacagttttgtaaaagaaaccaacttgttatcaacttaaggggaaaacctgaagttcagcatgtatatagttttttttttcatattttacatagcataataaatagtatggtctctacccatgtacgtcgggtcaatctagttaaatagcaaaaggaacaagaaggtggaggccaccagccattgtgatcatagataaaccacctnctttgatctcctaccttgcactcaataaaaacatgtctttttatgatgctcaagtttttaataagatggtatatctgatcctctgaggtatgaaaatttgtactattctatctgtcccaaatataaaaacgtattaatctggaaaaaaaaatgtgtctcatccattactaattttttatatttttgggatgaaggtagttaaaaaaaattggtacacttacaaccagtanaatcttttgttntttggttctgtttgtttgtgtacatactatagatatatacagattcaaataatcgaaaaaataaggaaggagatggtgttcttttaccatgnggaacttggacttggcggcggcggcgcttgacggacatgaggcgcatcagattcagcatccccatggagatggtggtggatgactcctatctgtctcaggggatctctctccggcgatggccactgtggtgagagaatcgcactgaaattagggggattggagaggcaaattaaacgagagattttccttttaggaaggaaagagaagacattgcaagcgacgcgtccgaggcatccacatctacaccggcagtggtcgtcgacggcatgcggttttctggaccgccggcgaccaaagagatcacacacaaagagcgcaccggagcaatgacaacatcatcacaccatataagctaagattggcctagcctggtcggttagatccaagccaggctaccaaaattagagatcatagattgatccacttcagacagttcacgtagaggctgatatatatggttgccatttgccaaggcattcgaatttcaacaacactaatgctgctgggtaagcaaaccatatcaatacaactgcaaacgatgacacatgcatggatatcaggttatccaatgattcagattggcacttgagaaccaagcatcagattgtcactggataaccaatcacacaaaccagtttgtcaggacatcctttggaatgggtttcaggaatcaatacagatgacttgcaaaccacatcaaacaaaatttgaaaatataatacgcacatagcagggcataa

SEQ ID NO: 71430 - DNA, 697 bp, Oryza sativa
gttctagatgaagatgagcacacaatcaagtatcagtccttggaatgacaccacaccaagaatcagctacaaacagcaaactcatctatccatccagggacagctaaaatggagaatcagacggccaaaatccgtaatccccaatttacaccacaggcaaccagcttccactagaaaccgaaatagccgcggggggcaaaagaaaaccaagaacccatctaccgttacctcctctcctccttcaaaccggccacccgccgccgccgcacgcgcaggatcggcggcgagggagccggaggcggctcagcgtgagggggcgctgctgctcgcgagtggcagcagcagcaaccctagctccggtttgggatttgggacgcggagtgctcctctgcgctcttgacatgacagattagttaggcattaatccgagcagaaaaggggacgatgattaatttgacagaggattagctactaactaatcacgtctctcctaatcattcattattcgggtaactggttcgtccgaactcgcggggcccaactgcaagtggcactggagtggttgctcgggtaattacgagattgcccctggaatgagatagagacgaagtgaaaaagaaaaaagcttcgattttttcttttgcagaggtggtggatagatagcgcggcagaagaaagaggagaagaaaagatggcg

SEQ ID NO: 71431 - DNA, 840 bp, Oryza sativa
catacgtacgtctacaacgttatacacttaaacaatatggtattttttaagtatttataaataatcttttagaagtatgaaaataaatattttttttatgtgtgtattttaaaacaaagcgagtgtaccttttgaatttaagttttgatggtacacaagacgtcgatcttaagatatatcaacccggtcttatagagagagactcacagaaataagatgtgtgtttataaggataagtgtgtgcgtgttgcgaatgtctgtgtttgtactgtgtttcttttaaaaaatacgtgcttgtgcatgaactatttcattttgcattcctgcataccatccatccatccgtagatcaagggacggacggctgcgatacggctgttcagacggtagagtgtacatgtaagatgtaacctcgcccgttgccacggtcgcacggccacgactccatctctcctccatcgggtacctctctctctctctctctctctcctcttctcgtcgccctaatccccaatccaaaacgaatccccaatctcgtccgcgccgcggctcgccgtggcctcccccgtgcgccgcccgccgcttcgcatcccggtgagaagaaaagaggtaaagctttcggttccacggcgaaagtttggatctttgatgcacaaaaagaagcatcttttcctgctttaatctcccttgttcttgagctacaagagatcctctccccgtagaaaatcttgatctttctaagaaccgtgaaatactgattcttggagatgatcaatggtaaattagtgcagagattaaaactaggtttaggagaccccctccccggattgattgattgat

SEQ ID NO: 71432 - DNA, 547 bp, Oryza sativa
gtcagcgatacagtgatcctcattgatacacaggatccatacagaccgttcccttaaaaagtcaattctgaagaacctcaaatgccacaatgactgcaaatattcgtaggaaattagaactcagatgctagcacatgaccgaaaaaagctacatgcaaatttttactacctgtatgatcacatgcaagataatcaggtctttgtcagtgttgtctttttcgagaacataaatactttcgtcgctgatggtgcttgccatgtcctcacctgattgggcttaagttactggataataatgagattattatcctaagaatatataatcaccatgttgtgtaactgagttgaaaaatgggagcagagtgttttgctaggacatggatagattttgtaattatgaataaattaatttgttcacattaagaaatcaatcacacattactacgttcacattaacaaaaaaaaattgcatgtgcaaccaataattgtaagattaatatattcacatcaaccaaaaaaaaattataggtccaactaataattcaaa

SEQ ID NO: 71433 - DNA, 604 bp, Oryza sativa
gaaaaataaacaggaaaataaacatggtctttctttttattctacagggaatgctatgtttacctttgcggataagcttggctcttgacaaggtccgtggtgctccagttgttgttccacgactttccacggtgagtttaacgattgacatgttcattacatttctggaatgaagatttttttggtaccataaattctttattctatataaacatttctgtgatttttatcatataacattttaagcaatcaaataagatctctccacctggcatgactttttttaataaaaaaaagttacttatattagacattaagtatacgaaggatcacccacactgtgtgagaatgtgagattaccgacagcaatagttcaaagatgacacaactattaatagagctcacttttttcttattacctgataaatggctagttactgcaaatcatgttcgtaaaagcatctataagaatttcaaatattgcacattaaaggctctaatagaaaaagatggtgtatgacctgtgcttacttgtcgcataaccattatggacttgtttaagtttcataagctatcactcacactccattacttcgaatacaac

SEQ ID NO: 71434 - DNA, 6759 bp, Oryza sativa
ccaattttaccgagttagacactgattagaatgcgacgtgcatacacgaggtggacatgagacatgctatctttgtaaacttgacttgtgctttaatattctttgttttaccctttacatcatttccttttttttctcttcctgtaatgtaatctttaggtcttattgaatctttctactgaacaaatatatatatgtgcgtaacattcttcttacgtgtgtatttatataacatcctaattaacacttgaattagcaagattagccttattttggttttggttcgcgcatgccctcgacaagtttgcataccaaaataagtgttttacaagtttatatactatattgcacccatctgataagttcttgtatcgctaatataatttactcttttattatttttgtaattctgaccacataactcacttttctatcaatgtctagcatctattttggcaaagatatatcgtgcatatggatggggtaatttgtcggtgcatcggagccgatttgtttaaggttgttaatgtgcatttaggaagttgtttggagtagtctaaactataacgacggtaaaactactcggtctaagaaaaaaagattgacctaagggtggtttaaaatgaacatttagcaataaaatatgacctaaattgcaattcactctataaaatgctctgatctacattaaggctgtgtttagattcaggggtgaaaatttttgtcatgttgcatcggatatacgaacacacatttaaagtattaaacgtagtctaataacaaaacaaattacagaattcatcagtaaaccacgagacgaattgattaagcctaattaatctgtcattagtaaatgtttactgtagcaccacattgtcaaattatggagccattaggcttaaaaaattcgtctcgcaaattagtcacaatttgtataattagttatcttttagccaatatttaatacttcatgcaggtgtttaaggttcgatgtgacagggtaaaaaattttagggtagtatctaaacaaggcctaacacacacaatttgcatatatgggtcccttggcctttgccgtctaatcaaacgtaaaatgagaagaagcaagcatcaatcagaacaataattggcaacagtgccaggacacatacacatcaaacacatacagcaagtcccaatcagcagcagaagatgtcactgtttattttgagaggctttgcagtttgcatgcatcacattctccatgtgatgaagggtgacaaaagaagttacagctaaccatggccaacgtcgatcatccacacaccagggtcacaagcacaacaagcacacaacacagacacatcacaaaagctgtctgaatgattctccagagagccattggctctagctgcagcagagctgagttacctacctatacctagctagcaggcatgcagctaccacctactccattcatcccaaaataaatcaaattcttagagtttaaattttgttcgaaaataaattaattcttacctttttacctacccttgatccaaagatgagaagttttctcttcaacacttcttaacttcccactcaccaacaccaatactatttttctgttaatgaggacaagtattttttccctcgttagaaattatcttaaaatataagagtatggtttattttaaaacgcaagaaggagcaagatcatcatcagctagtggagcatgtggcctactgcaagatgcaacatcatatgtgtgcactgtggctgtggcagtggaaaggacagtggaaaaggatagctatagctctggatgaagctgggattggatgcaatgcaatgcagtgcagtgcaagcctgctggctgctggctgctgctgttgcatgctggtgcttcttttgggtgtcactccagtgccaagaaaaaaaaaagcctgtgtgccattttgcttccatgtgcacaaatggaggagaaagcctgcaccaacaaattggtgttgcattgcatggataggggtggtagtccttttctttcattggttgcttttggatcactgctactttgtctagtgcatgattggccaattcagtgcttaattgcagttcacatagtagctacaatatgatccttagatttagggcctatttatatctcaccccaaaattttacatcatgtcacatcgaacgcttgaacacctgcatgaagtattaaatataggctaaaaataattaattgcacagattgcgactactttgcgagacgaatcttttaagcctaattgctccatgatttgacaatgtggtgctacagtaaacatgtgctaatgacggattaattaggcttaataaatttgtctcgcggtttactgacagatactgtaattagtttttttttattagtgcccgaacaccccataggacaccctatataatacccgatgtgatacgccaaaactttacacccctagatctaaacacacccttaagtggtggttctacatatttatcttacactagctacaaactgtgccatgacatagaagacctatgtaggtgttattttctcctgcaaggacaagctgtaatttccatttttatgtctagaaataaaggtaaatttagtgtggttattataaattgttttatgtttctccatatggaatggataaaatgatgtaatacctccgtccaaaaataaattcatttttaactcatttcacacataccaatacaaaaccaaaaaggctacaatacaattactttatataattccattacaactattccttattttatctactcccaataaaattattacgtactttcacaaactacaatgcaatgattactctaaaaataaagttatttggggccaaatggaaggggctaaaaatgaacttaatatagaattggggaagtacatgcctaatttagtttattattaatacttatagtagtaatgggcatgtttgtgctgagcaatggatcgatctcattattgatgagagtatgtaaacattaactcaacaaggtttgacaagaatttctcaaaattaaatggcgtgtagggaaaaaattatattgctgaaatgtgttggcttataaagcacagccaaattttaaaattttcaaacttaataaaaaaattagtttaaatatgtaagtcaagcctggaataccttaatttattgataaaaaaagtcacaacaaaataatgatacttacatacagatttaaaataaaacaaatggttaaatatgtcatatccaagtcaatgtaaccaacgtagcatattttactctgtagaatatagtagacaagaaaaccaacaacaacaatatggagaaacctctgaattgtcaggctgtgtgtgcatgatcatctacaattgcgactagtgcttgtataatatttgagcatgcatataacaaatatatatgattctactagagaataatatttcaaataggcccactcagcccatatgtaatctagacttctacatgggtccaaaatgggcttaacaaggttgttgttgcttctcagagatgttagtacaaacaaatttcccgaacgtattacttgcttaaaaatagttttttttttgcaaaatttatctgacctagcattattatttaaaaaacttaattgtggcaattaaatgaaaacttccataggccttgttaaaaacaggaatacgtccatattgttttgtctataaataagaatttcacatagacgcctaggtttgaactgatggggttaacttgaatggttcaagagagtgtattgtatctggtatagaagttaagcaggttttctttttagactaatgagatagtattaaaaactttgttaacactacatcatgatagcaacatcaggcacggatggttgactaatgtgaaacatataacgcaccatatatatggtgattaagcaagagatgcacagtcctgaccatcataaaaattgtagcataatacttagtcaaagccccttttcattttgtatatacattttgttaaaattttcattatgataatgactatgcatcttgcttaatcaccatatggtgcgttttatttatcaaatatatctaggttaacctgctctcacaaaagtccaactttctccaactgtagctagtaaaagaaaaaaaaacagaatactaagtgcattaggtttgcatgcttcatcaatccttttaactgctcatttggcttatcacttccattggttcatggttagatctatatgcatctcccaacaccactgttcagcatcagtaccaaacaagaagaagcatcaaaatagcatcatatgctctgcatgcatatccatggacaaatgtgcttttggattgaagatccagagacatcctgtgttggaacggttcaccatctctgagcctcctgtcccaatccatgacatcaggcaaatggttaaacgatgtgaccatcagaaaatctgcttggagagacaaacaaagctggttattcttagttttttttcattttggtagattaaaatatacttaattattgtgtagtgttatgatagagtccttttctgcaaatatataagacttaagtgtgtcttctagctaccattatataacttttcaaatccagagcagttgagagtttttaggcttcacaaaactggagttaaaattaacttgaaattgtgtgagttctatcactaggagaacaatcttgttaaatacctagcaaccattacagggcttaagaggcagagaaaaatagcgttgatgaaaataatgttttacttttttaaaaaaagaaaaggaaagaaaatggtgttttccatgtaagtcagcttaatatcattgcgataactaaggttatacccaggggcgaagctagcatcaaaacaaggggtgcactactattgagaatttagaaaatttcagtacaacactgtacattctagtgtttttaagtgagaaattaggaatttgggggttcatgtgctgcctccccccgcaacataatatagcctcgccactggttatacctaaataagattttggttatattgtcgaatattggtatcatagcatgcaaagagaggttttgtgacaaagaagctacaaatgaactctggctaccctgtacatttttaatatttatatatactatgtacttggaaccaatttattatagttattgctaaaaataatataatgtaagacacataaatgtattcttttacaatgaaaagaactttgaaattatatacttatatatatccagatgttaattttgttcaaattttgtactactatatataatatggtcccacgcgctaattaactagcctccatggagctaggagacccaaacccacaattgtgaatatctccataaagaatagatactacccacaattggttatgtgtccctacaaactgtaaagcaccctgtcaactactggtgaacatgttccaaacatgtcactctactataaatatgtccgccacaaccataaaacacatcgctaacaagcttgttgactgtaaattcatcccaaactagtaaacgagttttcgaacatgtttgccaactgtaaattcattcaacacgattgggaaaaacatcatttcagtttatacaattatgagacaattatcttcactccagttataataatttttttctttaattttacaaacataagtattatatttagatatgtgtatgtacatgtgcaattttgcggtcccaaataatgctcgcttttacagccgtgaacttgttttacagaaaaccaccaaggatatacttgtagcgtctatagctcaatagatgttgctgacaggaatctgtaggatctcccatggttaattaacaccctagccaagttagcagcctgatagtggtgtagcaaaggcccatatggcctaggtgtggttgtagttggtagttcagtaccaccttagaggtttatctaggtgaggtaagcttatataccctatgagttaaccttttatccgaagtaagcatgaacgtgtaagtgagataatatgcaacgagagtacggtagtgtggattttggtggcaaggccgtatttgcatatgccttatttatgcatgcaatgctacaaagtgctccattcgcatctctaggcgttctttctaatagaattggatatttagaattggagtaaacatccatatctctaggtggctatttagatttggatataatcctatatcaaatggagaaaatagaaaccgcaaattttaccacgcaactaattactgattttgccaaaagagttctctcatgtgctgcaatctgatgtccgtgatatgttctttacattgatctccgtatttcctcgatagagagaaaatgagtggcacggtggagggggaggagggaaagttggcatggtgtctttgttagggttgtctattggatcacctaggtttagatctagtcgggtggttctatttgcaatggatgaacaacaatagatgaatgaacaaagagggagtgagaggatttagggttgtgaccagtcgttgttgaggaagaggaagtccggccggccatcgtcgttgtcgtcgcgggcttgacgtggacggcggcgacgatgtgctcggttccgatggcggtgatacggttgcagcagcgacggtgtcgacgacgaggcgtggcgctgcggtggacttcccgtcactggctgcgccccctcgatcggttagggtttatggggtggagtggcggcggcgac

SEQ ID NO: 71435 - DNA, 535 bp, Oryza sativa
atttagttttttttattatttatttgtagaaacatatttcttcatgggcctctatgctcccttggccagttgtcctgagaacgcaacaatgcaaaatgttgtagcaacggcggctggaccgaccagggctagggcaggcatgtgcgattgggctgtacacgccaatgcattttttttaaatttcacggtgaaacttccagttcccgcctactagtagtttcctccacatggacacgtgttagattcttggctagggcattggcaaacttacggagctccacgtggccgaatagtaaggtagagcttggtccctggaatcggttttaaagattggagcattcgggtgagaattcggaatctcttctactactcctttatgccacatctatatctccctctctgtccctttcaattcctaattactatctttctcgaaaacgagtgacgtggatgggtaagaatataattgataaggaaaagcattatccatgctttgtgggaaccttttccttttaggaaaaaaaagttggaaact

SEQ ID NO: 71436 - DNA, 6304 bp, Oryza sativa
agccccgtgctacctcttccgccgtgtgtgctcggtgagcattttccccttcctctccttgcctcctcctccacttcccgcattgccgctgcgcccagtggtcgctggctatgaccaccaggccgtgtgccgccacagttggtaggatcggccggtgagccgcctcgctcctagttgtttgattggtccgggccaatctagggtgtccatgctcgtggaccaccctgtgctcctggtccacggtgcacccggcaacctccgtggactcggtccacagtaggccggccccaaggccggccccttgacctactgacgcatggggcctgcctgtcggcatagtaaaataaataataattgtgcaataaaacgagtttaatttcagaaatttatttgaatggctcaaaacttctcaaattcaaaactaattcatacgaactccacttgcaaaattcacctaaagttgagctctacacgtttgtttacttttcatgtactgtttactaggtttttattagggtttttccttgttttgcgtgctagcatgtagaatctgctgttctggaggatcgcagccgcaaggaaaagagttcagaagattgttcgaagatgctaggcaagtcacacattctcacttgagcatgttgaccctactttatgattttttactgcttgcaaataaaatgcatgtttttgataattatatgggaacaaggattacctatctgcttgcgtgtgctatgtttacttgatatccatcttttatcaaacttgggtgacaatttgactagcttgtcacttatgttggtattgctggaactatgatatgcttagccatgcttaattactactagctcacctaatgggacgatcacattatgtatatttagtatcttgacaagctgcgagctcgagacacctggccatatttattggtcgcaattatccaactaaaacatggcctaatggttggttgtgagtgcatggttttgattgtcacacccatgacaattaagtaccggttcgcgggaaacccttgaagacttactctgcttaattaccacaagcaagcgtgggtaactgctggacttgtagtatagcttttccctttttgatgttctcaggcaagggtggatgtgatggtgtttggatggaccgtgtggcggtctatgcggcttcaggattcatcatggcacaagagggggttgcccacctcagttttaagagagggggcaaaacctgcagcgtggtgcgcttggtcaggggagttatgcaaagggtcttgtcacaatcactcgcatggtgatgtgtccggccggggatggaaacatgatggtgggttgtgtcttgtgagtatatatagttgtatacctctggccagagtaaaactatttgaatagttgtgcctatggttatgggcaatcaaccagcatctatatcgtagagctgtaggccgaagtctctttggcagaccaggggtaagcaggtgtccgaagcaatcgataggggtttaccttaacttaattaaaataattaacccataggaatcatctctattctcaacctaccatttagttgttgtccttggaagaatcttgtacttagattatacaaacacgttccctgtggatacgataccctggaatactcttaggtgaaggctacaatagtatctgtgcagttctagattattctgtgttcgtaataaataccaacagctacttgaaattcatctaacgagaacaagaagaaaatgaatatgttttctagattatattctgcttatatgttattttgggaaatagtgttggctggagcatcgtcactactattcgacactaaggtgtcttaattgatcttatccatggaaacagaagaatggctatgagtttgccaaatccttctataggttatcaagtgggttgggtttttccttatccacctggacacgcatatataattcacgacccaggaatagcacggctcatttggctatgggctgtgctatcactgcccgtctagccatgctatgcttgggctgctacccatcccggtgtgccaacacaataagtacatgtagcgagccagcacgacatggcctagaaatgataggaaatggcctggtccatgtggcacggtggtgaacaatgactggcaaacaaccgtcagtcgagcaactgccatccaagttgaagccaggagaaaaggagaacggaagaaccgctgaagctagggcctaggggcagagaaagcaatggtggacgctcattgacataggccaaaagggcagcgtggtgacgcggtcgacccctttcgtgagcacaaccactaagcgtgtcagttgttgggggctcatcagctccgaacagagcaagtaggaagtgaagggccacgacagtgcttgacggggaggaagaggaatgagctatctgtcagcagagaaccttgctggagcttcgccggagtttgtgcggcaagatagaacagactcaattcacattattttttatggtatatgtcaattttgggctaacggacctccacccaacccacataccccaatcgtgctaggccgacacgacacggcccgatatctcactgggccgtgcggcccgtgcctggctcctagcgtcagcctcgccattttggcgtatagttggcctctgtcgtgcgtgcgtgagttatccgtcagttcgccggccgccgccgcctccgacgatccccatccatcccgcgagcgagcagggcgccgtcgttcgtcctgctgcatccgcccgcatccatctggtgagcacatcctccgccaccgccgcctgcgccgatccccatccatctgctgcttcctccgaaacgcatctctctttcccatctctctctacccacgcacttcactttttctcgaatttgcgttaaccctagctagctttctgttctagaaatttgccttaaccttaatactaataacagtttgtttgttcccaaaaagttttgggggttcaactgaacccccatgtcccaatgttagatccgccactggtggtaaaatgtagtacactgtattttatttttcaactttgttttgtaaaatcctttgtagaattagtccaatggtgttgatatcttggcccaccatagctttctgcatatagttattctacctttggattcttgtaaagggggaaaataagcacggactgatttgtttacaggatgatagatgatgcgtaattttgatgtagctttctgatttccgctaatctcatgttcctatctgtactgcagtaggatcaatggagacgaagttatcgttttatcaggacagcccgccaattcccatcatttctgctgttaaggttgccatttagttgcttcatttacttggtgtgttatttttgtgattctttggtgtggccatttttttatccttttgttagtttgcgttggtggaaattgttcgctggtcctatcagaagatataatattatccagaagtatgtgtgtggtttcattgacttgatcagtattagcattgaccactaaatgtgaattttgattttattttgaaattgagtcagtaaggttacagatggccagctagtatatatcagggcctttttttggtagaaatcctaactttaatgagtcagacaaaaggcataatattcaaaccgaaacatatagatattggaatttttttttttagatattgtagtggttggcgataacatatattcacagccaattcactaacattgcaagcattagcctttctcggtaagttagctaaacggcatgttatttaaaatcaaattagttgttcaaaataacgcatattcatagccaattctctggttgcagatattgttgttggttgaagattgtcattaggaacggtgttgtgttgtgggaggaggtcctttggatgagacaaggaggagccaggaggtcctctgaaatttccttccctcgcagaaaaggtgcacaaataaaacaaacaaaaaggaagtctgtatccccacgaccccacccatggcattcccctccacctcgtcggtggcgtatcccagaagtctgtccccactgcgccgctgccccggattcctcgccctccttgttgccgtcctccttttcctctccttccaggtacacaccacatctctgtactcatcatttcctcattgtaatggcgaactgtcaacggtttcagaaaacaacctactacagtgtactagtgtaggattcctgccttctcattctaactaccaattcaatgctacagctcatgattcatgttccctccatcagattggcagtgtccggatggctcttctccgatcaccagacgtaagagttaagaacagccacagcgttctccgtcccattgcacttatttaagattctaactttgatgttactatcttgggttcttgaattgtcagtgggcacaagggtcccgggagctgtcctggatgccacaatgtacagtttatctgatatcttctaatgacatatatgaggtcaggaatagttggatcctgtttcttgccaaattactaagtgtgcattttgtttacctgacagggcatggataatgccgataagactattgcttacacgaatcaggatggtcggatcaggctgttcaaagttaccacaagagaattcttgtcgtcctctatctggaagaatcctttgttgccgaaagataccgagccggtagctgaaatagtatgttgtgaataaaaacatgtttttatcttgccaagtcattgcaatttttcggtttacagttctcactgctctttcttctgctgctgtaatagcaagagattgcggaggagcagctactagccactgggtcagaagtctccaatctttcaagcacagaaactttggaaactagaactgatccaattaaattaaagagagaggttgatttcctatttgccttatatcgtaactattatcaatgacgaactttggaaactagaactgatccaattaaattaaagagagaggttgatttcctaattgtcttgtatcataactattaatgatgacagatattttacctgtatattatgttcctttcttgttcctattcgattaactcttcaccatctcagcatatctgatataccattatgattcctgcaggtgttccgacgtaaaagaaaggagcataggattcaggagttgcttcaggtggacaaggaggctgagctccatatgcgaaatgtagcgacaaacagatcgaggaacttcagtaacaaagtaagagccagctacaacatatggaggctgcagtttcaccatactaatacggattcaaccctgagacttatgaaagatcagataataatggccaaggtgtatgccacaattgcacattcccagaagcaacctgacatgtacgcgttgctcatgaagtgcataaaactatgccaggaagctattggggatgcacacatggattatgaacttgattcgaggtactctattttacacccttgaagatttaccagttcagtgtctgtttgctgtgacctggttcagttatttattgctgtgactctaaaggttcaattatttatcacccacatttcttatgcagtgctttagagcgagcaaaagcaatggggcatgccttgtcttcagctagagatgttctgtacaactccgatgaagtatctagaagattgcttgttatgctgcagtctacagaactaaatattgatagtgttaagaagcagaactcattcctggtgcagcatgctgcaaagacggtccccatgcccttgcactgtctgcatatgcagctgacaaccgattattactttcgtgatggtatgatcaaggaatatttccatgatgccgctttgaaggaagaagaagataaagcaaagcgtgaggataggtcactataccactacgctatattttcagataacgtccttgcagcctcagtagttgtcagatcaactgtgacacatgccaaggaaccagagaagcacgtgttccacatcgtcactgatagacttaattttgcagctatgacgatgtggtttatacgtcatcctcctctacctgctactgtccatgtggaaaacattgacaacttcaagtggctcaattcatcatactgttcagtcctacgacaacttgagtcagctcggctcaaagagtactatttcaaagcacatgatccatcatcactctctgacggaaatgaaaatctgaagtacaggaaccccaaatatctgtctatgcttaaccatctaaggttctacatgccagaaatacaccc

SEQ ID NO: 71437 - DNA, 664 bp, Oryza sativa
acatttatgccgaggtccaatgcgcaaaaaaaattgaaaatgacttatttgtcattaaaaagggatcatttgtaaataaaaatatttacaaatagattcttggcgctagcttcattggcgccgaggacctatttataaatattttttatttaccagtaggtccttttttacaaaaatacaaattggtccttggtgctaataacgttggcgccgtcctccttcatatttatgacttagcttccactgggggctagggcgatggcgccaatgtcattggcgctgtcatgttggaccacggcaccaacgatgttgacagcacaaaaggaccatttctagaataagtttttttaggggtctatttatagaataagttttctaaaagtattaaaatgtgaaaaattcagtaggattgtgatgcacaaggacattaccagcttcttgttcatatccatttcttttctgtacgacgactgatctgtgtaagacacattgcacaaacatgttgatcttccggtttagctcaaactagcatagtaccagcttgcatacttccccctcttacaaatatacacattcaatattttttttagagattaaagatgaagggaaaaagtctctgatgcctctcattaaacaaagatggttgtggatgacacagtgggtg

SEQ ID NO: 71438 - DNA, 1075 bp, Oryza sativa
agcggctaggcgacaatttacaacaagcgacaagcggccgaggaggagcgcggcatgacaaactcagcggtggtggtggcgcggcttgaggtggtcgagaatggcggaaaatggtggccagaggcgatggatatggcggcgactttgggtacgcggggaagacggtgctcgggcggtggtttgcgggaaatggagtggtggtcgtggtgcggagtggcatggcgaagccggaggctctggtggtgcagcgcggtggcggcactagcggcagtagggcttgcccagaatacgacagcaggcggtggagctcggggttgcggcggggtaatgggttggggacgcggcgagctcgatagagaccggaaaacaagcaagagaagcatgggtatcatttatattgcctcgagaggacgagattgaggaggagtgggcgaggcgacgggcatgaagctccgatcttcgtggaggtcgtggtggtggtgcggtgcggttttattcacaaataatattttatttgctaataagtgattcggataagaatatgaataagcgaaacaatggggctctagataaggtgaccaagtagtcttttacctctttacaattctacctccattaaacatgtgatccctctttcactgaatgatattttaaattgaatcaatcaactattaggaggaacataggctttatttctgtctttaacatggtaccaaagtattatgattcctcatcacctaggctatatccagggattcacatttcttatggtgctaggtaaattccagaacatgaccggtcttagaaaaaaaaacatgacataacaatagtgactggaggagtagaaatgagttgttattgatgtccttttgtactattttaccgattgagacctcagtactttatatctacataagtaatcactactagataggtgtcggaatagctaaaaccggcacctttaagcgactataggtgccgattctataaaaaaaccaacaccaatactatagatgtcgtttttttaaaaaaaaccaacaactttaatttattataggttctagttaattaaaaa

SEQ ID NO: 71439 - DNA, 3425 bp, Oryza sativa
accgccgccacttgaaatttctccattccacaaattgtgccaaccacccttgacatgttgaagcagactaactatatcaatctcccaatgcttctcaagcctacattcagcctaaaaagaaacagtgttctttctttctgagcttggcgaagagaaagatagaatgaaagacgagaaatagtgagacaatataatgagatgcacatacatgttcatataactattatgtttggctatgtattccttcgtggatatagaggccggattaatgaaaatccattatctaaaaaaatataactattatgtgtcttttattgcatctatcatctctgacaaaaaagagttaatctagcaaatgagcacctgcaagtactaaatcactctttgtgctcaacaagggcattgaatcacttgtacttggcagtactctgcagtgtgaaaagaaaggattgggataatttcactcagataaagttggcacaagacatatgtgacgatcctagggttcgtggctctagatttggggaatcgtcacaggaaacatggaagaacagaggaggaagaaggagaattcaggagcagagaggttggtagtagtttgttatcatctctcttcttcgataccccacttcaccaaccacgcagggtttataacacacccgtgttggtggctcggttcttacaagacggcccaatagttggcccaacacaaacaatgtcccttacaaggcccattgatcatgacattccctcccccttaaggactggcttgcccccaagccagcgcagatggaaaacgacgccataagtcggccaaattttcccaggtggcaagagtatcaggaagccctgaccatcgtaccagaacagaaggaatggaagaaccaccacgcttgatcaactgacgacgtagaatggctttaggatagacttcacttcatcagtagaacaagtcaggggtagatctgaactgactggtgtatcaggttgcactgccttcttaagtaaagagatgtgaaccactaggtgaatcaagctcccagccggcaatgccaatcgataagccactgctccaatccgttccaggactttataaggtccaaagtacctgaaactcaatttgtgacaagaacgtttggccatggttagctgaacatatggttgaagtcgcaagtaaaccatttcaccaggggcaaactggcgttttgaacgatgcttgtcagcttgtgctttcatgcgctgttgagctcgaaccagatgatggtgaagcaactcgttcaatttcgcccgattgacaagcaactgttgcacatccgggatagtactttgacccatatcaatcacaccgaagctagttggcttacgggcaaacagagcttcatagggagacataccaagagcgctatgctgacaagtattgtaccagtgctgggcctaagcaagccaagaagaccacttaccgggggaagaataaacagcacaatgcaaataagcttccaaacattgattcaaacgctccgtttggccatccgtctgagggtggtaagacgagctcatattcaacttgacatccgagagtcgaaagagttcctgccataaagcacttgtaaagatcctgtccctgtcagagatgatggcctgcggcatgccaaaaacatcatagatgtgctggatgaacaactgagccacttttaaggtagtaaagggatgagataagggaatgaacgtagcttatttggtgaacttatcaaccaccaccataattgtatcaaagcccccagacttaggaagcccttcaatgaagtcaagactaatgacagtccaagcctaaagtggaactggaaggggttgcaacaatcctgggctcttacaatgttctacttttgcttgttgacagattgcacaagactgaacataagccttgacatccctttttagtccaggccaggcaaacatgctcttgattcgttggtaagtggcagctataccaaagtggcctccaacgccactattgtgcagggagagtaagacagcttgctgggcttccacgtgtttccctagccagattctacccttgaatttgataatgccattaaccaatgtgaaattgttgaccccatcaggatgtaaacttaattcaaccaataactgttttgtagcaggatcatggtgataaccatcgaccacaacttccatccatctaggttgaccaacagaaagggcaccaagttcatcatactcaccctgtcttgatagagcatcagctgctttattctccacccctttcttatactaaatgacatactgcaaccctaacaatttcaggaaggccttttgctgcataggtgttgacaatttctgatcacacagatgagtcaagcttctgtggtcagttaggatagcaaactcagcatattgcaaatattgatgccatttatccacagccatgagaatagccaaacattccttctcatatgtagaaaacccttgtgctttaggtcccaaagccttactcagaaaagcaataggatggccagcctgcatgagaactgccccaatacccttgtcactagcatcagtctcaataacaaattgttggttgaagtcaggcatggccaaaactggtgcttgctgaagacactgcttcacttcttgaaaggcagtatgttccagtgtagaccagaaaaagaaggtacccttttaagtaactctatcaaaggcttagtgatgaccccataatttctgatgaactttctataataccttgccaggcccaaaaaccctctcaattgcttaagatttttaggtactggccagtcccttatagcttgaaccttctgaggatcagtggcaaccccaatagcaccaattatatgtcccaaatattccagagaaggttgtgaaaaagagcatttacttcttttgatgtagagctgatgttgttgaagcactgtcagtactgatttcagatggcagacatgttcagccaaggtcttgctatagatcaaaatgtcgtccacaaaaactagcacaaacttgcgaatggcatgtgcaaatatagtgttcatcaacccctgaaaagtggctggtgcattggttaatccgaatggcatgacacgaaatttataatgtccttggtgagtcttgaaggcagtcttaaactcatctttttccactaaccgaatctgatgatagccagatcttagatccagtttagtaaaccattttaaacctgacaattcatccaacaattcatcaaccacaggcattgggtacttgtttttcacagtaatgtcattcaaacccctatagtccacacagaaccgccaagtaccatccttctttttaaccaagagaacaggggaagcaaaaggactatggctaggctgtataacaccatgctgcaacatttgagtgacctgttt

SEQ ID NO: 71440 - DNA, 709 bp, Oryza sativa
atcctaagttggttggaggtcagctacgacgacatagtgaaactggaggttggctaagatgtcaccgtagacctcgcttcacacaacgccagctctgacaccgtcacggtggttgccttaaacattacgagaaggcaaacgataatggggagacacatatcacatgtgggcttatatctgaatgcctcgtgggtgaacatgtcgtacatgtgggctaggctgtgttcgctcctgacacggaaaacgaaacacgtgattatagtgagattaattaagtattaatctaaaaaaaacttgaaaaatggattaatatgattttttaaagcaactttcatataaaaaacttttgcaaaaaatataccatttagcagtttaaaaagcgtgtgcgcggaaaacgatggaagtgagttgggaaagaggggagaaaaacacaaccttataattgaaaggctggtgcttttctaaaatttactcatttttaatgaaacatctaattaagtatatacatgtttcgtctctgcttcttgcctatggaagagctagaaggcttccactctttccggtttgtgatccttttatggtagtcaatcatgtcaatgtattctaccctggccttgtgcatatatggagcatgggattgggatgtgttaggattcaagaagccgggaaaccttcattatgccggtgccaagccaaatggtgaagtaaa

SEQ ID NO: 71441 - DNA, 707 bp, Oryza sativa
aaaatatatatagcccttatagaatacatgcaagtcattctgaacaaataatgcactatatcttcagaaaaataaacagaaaaaacacattgtatgaatctcattgtatacttcacaaaaacaaatagggagaaaaaaattatttattagtgcaagtgcctgcagtagccgcaggcgatgacaacgaaattggtcgaggttgcaggggaggagatcaaccatgagattacgtgtggcaagtcgtcccttcgatgtccacaatgatatagttgattttgtgttgatgggttaggtccttgatgcaagggtagatggctttagtacctgcttgaatctggtactccttgtccttgccttcacaaatacttaaagttctgaaaaaacaactgatcaagatattgaaattttgaccaacaatgacttctaaattattcaattagtttcagtatatatgtgagtttatgacttcacaattgtgtgcaactcacatgtcactctatggtgctgcactcataatcttgcagtaacaacatactaggggagaaaagaggggctacgaaatgcttgaaaaaaaatccacacacaagaatagtttgcagacagctaaaaatttgaattaacatccacaagcgatcccttgtgcacttggcatctactccttccgtcccctaatataagcgatattcactacgtttgaccactcatct

SEQ ID NO: 71442 - DNA, 7518 bp, Oryza sativa
acataactcacgtcgttgatcacttcctgagtgctcacacacttactggcctccacagcagccccctttttggatgaaacaatgatttctttggtcgatctgacctctcagctggaaagcccttcttcaaagggctagttacttcatcctcaccctgcgtgcctttctcctttcctttcgagccatctgtaatctccttttgccaggaaggagcgtcactacctttacaactgctggcacccgatttcctttgcacttggaatcgactgccgctagttttatcactgcttccaccctcccatatttttcgttcaggaatgaaacggaggcttttattaaacaaaggggcctccccctctgcgagctttttctcacacaacttctccgtatgacccacgatgccacagatataacagaagtcaggaagaaattcatacaccagcgggcaccatagcggcctttcatctgcacccacaaacaaggtcacgcctctcatgagaggtttcctgatatctatccggatcttgatgcgaaggaattggcccacagctgatccatcctcctctaaatccatcgtcatgaattctccaacctccctgccgatcgccatacccgtctccttggtcatcagtcctagaggtaatttcatggcccttacccagatcgggacaaaggcgaagatcatatcctctatcagcttggtctcatcaagatctatcatcaccactagatctttgttaaacatccaagggccatcctcaagtgcacgcctcttccccgatgcctgatgaaacgtgaagagaaaatgattttctcccagatccttgcagctgactcccttgatcgggcaccaaatcttccccagggcatgtgccagtccatctgcattcaccaatttctctgccaacacctttccgattcaccctgaagctagctgttggtgccaccgcggatctagtgaattcaaatgacgtcttaatttggtgaattccactcatggatttgtttgccatcgcacggatctagtggccatctcatggatctagggaccatgttggtgtcaatgtttcatactgacaataataggtggtgtctagattcagaggtgtaaagttttggcctgttacgtcggatattatataggatgtcgcatggggtgtttgggcactaataaaaaaactaattacaaaatccgtcagtaaaccgcgagactaatttattaagcctaattaatactatgttattagcaaatgtttactgtggcaccacattatcaaatcatagagtaattaggcttaaaagattcgtctcgcaaattagtcgtaatctgtgtaattatatttcatgcaggtgtttaaacgttcgatgtgacagggtgtaaaatttctatgtggaactaaacagggctatagtaggggctatatacaagataggtttagctcctactccctccgtcccaaaataagtgcagttttgcactattcacgttcaacatttgaccgttcgttttatttgaaatttttttatgattagtatttttattgctattagatgataaaacatgaatagtactttatgtgtgactaaatatttttaaatttttcacaattttttcaaataagacggacggtcaaacgttgggcacggatatccacggctgcacttattttgggacggaggtagtacgttaagaaataatacattacccatgtattgatggattatatattctactgaatatattgatgatatgctgttggttgcgatcttgtgtggtcagttgttctaccttgcccattttatatgggttggagatagagttatcaggtaaggtaacctaaacctagctgaatattattttagtttgtaatctagataacatagtattcggtcagagctctatacactatcttggtttacagcctaatatgataaccaagttctactctatctcatattatatagatatgatcccctcctatttttagtcggataagcaaactgtgtgaccattgatatatgttacctatactcttcacaatcggcctcctccggtgagatgcatccatgatgacgataaatctagcgcgcaacgtctgttgatggcggcaacaaattccttatggctggaccataaacatatgggcaacctttaacttgaggttttatgtgtagttcctgtaacgtatatggattatagccaactataaggttcataataagattaagttatgagctttcttgttgcaccctaaatagaaagcccctagaagggcagttaatacttttgtaatcttcacattgtgaattgtctacattatatttggggtgtcattattaatccgtttgaccatgaatttttatttttgcattaatcttcagtgaccgcccgtcatgtcgccattgtctcagccaatggagaggggagggggagggggaggggaggataaggagaggagaggagggcccactcgcccccctgtgctaaaaaacggaacccgactccttgctcaactcaccgacatttataatataccaaatgtgtcaaggttacgggtaaggtataccctctacccttcgatatacgtcacatatcgatatggtatacttgcgcgtatacagacgttttcggcataagttgaggaaatccattatggagtccacagatgtaaggagtcctactcgaatagaactgggtcgtcattgtatcgtgtcgggtctgatgtctccgagtcctacttggagaccagttgacctgcggtataaaagggaccccccccgggatgacccgaggcatcgaatcttaccgccaacacatccaccatagcctacgaagccggagcctacaggagccaagtcgccgggtgatctagtcggatcaactcgactacgatctcgtcggtaccgttgagttccactattccctttgtaatctgtgttttcctccatataatcccatatcaactggattagggctattacctatcaaggggcctgaaccaatataatctttgttttctgcctgcttgatgtcgtattacgtagatcctcgtaccagcgtaccccaataccctctatatctggtctacgggtatcccccgtcgacagtggcgcgccaggtagaggggcttggtgcttaaggttctactactatgacatccagcttcgccgacaacaacgtcaacactaacctcaaccaaggagtttctgcttcaacaatgttggtgtggactcaagtcgacgaaatcgtcttcccggtttacaccacggtgccgatctcagccgatctgtcaatggccgaaaacgagaacgcagtggctacaacccagggcgattccatgtcgaaggatcctcccgccgaagaggagatcggagcgtcgacgacatccgagcccgagaaggatcctagtgcagccaagccttgtctctccgacaagaatcacgagccgacgaggatgaattccaaggtgacaaggtcctagtgtcctatccacaaaaccagaaaacacacattgcaactctgctgggtttttctcaacgtccacgctgaaattcgtgcctgcaaagagcgtggaattcagcgtacttctccaacacgtgatgtctattgtcctgcaaagaatcacgacctctcgagctgcaaggtctttctcagcgccatgaagacgccacctcctaaggtccagcagtcacgcgtccccctcagggatgaggacaaggaacaaggagcgacgctgatttcagatcgatttgttggggtaatcgacatcgatccccacgaaccatcagtcttgcacctgctcgaagactatggttcatcgacaatgagtacgtcgcacaaggtattggctatcgacgatgtcggcacgtcagcgcgcgccaatgcggaagcggagaatcaagtgactacaccggcccagcacatcagagccgtcaacgcaatacagagggaaaccccctacgatcccgttctgaatgacgatctcgcacgatggacagagcggttacgggaatcagtgaccaacctcagcaacgcgttcgaagaggccgctgttgcagcacacccggaatagccaccaactggcgatgctaatggtgaaaatcctgaacaccgggaatcgcctcattgagccacccctccaccgcgcggcacttgcgatctccacgatcacctgaatggccgccgagaggagcgacgtacacgagacaacgagaaccgttccgacatcgcgtctcttcacggcgtcacgataacgaagaacgaggaggccgttcgagcgaagaccgagaccgtgataaccgccacaaccgccacgatcacgacgatcgcgaatggcgggtgctgggcgatactggttgaggacgtcgccataatgacgacgacgatggagatcggcgccgagacaacaacgggagacgacgacaagattctcgagaacccggccgacgtcctcgtaatcgtacgccggaaccaagcgacccatcctcatcgtcgtcatcttcctcatcctcatcatcagatagacatccacgaaggacgtacgatcgccgacaacccaccggccctagcgctgggtgtagagctttcggtcgttcacttcgagatgtccgatggcctgaaagattccgaccaggagcaatagagaaatacgatgggagtaccgacccagaagaattccttcaggtttactccacagtattctacgctgctggagtggacaacaacgcattggcgaattacttgccaaccacattgaaaggctctgcgcgttcatggctgatacatctcgccccctactcgatttcttcatgggcagacctgtggcagcagttcgtcgccaacttccaaggaacgtataagtgccacgcgatcgatgacgacctacaggcgttgacacagaacccagatgaatccttgagggattatgttcggcgctttaatgagtgcaggaatacaatccccgagatcaccgactcttctgtaatccgcaccttcaagtctggtgtcagagattgctatactacccaggagttggcaacgaggtgcatcacgactactcggagattattcgaaattgtcaatcgatgcgctcatgcggacgacgcactgagacgcaagaacgacaaaccgaagactggaggagagaagaaaccagtcaaggatgcaccggagtcgagcaagaagaaaaatcgcaagagtgggaaaagcaaaactcaagcggatgttctcgcaacagaatacgcggaccctcccaagcgcccagacccacaatgcagcgacacgaagaaaacatggtgccctatacacaagtcagacaggcactctctagaagattgcctcgtcttcaaaaagtcgctcgcaaaacacatagcattacaaaaaggcaagcgagtatgtgtggtcgagaaggacgctgaggcggctattcaggaatcggactcagcatacccagactctgatctccatgtctcgcacatcttcggaggttccacggcatactcctcaaagcgagaatacaagaaggtggaacgtgaagtctgttcgatgtggcagggggctgcacccaagatgaagtagtccgagcagaagatagaattctcagaagaggaccaccccaagactgcagtcatcccagggcgatatccgatcgtggtcgaacctactattcggaatatcaaagttgcacgagttctgatcgacggcggcagctcaatcaaccttctcttcgccagcaccttggacgcgatggggatcccacgaagcgagttaacacccaccgatcaacccttccatggaatcacccctcagtcatcgtccaaaccattgggcaaaattacgttgcttgtgactttcggccaagcaaacaacttccgaatggaacagatcacctttgatgtcgctgaattcgatacagcatataatgccatcattgggagaactgcactcgcgaagttcatggccgcatctcactacgcgtatcaagtactcaagatgcgggaccgaagggaacaatcactattcaagggaatactaagctggcagtgcaatgcgacaagcggagcctcgacatggtcgagcacacgcccagcccacctgccacagctgagccacccaagaaagtgagcaaaacaaacaagacgctgaaaccagacggtgcaatcaagatagttccactctctagtgccaacaccgacaagaccgtcaagatcggggcatcactaggcgagaaataggaactcgcgctcatcaccttcctctggacaatgctgacgtgttcgcctggtaaccgtccgacatgccgggggtacccagggaggtgattgagcacaaactcatggtgcgacccgttgcaaaaaactgtggagatttgcaccaaatcgaaaacaagccatacgagaagaactcgataagcttctcaaatccggtttcatcagagaggtactccatccagagtggctagccaacccagtcatggtgtggaaggccaacgggaaatggagaatgtgcgtcgatttcaccgacctcaacaaggcgtgtcccaaggatcacttccctcttcctcgaatagaccaactggttgactcaacagccggttgtgagttgttgagctttctcgacgcttactccggctaccaccaaatcagcatggcgaaagaggacgaggagaagacagctttaatcacgccgttcggggtattctgctacgttaagatgccgttcggactaataaccgcaggaaacactttccagcgcacggtccaaggtgcacttagcgaccaactcggaaaacaatgttgaggcctatgtcgatgacattgttgtcaagaccaagacaagcgactcattgattgacgatctgcgggaaacgttcgacaacctccggcgatatcgcctcatgctcaatccagagaagtgcacgttcggagtatcatcgggcaagctgctcggtttcctcgtctctggcagaggaatagaagcgaatcccaataagatcaaggcaatcgagaatatgaagtcacctacaagactcaaggaagtacagaagtggcgacactaagtaggttcgtcgctaggatgggagagcaaggacaacctttcttcgctctgctgaaaaagcaagacaaatttgtatggacacaggaagccgaagaggcattcattgcactcaagcgctacctatcaaatccacctgtacttgttgccccgcaacctaatgaagaattatttctctatattgccgccacgccatattccgttagcactgtcattgttgttgagagagagaaagtacaacgaccagtctactacgtcagcgaagctctccacgatgcaaagacaagatatccacagatccaaaaactgctctacgcggtaatcatgacatcatgaaagctacgccactacttcgaagcccacagggtcacagttgtatcctctttccctctcggtgaagtagtgagaaacaaagacgttgtcggccgcatcgcgaaatgggtagtcgagctaagccaatttga

SEQ ID NO: 71443 - DNA, 803 bp, Oryza sativa
ttcaactagcacacagtggggatctcatttaaaacctagactataggtttatatgataatgttggtttaataccaccgctctggtgttggttaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgtcgcaacgtgggttagcgttggacagcggatgtttaatactgcttaattattacaaccgttttcgcattcaattcctgtttataaatgctagtttttatgcaaatgaaccactctagctcttctttgttaattccctgcatcatacccctattccggtatga

SEQ ID NO: 71444 - DNA, 620 bp, Oryza sativa
aggcctggttgacccgtggtgcagtcttgtgccagacggagcatgccgtcccgtgggaagagagcacctcctgcataagagtagaggagatggagccgtagagccagctgaggacgacgcagtccatctgtgtccagtcggcgtgatcagggcgaggtacgtcggagaagacatgatcggtgagggcgtattttccaagcgcgacgaggaaaaggccttgccagcgggagtagttgttggcgtcgaggtcgagggtgacggggacgagcgccttcacgttgaggacggcgacggcttggctgtggaggttggcgacggcttcggcgtcgagcgccggcggtggtgcggcggcgtcgagcgccggcggttgcgcggtggcgtcctgcgtgggggcggccggcgtcgtggtgatgctgagacgggcgagaagcgccaggatctcggggggaagttgcgccgcgggagccggagtggaagtcggcggcggcgggatggcggtcgtcgaaggcgcagtcatcgaaggaaccggtggaggccccgtggaggagatggcgtcatcggcggccggagtcgtcggaaggagaccgaggagaacaggggtaagggccgctcggcccgcg

SEQ ID NO: 71445 - DNA, 2225 bp, Oryza sativa
atgcataaatgtccaaaatttttaaggtaacaactagcaactgacaactcatgtatatactgattattatttagatattatactaagggccctatctctagtttcgcactggcccctgaaaactcaggaccggccctaaacacgggtgctcgcatttacgactaattattctttcaatggtagacgacgtacccgttgacaacgagacgcccgtgaatagtcttctggaggtgctcatatgggtagggaggcgcccacggatagtcttctagaggtgctcgtatgggtagggaggtgcccacggatagtcttctagaggtactcataggataggaggcacctgtagggtttgaaatttcgattcgaaatttctaaaattttggtaatttcgcccccctaccggcatactcaaatctcacccgaaatttttggttttttgtaattttttatgaatttggtcaaattttattcaaattcattcaaattcagtcaaattttcaaataatttcggccagaaatttacgaaattaccgaaatttccagtaatttcggtcccccgacataaaatccaatttcgaaattaaaaaccctgaacacctgtggtgacttcatcgatatcaagatatgcctcttagaaaagttttagaaaagaaaaatacggcaaagtgctcacccatttacaagggaaaagaaggcctacaaatccaaccatcgtcatccataggtatgacccattcttggttcgatttgctatccatctcctgtgtgatttttttatggcatttgacattttttttggccgctatgcaccacttgcgatgtgagcggcagctcacggcctgtgtcacccagcaatatggctaatgctgctcggcgagcgacaccgtccctctcgtcgtcgtgaaatataaaattacgatcctatataactaaaattacatttgtaaatttagttaatatgacatgtaagcgcactgtaattttgataaaaataatgtgtaagtaaatatgtatttgttattttctttaaaatataaaaatacagtcctatataactaaaattatatttgtaatttcagttgatatgacatataagtccactgtaattttggtataagtaaatatgtatttgttattttctttaaaatataaaattacagtcttatataactaaaattacatttgtaaattcagttgatatgacatgtaagtgcactgtaattttgataaaaataatatgtaaataaatatacatttttttattttcttttgtagttcgttggatgtaaatctaaagatagaaaaaatctaggtgattttttttagaaatcacacgacaaatggatagagttagcaaattcgttgtgcgtaataaaaaaaaatcggaagcaaattatcgatgggccgcacgaagccacgtacacaattgcgtgacggaacccaatagaaaaaaagtacactgaaggtccctcaaccctcaacttgtcatcgggataaaaaacgtccttgaaccgcaaaaccagggtcccttagctatagaaaaccggtcacaataggtccctcggcggttttgatcccggttttgtcctacatggctgctgagtcagcgtgggacccatgtggaccccacatgtcaggatgccacgtcgacacctttctatttcccctcttctctcccttctctctcacttctctgcttctttgcgcaggctagccgacgggaggggaggaggccggtggggcgcgcccaccgtgcgctccgcgaggtgggtcgcagcggcggcggcgtcgtcgtcgccggccgcgccatctccgtccagttcgccacgtaccgctggcgcagacccgtcctctggcgccgcggcggcggcggggaggcgggtgtacgtgaccaacgttgcaccgggcgcgagcgcggagcggctgcgtgccttcttcgcggggttcggggagctcgagggcggcccgttcggcttcgacgctgagacaggattctcccgcgggggcgcgctcttcgtgtaccgcgcggcggagggcgccagctcgccgcctaccccgcctggaagagcaaaccacgcatgccgccgccgctgcgtggaatcacattggtaaacagattaccacccaattctaaagcaatcaagttgggaatgtttgctataccagaaggaattgatcctaagaactgatttaatcccatgtgtatcagtgtatgtactgccgtt

SEQ ID NO: 71446 - DNA, 2778 bp, Oryza sativa
ggatatgcccataaaagaagttgccgcccaattggaacttttggagatctggtagagagttaccgatattggatggtagctctccgcttagatgattggaagcaagggtaagttaaacaagagtagaaagattcaggatagcttgtggaaactgacctgccaattatttttgcacccagatgcaagtatactaaaccaggcaactttgcaaaatcatttggtatgctgccatcgatgttattatacagacaactaaaccttttcagcgttgtaattttggcaacagaaacagggatgggtccagtaagactgttaactgaaagttgcaagctttgaaagcgttgaggcaaatctgcagggatttgtcctaccagattgtttccattcagccatagcaccttgaggttggaacagtttgcaagattaggcatccttctttgcaatgtgttattgctcaagtatatgatttgcaggtgatgcatattaccaaaggattgagggatctctccggtgaatgaatttgcaggtacaaagagaaatttgaggaatgttaggtttccaagaggagacatctgcccaattaatcctctatttgtgaggtttagcgccggcagcggtgacgccacggcagcggcggccgcgcgcgtggtttgctcttccggcggagtcggcgtcgagctggcgccctccgccgcgcggtacacaaagagcgcgcacccgcgggagacgcgtcgaagctgaacggccgccctcgagctccccgaacccggcgaagaaggcgcgcagccgctccgcgctcgcgcccggtgcgacgttggtgacgtacaccgcctccccgccgccgacgccgccgccgcggcgccagaggacaggtctgcgccagcggtggcgaactgggcggagacggcgcggccggcgacgacgacgccgccgccgcggcccacctcgtggagcgtgcggcgggcgcgccccaccgacctcctcccctccggtcggcttgcctgcacagagaaagagaagcagagaagggagaggaggagaggggaaatagaaaggtgttgacgtggcatcctgatatgtggggtccacgctgactcagcagccacgtatgataaaaccggaattaaaaccgccgagggacctattgtgaccagttttatatagttaagggacccgcggtatctggttttgcggttcgaggaagcttttgtatcatgatgacaagttgagggaccttcggtgtactttttccaacccaatatgtcgtggtgggctggtgatggctgcgtctccatagccctgcaaagttctttggcccattggcaacctgttagtatttgtgtttggcccattttgttttactccaacttggtgtataataattcgatttcatatatgtaaaaaccttgtcacttgcaaaattatactatgatagatcatatttagactaaattacagttcgagctaattttacattggtcgaccacagttctctcttcttctttttttcactttgtaccagataattttgtctttgatctttgtttataatttggataactctagaccactttttttgagcacatcaacaaacacgagtacattgactctatatgccgatgaactccatcacccgtgggcaaatcatatctctctttggcggacgcatggttagacatgattagcaagagaattggtgtggtccaaagtgtgaaaagaaattaaatttaactggtccaaaacaaaagaagatcagtcaatagatggcacaaattaaactgcggcaattcagtccgattgaattgacttatttccatcacgttacactaggcaaagcatatacactagctgtgcccaacttatttattcatttaggttactacagcactggtgattgacatggagctatagctggatcgttcaaccaatcatggtgccgccgcgccaatgccgcagcccctccgctcggcggtgagcatgtgcggcgcctcgtcgatggccagccactgatccaccgcccaccggtgcgtcatcgacgggagtctcccctgcccgagctgcgtcaccatcacgtagctcacgtaccacccgggcttgttcccagagccgtcggaggtgagcaccatgttgcagggctccgacggcatgcagtcgccggcgcccctgaaccggtcgaggttccccttctcgaagtagtcgtggccggcggccatctggccccacgactccaggttggcgaccgtcagcgtcgggcccctggcggcgcgcacctgcagcgagacgcgggcgtcggtgccggcgttcctccggccgtcggtcttgacgacgatctcgaacgtgcatcgtgtggtggcggcggtggccgcggcggcgaggaagaggatgaggtagctggcgagggcgagggaaagcttgttcatggtaagcttcatgttatttgttattggatgtggtatatgtgatgaattggggagtgagtttggtgtggtattgcatgcctccacaatgtaccgttttataggaggcagaggaggggtaagggcaattgcactagccaatgttttgattaataataattctgtgacttgtgggatgcgctactgtgagctctgactgggtgtgtatattttacgagggatatgtggaaattaaaatggtctgtgccacgcgccttatcttctcgtaaaattagatcggtggccgccattctcaattgactaaacgcaccgacacacatgtgtacccatcccctctctcccctcggtcttcgttcgtggc

SEQ ID NO: 71447 - DNA, 18401 bp, Oryza sativa
agcaagacttatctcttatatgtgtttcccttttctaaatgcatgtaaatgtttataaaaattatatttggactgttcttatcctggggtgatgttgatatgttagaattacagtttaccttacacatgtcataagcttcttacctatttatgtataagtttaatctagtattaaattaagagaatgcttatagagatgattcagataaaatttaccctatatgagttaatttatttgttcacttccatgttcatgacttgtcttgagatggatggcctaattagttttatggggctagacattggcgttattgatatattttaaggtgtattatggttcctatgtattattttccaatagttagcactaggccctaatggtttaatggtttagttgattgtctagattttagttattattcatgagacctattatgaaatgcaaatcgaaaatccaaatgcatatgaaggactcaagtcaaaacatgtcctatgagagtatgcatgcttacaaataagtttacatttttgtcctaggttataaatgaaaaagttttgatttgccctcaaattttattcatgcaagagttagatcaatttcacctaagttttaaatgaaaatttttggttcacaaaattggagaactttcctttcatttgacgaaaatttcttcatcctaaaatttgggtatgttacaggtctcctcttgccacaaatcccttctccaagacctcaaatatgagcagcacagtgaagttagtgatatgccctagaggcaatcatagagatgattgtatcacatactatgtttacatatttatccgacattgtttcttgaaatagataactccttattggttaatgaatatgtgattctttcatgagactctttatgttgtttgttactatttctaaaggatccctgatcgaatatcatatatggaacaaatatgtttatatgatcagcacatgtattaattgatgatcatgtctcatggatcatggtatagagattccaaattaataatgtggacacatgttggtgaacatgttgttggatagacccaacatgagacactgcaagagccatatgtgttgtgtcatcagtgatctcatttagtgttggtgttgaatccttagacctgagattatcatggttctcaacatatgtagtagcttacttagggacttctaaacgctactccgtaaatgggtagctataaaactagttttcgggtatgctatgaaacatgtagtgagatatgaataatcaagatgggatttgcccctcctatggagagatatctctgggcccctcgatgttgtagattatggaagtgcatggccatgccaaaggtaattgaggagtcaatcacaagttatataatctatcaacaggttcgagtgaatgattgagctattagaggatggcacatatctagccttgagtttaatcgatatcatgaggcaaaggggttcatacaagtatacactagaggttcagccgatatgatctttatgtatgcccggtgggtcaatatgttctgctaggggccgctgttgacgcgtggaccgaaaaggagttttcgggttacagccgagtatatatgaacctatagggtcgcacgcttaatgggccggaataaggggattggatggagatccaatatgagcttacttcggatagggatccgaataggagtcctacgggccttggaggcccgagtgatggatcctatatattcatgaggggtgtgaccggcggaggcattgcatgacgtgagaaaccctagccgtcactttcctccccgagcaaaaccctagccgcgcgcgggtgctagcatatctgctcgtggcgttccgtccctgtacgtgtggataccggtagaggcgccgctggtttgcggtgctgatcggcgtgggattacggcgaggagaacgcatgaggaggagaaggtcgagttggtgcgatcgactacttcctctacatcgacgcgcgctacttcgcgagagttccttcgacttctcagcgtcttcttccgctgcacagcgcatcgagtggtaacgatctatgatctaatacttgcatggttcctggtttacgcgatagaaaattttgatttatgctatcgtagcctacgcgtatcccaacaggtggcatggccagtggttgccgacggctgtagttgagtggaggagggcccagacagggttgagtgtggctacaacgttgtggatggaggagtcaaggaggacttcaggtgggaggtgtcggtgctggaggaggtgctatcatctgcggtgcccataagagcacggcgggacctctagattgcggcggcactacaggtggtgcagcgacgatgtcagcgagtagtggtgctgggcgtggctatgcaagggcatagccatggacgccgcgacaacaataaggagggtgttgccgtcatcgatgcggacattgcctccaccttccctcaaccagtcctccccactccaatgctgcaataggcatctatcctctttggtgccatcactgccatcatccactctccaactggtggttctccggccctcccaagcactaccgctgcaaaacagcgaccccaggccaccacttcggcactccactcgtggtcctcgcaagaccgagttgtaggccaaaccaagaatcccagccattttcgtcgttgactggactggatggacaataacctcttcgaggcaaacttagtccttctgcatccacattgcattgaaggctcctcctcttttaccttttcacatccttctgcctcctggtgttgtttgtaagtcgtgaccacaatgcgtgatgcatgcatggaaggtgctcgatgaaatgcttcctcaatggaaggatgcatggtggtcacaactaggagatcagtgtttgtggagggcaatgccgtaggacagtgcaaatggcggcacaaggcccatggttagtgcctcctcccacttggcttgtaattcgtattgcaggcaatccattgagctggccatgtacatctcagctttgccggttgcaattggtattgatatctagatttttttagtgtttcataatcatctagctcgctagagttgttctggtaggcaagtttcctgaatcttgagaggaacaattttatacttatatatactgaacttcaggtaatatctccaccaggtccgcctatataagtatacctttttcttgcctaaaatgtagctttctttcttacatatttgtacctagctatgttcatcttcattctctaaccaatgcaattcagcatatgcaaacacactgcaggttaaaaagtagtatttggagagacaaaggcaattcagtttgcacaggcacaatgcaggtgaaatgcagtcacaatcatattacatggtgggatgtttgtgaatgtcctattgggcttcctctattgaatatcaacgataacttttttcccgattatactcatgttacatggtggaatgcacttccagggtcaggctgtattccaaaatatggctttgtgttgctgagttatatgcttcagcactctcatgttgctttcatctaatccatgtaagcattctaacttttttgctctggtttctttttctgcaaactagtttctgatggaaaatttcttatcgctagaaattgtcatgtaatctccaatgtgctctagaaatttcagattgagctatttgaattttgctatgttaatttgaagaatactattctaaagtggcagcggattatcataaccagctacctcaaactattcaattgcagcacttaatttaatcatctaatttattcaatgtgcattccaaatttcgcatttcttaatttaatcatgtattttggtttgagttgatatagttgatttggacaattataattgcaaagtaaaattgattttgtcgttgtaaatatgactgaattttctggacaacatttaatgtgattttgtcaaaaacacgatgaaccttccacttgtcagtatagtcctattttattttacttccgaaagtaagaaacgtatcttacaacatatttgactgatatctagattttttagtgtttcataacatctagctcgctagaattgttcttctaggcaagcttccaatattcttctaatgttcccaccatacatggagaagaactccaacgcacgcttctctagcagcttgcaatagctcttaaccatttcttcgtcaactcctttaagaagtaaaggccaagtccttgcccaaagcgtccccatgaaaatgacctgtaagaaagatataggattggagccattaaagaccacatagttcctatataaccaaattgcccaaagaaatgcagctatccccacaaacaatattatcttgagcctaggttcaacacaatttagccaattctcaaacatttgagacatgctacacggttgcctaatcccaaaggtaaaaaggagcacactccaaatatacctagtcattgaacaatcaaattaagaaaaggtactgtattgtttccttagagctacaaaaacaacttaggctaccgttccaccttctctttgctagattattcttagtgagaattaccctttccttgaggtaccacaagaaacttttgattttaagtggaatcttgagcttccaaatgaaattcttcctaggaactaccccttcatacatgagcgacttgtacatagattatactgtgaaaataccatctttattctttttccaaaagaaacgatctttctgatctgtcaatgcagtgtttacaacctttgacactagctcataccaggcttccaagtttcttcccactattgatcttctgaaagagacatttaacgagattccactcattaccttggccaccatctcatttttatttctaactagactgtaaaggttaggatactccttctcaaaggattgaactcctatccaacaatcttcccaaaatcttactcgtgagccatcttgtattaagaaggaaccaatcctttgaaaagactctttgtctaacatgagactagcccaaaaaatgcgagtcccctggtcttttttggacttgcaaaattgtttctttgtcaggtatttttttcctaagcaagctttgccaaattccttcttcattgatgtcgagggggcgatctctctgacaatggggagtggagatccctccccgagagtgaagatccggccatggggtttgcggtgagaggtacggatgactgcaatcataaagggttcacggggaccgaccatcctgcgtagagagagagagatagataggaatttatacaggttcaggacacccggaggtgtaatactgtcggagaataaactccatcggggaaccgtgaggcccccctttgtgagttcggccaggggcagcgggtgaaattcgagggcttggtgagcgaagctgtgtaatcttgaggggattcaaccccccaaagacgatgagacaaaaggggtttatacaggttcgggccactaagaagcgtaataccctactcctgtgcttgattgattgagtgtagaacataagtgcttggtgttgcaagactcaagcgccagttcgctcggagctcccccctccaccactaggcctggacctccttttatacctcaaggggttaccacatgggcccaacaacctaacctagctccggtagagaagtattataatctttgcattaaatgcatgtcttgtctcttgacttgggaagccaagcgcacgtcgtcttgatgatggggcctgtcaaatcttgtcgcctgacacggggggtgcccatgtcagtcaccatttaatgggtgaagacttctgggctcctattacaccggaaaacgggagccttgctttgaccagagcaggaggaccgactccggctgggataagaggatgagaacctctcaccatcattatttgatgggatatgtcgggctgcacgtcgcctgacacacgcgatggtgcgcctgacatcctgggtcccatcagtcattcgaccggtcatagaccggttgagtgcactgcacaccgcattaaatgcggcgtagcgcgaccgctcgggtcgccataaatgcgggtaggtgggcacctgtaggcggacacctaacccaccgtacgtggtgacctaaagagggggccggaggagcccgacccctagtcacaggaggggcagtcgtcacccgaccttgggcccgatcccccctcgggggagggccatgtggcacctggggtagcctcctccgtccaatctctgggaaggagtggccgccaccctatctcgggcccgactcccctcggggagggccacgtggcattggggggcagcttcctccgactagtctttgggaaggagtagccgccatcccacctcgggcctgactacccttgggggagggccacgtggcattagggggcagcctcctccgtccaatctctgggagggagtggccgccgccctaccttgggcttgactcccctcgggtagggccacgtggcattggggggcagcctcctccctctaaacgtgatacccccgggcccatattaccaacagtagcccctggcgttagccctgaccaaaacctttcccaggtggtctgggttgacgccaatctgctagtcagttgacatgtgggcccgatcttctgtcctatcaatctgggagttgggcggtgggagtttagtcacgttcatacgtcaccttaacttcccactttcctcccggtttccgaggcgctgtgggcttgggagtttagcccataccttaggccgtgaacttatttcctatatatattcagcaaacgttgttagactctctcgggcccgtgaccttacgccgtgtacctcgcttgcccctgcctcttgttaacctctattcgtgttctacttcatctattcaaacgattatttttgcgtgagcatggggactgaactttccatagtcagcaatctttacccgcgatcaagccaggatgggcgccgtagctagccagcggggccaaagctagctgctacggaagagccagcacaaggggccccgggctatgacggcgaccagagctcgacgcagggctaggattgggctaggaatcgtagcccccacacttctagcaaagagtcgtttgaatggacgaagtgaatacaaactttttgttaccaagggaggcaagccagcgcgcgacacgtgggtaccgcggaaccgcgaggaagagatgggcgagagataaacataagcaataataattctatgcaaactatcatctttgcgcgagtgcgaggactaaattttccatagccaataatcttcacccatgatcaagccaagctgggcgctgtagccagctgctacggaagagccagcacagggggtcccagacgtcgacggcgcccagagctcgacgcagggctaggatagagctaggaatcgtagcccccacacttttagcaaataatcgtttatatgaatgaagcaaacacaaaccttgcttgcatgtcgcgacctttcaaacctttagcttgaagagggcctcccaccattggtccctaaccactttgggaagcctgcgaccacttagcaaacgaggtcaggttcccacgagcctgtgtcctcacgctacacattctttttgctctttcctttcggtggcctccttccaatatctctcccttctacacggacgactactttcgcccgagtgtgagagccgaaaaactctagagccagcgatccccgtccacagttgagctaggccgggcaccgtagccaaccggcgggaccaaagctagctgctacggaagagccagcacagggggtcccaggcttcgacggcacccggcgctcaacttaaggctagaatagggctagaaaacttagcccccacacttagcgaggaaacgttcatgtagatgggagagaggttgggcttttaccaccgagggagcaaacaaacgcgcaaaacgcgagcgtcacagggccatgagaaaagaacagggggaaaataaatataagacttcaagctgtattaagctgatgaattgaaaaattaaaaatacttgaagcttgaaaggacgattagttgagccgggccgagcaccgtagccagccagcgggaccaaaactagccgctacggaagagccagcacaggggatctcgggcttcgatggcacccggagctcaactgcaagagtcctcccaggagtagaccgaggcaggtggtaggttcatgagcgatccccgtgcttggccctgaagggccatggggaagaaactcgccttgacccggtcgtcaccccacgccgcctctatgatcgtcgtgtggacctggagggactcggaggggttgacgctaccgtggtacctttcggtgaggctgggccgaaactttgggggttatccgactttccgaagattcgccataaagacctggccgccagccttatccggtgaagatgcggggggcctagccccctgcctggggtggcgcggcactcctgaggaagctgccccttcccccgcattggcagtgcgacgcttatcgcgccagcgctcgaaagaacctcaaaaatcatgaatgcaccccctacctggcgcgccagatgtcggagaataaactcctccatcggggaaccgtgaggcccccctttgtgagttcagccgagggcagcgggtgaaattcgagggcttggtgagcgaagctgtgtaatcttgaggggattcaaccccccaaagacgatgagacaaaaggggtttatataggttcgggccactaagaagcgtaataccctactcctatgcttgattgattgagtgtggaacataagtgcttggggttgcaaggctcaagcgtcagttcgctcggagctcccctcctccaccactaggcttggacctctttttatacctcaaggggttaccacataggcccaacaacctaacctagctccggtggagaagtattataatctttggattaaatgcatgtcttgtctcttgacttgggaagccaagcgcacgtcgtcttgatgatggggcctgtcaaatcttgccgcctgacacggggggtgcccatgtcagtcaccatttaatgggtgaagacttctgggctcctattacaccgggaaacgggagccttgctttgaccagagcgggaggaccgactctggctgggataagaggatgataacctctcaccatcattatttgatgggatatgtcgggctgcacgtcgcctgacacacgcaatggtgcgcctgacatcttgggtcccatcagtcattcgaccggtcatagaccggttgagtgcactgcacaccgcattaaatgcggcgtggcgcgaccgctcgggtcgccataaatgtgggtaggtgggcacctgtaggcagacacctaacccaccgtacgtggtgacctaaagagggggccggaggagcccgacccctagtcacaggagggggcagtcgccacccgacctcgggcccgatcccccctcgggggagggccacgtggcgcctggggccgcctcctccgtccaacctctcggagggagtggccgccgccctacctcgggcccgactcccctcggggagggccacgtggcattggggggcagcctcctccgactagtctttgggaaggagtggccgccaccccacctcgggcctaactccccttgggggagggccacgtggcattagggggcagcctcctccgtccaatctctaggagggagtggccgctgccctaccttgggcccgactcccctcggggagggccacgcggcattggggggtaggctcctccctctaaacatgataccccgggacccatattaccgacaaataccttactcctatgttagtgttcattgtcctccctagatctggtaagtacaaaggaggccatttcaggctacaaagcaagagtactgctctaaagagtccaaccccttcatcagtatctggtccccttccttttatagtccaaggagctcacattattaccaatctactcttaatcttgtcttatcagccgtcttatcgctactagctggttcccaaacacagtcttgaagaaaccctttgagtcttgtgattcgtattaccccaggctcttgggctccgtctgagatagttgggtcttcgctagtgtgctcaccacgtggtgcgtggtgggccggatgagacccaacctgcctgaaatagcgccacggatgcttctctacctgtttggctaaattaggtggcgcagggcatgtgcgacgcgtgtccaaggcgccaccggtcctaagtgactcaacgctggcatcttgtccacatctttttgactccagacgggttggggatcctacacaaatttatttcatttatggcagggcatgctgcctcacagctagctgtggagcatgcctaacttctcgagttctgacaccgcgtttaaagaaatagtttagttattcttggatgagcttctcgaagatgtcgttaatgaaggaatattttaagattatgtatcatgtacatctcgatgctcctctaagcagagtgtcacgcccagaaattcactagtaatttctgaactaatttgtgcataaaatcctcgtccaggaatcagccgaggtacacaaattgataatttaatatacatattcatcatactaataacgttacaaacttacaaaagaaaagagaaaacaacagcggaattacggtctagcgaagctcccgctctactcccacaggcagctcaactggggtataagccaaacgtcttctccttctggatccttttttattccactgacgtttgattaattattgcaaggtgagtacaaggaatactccacaagccacacgataagtatgcaagtgcacaaggataccaaagaatggcataatatagggctcatctgcaaaagcagcatttagcaaacatttgagaattgtaaaacagtagagtaattaatcatcaatattaatcaacactgaacagcatacccatgctgcacaggcccaaccaaacctgaacaaccatactaggctgtacagatctatctccaaaccaggaatgtaccattccaaaccaggagctaatcaaattattaccatcaattaccacattattattaatgagtagtgtgggactaatcacgaaagacattgttagagccgcccataaccgcgggcacggatattcgaatagttttactctggccaaaggtgtaccactgtacccacaagacacaactccacaatatgtcaccatatcatcatgtgcccatgctgaacatgtcaccatttgtgtagttgtgacaagacccctcacatagctcaactcaaagcagcgcacctttcctggatcgtagtcaccgcctaaaaaaaaaccagaggcatggactccctagcgacccccgtggccttatctccgccacttctcagtctggcacaccacaatgagccttgctatacaaagtgtccagccgttacctattctggcttgtggttggcacggttaatgtttcacaaccggaactcgtgaaccggtccttaattgtcaagagcacgaccatcaaaaccatgtgctcacaacccaccattatcaagttttagttggcacattaattaattaaccaatcatgattgaccatcgtgagctacctttaccatgtacatcattaagtaatagtgaaatattagttatcccaatagtgtggtaatgtttctaagcatggctaagcaattatatctaatatatctagttgaaccaatatataaatccaactagtcaaattataacccgatgtaatcaagaaatagggtaatcaatgcaaattggccataacaaaggaattggttcacaccacctggtgacatttgaaaataaatgcactgttgaaataaatagagaatttaaatataggatcaacatgctcaaaggaattgtgtttgggatctatgtgacttgccttgcaataaagggtcttcaattaatcttcttgaatacttccgatgcactcacgaaccttcgaaacgacggaaacgacaagctaaaatgcaaagcaaggaaaaagactaataaaaaccaaataaacagtacatatatagtaaacaaacatgtagatcataattttagatgaattatgagacttgaacggcttcattctgacttcatatgaattagttcgaattttacaagatttaatctaattaaagcctatttaaaaaggattaaataaatttaacacaatttatggataatttaaatatatagatctttattttatacaacttttgcaacttgaaccacattaaaccgagttacaatgaattagttaagaatttctaaagattaaaccgcattaaagcatttatatggattttaattgaattatgatgcaataaagaattattctgaaaagaaaaaggaatttattgcgtcatcaaagacggtccacggtaaaccgggttcacagaagcggtccacggaaccaacgaccaagatctaattgacctaaaattgaccgaatcggacggccgagatcgatccggtctaccacgggtctacggctgacatcagcaatgacattagcgatgatgtcatcgccgacggcagcttggcacaccatgctcaccggcaaacgacggcgcggcggtgcaaacggagggcatctacgcgtaaagcgcgacgcgacaactcaccggtggcttggacgacgacggcagcgaggtcgaggcggcggcggtcttcgggtcgtcgatggcggcggcgctccggcagtctttggcagaaacggaggacgggatgaggacggtggcgaccttgcgaacctggcgatggccttccggagcgacggcggtgactggagcagcggcggcgcttggctggactcgcggcagcgacggcggcgcacgggctgacgcggaggcggcgctacaagcgacggcgggctagggcgaaggtggcagcgaaaagaggaggtcccaggggtccttttataggggctaagaggcggcgatggaggcccatggccggcggcaaggagatggaaggtctagggttagggaatccgaatcaaaatcgaatccgagctatttccaaacaaaattagctaaagtttctataggggaaaagatagaggagatcaaggggatcctttcccgtctatcaatttgatcggagaaggaaaggggtggcccgatttggaaggggtatcggcggctgcgtgacatggttggttgaagacaaccctgacaggtggaagaggagggagggcacggtggtctgggccggcttgggccgggcgcgagcaggccgaaaggaagggagagagagagacttgggcagactttcggcccaaagccaaaagagagatttaaaaccttattcatgaaatgatattccgtttattaaaaatacttcctttactcaaataaatcctagaaaaatctaggaactatagaaacaagagaagtatttaataaaattttatctagcccacttttatattgagatttattcaattaaaattagatattctcttttaggcttttaagataatttctaataataacttttaaacaacactttataatttaatgatttttaaacaagcaaatcatttaacttaattataattagatcattaatgattaattggctgattaactaattactaaaatattgtttgtattgttaaacttaggaattgagctctgaaaaattcgagaaaattccagagagtataattaatcatggagaatttaataaaaattaaatccagccatggtttatatttaggaaattttatttcccacatttaacttcacttgtaaattaatgaacatttaatataaattctattaataatttattaaataatttataaatcttgaaacgggaaatcaggctgtgacacagatagatgtgagctctacaaggaccaaggtgagctcgggacccaggacaagttcgggaccgaggaagaccttggctcataatcttgttggtataacttcatatgtcttcaccctccaccccatctagaaagtgtgacttatgaagactgaggtgtgccctatgaagactgaggtgtgctcggggccctgaacaaggccgggcctgaggcaaacctcaccttacatctttatgttttgtacatctcgacactcctctttctcgagtagtgtgtgacttgtgcagactaaggtgagcgcagggcccgggataaggccggactcgaagcagaccttagctcgttctcttaagatataaatcttgtaggtttctacgcccctcttgatgaggagcgtagagcaaacaaggactaaggtgagcccgggacccaggacagggtcgggtccgatgcagaccttaggctatattcttaagacgtatttgggtatgcttgggaccaaagcccagtgccaagctactttcatgcttggagttttgagtcattgtacatatcatacgatgttttcctccttacccagggataattccatatatgaaagcttaggtgggctcgggaccctagctacgtcaccctagggttatctttttatttttaaagatattctgagcatgctatttatttgataatgatcgttttgctggataaatgggtacccctgttctcatttcaccgacaattgatcaactttaaaatccatttactaagcatacacttgttttgcatttctaggttttggatttccaacccatcacatcccttaggtctgcacaatgaactccatttagctaacctatacttctttttatgctcatcacattgccaaaaaatccggatctgtaaaaatccagcttctttaaaattcctctagggatttcaaagaaagaaagcataaatgttgccagactactcaacactgaattaatgagcaccagccttcctcctgacgacaaaaacctttcctttccaaccgctgagtttctcctggaatctatcttatagatccttccaatctttgtttgacaatcttttgaagtggataggaaggcctaggtatctgaatggaaaagttcccatcctacatccaaacaaagtggtgtaatccttttccacctccttatctttcccaaaacaaaacatctcacttttatggaaattaattttcaagccagatatcttttcaaaggcagttggtaccaatttcaggttcttagctttaaccaaatcatgttccataaacaagatggtataatttgcttattgtaagattgagagaccattgtctaccaaatgaggaattactccatttagaatctcaaggtcacgtgccctattgatgagaatggcaagcatatctgctactaaattaaataaaattggtgagaggggatcccctgtctgaaaccctttttcattaggaaaaagtggcctatctcatcgttaaccttcacagctacgctacctccagacacaatttgatcaatccacttgaaccaaatgtagaaacttttcattctcaacgcttgttgaaggaaattccaattttccttatcataagatttctcaaaatagagtttcagaataactccatctgactttttcttacacatctcatgcaatgtctcatggtgaattatggccccttccataatatttctacctttaaaaaaagcagtctgagaaggtcttatgactttctgtgctactagagcaattctatttgccatgacctttgtgaataccttgaagcttacattaagtaaggaaatgggcttgtattgtgtctattttgcctctttattctttggaagcaaggtaatgataccaaaattcagtctatgtagggtaactcgccactgtgaaaatctctaaagatagccattaagtcttctttaattacttccctttatgttctattaactcagctgggaaaccatcaagccccggagctttcttatgttccatttggaaaacaacatgtttcacctcttcttctgtaaattcctttgttaagaaattattttcctccattgacactttagggatatcatccttttgggattcaaacatggagaaacaatttacatccggagctccaaaaagatccttatagtaattggtagcgtatttcttgagttgtgcatctcccttaatcaccccttcttcttgttctaattgaaaaatctgtctctccgtgttctccattcgcgatgatatggtagtatttggtgctcctgtccccttgtactattctttttgtttttgttcattgatactatttagcttcttcttctcttaacaactgggctaaggcatttttacatgatttttttagatccagttcttgactagtcaagatcagctaatttgtccaactcatctgcctttgctataagttgagctttctctttttgtatatgcactacttaaattctccacccatcctctcaggaattgacgaagcctgcatatcttattttgtcatctttctatattcgttgccccttgaatatcctttgaccaaatttctaccaaaagattttgaaagtcatcccttaataaccatcccaattgaaattcaaacaaaggttgagcatttctatgtgtcccttttcctgtgtctagcaccaatggtgtgtgatccaaaagatcgctacagaaagcatgtactgtccggatttcttatttcccactcggtacttaccaaaactctatccaactttttgtaagttgggctcggcatagagttggcccaagtaaatttgcgtccggagagcaagatctccctgaaattaaggctgtgtatgacagcattaaataagggccatctatcattgtaagttagggatgaacctaggaacctctagcgatgttgtttcagattccgtttattgtttaaagaagggtgaattagacaagttggggaggttagaggaaaatgagcggtacaatgatgaaaattgggaatatttgggaatggagaatgtagtttgctagtatgatgaaaattatgcttgtcataacttgtatacattatgctgtatgtgttggaaatttggtcataattcggcatattttaatccaaaatattaagacaataaacatgacatttgcaatatgagtagatctagtgatagtgctagatgtatacaacttgagcatgcttaatatgaaataagcatcaacatttacagagtaacacaatgctgccattgcgaagaacatcaataaagaaacatctaatagaatcaggagaatgaaagtataccctaagaacgtcccaccgctggattttgaggcagtattgcctccgttgatgtcgttcacctccttgtctccaatctccatcgacatgttgacgaaggcgtcgatgcaataatagtagtcgcgaagaacaggagcagtcgcacttgaagcgctacccaaaaacttgatcgcccgcctacccgtgcaagttctcaagcggacggagtttcggaggcacctgctcgtcccatacacctgtgcgcgcaggtgaacagaaccagggaaggattctgcagctcaggaacagaggaggaggaactcgaagtgcaagagtcgtgaagaacttcctcagtccttctggtcgctgcggagtatatatatgcgagcgcgagagtaacgttcagagtcatcaaccccggtgtttaatttcgtaaccgacgcgctcgttaatacggaatcaattcacgacgtttaattccgtaaccgacggaatcaattcacgacgtttaattccgtaaccgacgcgttcattgatacgaaatcaattctccatgtttattaccgtccgttacaaaacgagagagcgcagcagtagcagctgtctgcctcgcctcacctcgcctcgccccgcctggttgtccgcgcaccatctcaaccggtcaacagagactctccactagctccgtatttaagttaagacctcttcacttagatttccgaggtggtattattacccatagcacttaatgtgggccaatggaatatattaggatttaattgggcctagcccattaatttaacaatccctaccaaatttcatggctcacaggaaatgctctcgattctgatcctgtttgttataccagtgtttcggtggagactgttaggatgaacttccacctaggaaaagagctacaccagatcacaactgaacaatggactatgccttgaattgtcagtcttgtgcgattcaggtttcactcaaacccttaactggtactaggctgccgtttgcatcccctctgtttggagcgtataagtcatactcctgaccttttcatgagtatctagagatcacccagatctcatagactgtgactagcagtcagactcatataggtgtgttccttctaagataaaaatgggggatccact

SEQ ID NO: 71448 - DNA, 15111 bp, Oryza sativa
  unsure (1)..(15111): unsure at all n locations
acacaaccgagcaatgtcgaaacattcgacagcaagataacactcaagctccaaggcagtagcaagtcaaggccgaagaggcgcctcaggaagcggctcttgaccaaccacgtaagccgaacagcgccaggatgcgcagcgaagagtgatccaagtcatcacaagatttgatcccccttcgcaatcgtcgaaacgcaagaaaaaaaatgcaacttcgagcagtgcacaacatcgtttcggcaagcgaaggggccttgaggcatttggcgcagcagatatatttcagacaagaggatgccgaatgagttttgttcccacaccaagacccactggtggtatcggtagaaatagtcggttttgaagttcgacatattctgatcgatggaggaagctcggctgatgtcattttcaccggaacatatgccaagatgggactaccaaccctggcattgtctcaagcactgactttgctccgaggtttcgaaggcaaggccgtgcaagttttgggtcaggctctcctgaaggtctcctttggcactcaagaatacaagcgagaagaagagatacttttcgacgttgttgacatcccatacaactacaatgccatcttcggccgaggcactttgaacaaattcgaagcagtctcccaccacaactacctcaagctcaagatgccgactacaagcgaaggagataggcggtttaaataaaaaaagacccaaaatttcaaacatgtatctagaatcacaggaaaactacaaacaaaaatagtgaaaattagctcgttaggaacccatccaagattgttatagacccaacgaattagtagttcccaaccgcgggtggagtaaaacccaacaaaaaaatcagtaactaaaagaataaaaaagcttttactgagtcatttaagttatagaagaattcctgaacccaagaattcaaaataacaagttccactttacccagaaaaaaagaaccacttagaatagccaaacatattatatttgtcgagaaatgcaaaatgatatggagatgacctcattatctattttggccaattgtattatttcctggtccggccattgggattgttgtcaaggggctctagccttcggctggttcagtggccccattcgacaaggaagtgcacactgtcgacgtcgaagggcaagaaagagccagactagtgccgaagcccgctccacatggcaaggttacccaggtgcagatagacgatattgaccccaccaaagtcgtatccccgtggggagatctgggcgagcaagaggtgaacaccatcttggctatgctaaaaaagaacattgatatcttcgcttggaagtgggaggcgtttcgcctgacctcatcatgcactacctgtcagtcaagcctgacgcaaagccgaagcagcagaaattgagaaagatgtcagcggattgccaagaggcggcaaaagcggaagtgcaaaagttgctcaaagcaaggtaatctaagaaatcaactacccagactggttggcaaattcggtactggtgaagaagtcgaacggcaagtggcgaatgtgtgtcgatttcacggaccttaataaggtgtgccgaaatgatgacttcccttgcctcggatcgaccaactggtcgattcgactgccggatgtgagctcatgagtttcctggatgcatactccggatatcaccaaattcacatgaacctagcggacatccccaagacagcctttatcacgcctttcaacaaattttgccatctcaggatgcccttcggcctgaggaatgttggggctacattcgccaggccggtatacaaggtcttagtaccacaattggggcgaaacatcgaagcctacattgacgacattgttgtaaaaagtcgcaaggctttcgaccatgcgtcagacctgcaggagacattcgacaacatccatgcggctggcatgaaattgaacccagagaagtgtgtgtttggtgtttgcgcgggtaagttattggattttctggtgtccgaaagggggtcgaagcgaaccctgaaaagatcgatgccattcagtaaatgaagccaccattgatgtggacatcactccttcggatacacacaacaatcctccaacggtcattcaaggactgattgttggcaactttttgtgacaagttgacaaccacgatcgcagcacctaaagctttgcggtgatagtagagtcgccaaccacctcaatctagcaaaagctaaatcaagaagggtttcgataactaaactggctagcggagccgattctagataactacccgtctcgtgggcaaaacggaaggttttcaggacaaacctacaaagagggtctcgcactctcgcagcggcggtggaaaatttacggcgcaaattgacaaagatggacaaactaagagaaaactaaaagcaatatgaaaaacgattcgattgattgattatagattggttgttacaatgaaccagccttatcccttatataggggttggtcttgccctctacaggcccttatccacatctaactcgggatagaatccaaaggaaacccgaaacatgccttcccgagtaaggaaacttcgagacccggcgaaacagtcctggactcggactctgtcggtcaaaccggccacacaccgccggtctgaccggtcttctagcggcggtctgaccagccaacatatggcggtcagaccggccctctctggagaaaaccggcacaacctcaaagtttggcaacttttcctatttcgatcctaggtgccaaatttgggtgtaaacacatgcctccctgcctttttgatgaacaacatgaatctaaaagcatagaacatgttttggtcataggacgataatccaatttccggccatagaaactcctaagcgtcttgcaaaacacttaggaagtatttcttcaagtatttcccgttgattgcccgctgaaaacgctctccttgaagtgtctccaaaaaatatgcgttccctcgaacaatgccgcatactcgataaggaccttcccaactaggagaccactttccgaactctctggatcgagtacccaaaggcaaaattgtcttccaaaccaagtctccaacttgaaacaactttgctctcacccttcgccttcaagcgcttgtcgatgacttcatcaaggttgtctcccatcaatgtcttgtaatcttcacttgataaatcatcttgtttgatataacgaagagagccaagattcgcctcaactggcaaaatggcttcttgaccataaactgactcaaaaggagtgactttagtggtaccatgtttagatatcctatgtgcccacaatgcttcagaaacaacctcatgccacttctttgggtgttcctcaatctgctttcttaccagcttcaacaacgttttattactcgactcggcttgtccattagcctgagcgtagtaaggagaagaactcaacaatttgataccataggattcggcaaaactcttcagttccttagacatgaaagaagctccttgatccatagtcaatgtttgtggaataccgaatctatggataatatgcttcaaaataaagccaattacctccgtatgagtcatgttcttgagcggcacggcttcggcccacatgctgaagtaatctgttgcaactagcacgaacctatgcccctttgatgacgaaggataaatttgaccaataaaatccaaagctcaacctcggaacggccatggtttgataatagggttcaacacggcggcgggcgccaattgaacattgccgaaccgttgacaagcttcgcatcccctataatatttgaagcaatcctcaatcatcctcggccaatagaaccccgctctcccaattaaccaattcatcttatgggccgattgatgagttccacaaatttcttcatgtacctctcctatagccactttagattgatcatcatccaagcacttcaatagaactccatctatatttctgcgatatagatctccatcaagcaatgtatatttgaacgcttgcaaccaaatttttcgatcaaccttaagtgtaagatctttcaaatatttaatcaaaggaaccctccaatcttcttgtatttcctgggtacaaacgtctgaatttacaattaattcggtctttgaatcaattgtggcatgcccccaacttcctgtccagaaacggtcagaccgactatgcaaggccagtcagactgcccggggtggccggtcagaccggcggcatatggccagtcagaccgcccctggtcacaagtcagaccggccatgtaatgccagtcagaccgcacctggtctctgattttgccaatttcgcacaaaggtttaaaatcaagcaccggctcttccaatatcaaaaatactcctcttttcacattatagccagatgcttgttgtgctaagtcatttgctctagaattatcacgcctagcaatatgtctaattgaaaaattatcaaaattggcaataatatccaagcattgatcgagatacctatttattgatccgtccaagcatttataagctccggcaacttgttgcgccaccaattccgaatcaccaaatgcttccacgtgtttagctccaaccattaccatcacttgtaagccaaataataaagcattgtattcggtttgatcatttgtacaataatattccaaacgaactgatgcctcataacacatgccattaggtgaaaataaaactactcctatgccttgaccctctttgcaagaagaaccatcaaaataaatcttccaaggtatgacttcagtaagcaaacctcttcttcataagcaatatccacatgatggtctactataaaatcaactacaatttggcctttcatagatttcaatggttcataagccaaatcatattcaatcaaagcacccatttgccaattctccctcttagaattggcctttacaacatgtgtttaataacatcggcttaacaagcaactatgcatgtactagataacaaataatgccgcaatttggtacaagcctagtatagacataaacaaagtctctataaagacatacctcgtttcagtatccaaaagatggcggctcaaatatgtaatgatatattccttgccatcttcctcttgtgtcaaaacggcatctatgacttagtcttcggaggcaatatataaccgaaatggcattccggctttaggtgctcgtaccacgggtggagtagataaatacttcttcaactcctcaaatgcctcttattgttttgccccccaagtaaaatcgacttcttttttcaaacgaagtataaggacaaaagcatcgatattacccgctaggttagaaataaatcttctcaaataattcaccttacctagcaatttttgaacttccttcttgcatgtcagcgctttgaaatcacgaatcttttctatcttcttaggatcaatctcaactcctctctcatgcaccatgaatcctaagaacttccccaccgatacaccaaaaacacatttaagtggattaatcttcaaactataccggcgcatcctctcaaaagctaatctcaaatcggctatatgtccatcaaacccatcgatttgaccaccaatatcatcaatatagatttttaagataatacctagcaaatcatggaagatcaaattcattgccctttgatatgttgcaccggcgttcttcaatccaaaagtcatgacaacccactcaaatagaccaacaaatcccgggcacctaaaagccgtcttgtacatgttgacggtccttaaatcataatatttgaccgtcaatacctgcatataatgaaataaaatatggtatccaacttagtgtagggtttattactaatcctttccactactgttggtgaaatatgtgtatgcaggtaatttgaggagaaaacacatccgtcatgtgacaaaatgtacctccgcattcaggacgcgtttacacggattagaggaccaataagtcaataaaaactatttagaattgggccaaaacatagcctaggttattcggggcccattaagcaacctcccggctgaaggagaggctgggaggacacattttgggttcggncnaaccccngntcngccgaaccagttctgcggccgttcatcgcaagattacacgtgtacactcctgatcacctgccaatggcggttccgtggcattttggacatttcacataggctgtaaccgtcatacctgcctataaaaggaggagctcactcacattccaacatacacaactttaaactgaattacaagaggctctattgtatcttttgtacattagagtaaggtaaagagtgaggggaagctctggaggagtgcccagaaagtttggcgctctctctgacttctttctcgacgagtgtagcttcctaggaggaattctagaggagtaccggagctgtcggtacactctgctccgggttcggagaaacttcttctataaagtaagcattcgttttcctttcttatgttatttaattacttactctgagtaagttatatttccatctttgcaggttcattgtttagtattcatactaagtgctttagtactcggactctggataaagaaggaagttcttgtataagtattagagtagtaattaataacttagacgtgatgtctaggttagagattacctttgtttgttgtgtatcccacggatttctcaaaggtaggcgataggtggtggcagccctgaattccgtcccagtaatcctccacgttcggatacatcatagagctatagccggaaccacgctggcagaccagcaggggtcggtgcccgaagcaacagatatggaattacattgcttagcgtagataattaaaatacatagaaagtcctctctagcctagcctacctagcatcagttgttgtccttggatagtcttagccttgggtagattacacatgttccctgagttcgatatccttttggggtcacccgaaggtgaagtgctacagcagtattccgtgagcttgcggatttatctgtggtcgtaagaaataccaatagtacatatcctcttccaccataaaaatttgattgtagccggcattaccatccaaaaaactaatcaccttatgacccgaagcatcattaatcatcatgtcggctataggcattggatattcatctttcggagtagctttatttaaatctctaaagtctatgcaaactctaatcttaccgctccaattcttttccaccgggactatactagatacccactccacataatgatatggcctaataaaccccgctttcaatcaaccgatcaatctcctctttgactcggtcatatagcaaaggattgaaacgacgaggtggttgtttataaggcctaaaaccctacttaatcggaagccgatgctcaccaagatcacggctaagacccggcatctcatgatactcccatgcgaagcaatccacatagtccttaagttgcttgattattttaaccttataatcggctctcatatttttgtttacaaaagtcggccttgggtagattttaacctatttctacttcttccaacggattggccgatgtaaacccttgaccaagcttctctacttcatcaaaatcttcaatagtttcaccaatatcgttctttgtagaccgatattcttgcacccttttttgaaaccactctaaattagcttcttcactcattacataaagtaatatggcctagccgtgcttagccggctttatagagataggtacaaatttgtcatcggagatactaatgaaatcataactagaaagattcctccccgataagcattgaatattcccatgacaccactcaaatgttgcatcggccatattgcaacctcgaccaatgtatctgcttgaacaatttcaatatcaccgccgtccctttgaattaagcattgatgcaaggtagaaggcacacaacaattggcatggatccaacaacgacccaaaataacattgtagttaccttgcacatcgacgatgaagaaggcagtgggcaacgtcttgtttcccacggtaagttccaccgaaaagataccctttgcttccgttggttcaccattgaagccattgagaatcatgttggtcttcttcaactcatcatctccacgtcccaacttcttgaacaacgagtatggcatcaaattcacggcagcacctccatccactagcatcctagagactggctacccatcaatatgacctttgagataaagaggcttcatatgatggtttgactcatcgggcttctcagtctttaggatctagtgaaaattgagcaacctcggcttcatccatagcacaaaactccataggcaacatacacaccatgttgatatccatgtcttcctttggagatgaattttctttagcaaccgattgttcttccttttccttttgcacaacaaccggtttttctccatatatggatttatgcctccatacctttgtacgcggtggtcgcaacttgttgaactttctatctctttcctcttcggcctctctctctcttaattcttgggcctgaagatgttgcaaccttctcttttgagtagccgttaaatccttaggcattcaccttggtttcggctctattccaggaggtaaatagtgccctctgttgattttattcgaagatgattgtggggtacatggtacccgggtacccaacgacaagccttgggctgcaccacatggggtgggccaagtgccctatgcccatgcggcacacttgtatacatagtaagagataaaagataaggaagtctatcctatcgcttgtaaatagatggcaggtacctagactataagagataccctgccatgtatggcgccggcagccctagctctatataaagagcgctggcggcaatcctaggggggctgcttagttcatttttccaccccgatacagagaacaacacactggacgtagggtattacctcttcccgtggtcatgaactaggataaacacctgcgtcaccatctctcattgatctagcacaccccaaaaaatatattgccgatagtagaaatcgacaattggtgcgccaggtagggggcgcttgatcgtttcttcaaggaggagatggcctcaacaccgtcgggtttgtcgtttttcctagtggctaatgtagattgatatatgattatgcatgggcattgtcgtggttgcctccacgagcggggccagggtgctcgatggtcaccagcatgactaccggccgatccgttgctgcacgtgcactggtcgtcactgcggccaaaacaccctggagtgctgacgcatgctcgtcatcgatagcgtgaagtctttcaccgacaacacacatgcatgggtggatcctgcatctgtacatgcaggagattgatcttggatcatggagacacatcatcaccattcatgttgcatgaagacacgtcatcaccatgcatgctacagaaccatgcgtccaacaccaagaagagcaaatcgaaccaaataggagcatgcaatacatggcaacatggccagccaatcagagaagaaacaacatcatcgcccgcatctgtctcctccgccggtgcacgcagccaccgtcaacaacagcgatgtccctgacctcaccgccgccgccgccgacaagcgcggcgccatcgtcttccactcctgcatcgtcgtccacaccttgaagattgacgaccactaccagactaaggccgtagtctctgcgccactacaaggaagacggccggctgagtcgtcgccacagccacgcccgccgcaagtccgacggcctcagcctcctcgtcgtcaccgcagtacagcaccgtcttcctcttcgtgtcaattccaagcagcagcaccgtcaaggccaccgtccgcactaccaagtccaacggcctccagctccacatcgtcaccgcccgtcgacaagatcattagcagacgaattcaagtagcaagcatgcaccatggccaagcgatcagacggggacacatcatcaccaagcaacaagcatgcaacatggtcaatgagaggaggtcacatcaccaccatactacaagaccatgaaagcaactctgccctcacccagccacgacaatcaagacacaagaaaccgcgcaacatgccaaaggtcttgccttcaacctccacgctaatcaaccaagccccgagtcaggtctacctgcctgatccagcgccctctccttccgccagctacgcaagcggccagcaaccacccggaagttccgagaggctcacagtacagccgtgcctggaagtgataatctcacgatgatcaaaagttcctggaaacgcccaacccggccaagccagagggactttctttcgtccgccccgtaggtggctggcaaccacctaggagccagcgaaaaagtcagagtacactcgtcacaaccggaagttaatacccagccggccatcccagaggaactctcttttgtccgtcctacaagcggccgtcgaccacttagaagccggcgaaaacgtcaaagttcgctcgtcacgcctggaagacgacaacttctcagtcatcaaccattcctggactcgcccaactcggcaaagctagaaggactctctttcgtccgcttcgtaggtggctggcaaccgcttagaagccggcgaaaaagtcagagtacactcgccacgcccggaagctaataaactcccggccatccaccattcctggacgcccccaaaccggccaagccagaagcattccctttcgtctgcttcgcaggtggctggcaacttcttagaagctggcgaaaaagtcagagtacattatatcgacgaccattatcaaagcacacatgaaaccaccaggtcattcataaatcatcccgcagaaggtccaacaaggaagaaaacacctccgttgcatcagcccgtctacgccgacactcctctacaacatcgttagccgcaccgacgacgatggcgctggtcgcatcttctacagctacatctaccaccgtgtttactctgaccacggcaactacatgatcggctacatcaacgattcggcttccccaacatagacaggaggctccatcatctactacaccgcccgccggagatcctcgtcattcacccggctggtgcacttcaccaacttctccatgggcttagggggcttcaccacccgtaccgcctgggtgccatgccgcacgccgggggcttcgtcctacacccggctggcacgcttcgccgacttcgccatgggctcgggggcttcaccaccctcactgcctgggcgctacgccgcacgctgagagcttcgtccttcacctggctagcacgcttcgccgacttcgccacgggctcgggggcttcaactccctcgccgcctgggcgctactccgcccgccgggaatcttacgcctccacccggctggcacgcttcgccgacctcgctacgggctcaggggcttcacctgcctcaccgcccaggcactacaccgcccgccggggctcttcaccttcacccgactagcacgcttcaccaacctcgccacgggcttaggggcttcacctccctcttcacccatcaggcacgcttcgccgaccttgccacaggattactgcgcccaggggctacgccgcatgttaggggctccgcctacacccggccgaaacgactccgctccgggcgtgactactacgccagggggctacaccgcatgctgtgggctccaatcgcacacggccggcacgactccgccctaggcaagactactatgcccaggggcttcgccgcacctggaatattgccacgggcacaagggcttaaccccaatcgccgcctgggcgctacgccgcccgccggggatcttcgtccttcactcgcttggcacccttcgccgacctacccacgaggtcagggtctacaccgcacgctaggggctccgccttcacctggccggcacgactccgccctgggtgttaatgctacgcccagggggtacgctgcacgccgggggctccgccttcacccggccgacacgactcagccctaggcacgacggctatgcccgggggctacgccgcacactgagggctccgccttcacctggccggcacgagtccgccctaggtgttattgctacgcccggggctacgccgcacgccgagggctccgccttcacccagccgacacgtctcggccttggccatgactgctacgcccgggggctacgccgcatgctaggggctccgccttcacctggccggcacgactccgccctgggcattactgctatgcccggaggctacacctcacgccgggggctctgccttcagccagccgacacgactcggccatgggcacgactactacgcccgggagctgcaccacacgctgggggctccgccttcacccggtcggcacgactccgccccaagcaggactactgcgccggagggctacgccgtatgctgggggctccacctgcacccggccggcacgactccgcccttggtgcgactactacgcccgggggctacgccgcatgctgggggctccgccttcacctagggggtgagcgaagacctcggggtcttgcgcatcgagttcgtcaagtcaactccaccccgcgaagaccctagtcatcccggcatggagtcaggaggctaccctaaatctagactaaagtgaggagaattatgtatccatacaaggatgggttgtgaacttcatcaaaacactagagaattagcccaaaatttcgaagaatggatagaggagaactaggggaagacatgggtgaaaggccaggctaggtgggcccagcccagctacgcccgaaccccctagttcggctgaaccaccagctccaccgttggatgtggggtttgccgtggacagtcctaatcatctcctgatggcggttgcagggcatttccgacaattcgcatagtacaaccgtcatacctacccctatataaagacatcactccctcacttcacacacacactttcaagcttgagctgaattataagaggctctattgtactatattgtatactataataggaagagagtagagtagaagaagatggaagaattccggagttgtctgtaatcttctctcatttcttttattctgtttattactcttaattcaatataatattcttcctgagtaatttagatttatctcatgagaattatctcttggttagttcctaaatagcatgcgggatcattgttcactatagtccatctgtttatagtgattgctttagtgtttgatcaacactagaatagttattaattgcgtagacggtgtctaggtaattaatctcaagtagttgttgcgtatcccacaattcgtttgagataggtgtagaggtggtgacagccctcaagagcacttaagtcctccctgtccggatacgcagtagagtgacatctgggagctgcgggttgccagtgcccgaagtattgcattagattaaagttaagctttccttagacactgtttctcattagtaaatcctctctatcctggcctatcttctgctcgatgtccttggataaaccggaggaagatctgaccacacacgctcccttggatttgataccttttggaatacttcataggggaagtgctacatcggtatatccgtatgcttgcagattttatctgtgaccgtaagaaataccaacaagcatttttggcgccgttgccagggaacggttgctgatcatttccgaatccagttcatcctcgtatctcttttttgatttttattctacctttacccctgctacccagagaagtattcctgctaatttcttctcgaccatggagcaccaacttttcgagccatctgttcctaggggcgaattctatgagccacctccttcgtcggagcccatatatacaactggctatgaaattcgccccaaactaatcagcatggttagggaaagtccttcttctggcttcgatctagaaaatcactaccatcatctgcgagactttgagcaagtctgctcatgccttaagattcgtggcatgtgaccagaaactgtgcggtggaaattgtttccgttctcccttcaagagagagcaaagcaatggtacacatctaccgttggatgtgtaaacggtagctaggaaaaggtgcaagacagattttgtcttgccttcttcccaattactcgtattactgcccttcgagtagaaatatcctcagtttccagcagatcaaaaacaaatcaatcgatgcagcttggtccagattcactaatttagtgcagtccggaccaaccctgtccttacccgagtatgtgctattgcaacatttccagacgggtctggataaggagtctacattctatctcgacataactgccgaaggatcattcatgcacaaaacgccgtcggaaggaagaatatttttggattgcattctagaaaatacttccttcatgatacaatatgatgaactccagccggaggcatccgtgtccaagatagaggaacctctaacaatcgagccacactctgaaccatccttttctgctagctcgattgacgagaaggttcctgagtagccatttgttgagaatgaagaaattcagactccggatcgtgccgcaattctgttcagggactatttcgacgaagactatggcaacaccctgaactatttcagcaagaagaaaccactcgttcctttggcacctcccgatcctatggaacttgggttcctaagggaaactgttcgggagttgacatccataatgagcgacgaatggctaagggaggcagagctttcatccgaagtaattcggataaataccgctcctcgaatcattccttgccatctggaagggaatgacgttggtattctctacagtccaaccgttggggccaatctcgtttctgagtcttgtgcgttcgcttatttaagcgataaggcagtgaccccgacgaacaaattattcaagcatccaaacggaagtatcgttgaaggatttgggattgtgtaagatgtacatgtctactttgaagacagggaggcgatattg

SEQ ID NO: 71449 - DNA, 1164 bp, Oryza sativa
cggtctgtatttatggatatttttgtttctgtactaatatggttcagctcttcaaatttttcgtattacatctattttaccgatataaatataaacagagttttataaattttatgattttttccgccattggatttgacgacttatttgatgttccattttgaaaagcataaccaaccagaatgttctgtgacacacaaaacaagaaaaaatattagcacatgtttaattgagtattaactattacaaacttgaataatctattgagtaaagtctatcacaggtccctaaacttatatcgttgtgtcattccggtccctacactcgtaaatcgaccgttcaggtcctcaaacttgtttgactgtgtcatcccggtccctaaacttgcagatcactcgtttaggtcctccaacttgttcagctatgtcaccccggtctctaaaattggatttgaatatcatctgggtcaaataggacggtctaaatactttatatttaaaaatagttcataactttttcatgtgaactctaatgaagataaactttatatcaaacttgtagccgcgacgcgatctacaactttatagttgaatttttttttattttaagtcattttttgtcccaaaatgtaattttaaaataaaattacaaaatctataaacatgcaacaatattttgcgaccctaaacagttttagttaaaaaacttttcaactacaaagttgtaggtcgcgaagggctacaattttaatataaagtttgtcttcattagagttaacatgaaaaagttatgaattattttttgatataaagtttttagaccgtcctgtttagggaccggggtggcacaactgaacaagttggaggacctaaacgagtgaactgcatgtttagggaccgggatgatacagtcgaacaagtttgaggacatgaacggtcgatttgcgagtttagggaccgggatgacacagcggtccaagtttagggaccggtgatggactttactctattttatatatatacaaagagtatactatttggcagtttgaattgagtgatagcaacaatcgagttgtatgcactttagaactcacagaacgataggcaactagggtcaatactagctacatcgatgctgtatgggtattaaatgcgacattttcat

SEQ ID NO: 71450 - DNA, 16486 bp, Oryza sativa
ctagaagatgaagtccccgacttcatcaaggatgaagcggaacccggtgagactcccgatctgccaatcatggaaccgccaccttgacctccgcttgagcttgaacctctacctcagggcctacgctatgctttcctacacaatgatagagaagcccctgtcataatcagtgacaagctctccgaagacgagattcaacgtcttctaactgtgttggaaaagcctcgttctgttcttggctattcctttcaagatctcagagggatcaatcccgcactttgcactcatcgtatccatattgacccttagagtactctctctagggaacctcaacgacggctcaataatgcgatgcgagaaatcgtaaagaaagaggtcttgaaactcctgcatgccaggattatttatcccgtaccatacagtgaatgggttagcccagttcaagttgtgccaaagaagggaggaatgatggtcgttgcaaatgctcaaaatgaacttattctgcaacgaaccgtaaccggatggagaatgtgcattgactacatgaagcttaacaaggctatgaaaaaggatcatttcccactgcccttcattgacgaaatgttggaacggctggcaaatcattcattcttctgtttcctcgatgggtattccgggtatcatcaaattcctatccatccggaggaccagagtaatactacgttcacatgtctgtacaacacctatgcatatcgtaggatgtccttcggactgtgcaacgctcctgcatctttccaaaggtgtatgatgtctattttcttggacatgatcgaggacaatatggaagtcttcatggatgacttctctgtctatggaaagtccttcggtcattgtctacaaaatttagacaaagtcttacaatgatgcaaagagaaggacttggtacttaattaggaaaagtgccatttcatggtccgtgaagggatagttcttggccatcgagtgtctgaacgaggaaacgaagttgattgtgctaaaatcgatgttatagatcagcttccacctcctgtgaacatcaaggggattcgtagtttcttgggacacgccagcttttatagaagcttcattaaggacttttctacaatcgcccggcctctgaccaatttgctggccaaggatgcgccctttgagttcgacgatgtgttgctaaagtcttttgaaatcctcaaaaaggcactcgtctctgctccaatcattcaacctcctgattggactctgcccttcgagatcatgtgtgatgcaagcgatttcgctgttggtgtgttcttgggccaaaccaaggataaaaagcatcatgcaatctgctatgctagcaaaactctaaccggagcttagttgaattatgcaacaactgaaaaagagctgctcgcggttgtttttgctatcgataagtttagatcttacttggtgggagctaaggtaataatttttactgatcatgctgctctgaagtgcctgctcactaagaaagatgctaaaccacgtctcttaagatggattttgctgctccatgaatttgacttagaaattcaggataaaaagggagtagaaaattccgtagcagatcatttgtctacgttgcagatcactgacacgcaggaacaaccaataaatgacttcttgagagatgacatgctgatgacggttcgcgactccaacctgtggtatgccaacatagtaaactacatggtatccaagtatataccactaggggaaaatcaacgaaagctgaagtatgaaagtcgctgtcatatatgggatgagctatacctatacagggtccactccaatggcttactaagaagatgtgtgccgactgaagaaggacttaagatcatagagcaatgccatacctcaccctatggtggccattacggtgcattccgcacccagggcaagatttggcaaagtggcttcttctggctgacaatgcacgaagattcaaaagaatttgtcagaagaagcacaagctgccagaggcaaggaggaatcactgctcgtgatgcaatgcccctcacatacaatttgcaagtcgagatattcgatgtttggggtatagacttcatgggacctttccctaagtcttgcaactgcgagtacattctggtggcagtcgactatgtctccaagtgggttgaggctatgccatgcagcgccacggatgtgaagcatgccaagaagatgttcacagaaatcgttttcccaagatttggtaaccctaggatggtcataagtgacagaggttctcacttcttcgacaagaccttccgagacctcctacgagacatgggagccaagcacaatgtggccactccttaccatcctcagaccaacggtcaagcagaaatattaaacaaacagatcaagaatattctgcaaaagacggtcaacaaaatgggaacaggatggaaggatagattgccggacgctgtcggtgatatgggcccgggggtacccacattagaggtaaagaatccttccatctggccacgtggccgtgtggcctgctccccccccaccccccgcccccacgggggaggtcgagcggtcgtgaagtggccaagggccctcggggtgccccgtcacacccctcaggcccttggcgcgcgccgccccgaggccctcacccggtagccacgtggcgccaagtgagcgaagccagaggcgcctccaagcgccataaatgagcagcgccccaaccgtccctcgccgcacttaatgcggcgagggcaggcgtgcaacgctgcccgattgacgtgcgtcatcggttttgaccagcccgtgactggtcgcaggcggatgggacgagtggcagtgcacccacgccccgccctatgtcaggcggaatgggggcaggtatgccctatcccatcgacacgcagctaaacgtgcgcccccgtccatgaatccacaaaagtctctatggagttaagagggaatgacggggatgtcccccatgtcaggcggagggcggcgccgggacccacctaggggggaacggccaccttgcttccgattgaaggcttgaacagtggcttgacccaggaagtatgggccccccaccaatgatgaaatgtgtaaaggcggtgcatgtggtatccccttggactataaaaggaggatctttcccaccaagaaaaaggacgactcttgatagcttgagctctaggggaaaatgcagttaggttttcccaagagcccaagatcccacgtaagaactcgatcataatcccacacacaagagtagggtattatgctccttagcggcccgaacctgtataatcctcggtttccgacacttgtttgtgaacgatctagttagccagatcccaggaggtggaacgctcttgatcatcgcgccttattccccggccaaactcacaaagggggtctcacgacctcccgctagaaaggattactcctcgacagacgcactgtgggcataccggacagcatacaagacacccattggaatgtccccttatcaaatagtctacgggaagtcatgccaaatccctgtagaactcgagcacagagcatactaggccatcaggaactggaatatggactttgaaggagcaggagaatggagaaaaatgtaaattgatgaacttgaagaatggagggagaaggcttatcacaacgcgaagatatacaaagaaaggacaaagcgctagcatgataaaaggataaaaatcaagaaattcaagccaggagacaaagtattgatgttcaactccagagttatgctttttggccacggaaaattgcgtagtaaatgggaatgaccgttcaacgtcatcgacacctctacacacggggcaatcacactccacgacgactcaggtaatatattcaaggtaaacggtcaacgcttaaagattttccttgagccaaatgaaactttagatgaagaagtggacgttattgaattaatcgattatgaaccataatgttctcatctattgcatgctaaaaaccctgtaaagttgtcatttttgttcttagcttaggatttagtgggtctaggaaaaagttggcagccagtcggacccaccagggttcggccgaaccaaccagggtggcacccgatcagccccaattttgaacatccgtctaccccgctcgtctatagtctgttgtgatgcgcattcggaggtagattagtcatatcaaacccagagcaccttttcttcctcctctctcccacttttgcaaaactcctctccatctcatctcaattcacttattccatcacctccaattcaccaatggttggcaagtccttgatcccatacattggctcctcctccaattccacttacaatcttgatggagagccaacaccggcgaaccaattgatcccggtggagaattacacaatggaaggggtgaatgcactgtgggcgtagccccctgcgaatctggagcccgtcggcgagctcgctggttcggccgaaccctcctcggccccgttcggcagagagatccctctcccctcaccatgttacgaagaccaaaatctgggggtattcacctgcgcgacggccgacaatgggcaaactcggtcttttgaaggagcgacgcctttttcaagacgatgagaatgccgctccgccttccgccgagcgatatgtgggcaccctattcaccaaggcatgggatgaagtgctccacaaatatatcacacccaccgctactccatccactccgaaggaggaccggttttgcattcagggagtgcgaactcccggcggtgggtatggtaagggtttgctccagcctttgatgacatcttagaaggagggggcagcggaatcccatagccctccacctatgaaggtgaagcgtcatttgacgccccctccaattgtaagggcggccggccaattccaagaagacgaagtgaaatcaccggagccctcggtccataagcacgccgcgcaagtgaagaaactccacaaggagaacatagagcttagggtttgcaacgcggaactaggcgtagaacttgctgaacttaggaataatgttgatacccttagtcgcggtttgtgtgctaaaatcaagcgtgcatttgtagaaatggggaaggagaataagtattatgcaaattagatgtctcctctctcataaataaaatagtagaaggtgcttagtttctatttttccaatcatgtaagcgcttgctataaataatatggctcattggtgctaaccccaatgcatgtcgagtttgtttttgttttcgtttaataaagttcaggtttcgaataagtgttggggagatatcccagcttctgacatgcatatactctgaaaattgttgagtctctgaacacctggaaggcactgaactctgcagaaaattgcagagggattgggcaccagagtggttcggccgaaccaccaggttcggtcaaaccagtgttggccccaatccccctcaatttttacaggtaagcaggtgagcacgtctattatctgtatatctccaccacgatatagtactagagctgaaaattcagaaaacaattggttcaagcgtaagtaaaagataaaatttccaactaatgaaattcttcatattgttgatcttgtatattcattattctcagctgaacttgtgcttgtgaacaaccatccatgtttagggaacattatgcatctaagtaattgtttattgttttatgtgagatgattcaagatgaaagaaattcttgcgactcttgttatgactcttgggaatttgttttcgaagtaaaattgttttaaaagctcattcctccaattgacttcattttatacctaccaaggccatatgcaagtgtatctttgataaaccttattatgcatatgactgcttgacattatattgagccttgtcaaatttatgtgactcgtgttagatatctttcatactctcatgatcaaggggtcatttccactttcatttccacatatacatgactaagctaagctcctacactggaagttggcttcccataaaaattccattcaaataaactcctacattagactgtacttacttctcctttaaaaaaaagagtccttgataaaaagaaacatgaaagaagggaggaaaggcatggctataaaaaaaagaaagagaaggaaataaagcttgctctcaaaacattgagcaagattaaaagaaaatatagccatgccccttccatattcatgccgagaaagcaaaatggagaggaagtataggaaaaagggagaatcatttcgttattccaccattccacaaatattctgcttttccattttctaccacaaataaagacccttgatctaggagtacgactgatgatcttcttgagtccatatttttggctttgcaatatatataatgcaggtatgtaacaatttatccctaccaagctccacatatcagccttagaataggggtaagttctagcaaattttgcctttgtgaggatccaaaaagaaaatacacatccttgagagataagagagaaggtcaatatgaggaaaagagctagtttgcgaaaattcataaaaatcccatgagtctgacagagaagcaagaaggactggaatcgggatcgttccatttatcaattgctcaagatggtaagatagccactaatagagttcacaggtgcaggtatggttgtgaatgatttatatgcctcattcataccttgaagaaattcattctacactaacctttactcagggatgagcaaagagctaagtgtggggggttttgttggcggctgttaaatgccaattctatattgccaacatctgcataaagttcaaataataaaacatccaacatagtgataggtgcttaatctcacaaattccacaaatgtttgtgtatatttgtacgcagatgatagacctcgaggttgggaggaaatctagactaaagtgaggagaattatgtatccatacaaggatgggttgtgaatttcatcaaaacaccagaaaattagcccaaaataacaaagaatggatagaggaggaccagaggaagacatgggccaaaggccaggccaggtgggcctagcccatgctcggccgaaccaggggttcggccgaatcaccagctccaccgttggatgtagggtttggcgtggacggtcctgatcatctcctgatggcggttgcagggcatttccgacaattcgcatagtacaaccgtcatacgtacccctatataaagacatcactccctcacttgacacacacactttcaagcttgagctgaattataagaggctctattgtactatattgtatactagaataggaagagagtagagtagaagaagtcagaagaattccggagttgtcggtaatcttctctcatttcttttattctgtttattactctgaattcaatataatattcttcctgagtaatttagaattatctcgtgagatttatctcttcgttagttcctaaatagcatacgggattattgttcactatagtccatttgtttatagtgattgctatgtttgatcgacactagagtagttattaattgcgtagacgcggtgtctgggtaattaatctccagtggctgctgcgtattccacagttcgtttaaggtaggtgtagaggtggtgacaacctccaagagcacttaagtcctccctgtccgggtacgtagtagaccaacatctgggagcagcgggttggcagtgcccgaagtattgcattaggattaaagttaagcttttcttagacactgtttctcactagtaaatcctctctatcctggcctatcttctgcttggtgtccttggatgaatcggaggaagatctgaccacacacgtcccttggattcaataccctttggaatactccgtagaggaagtgcgacatcggtatatccgtgcacttgcggattttatctgtgactgtaagaaatacaaacagtgtgcagtggcgccatgggctgcgatcggaggccgtcgcggacgtggcatgctgggttcccaaccctcaccaatgaacactgccgtaaacatcttgatgaacggctccggtttatctctaaagtacaagtactgcaaaaactctttttaagtcgacgatgcaattgtcaagcagttgtatacaacttgtgcttatgtttcccatattttggttaaaaaaataaaatgttgcgaacctaaatacattgtactaataaatgtctcattcgatttaagttcttatattttgggaccgaggtagtaattaaggtttgatgcacaaataattgtacttgtcctcaatcccacatgcaaccttcatatatcgtacgtcctgtaacacttgtacgtgtacacatgcttcttaatttgttacaggaatttatctttcatggcaaaaggtactgaatcgtctaaccgtaaccatgtgaatcaatcagctgtgtgtatcagaaaaatggtcaaaatacccaacagagtgagctaagaccacatggtatttgattcctagccatcaacatgtgaacctagactaaagcaccactcaatctctgtgattgattcccagcgaaaaaaaaaatctctgtgattgattgatactgccactcagatgacctggatggggatgcgcacagggaacaacatctagcaaaagattcagttgttttcaaatccccgtttaggcctttaacattattcaacagctttacatgaccgttggccaatacaaaccaatgaatgctctcctttgtatttagagaaaatccaaaaaatatcatttacaagcgcacaattacaagaaatatcattgataagtgtgaatttcatgaaataccatcgtacaagcgactttgtcccaaaaatatcgtcgccattaaggctccgttagcaaccctccgttaagtgctacagggaacggtgtatttaacggcatgagatagatggaaccctaacaacgatgacattttaaataaaatcgcttgtacgatggcattttatagacactgttggggaattgatctttaagactggttcgcaaccctttttagtccccattgtgcaactgggacgcacaatccgggacgaaagatgggtatttttagtccgcttgaaataatcgggacttaaaatcgatctttagtactaaagatttttttctttttttctccaaaaagcttgttattgctttatgatttcttatacacaggcgcatatgcatacatatatatatatgcacacatatatatatatatatatatatatatatatatatatatacatatatatatatatatacatatatacatatatatatacatatatatatatatatatatatatatatatatgagagatatgaaatggtcagttattgttgtgcagtaaaaagggtataaacagggtgatttaatggtgggatacaatagtaaaaaaattactcttcataggcggtgaggtggtaagaagatgatagtaaaaaaattactagctgcaacaggtagagaactggggatgagctagatagggggattagacggggtgcctgtgaggtgtgctatgaagatacgtggcaccttagggtgtggtatacatgcaaatatatatatatatatatatatatatatatatatatatatatatatatatatatatgcgctcttcccgatctctccatcccctctccccggcgcatctctctcccttttttttctcgctttttctcctcctcctccccatccccgatctttctcttctttttttttcttttcttcatttttttctctcccatctctcattttttcttctattttctagaaaaaaatataaattaattggtgaattcaagactagaacccataatctcatggtttataacaaactctcctaaccaaatcaccctataacactatgttgtttgagatcattgtttgctttctcaatatatctgttcaaattttgtgaacacaaacccgttatgttactgtagaaaatatacctttgttactatggttcggtagtaacattatcattactatggttcggtagtaacattatcgcagaagtgcagtaacacgatacgttactgcaaatgttataggtcgttattgtgaaatttgtaggtcatcactgcactttttacagtaacatcatgatgaatttgcagtaacagagaacatatggtagtaacggtactactacatgttaacgaccaaatttggtaattcaagtatcagagatgaagataaaaccgaagcgaaatccgagagatagatcgttccggaaacaaagcaagaatcggctgcgaccagggtcgacagagttcgtgtcggacaaggtagccaattgagccgattccgacaatgtgactcggtacacgttgtcgggttgagttatcgtacttcatatggattgccacgcatggattgagtcctgaaaaggcaattgtatctattaattaggatattttatgtaatttccttagagataagtttgggcaaaagtctactgcaaagacttatgatatcttagagtttgttagagataagaaacgtgtccgacaaggacatattttgtatctctggtataaatagaacccaaacccatgtaatcgaacaacaacacgttcaatacaatctcggcgcatcgccatctttttaatttactttcgttttgttttgacgagttcttgttttcgggttgagctgcatcgatttcgatcttcaactacaggtaaaactgttatgacggcttgcgttctcgggattagtgcttccatatttatgacactctaatcttgtttatgtaagttgtcgagttatcatatattctatataatctctgaaaacattgttatttaaccttcagtcggctaacatctgtcactaggaagcagccgattaggttaaataccaacgttgacctagattatatagggtatccaccaccctatgaaacatccaatggcttgattgtctagatattgttattctttccatacttataggtgcatcaattaagtttgaccttataagtcgtgattagaatctcaatctctagcctgctttttggttgaaaattagggtagtatcggggtttcagccgatcttacctgatttaactcctttatgtcttacattcttgattgacatgttaaatccgccctttatgttaagatcttgttgcatttaggtatattaagcttcctatttgatgtattttgcttgctttaatatcttaatatagagtggtatcagagtattagccgatacatgctagatctatctgatcggctatgctatgaatgcttataatctccctattaatgtatatttcgatctaagtgatttatactgtctcggcatggtgaccgatctatcccaatcacttgatttaagtatatatcgacagaggcattatataccattaatatctacagccgatcgaatagatttagttctaccttgtttatttataactgccgatcgattgaaatatgacatcggcttgaagataaatgatatgtcatcggctgctggccgatcggctatcgtttatggatttaaccgtggtttcttttgtctttatttattgttgattgcaggatcaaatcaactggcacactcacgaacctaaaggcaagatttttggacctgcactgaagttaagcagatcttcctggccactgtgtgttttttgcatcaacactacagtaccattgcttgtgcatagctaaatttttaaatcaaaatcttgtgcaaaatacaagtgctaaaaaagtgtatgtgtatggtcacaagttaacgcaagtgctaaaagtacttctatttgtccatacaaaaatacatagtagcaaagcttagtactagtaaacttttagaattctaatctttaaacaataatatctctcacattgcatattattttttagaaccggtttcaccataatgctttaaaaagacattacagcaagacaatagtcctgttactatacgatgatcgagacaaaaatgcttttataacgttgttactgcggaaagtagtcgtgttactgcacattgatcgtcgcgtttcttcgccgttctaaagagatgagaactaaaaaaaagtaaatctcaatctttagaaagcaatatctctcacgttatatagtatttttctaatccgtctgcaccatggtattcgtaaaaaagtgattaacaaaactagatccatcatgactacatttcaattttgttactgcgagaaagttgtcatgttaccgcacgatgactgttaagttactgcagaatttttgcgagacgtgaacaacaaagtgttgggcggggaagggagtcaatgggcgggtttgaccggcgggagggggctttgaccagcctttgactgaggtgggaggggggatttgggccctaagaagggtgggggaggtgggattggcccatgggagagggggtgtagaatagttattctaagggaggggtgtagaatagatttgctatatatatatatatatatatatatatatatatatatatatatataggtaaattaactagtgctacatggagtatgggctccaacaatatccaccgtatatgtgctttgagatttgtgctgctcaaaccagggtattagatatattaacgggttaaacccaattagatctttccatttttagtgtacccgcatgatttgcatacatgcatgtattgcctttccatataaacgtactcacatcgtttccatataagcaaacatgtacgtaataatttccttccgattgcatgattatttatttccatatatgatacatactttcctttttttggcacatgctcacatcgtttccctatgattgtgtgataatttatttccatatttgagatgacactgaatcagatccacaaattttcagtaattccactaattaagttgtaattgatttatttccatcaatactgattaatattttccactttttgtgtacatataaaatggtatgacatttcattttttacacactccactgtccagtccacgctactaccctgccggccggatgtcggcgagcttttcgtctctgccggttgtctgcaaggtttcgttgccgttgtcagtcatctgttagcttcgtcaccgcgccgttacgcaccgtcggtcgttcgcaaggttcgttgtcgccgccgtaggtcgcccgtgaggaggttcgtcgctactgtcatcgacggtcactgcgcgtgtggttcgtgtgtaatttatttcaatttattcttatattttgacaagtccctgttctaccgttttcgcagactgagtactgtaacaatttcatttcgttgtcaagaccttaagatggaaatgtatcctgctaataagtttttggttcatcttcctattgagccaaagactgtacgtacgtatgttgccctgggatcatgtggagaagatggtcgtgggcagaagaaacaccagttggatgcacgcgctaagagctagtgtatcaacacaagtttttttaaactgatgttcttgacagtgtattaacatgaaatttgcacgttgtaatcatgcaaattaatacagaatattttggtactatgtatatacctaccatcctactattccataaatgtcaccacctacttaatctacatcggtagaatatacatagcacacgagacttatatacctaaatctataaatagtttataggtatatacccaactagacttatacttacatctacatgtatctaattgcatctggccaagctacctagttagagtataaaaaaacttaactaaaaggcctagctagcttcaaattcagttcaagaaaaaaaaacctacttgaaaattaaacttttttcatgcgcatttagataggtatataccaaactacaatatgcaatttttaatgggtatatacctagtatgtgtgtttagaccggtatatacccaaatagaatctggtatgtcacacatacccaacatacgtgtttaaatacctaaaaatgtgtatcctaaatggtattatacccaattaaatgtacatatgaaatgcatgcatgtaaatacctagcttgtagtacgtttgaaacgcatgcacgtcacatacccaaaaaattaaaaagcacaacacacgagacttatatacatacatcacatctacatgtacctaattacatctggtcagctacctagcgagagtataaaaaaaacttaactaaaaggcctggctagtttcaaattcagttcaagaaaaaaaatgtaagctacttgaaagtcaaaattttttcacgcccatttagataggtatatacctaactaaaaatgggtatccgaaatatgcaatttttaatgggtatatacctaaatcaattctgtttactggttatattgtacttattttttctccggtatatactgatattttagatagtatatactagatttttcaagtatccaacatatattaaatcgaacggctaggcggcgtgatgcacaactgtaccaaagtttttttcacatattcgtacatcatataattacaaaaaaatgtacttctaatacccagttttttttgccataaaattaacatagactaaaattgaaattttttcattgcatgggattttttttccgtttcataccaaatttttgagtatacgacccattcgtacctaaaaatggaaagtgacccatagtgcatattttgtcactcaaattgctaaattaatggagtcatgaatgtaataatttggtacggatacattaccatataaatttgttgcgatattatccatgtttccaaatacatttgaatataataaattttctgcgatatatataataaatttccaactaatttgtttccatgtttccaaaaaccaacaatcagtatttagtgttacatacttagtttccattttcacatatacttactttccatttttccaaaaaattaatttgtttttccatatacttagtttccatttttcacaataatgttaccatttattcagaccccaacgtgaagcaagtaagtttccatatttacaagatattatttccaatttcacgggtatttaatgtttccatttttgaaatgtacacgcaattatggaaattctctcatccgcattgcatgcatataaatgcatttattccttttttttactgtctattcaaatatgtggattccattcattattaaatactatactctaaacgggtgtatacccattaagctatgtacccaaatgatcaaaaccgatcagtaagcatcctacggctcctaacgttggagcccatactccatggagccccatccgtgcgtcctatatctatatatatagagagagacacacacactgaaaagttgggtaacataaaataaaaaatttactcggactaggagtgggggaggtggcacatggtgggatcgagattggtcgtcggcgagttaacttttaactatatatagaactcctaagaagttggataacatcaagtaaaaaaattacatgggagtggaggagggggcacatgggtgggatcgagattggttgtcggtgagttaaattttaactacatatagaactaataagaagttggataacattaagtaaaaatttactcggactatgggagtgggggaagggggcgcaggggtgggattgagattggtcgtcagtgagttaaattttaattgcatactatggacctggtggggagcatatatatatatatatatatatatatatatatcgggatggctatatatctgttgacagatttttttttatagctgaatcattcgctttttaggccgttgatctttctttgagattggtgcaatcctagattagtatcatctagtttgttccgtccgtgggttactggctctttgggctttatgtggtctcacatttactgttcaattttgtgatactactagccaccgacagggagagtgtttgggattttttttgtgcagaattgctatatctttgtcgataattttttcccaaaaatctgtcacttttctattcattcgatttgatgctaagattcggttttgtatgtcctgtgcctgcatggaattggaatccaatgtctggtcattaacgtgttcacaccataagacccttttgttactctttttacccttatttaacgtgaagttcgctgacagaatatcggatgatcccacacgtacaaattacatcatacttacactataattacatatatatatatatatatatatatatatatatatatatataattttagtgtatttacgatgtaagtctgaaatccacttgagcccatttgagcccacgtgagcatcatattgtccatgtggcccgtttgtttgttttttttattttgtttgtgtatattaatgtcatccgttagatgttgattcaaaggataagaaatctgcatgatatgaggc

SEQ ID NO: 71451 - DNA, 2201 bp, Oryza sativa
ccgaccaaacgaacaaaagaattattatagaaattatttttttacaattttcgatagtctagaaacatatatcttccagttgaaaacattcttcttttgtccgtgaagtcatggacaaccattaaaactgtttttctctggcagaatactaagtatatatcgccttgcttacacgcacaaggtgttttcctctctacaggcttgataagaagccgatccatgcatttcttttatgcatatatggacattttagtggcggcacaatcagccaaattagcataatatttccctcaaggatccagagcaacatggtgggcttgcataagatccaaaccatccaaaaaatagtaaatcaaacaatccagaaataaatgtctttttggcaagatagaaatgtccagctcttatttttttaaaactaatcgcacaagatagtgcgagttttatgtattgataaagtaggataaaaatacaagtctagtcctggaagactatagtcaagaaaaaaaacaaccacgtcacgcgtctacgacaacacctgccatgagagcgaaaacaagaacgaaagatctttgaagtgatgcatccaataagggaaggacaccgaaagcgccgctgccttttgctctagggagtcaggacatgattttcacttgaagaaagtaaccgggagaaacgagaagaaagtaactgggagaaacgagattatgcagcaacgctagaggaaaacggcacccataggcatcatcgttgctgccccgaaggcaaagctttcgcccataattatttcacccctcccaagaaagtttcctgtcacactcctgctgcaaccacctttcgaaaaccttcaacgcgtggccaccacgggcgacgcctctctgttggtcggccgtcaagaaggggcatgacctcccccccccccccgatgcgctccagctccatccatgcagttgggttggatggggagaggatgagagaggacaatggatctcctctctccccacactagcctgctcgacgtggccatctttgtcggcaaaggcgctatcgcaagaggacaatgtccagaatagggcccatcgaagaaccacagcactccccttagcagtgcaaccgccgaaaccgtcattgtctaattgcccacatcctcgccatcaaaccgtcccgtcatcgccttgccaccctccacgccacgccgatgccccctccatcaccgtgctctcgccatcgttacagataccaccatgcccgcagcaccgtcaaaccaccggtggcctccccgccgacgctgactctgccgcaccacacgatgctggatagctgagttacctcaccgtgcacctcgccggctgtaacaccccgattttcgttcgggattaaaaatcaattaataatgcatttctagaaattatattaaaagttaaatcaatttaatcaagtgaaattatagacgaaattaaaatttcctttaaaaaaaatctttggccgggaatattttgtaatattctttgtgccctaatgtactctccggaattttccatgaattttcagagctcgagaaatagttttaatagcacaaaaatcattgcatcaattaaaataaaaagaaaaaaaaatcctccttcctctctttgggccccttttcggcccaatccctcctttctctcccgcggcccgcgtgccccttatctctccctctcgggccggcctcctccctcggcccgcacggctctctctctctctcaagtctgctttacctccctcgcccgttttcccctctctctccccgacaggtgggacccgaggccccacctgtcatcttcttctcctacctccagctccatccccaaccgccgccatggccgccaaatcctcccacgtcgccgcctctcccgcgcgactccctctcccgcgcgtgcgtggacgcggtcgtcgcccacgtccgcgccgtttccccccactcttcccccgcaaaatccggccacgtcgccgcctcccgcatctctctctcctcccacgttgccggccggtttctacctctctcgggctcgatcccgcctcccctcccctataaaaacattccccacacctccctctccattttcccctctctcccgagccctcccgtgcacgaaaaccaccccgccaccgtcgcacctcccgccgccgctcgccgacgaccctccagccggtcaccacag

SEQ ID NO: 71452 - DNA, 3839 bp, Oryza sativa
actatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccactgcagcgcaccttcctggatcataatcacccccttataaacaaggcatggactccccagcgacccctgtgggcttatctccgtcacttctcagtctggtgccccgcaatgaaccatgctatacaaaggataaagccgttgcccacgctggcttgtggttggcacggttaatgtttcacaaccgaaactcgtgaaccggttcttaattgtcacgcgcacgaccatcaaaaccatgtgctcacaacccaccattatctggttttagttggcacattaattaattaatcaatcacgattgaccatcgtgaactatcattaagccatcattaaataatagtgagtcataagttatcccgatgatgtgctaatgtttctaagcagggctaagcaattatacctaatatctagctgaaccaatatataaagcccaactagtcaagttataataacccaaggtatcaaggaataaagtaatcaagaacaaaagggctataacaatgaataggttaattccacccaatgacattcgaaaataaatgcaatagttgaatagaaacaatagctttaaacgggatcaacattctcaaagggttgtttgggatctgtgtgacttgccttgctggccttggaactcttcaaactcttctccggcgaaaacggactctccggaaacgacgaaatctaagcagaaaagagcaaaatcaccaaaacagcacataaacaagcatgaacggtacatgtggatatttttaatatgtagatctcaattttagaaaaatttacagacttgaaccaactaaatccgagctaagatgaattagttatgaatttttgaagatttaatcggattaaaacacttatattgattttaattgaattatgacgcaataatgaattatttttgaaaaggaaaaagggatttattgcgtcagcgggctagggtttcggtggaccgggcgcacggcggcggttcacgcgaacggacggccgagatcgacttgatccaaaacggacggccgagatcgatcggtccacgaccggctcacgggagagggcgacgatgacgtcggcgatgacatcaccaccggtggcggcggctcggcggctcggacggctcggacggcgcaagctcaccggcgaacggcggcgctttggcacgaacggagggcaccaacgggtagcggacggcacggcgaactcaccggcgaccaaagcgacggcggaagaggaacggacggcgacggcgacgaggaggaagcggcggcaaacttcgggttgacggcggcgacggtgctccggcggtcttcggcggcggcgaaggagcggacgagaatggcggcgacttggcgatcacgacggtggccttcccgagcgatgacgacgaccgagacggcggcggcgcacggctggagcgacggcggcgacggcggcgctaggttgcccggcgctagaactcttccggcgacgagaggcgaaggcgagagtggcggcggatagaggagacaccggggaaccttttaaaggggctcggaggcgacggcgaaggcccacggcggctggcgacgagaaggaaggtttagggttcggaggaaagagacgaatccgattcgaactcgaatccaacaatttccaaaaagaattagccgatgattccaaaagagaaaaggtagaggagatcccggagattgtttccctctatcaattcggccggagaaggaaaggatcgaccgaatttggaaaggaacggcggcggcgcgaaactagggtttcgggcggcggcggctggaggtagacgacgaccctgacaggtgggccccacctgtcagcgggcggacgcgcgcgcgcgcggcggactgggccgacttgggccgaggagagagagagcggttttgggccgactttcggcccaaagccaaaagaagacttttaaaacctttttcaatttaaattatttcttaaatgtaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaataattccaattaaacaacaatttatatatttaggatttttagggtgtgacaccgtgccccagccgcgccgcctcgtggccgttcgatcggctttgggccgatccgggccgtcggttcccgtggaccggcggtgggccgcctcggtggtcccggtccacggtggaccgacgcccttgtgccgctgaccggtggggcccgcttgccggcgccgcccctcccctttgatgacgtcaacaaccctcttttcctttggaaaaataaataataattgcgcaataaatcgagtttaattctaagaattcatttaaatggctcaaaacttctaaaattcatatctaattcatacgaactccaaattgggccattcaacttgcaaaattcatctaaaattgagctctacatgtttgtttactttttatatactatttccttggtttttattagagtttttcctcgttttgcgtgccagcgtgtagaatccgtcgtttcggaagatcgcggtcgcaaggataagagttcggaagatcaaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgtcctttgtcaaccatgggtaataaatcgcctagcttgtgttactttgatgacctagctagaactatatgcttagccatgcttaattaccactagctcagttgataggacaattacagtattagaccttttaatatcagaatgagctgcgtgctcgagacatctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccaacgcatccaggcaagggtgggcgtgatggagtttggatgggccctgcgacggcctatgcggcttccggattcacctaggcacgagaagggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgggaggctgtgtcttgtgggtacagttgtacacctctgatcagagtaaaactattcgaatagccgtgcccgcggttatgggcggtcgaccagattcaccgtgattagtcccatcttaataaatcgacccaatgcactgtagttcaggtgggttggttgggcctgttcaacgtggtgtagcgttgatcagtggagatttaatattactttaattactcaaccgttttactgttt

SEQ ID NO: 71453 - DNA, 35740 bp, Oryza sativa
  unsure (1)..(35740): unsure at all n locations
tgaaaatgcgaattataaaaaaattttatataagacggacagttaaaattggatacggaaacccagggtttaccttttttttttttggacggaggaagtacgtattaaacgaagtgtgatactgacctcaccttccacccacagcgcaaccccgttccactaatgattccagtagtcaaatttttactatttacacatccaccagatagcccaccatatatagacagtttcgtgtagtaaatttttaactaatcactttcatttacagttaacttatcataaacagtgtgatatttattttagagttattgttttactcgatttgttgatgccataaattttttttatattattctgtttcaatattttcgcaaaaattaaatgtttgttattttgtttttaggaaccaactttttctaatttcaattttacttttattttttagatgcttcttgtttcaaatatccaagaattaaatgtttggggaacaaacttttttattgtctattattgaacaagtcaggtttttttaaccgttatcgagataacccttgtgtgttgtactccaatttatttagcatattgagttattttttagctcagcacgcaatgaattgataattacgagccattttttattcctttttttattaaataaatgatttttacttgtcaaatacatcatgtcgaaccataatcaatttgccttcaagttaaatattaacttgtcatcctaagttaaatttttactgatcaaataaatcctatcaaaccttcatcaaattgccatcaagtgaaacgataactcatgcttctatgttaaattttactactactcgcacccacgtagatgcaacgatagtaattttttttaccacactaactatgagtatttgtagcataggtaacaaaccagtgaaccaccgcttcgtatccagccattatcccttaagttttttccgaatctagaacagcatcctcaaattccaggcagcggcggatgagactctaagatccgtcgatggcgacggactccgaccagcacaactttgcggcgctctgaagggatgtgcttcatgctctgctcgaccacggcgaccacgtctgctttatccagttcccgcagcagttcgagggcatcgaccccagcgaccggcaacccaacctcgtttcgacgtctctatgcgcgtcatggacggactccaggggtggttgagtcttctgccgcgcacctgaattacagcgctttccaggagaccgaaacaaaaacgatgagctgatgaaagccgcactaatattttggaccaatcttacccctctctgatggacggtcagatttaattggtagctcatgttacctcctcaacaactgttgctcccacttgaatgggttgacgacatatccctcatcatcatgtttactcaggccaagaagcccagtgctcttagtggttagttgttgctagctagttgctgcattcatgtggtttgttggtgctctacatgtcttaccaagttgagggtgaaactaacatatgctcctatatcatattaattagtattatatatgtggctggctgattgtatattggcatcatggcctgtattgtcccctgtaacatggcatttgcataatgcttggatcaacttggattagtggatgcaagtagctcaggaagccaaattatatccctgtgattaatttatgttgttggtgcatgtttctccaccacgaattggcttcatcgtttttgtttgggtcattttcagtttctttgtttttttacttgacacgagcattgtaatcatagttagtctaattaaaatatatgtacagcgtaaaggagatcgaaccggtatgtaacttctatataagatggaacgaggggaacaacaacaaacaacaatttcattacacacagaggtgagctaggttggagtcaaagctaaggagaagaggaaaaggaggtcagggagagggaggtcatggtaatggaaagcgccccagagaagttgaagctgctgctgggggtgctggcgctgcagtgctgcctcgcggggttccatattgtgtccagggcagccctcaacatgggcatcagcaagatcgtcttcaccgtctaccgcaactgcatcgccttggcattgctcataccttttgcatacttccttgaaaagtgagctcagacatacctcttcgattcaattcgttgccatttatgcatgaaattcgaaattctcagctaaattgtacttatattgagatttagaagggaaaaagaaacatctattctgtgtgcctgtgagaatacatttttcctttacattctatttatcttgctatgtttgtttttgtcctgtctgttataagctgactatacattttatcttacatctgtaggaaaaatagaccacccctcaccttctctttgctggcccagctcttctttctggcattctgcgggtaagttcgatgcacattgcactgaaagataaatagattgcttgagattatgtataatgaccatatgctttgctttatcaggataacatgcaaccagggtttctatcttcttggtttgcactacctgtctccaacctatgcttctgctatccaaaatacagtaccagcaataacctttgccttggctgcttctctgaggtaatccagcaataatgtcattatcatttaggcacttcattaacttttgctactcattgaagctatcaatcaaaacttggtaatatttcttttttttaaaaaaaagtgctcctagttagtaacaagaacaataacagtaatagcagtaacatattgtattttgaatgcacatctgtgttcatgaaaagaagactgaacaaagctaaaagcttaattggttaacattagttcgtacgtttctgtgctaatctggtgtctctaccttttattctttctatggttaattaataggcttgagcaagtaaacataaacaagaggtatgggatggcaaaagtgattggcacagttgtaagcgtagggggagcaactgtcattactctctacaaagggacaccactgatgaacttcaagtcatcctatattttgggagccaacactgtgtctcaaaatgtagttttgaattggagtgtgggttgccttttcctccttggcaattgcattgcctggtctggatggatggtacttcaggtgtctactcttacttgaactcaacatatatagccagccgcttatgactaattaagtttcctgatagtttgttccatctacgtatactatacatgatgcacgctacatcgtctctagttgaaatatgctcttttaatttgtgtagaccccagtcttgaagaaatacccagccaggttgtcaatgcttgcgctgaccctggcattcgggctggtacaattcttggccatagcagcattctgggagaatgacattgggaagtggaggcttcattctggagaagagctcttcacaatcctctacgctgtaattttcatttatccatattccatatttccataacgtttacgtgtttcatcgtaattaagtacaccgcagtggtacttcaagatttgttgcacaaaaataaattggtagcaacaattttgtaaattacatgtatatattccaagaaagcggcaaacataatttccttgaccatttccattcatcttgtcttcagggtctagttgcttcaggggttgctttatctcttcagatctggtgcattgacaggggtggtgctctgttcactgctatcttccaacctgtacaaactgtcatggtggctataatggctgccgtcattcttggcgatctactatacacaggagggtaaggaaaaacaaatgtaacctgcaagaaaaacattccatacagaacgaataatgattatgcacatctgaaaagaaaaaatgatgagcattcaggctcatccatgattagtctaaaacattccaattgttggagctaagattttttctcatttacaattatcaggatcattggagctgtccttatagtgattggcctctaccttgtgttgtggggtaaaaacgaggagaagaaaagcaacagtaaccaaccagatttgtcaaggcatctcctcagtgaagagtcttctcgaccaacgactgtgacaagtgatgttccataaaagcagtaaccaaccatcactgctattataaaatgcacaagtatagaattaatgtgcaaggtgatgcaagtgtggattgataggggtttttctaggttatatctagtttaggaataatatagttatattttcatgcttggttctaatatacaattctattttcaacatgctgttgagtagtagttgattgcaccaaaaagagaccaaagatgttggatgattttatattgtttgctacatacgattatcatctttggtctcagttctactactcaattaataggagtgtatgtagcaaacaatataaaatcatcaaattaaatgataatcgtatgtgattgaatagataccgacctatagtatctacgcttctaaagcattatgtcttcactaggctgagttcttcaggtgactttcccaactcaccttcatttttcatgtgcacattttccaaacggttaaactatgtgttattttaaaaatattttatgcgaaggttgctttaaaaaattatattaatctattttcaagtttttttaagctagtacttaattaatcatacattaataaacaccacgcttcccaaacgcagccttacgcatgtaacagtcccttgcgagttccatctaccatttgtgctagttttaaatttgcctaatttagaaattatatgttctcttttattcgcaaaaatttgcttcgtgaaagttttataaattaaaaaggtttaattttggggggtattaaaagggtttaattcgactaattaattagatagcacccaattattaattgaagttattttatcttatttgatgttctaaagtggagcttattccattaatcctgaaaattctcagaattccattgtttcaaatacaaaatatttcaaaaaggtccctatccttttctctattttttttctcttccttcattcctcttttccattcttccatttggcaacccacgagatgggaaatcctggcctgatccgtgccgtatccccaggaaagctctcacgtgtcaactagtcaggaggataatgtaccaaatgttgctgcaatggctgatatagatcgtcaattggagaaaaagacagcggccttgagagagaatgttccctcgttatgtgcctgcaacctaaaaaattataaaataattaaaaatatggatcaatttatgttatcactacagaaataatcaaattggacatctattcccagttaaaattttattttattttatttttatttttaggtcgaatttgaacattcacattttcatgtttgtgtagtgatcgatcttatcaatttatttttaaaggatgactttctaggtgtcattgtgtagtcatgctagcacctacacttttagttctcagctactgccacacctcctttcttaggcacaacctgaactgggttaacccactcgctatacggcacaagatagattatcccgacgtgtaggagtttcatgacctcttttttcatgacttctctcaccgcattatttagccttcgttgtggctctcgagagtgcgcacaagaacgatataaacggatacgatgtgtgcagagagccacactaatccccttgagatcttaaagtgagtagcctagaacagaatgatgcttttctagcacagctgtgagtcaggaggtctcatcatcagtcaacttgtcacttatgatgacgggtcaacttgtcacttatgatgacgggtgactctgtattaccatgcagaaaaaacatagcgtaggcctaaaggcaaagacttgagctcaatcggaggtcatgaagacggatcggttttgggtaactcgatcatgtcttcaaaatcgtcctcttcctcaacaaatgcaatggcatcatcttcaaggagggattcagggactcaaatggagagacaaccaacatgttttcaattggctcagactcgggaacaggttccgtcaaggagtttttcgaccttgagatcgggaaggaaaatgacaatttatcgagtttgatgtcgagaactccggttctcggcacatctaagaagagtttttctatagaatggcctattatgagggcgaagtcatagacttcgaacacatggaaatcaaggatgaccttgacatcattgtgcctgattggcgctctgcggatagccctatacccttcgatggtagaaccgaacggttcttaaaaggttttgtctgtgggtgctaacagttcgtcccaaaaccgatataatgtatgatgcaaagctttgtctttaggcctgtgggtgcaaacagttcctaaaaaggatgccaatataatgtttgcactgctagtgggatcattaaaaagagtttgcaccatggcctctctcatgagacagggaatggttaaggacggggagctaatccgaattgcttcagatgaaagctccacctcccttaactactcttcactcatgatggtagctagttgatgaactacctctttaaggaaattttcctcgagaggttcattccaactacgtgggactggtggtctcttttgcacagaatagtttgaggtgtttccatagtcttcaaaaagatcacccttaaactggaatgggatatccgaaggctgaatttcttcttccttcatttcccatggttcggttgagcattcaatggttgaatcttaagatatgaaggttacaagctccgattcaacgattgaaggctcgtcttgtgtatgctcgatttcctgaaaggtttcgcaacgaacgaaaaaggtattctccaagatatgatccaggagttccctaccttccatcattattttgtgtgcgaacgaacctccggcggaaatatcaggatacatggaaaactccttgtctaaatccaaataggattgttgtactaacacatggtcaagtagagacaagtctgagttggcttgagttaacaaggaaaatcgatcctaggaaacaccaacggattgcttcttattttgctaaaaattgagaaccacaccacggagagaagctacatgggttaatgggaagaaagcaaggcagaacctactttcaactccacccattcaccgtatagttttctcaccgtatgggtgtaccattgtttcaccccttctgtaagagaaaagggaaacaacttccatcgtgaggtgccttgtgcaatgcctgcaattatcaggcatgaacacagttgctcaaatttcacgcagatgatcatagtgattttcgctttcgcatccagagaaggattgtccctgaaccatcgctataaatctaggactaagttcatagctagatgtatgaattggttttgaagaaggggtagctcacagaacttggcccttggagctatgaatacacaccaatgagaagatatctaactcacgtaaattaattaaacaacataaaagaattttgaacacttactttataaaaggaagcatctgctgaggtacaaggaagaagaaggctgacaatcccggcgtgtcggtgaaatgggaacggggtacccaattccccggcaaaacaattacaagtaaagtaaatggcatgcttaaaccattctaaaaaataaaatgctaccccagggtgatgtaggtgggggcccacctttatctgtttgcgggataagaatgtaacctaaggtatgcctcggacccggtcttgtcctgggtcccaggctcaccttagctcatctaggttacaatactgctcagtgaagagaagtgttgagacctataaaagctatgtcttaagaatgtaatctaaggtctgccttggacccggctttgtcctgggtcccgggcacgccttagtccttgtaagtcctatgctatccagtaggaggagcgtagagacatacaaggtctacatcttagaagatataaaactaaggtctgcctcagtcccggcctcgtcctgggaccggggacaccttagcccttgtagtttccgcattcttctgcaaagaagagcgtcgaaacatacaaaataaatacattatctactcatcaaagacatcttcgagaatcttgcccaagaatagatgaattatcatcacaaaaagcgcaagggcgcgacctcaggatcgtctggggagatgggcgtgctccacagggctgttgtgaagcagtcctctccgccataaatgaaacatgtttatggggagccccagccagttgttgacggttgtcataaaccagttccgacaaccaatataactataataaaagagaattagctatgcttataatgcatatttgttttagattaatatagttccacttgtacttggagaataatttgttgcaagaattaagcaaataaaataatgaaaaaataaggaaaactcactcctaagtaagcatatggataaggagggcccacatgtcaggtgtaaccatccggaaaccaccttaactgtcacaaccgataacaggacccacctgtcggtaccctagccaaacatggaggcctgctgggccggcccacgttcggccgaacactagtggcgacggctcagcccggccttacacgtggacatccaggattgctcgctgatggcggttgtggggcagaaggtcattttgccttctcagaaaccgtcataccgaccctataaatggaggagctcatttaacttcacaacacactcaagcaagctcaaggttcctctcatactttattttagtagttttagtgctaagcggagtagtatagaatagttctcggggtcctcagagcttccagaagagtttcggtatggctctaatagcttttctaccctcttctataatactttcagaattaatgaaatacacttctttatatattctcggtactttagttagtataggtattgctcttactttacatttgtgtcggtataattgtgtgagtagcctactagagaggtgcaatggtgtgggtttagtgtccgatttatcggttgctttatatcatctacagaggtgtagagtagtatttattaatgtaagtatggtgcttagattactaaatatcactatctaggcatatatgctgcgggacagtagaggtgcgccgctgacggtgatagctcagtataggtattcctccatgttaatatatattcctaagacaaattcctgaggagggtactcctccatattcaaccccggttggatgaccatgacaggttgtcgtaagaaactcggcaacctgggatggtctctcgaaacaccaggaggggtattggccacataattgtatactagcaaatgtagactagagtttgagtgtatattagaagtataggaaatgagttctttctatctcttctcccacttagtttagaattattcatatgagggaatctataagcttcgcttcttgtcactctacccttatattaaattaacccctgcttagactttgatgaaagcaagtaatatatatgtgtatatattagcatggttctctctttcataattttaccttggattaaataaatataatacattggaatacttccggatgaaatgctataatggtatatctgtgcgcttgcggattacttaggtaaccataaatatacctggactatttctgatgaaccctgagttccactcggcactcaaggctgttgttggcccgatctttcagtgagttgagataactacgatttagtagaaacgttgacgatccaactacaaccgtacaagacattgtgttgcgcctttgcgatcgatacacctctccgtgggttgttgatcttgccggtgcagatcaaccttattcctgcaagcaaatcgaagaaacaagcaagaacatgataaaagcgatctaaattgcaaataggaatgaatacacacgataagttggggtttcaaatacaagcagacggacggtctagccgacacgcgcgctgcaaggaagtagcaatggctaaactttcatctaaacaaaacccaaaaaactctaaagtggtacctaactatttaaggaggtgggaggacgacctaacgggaccctagggtcgttctccacctggttggggcgcaccccacatgggccccacttgggccggggtcccagacgaagttacaagcccataggcccattataggtgacgcagcaccttctttttgtgatttcggccgactgggatggaatttggcgatgaagctggatccattggaaagatgactccgagagctttccatcaagtactcatggacccaaaatggagctcgcatgcatatttggcggccttttgaagtccacactgtagcaggtggccgaactggattgcagaacttggacggcttgatcttgatgtgaactacggttgtatctatagtagccatggtcacatcaatttctacatcattgctaggaatgaatatttctactaatgtcattaagaaataccaacaccagtttgaagttgaaaggacatggacaagaggtattggttaagcacgaagatggaatcctcttgatgagtggaacagcggtactgatggtttgcatggagatctcatggttgccaagaattgagaggaagaagagaacttcttttgataataggaagaagaaagatagacgaagaagaaaacgacattgaaggctagctacagtctgtcaggttgggtcgtgttggtgcctttagagctaaccttccggtccttttgaacgactcaaatcggctacagctaaagttgcagtcactataacaactactacaactgatcctaatccctgtgcagcccgtgtcaagagcgatccagaaagacgagacaggttacaagaacagggaccgaggaatgcatttggatggtgaattggtgagtgagctcccacaaaacctcttggcatccggattcctgtcgtcgtcgttcacccttaacccccgcttgttgtaacccgttggtcccgctttataagcataggccgtgtttagttccacccaaattcccaacttgccatcatatcacattgcatcgaaaactttcctactcacgtaaagtaccaactttttctccaaactaccaactttctcccaactttccaacttctccaccatctaaacacacccatagtgtaaaacagaccatcggtgatacatttcacactactacatctaacaacagatagcattatattttggtactcttctcttctcttgttcaatcaccaacacccttctatctgatcccatgcaatccctccattcttattagattccacatcctccaaactacattttgtagtactactcccaaaatactactacaagagagcagaaaaacagagaggagggaatgcgcctcctaactcgcatttacagatcaatgagaaactccacccttgaaactcagacttgttacatccaaaggaagagaacctagcatcttcaaccactatctagtcgaccgatcacgcaaattaagtacatgatatggtgttcctggtaattacctgggctccatgatcaataagtatgttactcagttggtgtgcccatggggcagcagcttgagggcctccatgaaagtgttcttgagcctgcccaaatgtggccgcacattctgcttgtctaggtagaccatcttgagagcgttccagccctgcttgtggatggagtaggggtccttgagcaccgggtcgtccttggggtattgctcgctcagcgtcgtctcgtcgagctggatcatatattcgaggtagtggatctgcatgtcggccgccggctccttgaacgtgccgcgggcgagccattccaggccaccatacggcaccacctggatgagcacggcgccggcagggaggaacaccatgttggtcagccctgcgccgtgcacgcccaccatcacgtccgccgagttcaccagccgggcgaacttggacacgtccgtgctgatgtccggctcgcccaaacgcacgtagaagcccaggctcatggccatgtccgccatggcacgctcgttcaggaacgcacgggagttgcgccgcgagatgatcagcagtcgtgggcggcgccggatgtcccaccggtcgccgctgggctcagccacagcgcgctccagcccgagcgctccacgcaacatcgtgcggaagtccaccatggagtaccccgacggcgttctggacgggtccaccccgagctccttgtggaacgtcggcccgaccaccacgctccggtaacatcggacctcgtcatcattgtcgatgtcaaccaattcgtacttgctgagccgctggaagatttgcatgtacctgttcgtccaccacgacttgaagctgctcaccaggaactgaacctcgccagcgaagcggtgtgcggtgatgaacgccgggatgagcacgtccgtgtagtcgtggaacgggttgcccgtgaacccgccggtggagagcacgaacgcggtggccgaactgttaaccgtgcaatgcggcaccgccgggtatgtgtcggcggtggagaggggccgaagcgcccactccttgacgtgcgacagcgcgaaggcatcgtgcttccggcagtacggcttcaccttccactcctgctccagtgggctgatgtggatggtctggctgcggccgtgcacgcggacgtcgccggtggcctcgcacgtgtccgaccgccggcttgactcgtaacacaccggcttagtcaggtggtccgtggccgtggtggacgctgctgcaacagctgcgctgcttgcgccaccgccaccgccaccagctgtggtgtctccagccttgggctgcgtttcttcttcctcttctgctgctgctgcagcaaaaaaataaaaaaaaatcgcgagtaaatagacggacaaaaatatcaatagtagctacccctgagcgtttatttcctcttctgcacattaaaggccacccaaattgttcagatctgaactaatttccgtaattcctttggacattgaatcataaatcattgatgcatttttgtgcgcacaagttacaagaaatggcctaaaatttcagagctcgaaccgtagagcggaaacgggagaagatttagtgcaatactgcaatcttgataaatgaaggacgaaatttactctcaaatccatacggtcagctccctacatccgtacatgctactaaatcgaaatactaataaatctatatcactcgaagatgcaggagaggaggaaactcgtgcttaccagctgatgctgcagcctcatcggcggcctcgagggtctccatcttcacactccccttcctcatcgcctcctgctcctctgttttgatggcttcccctggcttccctgcagcacccagcaggaagacgataagaaaaaacaacacagcttagatcagtaatcaaatcaccggcagcctaagaaccaaaaagcagaccagaccaccatggccggccggatgcgaaaggcagtcaagctgagccgacgaagaagagcggagcataccgatgggggagaaccttgccctgacgagggagagcacaagtagggatcccagcataaacgctatcagtgccgcattccccagcctcctaccgtctcccctggtcaggttcctgttagacttcatcgccttccccctcccctctcctccttcttcaagactgaatatttggatggttcatgagggaaaatccgagtcttataccactagcaatggaagcatgagctggtgttgaacagggcaaagaggttgaaatggtagtgtgttgacccggtgacagccacggctcaacacacaaacaagggtactactacaagaaaggggaggaagaagaagaataaagggaggacttgtataggaagagaagggaggacagagatgagagcgcgtcaaaagggacgcaagccaagcggtagcctgcagcagcagcccgagctaatatacttgttcctgaaatctattttggagactactctcgattttgtcttaactagcaacggctaaacacgaaaaaacatgaaaaagtccagctgctacatggcactatatgcatgcctttttttagaacgtggctccacagctagtgctagctagtttgtctaaaccagctaccactccatttatgaaagatattatccacatatactttaaatacaattttctcttaaattacttatccgatctacgatccgattgcaccgttgtgtttatagcaattaaatctttataacaagatctcacatgattatattttaatgaaaaattataaattacttttataatatatctaaattacttttagattttactaaattacttcttagacatgtaaaagtaaattcaatgaagcctaaaagtaatttacatatattatagaagtaatttataacaaaaagaaattaactttaatgaatgtcttttttaattggatgtgactacacagttagtggtagctagtttgtattctatctagtatctcctttcaacttgaaaaatacaatagtatctttttttctcattctacatgaaaaacaaaaatgaaaggaaaaaaacaattgatgattaaacagatttacagagagttacttttgaaccatgcaaaagttacttccaattaacattgaagttacttttaaaaattgttaaacttatgtgtgttgatctgtgctgattaaatttaatttctagataaagtcatatttttatccctacaacgaatttacttctaatgtcgtgacaaaattacttctgttttgttttaagttatttttataatatatgtaaattacttttagacttttatatgtctaagaagtaatttagtcaactctaaaaataacttatatatatatatgtgtgtgtgtgtgtgataaaagtaacttagtaatttacaaatataaatattttttcatcgtaatataatcatgtaagatcttgttatgaagatttaattgtaacgaacttagtggtgtaatcggattatagatcggataagtaattcgagagaaaactttatttgaagaggaaaaggatgtacatatatagtaaaaaaacgtaaaatctatttggaggggcatctggattttatctttaactatccggttatcccaacagtaacatcacacagttaccaacactacagagctgccgttgtcgctgtttctttttaagcttatctttgttggattagtgattagttttattgcttcaaggcagatgacagtgttagaaaaagcactaggcccagaaagagattcctgttcttagcgccggtgaaataccttcaaaataataatgtgcccaattcactaaatcactctctccaaaataataatatgatactttctagtagtatcaatatgaacactaggaagtgtcccataagaccatactcccatccatctaaaatcccttatattatgggataaagagagtacttagatgcaatggaatgtgtccatgagacgagttcagtttctggacttaaacgctattttctaagttataagcaaatagacacgcctgcacaagtgtaatactccttccatccaaaatataagaatatagaaccgtcccaaaatacagtttacttgcccagattcgtagtaatagaaaatgtcctatctgatactacgttcttatattttagaagggagggagcatgtgcatttgtgcatcctgagttgtataaaaataagagtaaagtgtacggacggtctttaaacttatagggttgtgtcatctaagtccctaaactctcaaaatgcatatctaagttccagaacttgtcatagtatgtcatctaggtcccaaatcgccaaaactccttcaggaccatacgttgtgttgatgtggcatgccacacggatatgatgtggcattattttgactgacaaatgttacccatttaaattttttcctttttctttttttcttatctttttcccctttattctcctttctccgtgacccgggtagaagaaaggaaaaaaagaagaatgagaagaaaacggaaaagaaaaagaaaaataaaagaagaaaaaaaagaaaaggacacgtcacgtccatgtggcatgtcacatcagcgccacgtaggatcttagaggagatgtatcgatttgggacctagatgatacactttgacaatttctggaacctgaatatgcattttaagagtttagcgacctagatgacacaaccctacaagattaaggatcaccaatacactttactctaaaaataataatgcattggcatgttttgtctagaaaaagactttaacaactaaactgatggtgcgacctgatgctaagccagtcaagcaaaaactgtggagattcacaccagatcgaaaataggccatatgagaataattggacaaacttgtcaaggccggcttcatccgagaagtactccacccagagtggcttgccaacccggttatggtccgtaaagccaacgggaaatggagaatgtgcttggatttcaccgacctcaacaagccgtgacccaaggattacttccctcttcctcgaatagaccaattggtggcttcgatagccggttgcgagttgttaagcttccttgacgcttactccagataccatcaaatcaacatggcaaaagatgatgaggagaagacgccattcatcacaccctttagtgttttctgctacaccaagatgccttttggattaatcagcgcaagcaacacatatcagcgtgagatccaaggggctcttggtgaccaactcggatgaaatgttgaggcctacatcgatgatgtcgtggtcaagacaaagacgcgtgacacactaattgatgacctcagagaaacattcaataacctccgacgacatcgcctcaagttaaacctagagaagtgcacgtttggagtaccatctgagaagcaaaccctgagaagatcaaggccatcgagaacatgaaatcacccaccagactcaaagaagtgtagaagttgaccggatgtatagcagtacttagccgcttcgtagccaggatagccagaatgggagaacgagcacagcctttcttcgctttactcaaaaagcaagacaaattcgagtggactcaggactccgagaacgcatttctcgcgctcaagcgctacctgtcaaatccccctgtacttgttgccccacaacctaacgaagagctctatctatacatcgctgccacaccatattctgtgtgtactattatcgtcgtcgaaagggaaaaggtgcaacacccaacatactatgtaagcgaagccctccatgatgcaaaagccaagtacccacatattcaaaagctgctctatgttatagtcatgacatcaaggaagcttggtcactacttttaggcacacaaagtcacagttgtctcttcttttcccttgggagaagtcgtcaggaacaaagacgttattggccgcattgcaaagtgggtagtcgagctcagtcaatttgaagtccactttgtgccaagaacatccatcacatcccaagttctcgctgatttcgtagctgactagactattcccaagaatagaacaagcagccagactgataatgagacatggaccatggcattcgacggtgcactcaacaaccaaggagtaggagccggatttattttgacttctccaacaggagatcaattcaaacatgcaatccacctaaacttcctcacaacaaacaacatagtagagtatgaaggactcctcattggtattcgagcagccgttgcactcggggttaaacgattgattgtgagaggggactcagaattagtcgcaaaccaagtgtagaaggattacaaatgcaccaatcccgagttggctaattacctcgctgaagtcaagaaactagaacgaaactttgacggcatcgaggttccacacgtttatcgcaaggataacatcgaaccagatgacttagcacgacgggcatccaaaagagaacctcttgaacctggaaccttcttagatgccctgataaaaccattcgtaaaagagtcgcacgacgaaagtaccatagccaataccgacaactcctcgagggctcaatgatgaggacacaactagctcgaatataaccatgactaccttatgtattaatcaaccaaaggtgcatatggtctatattagatttacatgttatatatttgaacaaacgttgctacaaagtgagtttcgtgtgtttttgtttgcagaggtacttgcttgggcgaaggaaaagagaccgagcgtaacaaatgcatggataatcaaagaagttgattggggaccaaatcaagaccttctccaagtctacttctacctcaccgcgtcacttttggtccaaagaagacaagagataaaattatacacgttttggattcggattcgggcctcctaatagaatcaaattcaaatggacctatccgctaatatagaaggaattttggggcccatgagtacttgttggaaagcttatggagtctactttcagatggtttttgtcccacataaaaattcctatcgagctgcctggaatctgcaaagcaagccatgtatctcatccagtccgaatctgatttatgttttgggccttataattgtgtagtgggcttagcccaaggtggtgtttgccctaggacaaccttaggacgtccctaatcatacttaatcagtagctgtcatcgtttagagtcgggtttttcttagattaatctgtcaagaacagtttcgccgctagatcggtttgtagaaccccaaattcgagtgcttaatcattcatatgcaattgtgttgcaatctatcttgttcttgcttgtgttctttgattcgcatacagagattagtcttcttggcgaggtcaactatgtttcggcacggttgataaccagaggagacgtggtgctacgattgcgaggctcagtagcgtgttcgtttagaagcaagatcgagttgtgtcacgactccgtgcaaatctactgtttatcaatacctgtcggaagagcgggacctaacatcctcatcagggagaagaaggaatttaattaaatttagtctcgatcattactttggatttattaaaattgcctcctttgataaattccactaaaaatcatgttattgtatttaaacacgaggaactaaaaaaaaatccaccatgcaaattccacttattaattgcattggtgaattagaggtagctccaggttaaattaaataatttcttcgggtgatttattactaaatttgaggctaaggaaaaaggggaaatttcaaggtgtgacaaatactgcctatgactcatggggtggtgcttttgttggaggttggattatatctttcctcatttaatgtttctactcttcctatttaaaagaatgctgctctaagaaactggaatgttttatgttggaatgttagagggctgaattctcatgataagtggttagccatccggaatacggtggaagaatgtggatgtgcaattttttctttgcaagagacaaaaaggagtacttttcatcattcttacattaagaaattgatcctaagggatttaacaaatttgctttttctccttctgtggatgcttctgggggcatccttgtaagttggaatatttctattttttatggtcctgttgagactgttgagagatttgcagttcagattaaatttacatcaaatcactttggtgtggtttggtctcttgtgtctgtttatggtccctgtgctgggagtgagagggatgactttgtgttgtggcttcataatctcaatatttcggtcgatcagctatggttgcttcttggagatgtctatttttatcgctcagtcactaaaaggaataggcctggtgctgacatgaatgatatttttttaatgaaatcattagtgatcttagccttgttgaattgcccattaagggtagggcttttaccttgagtagcccttacttgagcagctagattggtttttcacttccactgactggactttaaagtttccaaatactttggtgaaacctttagcaagatcagtctctgaccatactccttgtgttgttcaaattggcactaatattccaaaagctaatatcttcagaattgaaaatttctaggtggagcatgagggcgttttttgaccttgttcattcaatttggcagaatcatgtccatttttcacggtggcagtggatggaggacttcccacgcgtgacggcaacgaccgacgacggcggtgtacttcccgcacgacgtcggcgatgaccggcggtggcagaggtaaggtttctttctttttttttcaatctttgagctattcttcgggatccgagaccccttcttcttcctccttcctaaccccactagatctacttctaggatggctctgataccattgttagaaactaaggtttcctaggtgcggatctaggggcttaactagctagctcatgggagtagtagggattgtcttagagagtgaacagggaaggagagagggagagaaaggcataccggcatcggtgttggagcttgacacagccatggggagggtgtggtggcgtgtagatgttcctgagctcggtgatgtcggtgtgaacgacggcggtagcgatggtgagaccatgaggaatcccctctcttcagcactttcccggatccgtggcagttttagggtttgtagggagtcaagtgcatggtgaaaaaccttggcccgcgtgcccggtcaactcccctttttattgtagcgatgcatgagaggggctcacagccatggataggatagcacccccgaccagggcgcatgcagcggagtgggttcctgattccccggagatcccaactaacagttcataatggatctcctgatgccaatagttttgatgtggcagattcctaaatattctgcttctagccttgatgttcttgcactgaatatacattggaaaatttcttatagcttctggcactgaattaattccaggtaggtcataatgttatgtttccacgtgttttccaatgtccaatttcagatttttacagctgagagagagagagagaaatatttggtcgtgtttatagtacatactaggtaaaaccccgtacattgctgcgggaatttagtatgataacaataaaaaaaataacgtgtaagatagctagataacatcagactaagtaaattaatgtggtttatgataatttaaatttaaatagtatgtagaatggtgattcaaatgtaaaaaataagatgctatgactttatggaagaagaaaaatagagagatagtttggactatagattaatcatctaaaggctaaaaacaattgatgtgatatgacttaattagaggaaaaaaggagaaagataatttggactatagattaattatttaagtactaactaagtgaggatgaagtatataggatatcataaaacataataaagatatacattgaaacattatgtgaattatgttggatgataatttaacatgtttgtatttgaaaagctcttaaattataaaaactataaagatatagcatgtttgcatgatgtttaaatgtgatgattgctaatggatgatgatgtagcatcttgttaattagtggatgatgatgtggcatctttgcaggttaagcttaatgagttagtggggggtaactttatagtaagataagatatgcagttggtaatattaattagaggcaccttcatttcctgccttttttaatgttaagccgcacttgctgcctagccgacgatgcaggggtttatgggtgatgggtgaaaacttggatttcaaggagatggctgagatcgtcaggagtgggattgtcgtacacatttgaacctttgtttcccaacgctttcactttcctagatttgtggatcattagcgcggcagttttttttcccatagagtgtgtgaaatcagctctcaactgcactatacctggtgattctgttagtcatttcagatgttgcatctgcctggtattcagaaaacgaacagagcatggcatttggtgttgcattagagaagagtccgatgggtttatctactaagaatgcatggaaaattttatcaacgaataataataatatcactggtggagaaaccatctttggccggtcgacccaaatccacaatagtttcggttccattaaaaaccgggactaaaaaggatttttagtcccggtttataagagcaacgggactatttgatcatttttagtccggttcacatgttctcagggctcctgcgatcttactcccaaccgggactaaagatcctaactttagtcccggttggtgttaccaaccgggagtaaagatcccaggggtctttagccccggttggtgttaccaagcaggactaaagatcaatccctttatatatgtcttcttcctcctccagctcgagccaagcttcgaaattcttcatacaagaggggaggtcatgcgaaaatttcttgtgaatttattttagttattatatacaaatcggaggtgtctgattagcaacttcattctccaatgttttttgttgtcatattacatttggagctatgttttatacacattattgtctctaaaactttgttagaagttgatgagagagaaaatttgtgtagggaagaagaatatattgaaattttgtttatttacaattttataaaaagtttttataaaatagttgagaaggaaaatatattgaaaattaatctaaaaaaatagaaaacaaactaaattgaaaactaaaagaagtgcaacacattaaatattattttaaaactttaaaaataatttcaaaaagaataatttgtggcattattttataattattgtatgaataatgatatgtcattattgtatgactgtttagtgggtttcactttcgttgaatatttttacgatttttttgcatttcatgtagatggatcggcaatgcatgtacgcggaccggcggtcgcaagagtttattgacggcgtgcattattttttgagagcggccgatgctaacaagcataagggttttatttgttgtcgtgcaataagtgcaagaaccagaaggaatattcatttccacttgtttgagtcggggttcatgcctggctataattgttagacatcgcacggagagctaggggttcaaatgaaagaagaggaagtggaagacgggaacattccggactgggctcagtacgctggatttgaaggaaatagaatgggcgggtggacggggatgttgacgataacgatggtgcggatgatcttggtcagatgctgcaggacgccaaggaggactgcaaaagtgaaaaggcagcccataaattggagcctttataagaggaccacagaacgtcgttgtacccaggttgcgaacaggggcacaaaaagttaggtaccactctagaattcttgcaatggaaggcaaaaaattatgttagtgacaaggcatttggcgatttattgaaactcgtcaagaacattcttccggagggaaacaaattgcccgagacaacgtatgaggctaagaagatagtctgctctctaggactggaagttcagaagatacacgcgtgtccgaacgattgtatcctctatcgcggtgaggagtacgagaacctagaaacatgccctgtatgtaaagcactatgatacaagattagatgagatgatccaggtgaagttgacgggtagccaacgaaaaagagaattcctgctaaggtgatgtggtatttccctataataccacggctaagtcgtttgttcagtaacagggggcatgctagaatgatgcattggcacacagaagaacatcaacaggacaggatgctgagacaccccgccgatggtttgcagtggcaaaacatcgacagaacatttaaagactttggagaagacgcacgaaacataaggttcggtttaagtacggatggcatgaatccttttggagagatgagcagcggccatagcacttggcctattacgatgtgtatctacaaccttcctatttgcacccaaatttagcacctatggacgaaataggggaaaattgcaaaagtttggaaagtgatgggtttccttcacagggccggtcagaccacaagtgtgtgggcggtctaaccggctagtagggccggtctgactgcaggtatgtgggcagtcagaccatcagggtccgagtccgagtctgttttcgtcgggtctcgggtttccttactcgggaaggcgtgtttcgtgtttcctttggtttctatcccgagttggatgtggaggagggcctgtagagggcaagaccaacccctatttaagggacaagcccggttcattgtaaaacccccaaatacaatctacttgaatcgttcttttactatgttttctactttaccctagttttagtccatctttgtcagtttgcgccgtaaaccgtccgccgccgctgcgagagtgcgacacctctttgtaggtttgacctgaaaaccttccgttttgcccacgagacgggtagttatctagaatcagctccgctagccggtttagttatcaaaacctatctaggtttagctttttgctagatcgaggtggttggcgactctagaatcaccgcaaggcataaggtgctgtgatcgtgaacttgtcaaaaaagttgccaacacaatttttggcgactccactaggattcgatctattcggccatattacggccgaatttggtttgatctagccgtttcgtcaaatcgagggtttcggccaaacggccgaaatcaatctatctatatattgccctcgttgcattgttttcccatctagccgagtgtttcggctatacagccgaaaccgatctatacgagcgcacgtcgagtcgtcgagacagcaacaagcagccggcagcatcttgctgtaaacggcctgaaaattagaaacttaatcttattcaatttgctatctatacgtatactgaaaagaaaaagatcaggctaccagaaccgatcgatctacatacagtaggcaaaactgaattggtttctgttagtacatacattagcacatctagcgaggagaattaaaaaaaaatcaaagccgattcatattgtttcggctgttagtgtgagacatcgattttctgaatttttgcttacacacgaggagacaagcaattctgttttagttgcacacacgtttgttatacttaaggaaatcaaaaccgtatattaatttattcggtcaaagatttcggctataagctatatggccgaaattaatcaaggaatttcttcatcaactatgacgagtgggaacggttacaacaatattactacacaatgcattaggactgatcaagacgtcataaaaggaaactagtttcactaaaggtaaactctgattcacccaacccatactttgctattcaaaaggttaatgatcattgtgtagatgcatatgctatttctagttttgctcctatataatatgcttataatgctatggggtcaatgggtaattatacagctgattacacaggaatcggctatatgcaaaacctagctaacggtatgaccggtcgtgacaccggtctaaccgcatcctatgctggtcagaccgtgcctaccatagccggtcacatcgtgccctattctggccagatcggacctcttgtggccggtctgatcgcaccacttatcaccggttagaccaggccatgggccggtcagaccggttccctaggagtttctccaggttttcataccacgactagcagtactgattttaattattattcatcacctgttaatactgttagtcatgctattccacatatccctaatgcctacaatgatactaataggggatatcctcccgatactaggtatggccaatataattatattgcgctgcaacaaccacctcttaggccaccaaatacaccaccagatccacataggcctaaagatatgaaggagttaattattatcattattaggaatacatttggggttgaagcggaggatcgtgctagggagtatcaaaagccatatcctgatttttatgacatgatcccacatcctcgtggttatagaattcctgaatttaccaagtttagtggtgaggatagtaagaccacatgggagcatgtagatcaattctaagcgcaatgtggtgagactagtaatatggatacatgcaaattgcgcttgtttcctttatctttgtttggtactgcttttacatggtttacttctttaccggcaaattttatttttacctgggctcaattagaacaaaaatttcatgattatttttgcactggtaaaactgagcttaggttgtctgatttaacattggttaggcaaaaatacaatgaatctgttgctgaatatattaagagatttagggatgttaaaaaccgatgttttagtttgaaaataactgacaaagatttggccgacattgcatatgatggattgcttgattctattaaagagaaattgaatggccagatatttcttgatgttgatcatgtgttgcatgaagctcaggctcagaaaagccgagtggatgacaatagcttacaagctagtttagatgaaagtgcaatatcatgtatagccgaaccaagcgatggttcggattgtgttaataatttgtgcaatgatgccataacgattatagccgaaccaaatgttggttcggattgtcttgctagcttggataataatgcaacaaccattatagccaaaccaagagacggttcggattgtattactagtttagataatgatggaatagccgaaccaagtgatggttcggattgtgttggtagtttagacaataacaccattgaagatataaccgaactaaatgacggttcggattgcatcacaaatgaaagtgaaatagcattgtcacctaagaccgaatcacaaatcggtcatgtggatgttggaaaagatgatgataatgtcttacgggatagtagtgaaatagaattcaaagtagctatgcatatatatcaaaggtcgtatcctgaacacgtagattcggtcccatacccgcaaggatttgaggtgcccaacttcacaaaattcacagatgaagatgctagaacaacaatggagtatattggccaatttattgaacagtgtgataaggccggtagtgatgatttgcttaagttaaaattaacttcctctttctttgtcaaactttgcatctacatggtatagtttacttgctcctaattcaatttctacaaggttacaaatggagcatgagtttcataattatttcaaagatgcaagcttgatggagcaaagaccgattgattcctcattggtcacttgtgaaactatttcagttacatctatgcctaagaccagaatttttagtgatcctttccctaatagtcctattgatgttgacaaaaagaaagggaaaaatgttattattggggatcctcggcccaagactaggatcaataatgcgaaggccaaagatcataaagttgcaaaggatgagtcatctagttcctaaaagaccaaaaagccgaagctcacttttgagatgcttatggctaaatacaagaaaggattagccagtcaacgatttaataatcaaactagtgattcaaaaagaccaagatcatgtcgcaggaaaagatttggtcaaacaccaaagcaatcggagtcatcaactatacaaactccatgcaaacctccggttgtgatgccatggtatccacatccaatgtcaccgtttggttatccttttatgtattacgtgccatggatgcctcaaccacctatgctgtgtcatcaaggatggaaggaatcacctaggtcagtaccaagtcattcatttaactcaagacaagaccgtttcccacaaaagaatcggtctggtggatcaaaggtgaaaaaggtgaagaaggtgtgggtgaagaaagaagccaaagctccggaggtcgttgctatcaaggaggagtctcaagatgttcatgtacctactggagatgcggtggaaactatacaagtggagaagactgaagccgacgccgtaactgtcaacattggcggtctaaccaagacagctggccagtctgaccgccagactacggctggtctgattgaccatcctagacggtctgaccgacggcttgtggtcggtctgaccgggccgaaaggctggtctgactggggggcaatggagaagagtgggaaaaatgagagcagcacaggagcttccacttcgaccaaaaatatcaagaatcattgcatagctcctagaagacaaccatagccgaagtggatacctttcggcttatctcgctctcaaaaaaaagaaaagaaaaggaggccgaagatgtggagaacaaaacatatcataatttagagcctcaaacaacacctaagcgagtgtggagacctaaagtagtaaaagttaagagaccggtgatttcccatagaagtaacaaatctaatttgatgagagaagaatcaccggtcattagagataagtctccttcacatgatgctgtgggtgttcgtgcggtgttcatcttgccttcgaaatcgtgcagtcgagaaagccaattttgcttggggggcaagacattattatgcttatgaaggaaccaagagaagatgaacggcgaaggatacaacatcacaactttgagccgccgtttgttggatgctaaggcaaggtatgggtttattgtgttcattatcatattatatgcgtatgccatgttattagaacattgcttgctatctagcacatgtgtgtttttgcttatcaaatacatattatacatacatgttgcaaatgccagttctaagtagtggaattggtaggttggcatataatttgtttgaagtatgatttggctcatgagtctttgatatttatttanagccaaatcgtatgtgtttttatggatcaccatataagatatagatttcatatttattacaccatgaaagtcttgcttattagtaattcggctaatgtcaatggtcaatgtgatgatttgctctagagttgttttctttagggacattggcattgttaatattttgcatacatgctcaagccgattacttacatttgtagtttattggaatctatgcatttggtacatatgactttggtgattcattattgatcatacttcaattggctaagtgttttgatgccatgatgattattgtttcaaaagccacttgaattagtattcatctagacatattagttggatattacaattttttatatttctagagagaagaaattttggtccaatttgatacacaaagcatctggctataatgtgaagagaagctatatattaaaaaagccgatgcttgatttcaaaagtttggacgaaattggcaaagttttagattgggggcggtctgaccggcacatcacggccggtctgaccggtggtgacctacggtctgaccggctttgcatggccggtctgaccgggtagatggagtggtctgactggcattgcgtggccggtccgaccgattgtgggcagagagctggggggcacgtcacaattgatttagaggccaaatgaattgtaaattcggacatttgtgcccaggaataataaggaggttggatttctttgataaaatatttgaaagaccctagtcttaaggttgatcggaagattcggcggcaagcattcaaatacactttgcttgatagagaattatatcaccgaaaaatagatggaatactttttttatcaatctaaggttgctatgggagaagtacatgaaggaatttgtggaactcatcaatcggcccgtaggatgggttggttgcttaggtgagtaggattttattggccgaaagtgattgtttcgaatactatggaggatgtgaagtttgttaatggatcggcaatgttcaattagcgcctaccgccatgttgaatcctatcattaaactatggccattccgaggttgggctttggatttcattggtcaaatttatccttcgtcatcaaaagggcattggttcgtgctagtcgcaatggattacttcactaagtgggccgaagccgtgccgctcgagaatattacttgtacggaggtaattgactttattttgaagcatattgagaatagattcggtattcctcaaacattaaaggagcttcttttatgtccaaggaagtgagaagttttgccgaatcttatgatattaagttgttgagttcttctctttactacgctcaggctaatggataagccgagtcgagtaataaaacattgttgaaattgtcgttttgccagttgaggtaaatcttggctctcttcggtatttcaagcaagacgacttgtcagttaaagattacaagaccttgatgggagacaattttgaagatgtcatcgacaagcgtttgaagactttgaaagagatggagacacttcaagatgtgtttttagagagcaatcaatgggaaatacttaaagaaatacttttctagcgtttggttagatgcttaggaagtcccgtggccggtaattggattatcgtcctcagacaacatgttctatgcttttagattcacgatgttcattataaaggtagggggcatgtgtttacacccaaatttggcacctatggacgaaataggagaaaattgccaaagtttggaaagtgacgggtttccttcatagggccggtcagaccacgggtgtgtgggtggtctgaccggctagtagggccggtcagaccgccagggttcgagtccaagtctgttttcgttgggtctcgggtttccttgctcgggaaggcatgtttcgtgtttcctttggtttctatcccaaattggatgtggaggagggcctgtagagggcaagaccaacccctatttaagggacaaggccggttcattgtaaaacccctgaatacaatctacttgaatcgttcttttactatgttttctactttaccctagttttagtccatctttgtcgttttgcgccataaactgtccgccgccgctgcgagagtgcgacacctctttgtaggtttgtcctgaaaatcttccgttttgcccacgagacgggtagttatctagaatcagctccgctagctggtttagttatcaaaacccatctagatttagctttttgctagatcgaggtggttggcgactctagaatcaccgcaaggcataaggtgctacgatcgtgattgtcaacttgtcacaaaaagttgccaacacttcccccttagctatgcatgaagaggaagtacataatgatgctgattattattcaaggcccaaagcaacgtggtaacgatattgatgtgtacctaagaccactggtcgaagatctgaaactgctatggaagaaaggtgtccccgtgtgggatgaggataaacaggaggaatttaacctacgagtgctgctgttcgtaaccatcaacgattggcctacacttaacaatctatccgggcagtcaaacaaggggtacaaggcttgcactctattagtacaaagcttacaaaagaggaaaggaaagctactagagccatacccgaactcttccgaaggcttccggactccgatttctattctattcctactccactagcttaagactactaaactaaacttgagagaatatgagagagctttgcttggattgtgtgtggaggaagtgagaatgagacctccttttatagcttgagaatgacggttgtggcggttggaatggtcgggaataccctccaactgccatagggagtcgatctcagccgtccaggagaaccttggatcaaatggtgccgcggtgggttcggccaaaccatgggctgggccggcctggcccaaaattggcaggtggccacctctactgctctcatccacagacttgtaaattttggcccagtttatcgtgtcaattctgagttcttggcccattcatgcataagtctgatcctctacatcgtccgattgatttatcgtctggtttgatctcgattctcctccactttatggttattctctgcaacaggttagtaaacctaatactagtagaatattattatcttaacataaatatgcattgcaagaataactagttctcctttattttggtaatattgacggttgaaactgatcgctaacgaccatcaacacactcactgtatggatgaaactaaaagtacgtgtctgaagcattgcagaaatgttgtgtacatgggccatcgtcgatttcttgttgcaaaccaccatgtacggaggaaaggcaagcacttcgaacataaggcaggccaccgtactaagcctaaacatcacagtgggaaagcaatgtttgttatggtgaaagatcttaaagtagtgtttggaaaggggcttggcagccaacctacagagagcgaagatgataacgaggcggtgtggaagaagaactctattttttgggagttaccatattaggaagtcttggacgtccgccacacaatcgacatgatgcacctcactaagaacctttgcgtaaacctgctggaattcctaggtgtatatgggaagtcaaaagatacaatggaagcacgtaatgatctgaagcatatggaacaacacgacgaccttcccttggaaccaaaggagaaacgaagccattacttgagtccagccagctacactcttagcaaggcacagaaggaaaatatgtttgaatgcttggagaacatcaaggtaccgtctggatactcctcgaatataaagcgaataataagcatgaaggagaagaagttcacaaacctaaagtctcatgactgtcacgtgttgatgacatagctgctacctgttataattcggtgtatccttcccaacaatgtccgggcaatactaacaaagctatgtgttttcatgaacgcaatttcacagaagatcatcgatccggatagattagaaacccttcaaaataatgtggtacaatgtcttgtcagctttgagttgatattttcaccttcatttttcaatataatgacgcatctgctttgtcaccttgtcaaagagatcggtattttcgggcctatgtacctacacaacatgattcctttcgagaggtacatgggtgttctaaagaagtactccctccgtattttaatgcatgacgccgttgactttttgacaaatgttttacctttcgtcttattaaaaaaatttatgtaattatgatttattttattgtgacttgatttatcatcaaatgttctttaagcatgacataagtatttttatatttgcataaaaatattgaataaaacgagtggtcaaatgttggtcaaaaagtcaatggcgtcatacattaaaatacggagggaggatgttcgtaaccgtgctcgtccggaggcaagcattgccaaggggtatgaaacagaggaggtcattgaattctatgtagaatttattgaagaccttcgcccaatagaggtgctcgaatcacgccatgaagggagagtacggggaaaggggactctcggaaggaaagcaataatgatcgtagacaacaatttattccgtaaagcacatttcactgttttgcaacaatctttattggtggctccttacacgaggagcacttggctctagttcgcgctagaaacatcagtaagtccgatgcatgaattacacgccatcacattgatactttccccgcgtggctgcaacaacatcttatgggtaaagagacgattaaccaacaactagccttcctagtgaggggactatcgggctcgatcaggacattctaaggatatgagatcaatgggtacacattctacacgagagcccaagaaataaagagtacgaaccataacagtgttgttcgtatcgatgccatgagacacgatggtacaactggcacgtattacagtgccatcgagaacatatatgggaatttgactatggacctctaaaggtccctctgtttcggtgccaatgggttaggcgccaatgggttaggctgaccagtgaaggcgtaatgattgataacagtgggatgacaatggttgaccttaacaaggttggtgtaacaccccaggtaaccacatacctagagtgccacacaaaaatatactcaaaaccactaactcccaagatttttaaaaatttcggcagtctcccctataatacggacatccatggcaacaattataagataactcaacaacgatataatccacacaacccaaaccattctagctccataaattccacgtgaaaatagggacggaaactttaaatgtcctttataagttctacgcaaaacttatgctaaacataatcatagtttaaaactaaatttcaatagtgtgcaacaataatgtgtagtctaaaggtgcaactcccgccccatgccgatcaatgtcattaggtacctaaaaaccaaattaaacacaagagtgagtaacgaatactcagcaagtacaatattgaactagtaaaacatatacaggtttaatgcaataagaaaccaatacgaaaggttggatttactttattctaaaacaaagaagccaaaagatagtagttcccttcgggcaggtatgaatatcctcatagcattaccggtaagccgagaaagcgtgatcagcgcttctcaaaaatcatgaataaagatccaaattgcactcctatgactacacatggtacttgaataatgtaaaccaaacaatcggaagaatgaagcatgaataagtgaaacatgaatatgtagcataataccaaaaccacacagttaataataggaagcttcgaataataattgtgtaagtgaaactgaaaagtaacacagtttatccatcatacaagtccgtcttgtacttaccttaactccttcgataatccgactaaactcttccaacattagaaccctccacacatgtgaagcaaaactacacataaaccataatactcaactaatgatagttatgagggatatttactaaaatcgagacctggaacatataaaccttttaccgatttgtattaaatattctatagttgttttattactgttttatgcgtaattcacaaaccgtctaacggaatctagcaaataatacaacttcggacatctagacaaaatttcctacatctttcatgttgggcacaaactcagattaagcctctattggtctcagattaagtaaatctaattactgtcccagttaaaacagatccggtcagcagtactgtttcttttgtttctcctaaaccatttattggaaacgagcgaaaccagtggcgttagaaagatatcgacattgactacaaattttatttaggacaattaatctgaatccttacggtgtaataccagatttgaaaatactattgtcagcccataaacaacaagtaaaaacacccgaccggcaatccgatcgattcccacgtgaaaattgaactaccatggatcaagaccagttacccttacaaaggagaaaaacaaatttgaggtgaatttgtggaatcctagaaaatccccaattttgcttctgtttccccttttcttcttttaccctcctgcttcctgtgccctgaaccctctcttccctcattgtcaccaccaccaacagc

SEQ ID NO: 71454 - DNA, 1704 bp, Oryza sativa
agcaaactggaaaataattgatcatctattcaggactgatgatatataataccaccagagaaggccacacattatccttgaactgatcagacagagaaaggcggtaggaaagaacattgataacaccatatcttgacgctgcagtagtggtgagacgccacaatattatttccatcaattcttttcatggcagacgagtagcatttgcgaccgatgctgtaccacgagcctgaacataatgacataaaatgaattactgttatacatgccattacatgcacagtttcattttcttcatataacaagtaaagtaagatgcttattatgacataataagatgaataacagttattcaagctgtagtccactaaaatatcatggtgactacaacgaaaatttgtttagattaacaaaaactagctaggctatataaataggtagaccctatataggaacaatgaaaaaaaataaaatattaaaattcctgctatcattaagatcgtaaccccttcattaataccgtgtcgggggtaggtattcctaacctctgcattaagagcttgatgaaaaatttcatttatatttattgacacatggttgaaaacattggacagaataaaaagctacttacagcttgtggattatctgcagtatagattgcacgaatattaagttctcgaacagcatcctcgctggtagagcttgggtccgttgtgaactttatactgccatgggccattgaaaattctccagttccaccaataacagaccactcaccactgcttgcagcaataatccccatcacctgaagtgtggatcccttaaacctgttttgataaaaaatataaagcttcatatatatcagagaagattatagaagtgacaatgcatacaattgaacaattaattaagtcaataaggtactcaacactatagcagggaaatttaaattatacatctagttatgctagcataaatttcaacctgtcatcctggaacacaatgttgtgggaagtgtaccacatgttagcattgctttggccagcctggacatgcatgccttgtacacgtgcaacgatattatcattgggattggttgtagctgttaaataccagtcatcaacgagtgttgtaccgaatccattaggatagctcgaggctatcacaaattcttcattgcggtttgggtgatttgctccagcaacaaactggtgcaggtacaagtgcatggtaacctcattttggtcagggcaaccacactccacaggacatatatcatagtaggtgctggcagccatgctcaggaatgttggaagcaagaagaggatgaaaagtgcagagctactgtaagtagccatgggaagtatagcaaattgttgatgagcagctagcaaggagagggagagagagcttgaatgccaactggagctagtttctctgctctgtgatggagattaggaatagacaatggtgtatttatagggtgctataattgttataatgtagacccgtgaatgtttatagggtgctatgactgttccccatcgtcctttacaccgaagggatcagaacgattggctcactgtgtacggggccataatgacttgatggaatgctgagaatgcccttttaattttgtgaaactactaaaatgccaggctgtgtttggaatcagcccctctccatcgtattccacgcgcacgt

SEQ ID NO: 71455 - DNA, 3613 bp, Oryza sativa
ccggccgcctctcttcccctctccgcgccgcccgctcctgcctcctctcccctctcccgcttcttccccgtgcgccgctgcgcccgcatctgcccgcctgctggggagaagcaatgagagccgacctcctccccctacttctttccggcgcgccgccatgcccactctgccctagccgccacacccgcatctgcctgcctgctccacgccgcccgcctgccgcgctcgcttgccgcctgccgccagcctccactcaccgaagaagataagagagaagagagaaaaaagaggagaagaaaataggagagggcaactgatatttgggtcccacgtcagcaaaaccacccatatatactgccataggactctgagtgtacgttttgtgtgggtttaggtgtgcaaatttctgattttgtatttaagggactcaaaaaaatctcgctattaagttgagggatctctggtgaacttattccttttgtttttgggttcccttggcccatcttgttcttttctgcaaagcccatggcccatctctttgcgcagcccagccagcacaggcctgcgctgcgtgtcattccagcagccatacacgcgcctatgcacagtttcgaaaaagaaactgaaaattagcatggtgattggcgcgccgccctgtgtgtattaccatgtgtattgcataagttattgatttctaccaagcaattgctttcagtttattaaaaatatcaacatggtaatggtacttaactgtatttgtctttatatttttcaacatcgtatgaaaatttcagtcaaaaaaaaaacatcgtatgaaaattgtcggtcttacttgtgtaatttcgcttattttatcttaattttcaattaaacctatagtagattacatctatttgaagatttttaataatgagattcttgctactactaatttggtgcttttaattttgctattttagacatataggatgttactatcattgtgttacttgcctcgattttgatttaacatgaagtaactgcatctccgaaaaaacttaccatgggctacaaattctaatatcgctcccttccttttatatttaccagtaatctatccgtgctaacactacagtgatttttgatagtgcaaatcaaaataaccaaatgaagaaacatacgtctaaaaatacaaatatacaagcaatcatatccatgtttttatgcaaatgctaaaggatctacgcatattagcattaaaataataattttatattcccaaatttatagtattttataaaattgtagaaatataaaattgtggtcaaactcacaccaccaagacaaaataattcaaaaattatataatttttaatttttgtcaatgggagtagtaaatttagatggagcaattaattgcatcttatgtatatgcacaacggtaaattacttgaatatttgcacaagaggtatggaccaatattataaccttataacatgaactgtctcatttcttctccaaaagggaatacatgacaattctttatccacaatttgcatataaatacatatggacaatctcaaatttattagtatcagaactttgcgtctaacgatctacaaatctgtccacatatctccatgtacgaggaccccgtataacccatcaacacattttcctggaggttatggacaattccaacagctcatcacccaagtgtatctccgttttttaatagatcaagccgttgattttttatcacacgtttgaccattctacttattaaaaaaatttacgtaattataatttattttgttgtgagttgttttatcactcaaagtactttaagcatgatttatatatatacatttacataatttttttaataagacgaatggtcaaacatatgttcaaaaatcaacggcatcatctattataaaaaacggagggagtattagaattatcgcagcaacagatttcatcgtagcacgataaatttcaatgcatctttgaaatctcatttaacacgctgaacttttaaaataaaaattaatcaatacttaaaagtacattactactgacgtgttcatacactccatttgtaaaataatttttttgcggggcatttgtaaaataaatttaaaagcatcgtaaaatacaaacatggatttcatcactgcacacaatatcttaatcaaaaaattgcaccagaagattagcaacgtaccatgaccaagcacaaaaaggcatatcatatattcattattggaccatttgctcaggtgaacaatttggtgccatacagacgaactcctggaatattgtaagatcaacatgtgttttgattcttcttctatgatgaataattggcatctgtgattattggttttgatatttggagattagtgtcgaagtggttttggagataattaattttcaggtgatgaacagggtttgctgttttgtcaggaccggtcagaaaaggcggtggttgccggtcagaccggcttgtgttgagcggtcagaacggccagcccgcggtctgaccggccgacgctgtgtcggtttcggtttcgggttgtttctttggatatccatgattgtttcacggttatggcttctggatggatactatacgtatgtaatactgttgtttgctaacaatgagtcaagttggtgatagcttggtctcggaatatggtttctttgtttgtttcatgtgtaggtgactcgatgccacgggagagtatttgcggtgatggaccgggagtcggcttggtggtaagacgatgtccgtggtggacagatatcatgcgggatacttaggctagagttgatgcacgtggttggtgattggttatgtaaagtttgtttcttgtactagagggttttctatggtgattaggacttttaggatgagtttggttcgtggctttaggctgcctacctcatgtataaatagagggggagcgtgaggcttcccgatatcgcttttgagagcaattgagttgctagtttagttagggtttcgagtttagtcgagatttttgtaaggagtgttgttggtacactttgtaaacacagagagaagcaataaaattgtcatatactttaagaattcttcgatttgtgtttcaccgggtttcggcggtctaaccggcgacacaccggcggttagaccggcggcggcagcgggcgcaggaaggcgacttcggtggtcggaccggttgatctatactggtcagaccggcggcatccgaacagtcagaccgacagatctatctcggtcggaccaacttccgtcaaatttgagggtaacttttatttccgctaaaagttttcggtttttgggtataccaaccattcacctcccccttctggttggcttagtttttgtgattcgatcctacaaatgtaagaaagtttggtgccatttaattaaagcattataacattttgcagagaacggaagaaaacccaaacaagcctcatgtaatactgcctattcctctttcgtccagtgacgcagttcctaattgctcaattgaaccatcatccccaaaagagtactgatggcctcagcaaacaatcggagaatgcaagcaaatcaagaagatagagtacaattagtcg

SEQ ID NO: 71456 - DNA, 23716 bp, Oryza sativa
caccaccgccagagacgccaccgccgccccaccgccaccgccatcgattcttgctaccatcctcaccaccgccatcatcatcctcccccaccgcgctgctttcgattcccctgaccgccccgcgtagccgccgccatcgtttctccccgacgccctcgccatcctcctcgccacagccatcacggtcgcgccagcgacgccaccgccgccccaccgccccgacgccctatccgtcctcctcgctgccgccatcgccgccccaccgacgcactctccgtcctcgtcaccgccgccaccgccgccccaccgccagcgacaccaccgccagcgatgccaccgccgccccactgccactgccatcgattcttgctgccatcctcaccaccgccatcatcatcctcccccaccgcgctgctttcgattcccctgaccgccccgcgtagccaccgccatcgttcctccccgacgccctcgccatcctcctcaccacagccatcgctgtcctccaccagctccctcccccactgccgtcctcgccgccgcctgtcgccgtcctcacccaccagcttcgacgccgtccatcctccccgctgccctcactgtcctcctccaccagtgccatcctcctccaccgcgccgctatcctacaagaaaaatgaatttgtgatttagaagtaaaataaatgcgtacaatatcactgacccttgaagtcagatgtgatacatctttgagtgttgatcttataatgctggctataatccaatgtcagatgttatatgttgcttgctcatggatacaaagcagtggatttataatgtcgacggcaatgcagcttaatgtacaatctgtttttatatacatctgttcatgtggatttactattgtgaaatctgcttgcgatttttcttcatttctttctgatctaccaaactgagatcatatttacatttgtctgaatcagattttctttctgttatcagatgaaaagttcaaaagcaaactaatcagagaatttcttcttgcaggtaacaagcctgccgccaggccttggttctggggttctcctccaccattccagtcttcgccgacactgcccgtgcctccatccaccgccgccggattggaactgcgcttgtgcgccgccttcgtgccgcctttgtgagccaatttcttcatattctttgcagctcatcaatgcctcgtttcaaaacaaaagattcattacctattataccctaagagctcccctttagcaattggttatatacttttcagtaatgaattttcaacatgaacagatggatgtacaaattatatgccgtaagagcatttggattcctgtttaccatgcaactctgaataggttttgcacatgcttatggatactccatgcatgagctattttagctgcacatgtacccctccagtttgagcttttatccactaattaattattttataaacatgcatggattttgcagtacagatatttggagcttttacagttacaagggtacagaaaaatccatatgggaaacaccttaacagaacaatttgtaatgctatttcttcagtacaaattgggaaacacaatggaatatcctatgttttttttatttgatcttcctgctgatggatcccctgcaggctgctgtaatcggttttcgttgagaggttctttagttagctaaaccttagcattgttagacttgctaatttatatgatgacattgtggccttttatactgtacagctggcttacacacattaagatatggataacaatattgggggctccacaccaacatcgttaagaagatcatgtgagtttttttatcgctctatttaagggcaaattattcagtgcattaagatgtgttttgcatgctgatttcgaatgatttcctccctcaggcccttttgctgatattaataatgcgagtgctggggattcgcccaaaaaacgtaacaatattggggtcttcacaccaacatcgttaacaaaatcaagtgagtttttttatcggtttacatatgtgactaatattcagtccattcatatgtgacttgcatattgatttcgcaatatttcctccctcagccccgtttgccgatattactaatacgagcgcgggggaatcacgtataaacaatgtgcctcaaaaggaaaatatgcaaagtatgaatccgaaatgtaaaatatgcaagttatgattttccattttctacctactagagttaacattaacataatttgcatgtgtgcacagaactgcaagaagatggtgctaaactcagcgcattagaattaagaaggaagcgtgctagagagaggtatgcatcaatgagcccaaagaaaaaggaggcgaggaaaatgaaggcccgtgtgtacaagcaattgaaggaggatgaatactcaggtttaactcaaacaactactaattatgtcaaaggttcctacataatcacaattatatgccaaaccagtttttaatattgttgcatgtgggcagctccacttggtgatattacaaatgttagtgttgatgatttaagaagatgccacgtaaatgattgttctacactgcagcaaggatcaaaccatgcattattacagcccgttgataggactggacctggtaacatcttcattcttacatttatcttgcacaaacaatatggtgatacagttgttttgaaagtaatgttctacgttccaacaggaagtgatcaacaacacatgatcacacctcggtgtctaccatttacagtgatcaacaatgtagctcagtatgataatgtggatcacactggatcccctttcagctgcatacttcaaggtgcaacacaaaacagccatacactacctgcaaatacaggtaaattcgtagtttttgcctgaatgaaattttgtgttcatactaatggttattattaccaatcgaacagtagtcaatatgcttgattaaaaatgtatgagattcagatcataactaatgttgcaaatattttttaagaaaaaaattgatgtattgtaaaacaatgcaaaaaccaaaaaaattaattaatatgttgaatacacatggtcacccattgacatagtacttacgttggacaactttttaaagaatgtactcaatctcatgcatttagccagcattttatctaaatggactgtaatgttaacattgattaattgtagtggagaaatgtgcggtacattattgtttcacatactccctttattccataatataaggcacaactactttttacaattgttttataatataaggcatacatgcatgtatgtcattaactaacacatcttctccactaaaatattattatttaaactctccaccaatatctctaattttattgggtgcatacattatatatattagattaatccaaactatggggtgagtgtattattatgttggaaaacaaataaggcggtcatgacgaccagggaacaaatcgaagataccaaagacagtgatgacgatgttgttatattgggtagtcatcaccagaaattcggctctaaaagggacatcaatgaaagtaaagaagtaaccgaaaaatatagttcactactctccgtggtatctacgatgagtaaacaagagttgatgagcggccttttgcagtacatccaacagatgaattgtgccgaagccatggagtaagccactgcaatgcattgtatacacaaacgtaattcaaacatgcattaacttattttctttgattgacaagaaaatataagtacaaagttcaaggccgcactttattagcttgagtctcaaacagcttcaatcaatactaaagaaggatgagccattggaaagtgattgcttcaacatggctatacgaaagttcatgtatgaaaaaatccagacaattcataaaactaaagaagcaatatcgaatcattgcctggacttgcaattttgggtaagtacttaaaatctaatgctcatgtcattctctattgctcatgttattatctacaatcacaatatcgaatatattgattattgcttatgtaattgaaccattttttaaatcatgtagagcgctagtggctttggtaaagacccggtccaccatgacaacgtacatcttgaaaagaccattggtagttggtcggaaattcattacaaactttcacattgcaaagcggtaagatcactaagatttgatcctatatggtcgtgttttatatattatcttgacagttgatcttttgtagattcttataccagtacgccatgctcgaagctttatcgtgctcatagtggaccaataaagtcaaacactctatgtattagacccaaatccacttatgccagaatataaaaataacccaaacatgagatacaccagaaaactgataactatttgtgaccactttaacaaagctatgaggaaggcatgccctggctctaggtggaatgaagacatcaacttgtggaggcaagtatttgtcaataatccggttttcgacaggtaagttatcttctaaaaactcgttcaaaccaataaatttaattctgtagtgcaagggtagctaactatcaaatttccttaggagtttatcgggttttgttgttcatctcttcatgtgtacatggaaaaataaagaaccacatttgtcggctattaatgtaagtcgtgataggcattgattatacatataatacattattttatatttaccaatatttaacttattataaatacatgtgcaggatagtgacgagctaaggaaacttttttttgctaaatctactgatgtaccaacaaaatgagtgtgaaagcaatattcctaacggcgcacaagattttctgaagtgtataaaaaatgcacaacattagggtagttatttaactatatggagtgatttaatttgaggtgatcatccattagaattaccgtatctagaaatgctggatgttccatattttttgcttgtgctttatttgtatgacatcatcaaattttcatagctgtcttctatctatgttgctttttataatttaataaacgccatgagattgttttatgcgccaaaaaggttgcactacacttctataatgataacatatatcttgctttcaaattaatctcaaaacaactatgacttgtagtttcttttcgatgccagattttatcccccgtgatcaacaaaattccctgtagcaacgcacgggcaccctactagttatatatgattattagaatttttaacaattttaaatcttgcatgtggtaattacatatgattattagaatttttaacaattttaaatcatgcatatgatatttatatatgcttataagagtttaaaaaaattttaaatcatgcgtttgttaactatatatgattattataatttttaacaatttaaaatctttcatatgctaattatatatgattattagaattttaatgcattataaatctagtatttgttaattatatgtcatccacataatttactacatattttaatctattttaaatgttttgtcattaattttgtgattttaaatcattttaatgcattatttactattacgttaaacccatatgtaatgaaaataaataagcactgttattatctttagtcccggttcttaaccctaaccggttcaaaaaagaacttggaaatagcgggaaaagatcttttcccggttggtggctataaccggttattaccaaccgggactaaagatcgtctctttagtcccggttggtgagaacaaccgggactaaagaaatctttagtcccggttggtgagaacaaccgggactaaagaaatctttactcctggttgtagctgttggtatttcttctttactcctggttgtagctgttggtatttcttctttactatataattcccagcaatagcactagaaataatcctggtatattacagttactgatgtgatccgcaagtacacgtatataccattgcaacatttcacccgggagtattccaaggtatcatatttattttatcccaaggaaaaatatgataagagagtactatgctaatagtttatactttacttgtatacatcaaggtctatgcacgggtaagttaagcttaagggtagagtgacagacagctgaggatttagctaactcctacatctcctaattatagctaagtggtagtagtttaaatatgttccatttctgtacttctagtatacaacatcttagtatactctaactagtatacactatgttgtataacccctttaacaatgcagcattgctaagccgtaactcagctatgccctcacgatgcatcgcaaagttaccccgggttgctgagttttttacaacaacctgacataaccctccaaccgaagtaggatacataggtgtatccaaccccagtaaattgtatgtagaaatataaacggcggggaagacgtccgtactaagctatcaccatcagcggcctgctactctcccggcgaacatacctctaaataatgatgagtgataacctaaaccctatgcttaagttactacttattactctacagccttgcaatcggtgcagagcatctgggtcctcgggccatagctctcgacctagccagagcagacttatgacccggtaatcagatattataccagcatcaatgcaaatcccagaaggtttaaccacacagattatactacttatgaataaactaagactgatactcatactctatgattggaataaagtaccaaacttgtataaagaagaatattatatttataaatggaagtcttacaaagaagaaaggaaaagctatagaacctttactgaactcctcgaggcctccgcggacttggaactattctaactctactccactaacactaatactaacattgtagagagctttgatccttgcttgagtgtgtgttgaaagtgaatgaggtgaggtccttttataggcaggtatgacggttgtagagcatggtaattgtcggaaataccccacaaccgccatcaggagttcgtccagagcgtccacaccaaaccccatcctgaacggctgtgatggggaaccatgatatggcctaaacggcccaatttttggcaggccgactccttgtttgctcctcaatccaaaacatggaattttgggcttaattgatcatgtcttttctgagttctcagcccatctatctataagtctgatcctcggcagcacctgattgatcgtttgtctattttctgtcgattctcctcatttatatgtgcttctcctgcatacatgttagtagcaaagtatatagtggaagtagatattttatttggaatttgtgcattgcaagcatagctagtcttcatactttggttaatattgatggtcgaaactggtcgataatgaccgtcaacaaggacattatggaagtcacagccgcgccacagccgccgccgccgctgccacaggccgccgccgccgccatcgataccgacgccgccacagccgccatgcccctgccgccgccctgtcgacgccgccatagccgcggccactgccgtcgcctctgctgatgccgccactgccgccgtgccactgcctctgccggcggccaccagtgaatgaacgtgaacgaacgagaaaaagatcatgaacgaacgagaaaatgagtggaacgaacgtgaacgaacgatagaaatgttagaacgtacgtgaacgaacgagaacgacagaacgaacgagaaaatgagtggaacggacgtgaacgaacgatagaaacgacgcacacgccgccccgcaccgcggccgcgccaatgccgccgccgccaatgccgccgccgccatcacctctgccgacgctgtcatagccgccgcaccactgtcgccgcctctgccgacgcggccacagccgccgtgccacagtcgcggccactgccgctgcctatgctgacgccaccagtcgccgcgcctctgcctctgcctctgccggccgccgcccgtgaatgaacgtgaacgaacaagaaaacgaacatgaacgaacgagaaaacgagtggaacgaacgtgaacgaacgatagaaacgttagaacgtacgtgaacgaacgatggagacagaacgagaacgatagaacgaacgtgaatgaacgagaaaacaagtggaacggatgtgaacgaacaagaaaacgagtggaacggacgtgaacgaacgatagaaacgatagaacgtatgttaacgaacgaacgagaacgatagaacgaacattaccgaacgatagaacgggacacctcgttaacgaacgatttaagttacatttatattagaacaatttagactaatacatttgtttgcattttactgaaaaatacatggtcaagcactggtcgtcaccgttgctcaagcctaagtggtatcaagccctcggaggaatttgctcaggcaagtgacattaacgatcaaacgtgattcaatattgttttgaattgtaacaatcgtttgtgcccaaattaaaattgttattacattgtaataataagttgtatttaacatacacccgacataagtcaatatatgattattagagtttaaaccaattttaaatcttggacgatgtaaattgttctcgatgtattgaagatccatataatccaattgttgtgtggcatatgttaattatgtatgattattagagtttaaaacaattttaaatcatgcttatgttaattatatatgaatattataatttaaaacaattttaaatcatgcttatgttaattatatatgaatattagaattttaaacaattttaaattatgcatatgttaattatatttgattattacaatttttaacaattttgaataaagcatatggtaaatatacatgattattagagttgttattacattgtaatagtaagttgtatttatcatacacccgacataagttgtaaataacatacgcctgcaaatatttcttgtatgaacagatggctgatcgcgatgacgaacagatacaatacgacacgatcgtagagggaagcagccagtactagaacaaagaagaggggaacgaggatccgaaccagtaactaaacgaggaggggaacgaggaggaggagggtagtggaagtcaaccctccgctagacagaagagggcacgcggacaacgaggtgctgtgaagaagattgagggtcggcacatcataactgaagtggacaaagacagctgaccaagtgccccgtcagatgcagcctggaatttcgtacgacacagcggttgggttgtgagggataacatgcctgtcagcacggtgtactggcgcagaataaggacacacggggattttgaatgttttgtcccagattcagagaaagagatgctgtggaccataatgctcgagacgttcacgctccatgagggtacggaagacaaagtgaaagagtggactctgaagaaagtgactgaacagtttcagaactacaagggagacctctacaagaaatgcatcatgaaagggcagacaatgaacttcaactcattcccgaagctcagggatcattgggatgactttgttgcttacaagacagggtaacaagggcaagcgcagatcgaccgaaacaaagcaaatcccgctaagaagaagtaccatcaccacctggggtcaggcggctatagcatcacagtgccgaagtgggaggatatcgaagccggcttgattgagagaggtatcgaaccggccatctctaaatggctggaatgatcaaagcgctggtactatgctcacggtggaacgctgaaccccgctgatggctccctggtgttcagcaatcagatacgcgaggctgccaatcgactaacggaagcagtggaagcctcttctcagggcatgtttcgaccggacagagagaaggacgagcttacgctcgctctgcagactcccgaatatccaggacaaacgcgagggaaaggcgtggttccttggaagattggattcaaggaggacatccacatgtacaggagttggatgaggagcaagagagataccgaggcgaagattgcagatctcgaagatagggtatcgaactatgagctcagtatgcaagaggaggtggcaagaaaggtggatgaaagtatggccgcacagcggagccatgagccccagccgtacattcctcctgtcatggtcagcccctcaggcaatcatagcggctgcacctcaacggggtaggtaggataacagagcatcgacgcgatgcaagctcaggatgaaaccacctgcctcgtcgatgaaatcacgcaacggacgccatgtgagctacatattccctttatgaacttatcaatcaaggtatgctcgtagttttatgatttttgacatgtacattctgcaagttgctgcttaggttgattactaatagataacctctcatcacgtgaaggtggcgtcaggaatggccattccaatggacccttgagggacttacatctgcaggccgattccacctggatactcgagggtcggagttgagctagtggaagccgtgtacgaggacctcgagttggactaccttggaggagacggcgagacgcatctacgagacacaagccacgtcattatactatggcgcaagcgctacatcatatttcttgggcgacaagcggcgtctcgtgcaccatctcctccagctcctccgcctcgtgcaccgtctcttctgcctcctacaccatctcctcaggctcctgcaccgtgtccttcggcaccttccaagttaaggtcttgccaagctccaccgcttgtccgcacaagggcaacgaagaaggcgaaagttcaagaccagccgctcgccgaaaacaaagaggaccttgatgcttatgtggtaggagaagtgaagaggcaattcaagcctcggagtctagaaaagaagatacctatagacccgagtgtgaagtacttcttcaagaaaatgtccacaacaaacaaggaggtcttaaagataacggactatgagcgaacacttaagaaagcatattacaaaatgtccaaaccagtccctcagcttggagagcaaccaaaccaagagatcgagccgttggtgaccggccaagaaattggcataaaagaattcatttctgacactgtactagctagggatcaactgcttaaaggcgcaccaatcccaacggcggaaatgaaataccaatttgaactcggtaaaccgcttgtcaagcctgagcagctgaagtccctatcaacacagatgtaccgattccatgaacggtacatggaaatgagcgccaacggtaaacagatgttcggagcaagaatcagaaactcagacttcttccaaggagaagatgttctctggatcctgttcgaggatgtcttcgacctatactatctggatgcccacgatgtctctcttctaagcacatggattttgtaagtatcattgagttagatttatttcattccttaattagctccttgtatatatgtacaccataataattccttttatcgttgtagaatgttgatttaaagggcccgacggtgaggggtttactatactggattcatcgaccctcggaaagttaacatcgaaatgatcaacaagtattagcaagacacagaggacaatctcatccatctcctgacgcagcagcatttcaagatgttcatactactgtcgtacagcacagagtgagtttttactgacttttgaacaaatttcgttcccgtacatacatgtacagtttcatatatcatctcacgcaaattgcagattccattgggtccttttacttttcgacttggaggcatgcgagtcaatgtctatgactcaatgaataaagaggagtctacttttgaccaggtttttcaactgatagacaggtaatgtcatctattccactgtcattacgaattttgctattgctactatgcagatctcggataataattaatcatagcttgcaactgcatgtagggcttgggatcggttccgtcaattggtccatgggacttggaaagaaaaacttggccggaggtttaattttccagtgagtacataatctctaattaaaatataagtgtatattaaatctctcgtcgtttctcatgtagtgtgcaaagcagacccagggaactaacttgtgcggctactacgtatgcgagtatacccactgcctatcaacccaaatctacaccacaagagagctcaatgtacgtattcaaaatttcattgcgtatcgatttcttgtttattaatttcatatattcataggttattcacatgagggacaacctcatacacaaggaatttatcacgtctgttcaagaacaactgataggattcatcaacaaactagtccttttttcttctgacataacaccaacgtcgaagtcgtagctagcgagcacatcaatgaattgtaatacatgtatatatttatatatgtacacatttactttagtgtaaatatatatgttggtaatatatgcacataaactgttaagtgctttaaattatacttgggtaattcatatatgaatttatacatatacatatgcatttgactattttgtaacatcgttactgcggaaagtagttgtgttactacacattgaccgtcgagttactatgtcgttccagcgagacaggaactaaaaaatgtataaatctcaatatttagagagcaatatctctcacgttgtatattatttttctaatccgtctgcaccgtgatgttcgtaaaaaagtgcttaacaaaactagatccatcataactattttttaacgttgttactgcgagaaagcaaacgtgttactgtacaatggttgtcctgttactgcgcaattcttacgagacgaggacagtaatgaggtgggcgtggggggaaatgagtaggcgggtttgaccaacgtttgaacggcggggggcactttgactaccctttgactgaggtgggatgtaggttttgggccctaggaagggtggggaaagtggggttgacccatgggagggggtgtagaatagttattctaggggagggttgtagaatagatttgctatatatatatactagaaaaaaatacccgtgcgttgcaacgggtgaagtctattttaatcttatcattgttatatagtttagttaagaagaaatgcactgtgagttagaaatcatgagctgcagttaggagtccaatcgtctcaagttaacatgcgagtttttttaaaaaagatttcttatatgactccttctgtatttctaaaagcgaacaaacttaaaaccgatatatatatttttagaaaatcatgagctacagttaggagtcaatcgtctcaagttagcatgcgggttttttaaaaatgatttcttatacgactccttctgtattttggaaagcgagcaaacttaaaacccgacttaaatacggatctgtattttcaaaagcaaatgaacttaaaaactgactcatacacggatgatgtaccaaagtaccggtaaaaacatcttcaacttttataatagtagagatagagatagagatagagatagagatagagatagagaagagatagagatagagaagagatagagatatttgatggtttttcatcggatatattacggtggtgatggtggtgcccaacggccaaaagcggatagccatggtgaagcaaagtgacgagccaggtcccggggagattagatcaacttctggaaggcattccatgggctgatgaatagctggatgtgggaaatattcatgggccgatatggtaaagctcccgtccatatttattggatactcacgtttgcctttctttttttcgggaaggatactcacgtttacgttcgtgaaaaaaaaaattcgatggactcgtcgcggatatgaaacagaatcagatatagatgacagtacgaaaagtaggtaaaaacatctttaatttttataatagtactagaaaaaatacccgtgcgttgcaacgggaaaaaacatgagaaatttaagaaaaggttaagaaaaatttacattatgtaattaattaaaatataaaatcgtagctatacatgtatacgatgttgaagaaaagaaaggctcataaaaatcaaggtaaatgtggaaaataaaattttccaaataagctatggctggatttaatttttattaaactctccatgattaattacactatgtgaaatttttccagtattttcagagcaccattgctaattttaataatacaaacatcattctagcatttatttaaatggaaatctaaatgaaaaccctcctttctccttgggccattttgagcccattcttctttagcccatagctgagccggcccattaacctcacttctcctcccgtccaccttggcctgtaaccgcacatccgacccatcaagcaaccacaaagtctaataagcatcccttctcctcctctcactttagtgtggtcccagtgctacagggttgtccctacctccgtccgtatatacaacgcttctaccaggtccgcaacactattccgtgcattccggcccacgcggtcgtttatgcgtttcggaatagcgtgcggcacaaccgcatgctggagaagattgcctccaaggagctcaagaccaccgccaagctcttcgagctggaggacaaggtggctcgaaaggaggaggcgtgggcctggaactcccccggcaccggcgcggcggctgcagctccccccaagtccgttccccgctctaagcggcgagataggaggaggaaaaggaagtcggcccgctccgatgacgagggccacgtccttgcggccgatgggccctcacgggccccgcacaaggaaaaagccaccggcgacaagccgagctccactgctccctccggcgagggtcgatcggcagacaagtggtcctcggtgcacaacacctattggcatagcctcgctgactgctgctcggtcaaaaacttggccgagcggttccggaaagccgatgagaagcagcagagtcgacgggagggcaaagccctcgcgacccccgccaatgaccagcgagggaggccaagaagaaggcccccgccgatgacagcgaggatctggaattctagatacctcagggaaccgtcgccactctcgacaggggggcttgtgcttacacctcccgccgcggcttcaagaccatgaggcgtgagcttttggccgccgtcccaactcacgaggcggtacggaaggcgcactggttggaagtgaaactcaccttcgaccatagcgaccatccgatagtgctcgctcgggggggggggggaggggagttggccctcgtggtctcccctaccatccacaacgtcaagatgaagtatcctagtcgacgggggggccagcctcagcatcatctccccggctgcctttaacgcgctcaaagcctaggggatgaagctccagccgtcattgccgatcatcggcgtgatctcgggacacacgtggcctctaggtcatgttgagctcctggtgccctttggcgactccaccaacttccgcaccgagcggatcgacttcaacgtggcggacctcaatctgcccagggcaggcccgcgttggtgaagttcatggctgccacccactacgcctacctccagatgaagatgccgggccccagtggccccatcattgtctttggcgatgtgaaggtcgccctggcctgcgcggagcagcgcgccgacaacttggcggcagccaccgagccgcagcccccggaggcctccgtgtcccgcgcctccaagaggcgtcttgcctcggccgacgaggtgcccgtcaaggagattccccttggcgatgatccgtccaagaccgccaaaattggcggtacgttggacgccaaataggaaagcatgctcgtctccttcctacgggcgaactccgacgtcttcgtgtggaaaccgtcggatatgcccggggtccccagggaggtgatcgagcaccgccttgccgtgcggccgggtgcacgacccatccggcaccaagccccggagaggcaagccttcacccgagaggaggtgacgcggctcctggaggccggcttcatccgagaagtcatccacctagagtggccggcaaacccggtggtcatccagaaggccaacggcaagctccggatgtgcatcgactatatggaccacaacaaggcatgccttaaggatcccttccctttaccacgcatagatcagatagtcgactccactacggggtgcgaccttttggcttttttagatacctactccgggtatcattagatccgcatggctagggaagatgaggaaaaaaactgctttcattactcctgtaggcaccttttgttatacaactatgccttttggtctcaagaacgcaggtcctacttttcagcgcatgactcgcattactttgagtaatcaaatagagcgcaatgtagaggcgtatgtcgatgacctggtcgaaaagacgcgccaccaggacacgttgttgcaggacttggccgagactttcgacagttttaagtccacgcgcatgaaactgaaccccgaaaagtgtgttcggtgtgccagcgggcaaactccttggttttctagtcttctcccgaggcataaaagctaatcccgagaaaatacgcgtgatagagaggatgcgcccaccccccagcaaacttagggatgtgcagtgcgtcacgggatgcatggccgccctaagtcgattcatatcgaggctaggagagagggtgctgcccctattcaagctcctcaaacgccccgggccgtttgtgtggacggaggaagtggagcaagctctcaatcagctaaaagcttacctcactccccccatcctggtagccccggggccagaggaaccgttgctactctacttggccgcgaccccccacgcggtgagtgccgcccttatagttgagcgcgacgaaggcgacccgcgtcgcgagcccggccatgaaaagggaccaggggcccccttgattggcgatggcccctcgtcccccgacggcccggtgcctgaagccccgaacccctgggagggtcccgaggcccccgtgggaggaatagaggctctggcgggtggccccgaggcctataatcccgacatggcccgagatccccccggggctcctgagcacgggcgccccaggccagctgcccctgacaacaaggaccggccccaccgaaaggtgcagcggcccgtctgctttgtcagcgaggcacttcgagacgtgaaaacccaatacccacaggcccaaaagatgctttacgcagtcttaatggcctcaagaaaattggccactacttccaagcgcatcaggtttccgtcgtgacctcttaccctctcggccaaatcttgtacaaccgagagggtactggtcgggtcgaaaagtgggccatcgagctcgctgagttcgacctgcacttcgaaccacggcacgtggtcaaaagccaggttctagatgacttcatcgtggagtggaccccggtggacgaccctgttccgtccaatgttccctccctcctcggagatgcgcagaagctgagaagctcgcgcgtatctctaagcagtacgagctcgtagaaggagccctctaccggcgtgccgccaacgggatactcttgaagtgtatttctcgggagcagggcgtcgagctcattgctgacgctcatcatggtgagtgcggggcccattcggcctcacgcacattggttggtaaagccttccaacaaggtttttacttgccgaccgcgttgcaagatgcccaagaatgggtctggcgatgcaaggcgtgccagttccacgccaagcaaacccaccagccgccccaagccttgcaggtcatcccgctctcttggcctttcgcggtctgggggctggacatcctaggacccttcaaagcggcccgaggcgggtattagcacctgtacgtcgccatcgacaggttcaccaagtggcccgaggcttacccggtcgtcaagatcgacaagcattccgccctcaagttcatcaggggcatcacgtcccggttcggagtgcccaaccgtatcattacagataacggtacacagttcaccagtgagctatttggcgactattgcgacgacatgggcatcaagctgtgtttcgcctcgcccgcccaccccaagagcaacgaccaagtggagcgagctaacgccgaaatcctcaaaggcctcaagaccaagacgtacaacgtcctgaagaagcactgggattcgtggctcgaggaactgccgcagtgctgtgggcgaatcggaccactccgagttgcgccacaggggaaacaccctgtttcctagtgtatggcgccgaggcggtcctaccttccaagctttccctgggtttgcctcgcgtagcgctgtacgatgaggccaaccaggatgatcttcgccgcgacgatctcgactatttggaagagcgaagaaggcgcgcggccctgcgagcgacgtgctaccagcaaagcctgcggcgctaccatcagcgccacgtccgggcccggtcactgtaagtcagcgacctcgtcctacgccgcgtacagtcgcgcttggggctgagcaagctctcaccaatgtgggaagggccatacaaagtgatcggcgttcaccgagcgggctccatttggctaaccacggaggatggcacggagttgcctaacccctggaatatcgaacacctccgtcatttctatccatagggttgcgcgttttttgctttcctggagctcggccaacctccgcacatccttcggcttgtgcgggtttggccgggggctatcactattaaatatgttgtatcttttctcttccccagcaataaacttttccgcttaagcggaggccgttgagcgccctttcttactctttcctatggctcgtcctggttcaaaggataattcgcgcttactcttgaccctaagtggcgttgggtgacctgaaaaccgccgaaagggagcctaaacgcggggcgcaccctgggctgcggcgaaccctgggggctcggaagggcctacgcatggccatccccaacccccggtcgtcgtagcctcggtctggccagacccgctgggcagctccctcggggcgatggccttgcccctcgccacctaggtgccacagaccgagcgcgaatttcccttttcaccggaacgagcccggggggggggggggtataaagggggtaagaatggcaacttaatcacaagaaagtcaattgaatacgttcgctttggttttttttttctttacttgccgcagacattcaaaggacaaagcaagaacgtaaaggtgcgaaggggaagctttatttacaaacaggatggcacgatggcctaaagtttgaagcattcactgcgagcacataacaaaataaaagaaaaaaggcggggatagtcacggagtgcccgggcccccgaggccggcgccgctgaccacctcgtcctagtcctcgctgccgtcatcgccaccaccgtcctcgctcccgctctcctcatccgaggcaagcgcgaggttgaaccgaggggccgacccctcgaagctggagacgatcgcgtcggccgcctcccggacttgctcccgagcccttgcctcggtccccgggggaaagtcctcgagcgcgcgtcacgggaagaagtcggggtcgcgagcttgatggctcgcgagaaccagctccaccgcagcccgtgccaaggaagccgacgacgacttcacggcctcgccgacctcctcctccagcctctccaaatctgcagccatcccatccagccgaagtgcatggagatgcctacccggcgccccgcgcgctccagccgttcgatggcataggagagttggccaggcccaatctcgttggtgaggcggagggccgcaatctcctcggcttggtgctgcaccaggcgtcccaggtcggcgagagtgtcttgagccgcgacgagctggctgaccaactccgcgccgccgggctacccgcctgccatcaactccttctcccgagcctccagctcggaagccctcgccgccatcgctgcgcgctcagcgcgggcgctctccagatgccgggcctcgcgcccagcgatgacctcctcacgcttggtgagttgctcgcccagccaccgcgccgccacctcgcgacggttcacctcggcctcatgtacggcaagcgcggcgtcctgttcccggcacgcctcctctcgaagccacagctcctccgcgcgacgagccaccaaagctctgcggtgagggtggtccggttgtgctcagctgcggtctcctcacggaggcgaagggaggattccgcctcggtggccgttctctcgtgggtggccaaggtggtctcgcgctggtctagcatgcgtgcccgctcctccagtgcccgggtacgctcctccagcgcccgagcatgctcctccaactcccgggctcgcagcccctgttcccggctacgcccgtcctgttcgcgctggttacggtcgaggacctcgatccgtcgacggatcatggcctcgaactcctgcatggagcgggcacgctcgtctaaggccttgcgctcggcctcgagcgccgcagtccgagcccgcagcgaggcgtcgacctccgatgcccgccgctcttaggcggccgccgcgtcgaggactccacgggcgtcttcccagatcctcggcgtgggcctcgtactgcaagcggatgtcgcccagcgtctcatccaggacgcttgaagcgatgagcgccgcctggcactcctcctgtctcccgcatgaccgagtctagcgtttcctcgcgcgcctggatctccgccagttgggcttggtgcattttgcgccccacctccaccatgtcgtccatggcgcggcgcccctcgtcaacccgcgtgcggtccgccgcgagctgtgcccactccgcctccagggccgcccgctcgtccgctagggcttgaacttgggcattgagcccctcccggacggtggaatcggcggcggcgagcacctgcaggagtggctccatgctcgcgggagttggagaagaaaaagtcgcggtccgcccccgggatgacggagtgctgctagaccccccgcgatattgggggctgctctcggccccccttccgcacggccagccctgaggacgccccagatgcagaggggaacggttgcccccgtcaccccccgccttgggccctcaggaagactcggcctcccgagtagcgctcctcgtgggtcgcgccctcgggatcgccctgggggggcgcctgtaacgtcccgccttcccccaggccaccccaggccgggtccacttacatctgatagctttcataggtcatagactgccctcacagaccaacacgccttcccccaggccaccccaggccgggtccacttacatctgatagctttcataggtcatagactgccctcacagaccaacacatgtcttttctgcacactttgtcctcactcgtgtgcacccggtaagaatttcccggtcggtcacccatcccaaattgctccaggccaagcacgcttaaccctggagttctttggagattggcttccggaaaagaagttgcaacttgttgatatgagtattctattaatcctattaagccctaggccgggatgttacaccctcaccaatgttacagcgccgccgctgccatcacccgcggctggttgcacctcggctgtggcgaactcggagccagacccgccgtgtggcccgtgggccccgccagggtgctgcgaaggctccgtggcaccgggtcggccgggtcccggtcgatccggtcgcttgaattttgacccctgtgagggatcggacgccgagaccccctaggaaggaatcccgctacaggagaaccccgatcacgttaagaagaaaaagaagggggaggagcaagaggccaaggtggatagagagcaccgagtcgggcgctagcgatcctacctgcgagggggcgtttgaaggtctacttcgggggctcgatgaaactcccccggcacggctccgtttgccctatcttccggagccgcttcttcttccgtccagcctcggacgtggcggggcgtttgtggcccgctggtggatggtccgccgttcgcttagcgcgccctatgcgcgggggagaacgcggccgagattcggacacctttcgcttccctttcgggtcgcaggcccctgaggcgatccgtcactgcgtcgtactcctcgccctgcgtcatactcctcgcccagttccaaaaccgccaaccacgcggcggatcgtttgggagggccggcggggagccgaagtcgcggatgatccggcagcgcggtgtaaaaccaatccgtcttccaatcctcccacttcttgcgaaggtggctctcaatgtactgccccgccgttcctggccggggctagaagtagcatcctcccaccaccacgccttgcagtagctgtgggacgaagaaggacaggaacagccgcatcgtctgcgcaccccgacgaacatctcgcagaagtgcgcgaagatggccagcgtcatcacagcgttgggtgcgagatgctaggcatgaatttcgtagaaatccaaaacctcatggaagaacctggaaaatggcgggatcagccccaccatggcgaaggacaggaggtgcacggatcgctctgggtactgcggccgcggccgcgactcctccaccctcacgacggcgtctctggcatgatcttgcggatgaggctaaggtgcctctctgccatgatgagcgacgccgggggcacagcgtcaccagcgtcttgggccatggtgaccggcggggaaacggcgaggagtttggtgtacggaatagcgtggagtgagagaagcgttagggcttgaggagcgagtatgcgggtgagcagtcggcgagaggaaggagacgaactctccacctccctatccttttatccccgcctcgcccgcgctcgcctccttgtttcacgcccccgcggttgccccctcgattcctgcacctgcggtttcctcctcgactctcgcacccactcatcacgccgccccactgaacccgcgccccgcgtttggtgcacctgtcagcggcacattcggcgcgggccatgcgatgttcacgggcatggttaggcgggcccgctgtcggtcccgtcgcgtgcctggcaggcgggggagtcgaggcggcgtgggtgatgattctgggcgtggtctggccgaccccccgattttcgcgccctaagcgcctccatcatcggcgcagttagtggcggtcaaatcgccgttatgggcacagttagtggcggtcaaatagccgttatgactaatgcgccagcctggccgcccggcggcaaccgtctggattcctcgtcgggcccacaactcggcacgggaagtcgtgaggcgccacgtcggactgccctcggggggccaatgtccgacgcggtgccgggggctactgtcggagatatgggcccgggggtaggcaaagtgaggggaagttaccttcccatccagtcacgtggctctacagcctggccctccccccgcgcctcgcgagtcgcagaagtagccagggggcctcggggtgccacgtcacgcccctcgggctctcgcgctgcctcccccgaggccctcgtgtcacgtaccataacgaccctaaaatatatcctctaaa

SEQ ID NO: 71457 - DNA, 1244 bp, Oryza sativa
cggtattgcctctgaatattcacatgattggcatggaaggtggacaaagttttgtctatcatgtcagcatcagtgattttctctccacatagcttaagacaagtgacaatgcggtgaagaactaagttatattgctccacagaattgtaatcctggaaacgtaagtgaagccactcacgttttgcttttgggagcaaagcctttacttgatggccatagcgatccttcagtgagtcccaaaggaccttcggatcttcctcagtcatatactcattcttgagagtaatattcaaatggtgcctcaggaaatgcagtgcctgattttttcagctgaagttggtaaattattaactcctccaattgatgttgtaatagttgggtcctgaatgaatgcagttcaggagtttcttagcaccaagcatgattttggcatccagtgcccatgtcaggtaattcttgccgctgactgctagttcagcaaaatctctcttagcaatatcagtcattttcctacattagtcatgcaaaattcaataagtactgcaagtaagagcatgacaagtgtgcaaatagtaaattgcctagttatctaaatttagtactatgtcaatatattcccataattctcccaacatttctcagaattactgtactatttatttaggtaccaaagatgaattactaacccattaaatagtatcctgaaaatataaaacaggtaggaaaataaaccataaatatgatgctctctggtgtgtactaaatttcaaattatgacagctcatttcctaaaacccatgtctctaggattctatggttgattcaaaaattaactaataaacagttaatatacagaaaattgaaagtacggaataactaaaaaatgtgatattctctgtaatttctataatcccgagggactattccgctaaaattccaaatccgcataaaatcagaaaatattcggaattttgccgtttttgggccaaatttcgattcgagcccgactccttttataggccgaattcatattcggcccacctctatatactggccatccaagggttaactggcccatcgggaccgtcggcctgctaatggtctcagcctatagtgtggcccaacaaggggtgccacaccttatccgattgagtggcatgggttgaaaccctagcccccaattccaccgatgcagtggcggcacggtttcccggaggctcatgcgggcaaggcagcggggttaa

SEQ ID NO: 71458 - DNA, 1098 bp, Oryza sativa
ccgcttctcgttcgatagatcggttgtacttgggataccccatacgcctgtcgcgcatggggtggagagccgcaaactctcttgctacgtgcgccataagggacaaatccacgtagtacaacccatcgatcgaacgattagcggagaaataaaaataacagaaaaagatctagcaagtttatcgttatccctatagaacgagattagatcagatcgatgttgacaatataccttggctgaagagcacctcatgctgataacttgttagaattcatgttgtcaacaatcgaacaagcacacacgaacacacggacacgaaagtggagggcaatcaactttattgatgtttttctctctgttacaagtcttactttgccctcaacctcactattgtatttatacccataataggatgtcctatatggatacatacatatatatatttggtataagcccacttcattaataaggaaacagaaggaagaggaggaggtaccgtgatcctcctataaatccgactcctttgggagatcggttttataacagttcattgcctctagcaatggaatgatggaaaaacagacaatggctcgccgaccagagcaaacgcactccatatttaaatacgcacgagtttatacgtactatcaactacctctatacctcatcagatctactagcaataacagcgcgttacgccgcacgtgattttatcaagctttggtgaaggaacctatatgatttatgagtttaagtagcatgtttcagttcatatataaaaaagtttgtcatatggttctcgtaataatttttttccgcaagattaataagaatgatgcaaacaggaggccaccagcccaccaattattcagcggtggataagatggcaatgaacataacatgcataaacattttttatagtagtataaaagagaacagaacaatattttacatggagtcgacgcgtatgtgtacaggatatgatatttatacggaggacattaggtacgatgcgtactgcagaacgcgatatctctacaacattagcattaaaacggtggtgataacatatagggatatggtgttttgctcatcagc

SEQ ID NO: 71459 - DNA, 609 bp, Oryza sativa
cattaatgctacttatctcacatgatgccttggatatggtgtataaactaagtctcatgcaagagatggttttcttctcttttctaatttattcacttgacacatcatttttttatcataggtgacagcttatttaatactatagagacatcatcctacttattgggttgagaatggcctaatgccggagtacgcacgcacgtgtttgtgcacagggttggtatcgagtcgatcggtctgaactcggaagtaaacgcacggatgctattctactgacgttcatcttttgacgacgcacttttgccttacaaatggagaccgataccccattgtgttgaccgttcacactatgtgtatatctaggagtagtttcttaagacaacgaattaacatttgattaataacgtccgccgctgccttcagactctgtctaaggagaactaactatacaaaaacgagatacatttgatgctttctaaaggagatcgagcactatagtagaaaagatcgattagataacactgtgatattcggaagtgtgttattttgatgcacttcctcaaagagtgtacatgaagtttgtaaaagcagaatgcaagtgttactgaa

SEQ ID NO: 71460 - DNA, 5049 bp, Oryza sativa
gtccaccaccgcttgcatccacaattcgctacccaccgttgtcgccatccaccatacactggcgccacggacgcccctccgtccgccggcggtttgccggccggattaggccgacggctcccgatcctcatcggaatcggaggccggccgagcccggacgccattccccggcaccccgttagggagtgtacggctaggagagccatggggaatggcgatgaaggtgtggcggaggccgggacggcaaacggcggcttcacctgcatgacgacgagacgaggacggattgaagaagggcggctcccccgtgcgcgcagccagggtaccggttctgccggaccccagtagcgcgggagtgggggaacggcgtcggcgtcggcttggtgtcggtggaggtggtgaaggggcggtcagtggtggcggcagcgactccatctccagggaaaggtcacatggctcgccgggcagtgtcaccactgccgtccatccgtggtaggcgcagtactgcaccccctgcacacagatacggcgaggcacggcggcaaccggagacggaggcggaggaggagcagccggagtagtggccaccacgatgcgtcggcgagggtggtggcgacggccaccagccctagcccgacgttcatggtgttagtggcgaccgtggtggtggcggcgactcctctccgatcgacggagaagatggtgaaggcgacgggcgcgctgattgcgagggaggccgagaacggcatccataatccaatgaaaggtaggcatcgtaccttctctgttgaatctcctgttcgcttttctgttagatcaaaagcgatgtttcttccttctttcacttcgcgatctccttcgcgagagcgaaagtgctgataacgtgttgaatgtggatagaattgattgagcgagagagagaattgaacacaaacagagcgaatcgatagatttctcattgatcaacagtacatttatacaatgtgaagcggtgtcaactgcaggggacgcgatatttaggaacatcgcgtcggttgtcgagagggacgctaaagggagagagaggagcgatctcctcttctctaccggttagtataggaaccgttgttcctatttccttgggtggatgagatcacccgtagtttcttaacaaaaggagcggaattgttgtgtgagaaaccaaactggtttgttgttcgtgtggacactggacagagctgttgactgatcgatggtggtgcggtggtgccatttcaaacttggcaaaagtaggtgacacggtagttgaatgttttgtacgtagtggccggccgctggggccacgagcgtgccacgccatcatcaaacacgtttctatctttttctttttggaggtttcgttttctcttggtcaacattaatccgctcgatcgccacgtgatcctgttgtgtcttaattactcgacgctttgatcaaacagcttgaccagcaacgtcgtgtggcatatgcatgcaggcacgtacacagtcagatccaccttggcaagctataatcctgatccaaacctgcctctggaactctattataaatacgtgccttgtatcggtgctctcgatgaactctacaagtcattttgtcgccatcagcttctttcatcaccaactcgatcagaccgtgagtggagtaccttttaattccttagttttccttagtttatactgcctctattttccttttaaataaactaattaaccaatgcaacaccgttcattaaagaatagaggaagtatattttgttctcatgtgtgtatatatatatatagctagaagttatttaactacctttaaggcatttaacttatcgatccacatgcaggcagagacgagggaagatgagctcgtcggcgaagacgtcgtggccggaggtggttgggctgagcatagaggaggccaagaaggtgattctcaaggacaagcccgacgccgacatcgtcgtgctgccattcggcacggcggtgccagaggattttcgcttcaaccgtgtccgaatcttcgtcgacaccgtcgccgagacgcctcgtgtgggctagctagcagaatatatatagctttaaattaaaattaataatggttagtagcgatgctgctgtgccccgaccgtatcctttctctaaaattgatatcatatatatgtattatatgtgtgtaaatcatcaatcctgggatgaaaaagatgaatcagctgtcaggaccactgcatggtcttcttgtactcctctcaaacttgttcttgcaacccgtctaaaaaacgaatttctaaaaaatgaatacggacatacatatatccacactagtacagaaccgggaatcacaatcaggctatctgtgatggaaatgagcgacccgttacaaagatagtcatctttatcaagctgcaaaaagcctcatcaaagatggcccaagagaggtagaattttagtcctcaggataggcccctcacggataaccaacattcatatggggtgtgatttgcccgttaaggtcattagtgacggcccccgttacctatgagggtcatccgtgacgagcctagtgttaaggccggataaagatgactgtgaagcctatcacggattatccttaatctttgttggggcttgtttgcggcccgttacggataacccatagtataaatactcccaaactttcgaaagaatagtattcctatatagcagactattcatagtttgggagggagggctagaggggcgaatttttgctcttcacttgaaaaaaaagtattccaagttaataataaattaccaatataacttcgatgtaataattactagctacatatacatatcattaatttcatttcatacattgcagatggatagaagatggatgtataaaagtgaccgatctagcatagagtattgaaggggcgttgctgatttcataaatgttgtagagcaagacaagagcagaacaaacaatgaatggatgacttgtccatactttgatcgtaagaatgagaagatgctttagaatagtgccaaaacacgcatgcatctgatctaccgaggcttcatggatggttactcatgttggactaagcatagagagcaatagctagagaatattggggataaagctggcggtggtctgaacaaggaagaacacaaacatgatatgtttgttcaatcctcgttggctggtgatcgggaggatgtcaataatgagactattccagtaatgttgcgtgatgttgaggacctaacttacaacgagagggaccatgagaagtttactcagctgatgaacgattttgagacacctctgcaagccagatgtacagtaaagcacacgaagttatctgcgaccttgtatctgatgaagcttaaggaagtaatggctggatagacaaaagtttcacacaactacttggatgtcacctttgaacctttggctgattgaaatactccattgttaaaataatggtgatgtctttatagccataaatgatagttagtgttaaaattttttatcacaaatattcacttttttggcgatgttgcatgtgaggagtaacaaaattccatcacaagaacttaaactcctaggaccaaagtttttttttcatgacgacaactattctaacaaaatgtaatatttttgtgcaacaccatcactaagaaatattttgaactcaattaagcccaatttgggaacaataatattcaaatatttattccgttagtattctctcaggttggagcttataagtcatactccaggcctttcatgagtatctagagatcacccaaatctcatagactgtgactagcagtcgaactcatataagtgtgttccttctaagatgttctgcaggtcaacatctctgcttaatgaaagccacccggaatacattgaggcataagccatcctaccatacagaatagaagagaagtacatcataaaaatgagcccatttaagggtctcttctttcggttacacaatagtttgtttcgccatccaaattcacgggatctccgatcacaattgacaggtttccactattgtgcaactctaagtgggtctcaagtccatttccctcgatgcactttctatcacattacgtggtagccccttggtaaactgatttgccagatttttagctgtctggacatagtccaatgctatcactccggagtttttctgctttctgacagatttcagtcttctctttacatacctagatgacttcatgttgtccttcgaactgttcaccttaataatcactgtttgattatcacaattcattaggatagctggcactggttttccaaccaccggcaaatccatcaggagttcacgaaaccactcagtctcaactgtggcagtatctagtgctgtgagttctgcttccattgttgacctcgttaagatggtctgaaacagcgccacctccaagtgtgaacacatatccacttgtggcctttatctcatcagcatcagatatcaagtttgagtcactatacccttccagtacttttgggtacacagtatagtgaattccatagctcactgtgccctttagatagcgtatgaccctttccagagcttgccaatgatcatctcccggatttgaaacaaatctgctcagcttgctcacagcaaatgagatgtcaggactcgttgcactagccaagtatatcaatgaaccaatgatatgggagtatctcaattgatcccttgctattcttcggtttttccttaaaagcacactagagtcataaggagtaggagatggcttgcagtcactataaccaaagcgactcaaaacattgtccacatagtgagattgcacgagtgtaatcccaccctcatctcctctcagtagcttaatgttaagaacaacattagctactcccaaatccttcatttcaaagctttgggacaaaaagtccttaacctcctcaatcacattgaggctggttccaaaaatcaatatgtcatcggcatataaacacaagatcactccctctcctccgccagtaccgag

SEQ ID NO: 71461 - DNA, 2151 bp, Oryza sativa
tgacacaaactatgatctatcttagtacaaggaagaatagctaatttgtggagagtctgaatagcagctgaactgggatgaccaagacgacgatgccacagggtagaggattgggccaagaagctgtgggcagcaatagcaggtgcagcaataggtagagtgtagaggtcaccacgactattgcagcgaagaatcacgcgccgggtacggaggcccttaacagaaaaaccaaactcatcaaactcaatggaacagttattgtcacgagtgaattgacgaatggaaagtagattgcgaaccaaagagggggcgacaaggatgtttttaagatcaaatttagtggttcctataggtagaaaagaagtgccatgacaaataacaggaatagtatgaccattgccaacggtaatgaaggtataggaattgggaagacgagtatcgagaataccgtcggtagaggacatgtgtgaagtggctcctgtgtcaagcacccaaggacttggactttgcacggacaactgattgagggcagcaatcagacctgcctgatcccaattgggctgagattgctgcattggtggcaagcccggcattggtggagagacatatgggcctgcaaatgtcgtgtgtgcttgaggatatgggccaagcagaccggcactgttgctgggacgccagggagactgctgctgctgcacagcccatggattgaaacagacccatgggccggtagttcgtggcccagcctggtgctgctgctgctggaaattgttcccgaagttgccatagccgccgccgttgctgttgttctgtcgtccgccattgccgccaccactgctgttgttccggccaccgttgtagcgtcactggttgcggcgaccactgttgttggagacatcgccatgagactgtgatgaagaagaggacgcacaggtgccggaagtgcaggcattggcagaggaggcagccaccaccatggttgtctcagcctggaccttgtgtgcattggcaattcgcagctctttgagcaacaaggtgttgtgcgctgaggcaaaggagggcagaacaggggcgctagcgatgttgtcggcggtgctcgaaaaacgagagttgaggccgctcagcaagttgaggacaagctgagattcggtgacggggtggccgacgtcgcggagggcatcggcagcagtcttcaccttctgacaataatcggcaatgggcatgtcaccttgcgtcattgagtggaactcgtgactgagatagatggtgcggggttccttgtttgcttgaaagagatcgtcgatggcgagccataggtcacgggcggtctggtcggtttccatgacgacgtcgaggatagcatcggaaacggagccgaacagccagccctgaacacaacaatcggcttgtgcccaagtcgagtcgtcgggacgagggggtgcagtgccatcaatgtgaggaaggagcccaaacttgccacacatagaagtgaagaaggtcttccacttgttgaaattggggtgcttgagctccagggtaattggtatgtgagtcttgacgttgacggtggcatacgggttgacgaagatcgagccggtagaatccccggtgctggcagcagaagatggagtagagccggatgatgtagatgccattgttcccgaggttgtggaagaggaggtggactcggtagacatggcagagaggcagaataatcacgacgtggcgaagacagaaagcggcgcagcgtgagcagagcagggcagggcgcggcgcgggcagggcacggcgtggcgcgatgggggcagagcgcggcgcggcgcgatgtagcagggcgcggcacggaacgagcgaggatgcggcgcggtgcgtcgtggcgcggtggggacatggaaggcgcagtggggctggggcgtggcgagatcgtgaggggaaatcgctggggcgcggcgcggtggtggggacgtggaagtcgcgtgggcagcggaagagaagcgaacgcggaaaaagcgaaggccataggaagcggtgaattagggtagaaggaaactggtatctgataccatgtagagaattatgagacgcctcacaacgcctcacaacccaacgtgggagggtgattgtatttatatatccaatacaatagagatt

SEQ ID NO: 71462 - DNA, 652 bp, Oryza sativa
tttttttaaaaaagcaccatttagaaacttggaaagcgtggagcgtacaaacaaaaatccaaaagatggaatcaggaataaaatagggcgttacactcccttataacactcttatcctataagagttctattgatattcattaatattgtgctcaaatttataacataatgatttctttcaactgtacgaacaaataatacaaagaccaaatacaacataacacaatacattataactattatgtactcaactttcggtttcagcttaaatagagctaagtgttggaaaaactcaacccacggggcttaattcttctctcgctgcatcacacctttaattttcatttcatgttattaacaaaattaattatctccatatatgaattgatatgtggcaaagcggtagcgttgtagcggttgtgatcaccttagatgccgctttgtcacatgtgcgaaaggcaaaggtgcaaacgtgcattgtgcagcaggccaaaaagggagaacttcggacacttatttattaacaatagatccgatgatttaaataataggttcaccggttctagtgtaaatgtaaattagttaatataaattttaaattgttaatttaatgggtacacaatataatggtgtagactttattttaaaacat

SEQ ID NO: 71463 - DNA, 15316 bp, Oryza sativa
gtactttttaattgtaccatctggcctaagctttttcttgaaaaccaatttgcatcctacaggcttgcacccatatggacgctcaacgacttcccaagtactattagatataattgagtccatttcactgcgtaccgcttccttccaatagtcagcgtcaggagatgaatatgcctcttctatagttcttggagtgtcatccacgaggtatacaatgtagtcatctccaaaggattttgcaaccctttgtctcttactctttcgagtatacaatgttatcctcctcaggattttcctcaggcgtttgattactgtgttctatcggtgcaaagtgctcatggggtaaaacaggttcttgactagatgtgctaggtgtatttttcatgggaaattcactcaaagaatgtggcatctctggactcagtaattataccaacacgtatgtcgggtactccagagtttactattaagtatctataacccacgctgtggatagcataaccgaggaacacacagtctacggtatttggtccaagtttacgctttttggctataggtacatttaccttggccaaacagccccatgtgcgtaggtatgagagatttagtttcttcctttcccattccttgaacggtgctactttcttatgcttcactggaattttattcaggacatgaaaagtagtcaaaattgcctcaccccaccattccttgaaaagtcccgcagtgtctaacatggcattcaccatctcagtaagagtgcggttctttcttttggctaccccatttgattgggtgaatagggaggcatcctctcatgaataattccaaactcttcgcaaaaggacataaactcattggaaaaatactctccacccctatcagacctcaaccatttgattttcctttcaagatggttttctacctcagctttatagatcttaaagtaatacaatgcttcatcctttgttttcaataggtacacatagcaaaatctagtgcaatcatctatcagtgtcatgaaatatttctttccctctttactcaacacgccgttcatttcacacagatcgaaatgaacaagttctaggggtgccaaattcctcgcctcagatgcattgtgaggtttgcgaggttgtttccattgaacacaagtatggcacttagaaccttttactaaagtgaattttgcaattaaactcatattagccaagcgtgtcatacaaccgaaattcatatgacaaagtcgcgaatgccacacattgaactcatcattctcgctaatatggttcacatcattattattattacgcatgtcatccaaagaaaaacggaacagaactccgctgacataaccttttccaataaaagttccatatttagatacggcacatttattggattcaaacacaagtctaaaagcatctctacacagtagagagctgctaactagattcttctttattaaagggacatgctgcacgttctttagctgcacggtctttcccgaagtaaacttcaaatcgaccataccaacaccatgaacaaccgcaagcgacccgtttcccatcaacaaggaggaatctctcccgacttgataagaagaaaacatggaaatatcagcacacacatgaatattagcaccagtatcaacccaccaatcaggtgaatgaaaaacagagagaattgtaggtaaaaatttaccataccccgatgttcctccgccctcgctaataaccatgttggcagacttcttgtccttgcgattaggacaattcttggcccaatgcctaggcttaccgcacacaaagcagtcgcccttggcctttcccttgcctttatccttaaaattggtagtagcctttggtttgacatcaggcttgactttcttgttgttgttgttgtgggatgcgtgagggttcttcttttgcaccaaattggcgctagaacctccctcgatatttttgccctgttgtcctttgctctcgccttctcctcaacacccaaagagccaatgagatcagtaacaccgaactcttgcctcttgtgttctagagaagtagcaaagtccgaccaagaaggtggaaatttggcaataatgccacccgccacaaacttgttcggcaactcgcagttgtttgttctcaagttcctttgtcagcatctaaatctcatgagcctgttccactatagaacggtaatcgaccatctcatagtcatagaactgctccatgacatacagctcgctgctggtgtcggaaactccgaacttggcctcaaatgcattccacatgaccttccccgaaggcatgtgcatgtacacgtccactatattgtcagcaagtatactgatcaatgttccacggaacaggcaatccgaatcctcgaacctagcctcctcctcaggagagagaggcagttcacttcgttttttccgtgaaatatagaagcattgcatcgctgtcaaccacagtagtgcacgtgcttagcatctcttatagttagaaccatcaaaaacatgtggtttcagtattgcagcaaagccaactacctaaaaggacctatcaggtttttggattgttgagaatttggtcataattcggcatattttaatccaaaatagcaagataataaacatgatatttacaatgggatttgatccaatgatagtggcgaatgtaatcaatatgagtatgcttaacgtagaataagcatcaacaatcacataataacgcaatgttgacattgcgatgaacattaacattaaaacttctaagtgaaataatataagaaggttataccgaatggtcctccgctggagtttgaggcagtattgccttcattggtgttgacgggaacctccttctccttgtctctagtgttgccgttgtctccagtgctcgatatgttggtgaagacgaagtagacgttgatgaacagtgagtagtctcgtcttgcgctccccaaaaacctgatcgcccgcccgtccgtgcatacgtcgcagcagtgcgtggtttcggaggcctactctcccaacgcgtgtgcatacactcgtcgggatgggattaccgtagcagcaacagccttggaaatggatgaaagtgtgtctcacttctccttagggagatcaaatccattctcattttataggaggaatggaagatgaagagtaagagtcatggaataagaagaggaatagagtaactaattctcatcaattagccatcaaccatcctccactacacaaccatcaatcaaccatcaattaggagtaattagtgtaggttaccaatgcaatggaataggaagaggaatagagcaactaattgtcatcatctagccatgaaccatcctccactacacaaccatcaaccatccatcaattaggagtaattgatataagttaccaattccctaatcaaatggattaattctgaaaattcttcgtcccattgatgtcccataagagaatgaatacacatgaattcctagcataatgagccttgaaatttatttgatttaattgatttaaatggataaattacccaattaaatctaacagaaactccgttagaagaggcgaaggtgagaaatatatggctatctgctcatcaagtttttgactttttgttatactattctttcaacatttgtagcttgtcggtccactgttctttcgtaagatttcaactcctcatgttgagactgttgctattccggtaactaagcatttgtgaccgttcatatgtcgtcctcccattcgtacgctgggccttcctcattagtgtgaattgcaagagtggaacaaacggagacgatgtaaaatgagaaaggaatactcacaggtggcacattcccatatttccaccatatttatatgctatatagaacaactctcataaactatatatatacttccacgattgcatcagcttgaggttattgcttaccgaaaacaaaaaaaatgccatagaaatgagaggccacgggaaaagaagatgtcgctcaagaaatagtcgccgagagcattaccgctggagcgttcagttcaagtccatcgatcacttgacatcttggtgctgcagcattagtggcaatctggcaagcatggtcttaccggcttttgcgttgcggtcaggctgacactggcacagatttccaacggctgcgacgcgctgtaaaccaccatgggtctcatcactccttgaggttatgaacttaatttggtgtagacgcgtggatagttttcagggaaaaaaaagggggaaaaacatgtgattgatttatgtacatttttgtttcgttggttagatatgtaacaatgactactgaatattttgccaactcatgcatccagctatgtatctctaatttataaccgtaactcaatcgtataataagcgactgatgaacaccagctcaggaatgacctcaagctaagaattttggggctagcagcagtggcaaagtcgaagaaaaggcagatatcgcgattgacatggctgaaagaaggggatgccaacacaaagtttttccacattcacgcaaactcgaggagaaggaaaaaccacattcaccaactccatacaacaagtgctatcctgacagaacatgaggaaaaaagtgacgcgcttttcaaccatttcaactcaatcctaggcaacaaggaggcgtgaaattgcaccctaaattggaacgcgatggatctaccacaggttaaccccgatgaactagatgaaccttttacagaggaggaagtttgggccgctttaaagcagatgccggcagaaaaggccccaggtctagatggctttaatggtaccttctacaagaaatgctggcagctaattaaacaggatatcatggatgttttccagtgtttgtataacctgtcaggatgaaactttggagcactcaacagagcagcaattaccttgcttccaaagaggaatgcccctaccttggtgaccgattttaggccaatcagcctcattcactccgtcgccaagctgatatccaaagttctagcaataaggcttgccaggcagatggatggcctgatctctgttgcacagagcgccttcatcaaaaaaagatgcattcaagacaacttcctgtatgttcggaacgtgctcaggaacctaaatgccagcaaaaagccaacactttttctcaagctagacattgctagagcttttgattcggtctcctgggaatatctacttgaactgatgcaaaacatgggttttggcccccagtggagaaattggatctgtttgctcttttccaccgccacttccaaggtagtcctaaatggagaccagggggaatgcattgcacacagacgtggcttgaggcaaggggaccccctatccccctatctctttatcctggctatcgaccccctacaaaggcttctacatctatcgaccgaaggtgggcaactaaccaacatcggaagtcgccatgctagattgaggacttcgcttgatgcagatgatgcagctgtttttctcaaccctgtacaaagcgaggtggatgttcttattaccatgcttagggactttggcaaggcaacagggctgcacgtcaatcttggaaaaagtctggtggcaccaattcgatgccaggaagtagatctggacgacgtcttgcgtagttattcgggggcaagagccagcttcccactaacttacctagggctaccactcactcctggccgcctacgtaaggtgcatttccagcctctccaggataagatcaaaggtcggttctcgggatggaagccatcattgttgtacatgggggggcgccgaattatggtgaactcagttctaagtgccatcccaacttacaccctcacggtgctgaaaccgccgaaacaatctcttcaagaaattgacaaagcaagaaggcggttcctgtgggtaggtaatgagaatatgcatggcggaaaatgcaaggtcaattggcttaaagttttctcacctgtccggtacggtggtttgggggttccgaacttagaaaagtttgccagagctctttgactgagatggttatggttcgaatggaggatgccaaagaagccttggatagggactgaaacaccctgtgatgaattggataaggatcttttcgcggcatcaacgagagtccaaattggtgacggacaaaaggcgagcttttgggaatcaaattggatcggtggccaaagcctaaaaagtcaagcacctaatctttataggcattcgaagaggaaaacctgcaccgtctaggacgccctgcaacaaggaagatggattaacgacgtccgccacagcctcaccattcctcttcttgatgaattcttccatgtttgggaaattttagcccgtgacaccccacaactaacagagggggtacaagactcgattgtttggcaatggacaactaatggggaatacggtgcaaaatccgcgtaccaattccaattcaatggaatggtactctcgccatcaacaaagttgtcttgggaggcatgggctccggcaaagtgcaaaatctttagttggttggttcttcaaaaccgggtgtggacaactgaccggttacagatcaggggatggccaaataattatttctgccagctatgctttcgaaatctcgaaacaatcgaccatcttctgtttgaatgcccggtctcaaagcaaatctggtttgggattctcacatggctgcaccaagggcacatcatcccgaaatggaacacaagtagaaacctcttagattggtggacacaaggaacaagcgacccggaagcaacaaaacagaaaggactcagagctctcttcttgctcattgcttgggaaatctggaaggaacgaaatgcaagaatcttcagagcaaaggaggcgacagtacaccagatgattagtcgcatccaagaggaattaggttggtggagtatggccggcgctaaacacattgggagaatgttgccatgaggagctaggaaggctacgtgcaagcttgtttgcatgttgtcatgtacagtttttctcttttttagccctttggctatttgtactttttgtccttctatcaatataacgccagtcaattctgaccagccgttcgaaaaaaaaagactaaagcttgttataaaaattcaattagtttgttttggattagatgcatggaatttgtcgagatcttatggaagtatggatctgtcggtaactccaaattaagtgactaaaaaactggtaaaaatagttacattattgtcatattttgagcaagttagccatacatcttgcctgcatatcaacgtcatatgtccaagtaacatcatggtttcctccctgggctacggttcgagatcaaataccaatcagagagctgctagctatggtacactaaaatgtagcaagcctagcttttcttgtgcttcttggggtggacagaattgcaaagttctcatgttgccgcctcttgtctcaccaggaaaaagggaaatactcagacacgtaatgggataaaaactagaaaatgctccatcctatgaactagtcaactcttcacttgtgaacaggttttgagtgcagcacaaatttattcacttgtgaacaaaacaaaaactgagagaattattggagcgtatgatgttttgctgcgaatagatcgggaacatcttgctacagttagcccgattgaacaaggaagaatggaaggatgagttaaaaaaagtagtccagagagtagtagtcacagagacgggtagagagagtctgggggcagcagaatcagtatttagtaatgttgtttaattgtatcagtattttttttaaatagggtgagtgacatttgggaatgttactatgttatttttaattttgaaaatgcaagtctaatttcttaaagtgatatacaattatttaatctatattttcgatttgtttgtatcttttatgtatgatccgatagcataaatatggttataatacaactcaaaataacatatatttttacatatgagcttaaattattagttttgtttttcatctaatctaataagtgagaaagaagaaaaaatgaaaataaagacgtggggctgggcgtgcttatgtacgtaccgtacttttttattccttcctacttaccgatcagtggcaacggttttggggatatatttaattggtgacttttaagatagatataatggtgaaaacgaataatgataggtccatcagattaaatcaaaaccaacagttagatattttgtttatttatagaatttttaggatttattagagcgtcacgtggcggtttaggataaaaattcatttgtctaattatggaactcaaattgttaatttaatagaaatataatcgtttaaatttaacataaaaccaccgatgaacctcatatccatcaccgtacatgggacatgcatcagaatttctttggcaaccggttttgccttcgtgagagaagtaaaggaattaagttgaccgtcagttatattaatatgtaacaaatcatggattatatcttaacaaccgaaagatagaaagcgggtgtgtacgtttatgcctgcacatgtattcggataaatctaaattcttaaaaaaatagatccactatatttaacgaatatcaatggttaaatgttttcttttttcatagaatttttaagaaacttttgaatttataagagtgtcacgtggcggcttagaagcgtttttaggatgcgacgtagcagcttgaagcgtttgtaagaagtttaatggactctagtatataatagatagatagatagatatatgatctgtttggtacaggtctagctctagctccatgtctcctagagctggagttcaatcaaacagtttcaactatacgtaaaatcttagttattaagaccggactggaccagcggttggaccggggaaaaaccggaaccaatgccccaaccggtccggtccaggtaaaaagaccggcatgcaatcggcccagcaataaaccggttagaccgcctggttttagagaaaaaacgccattaaaccggggaataaaaccgcttccaaccaggcttggcggctgctgtacgcgcgcatgggtgctgttgggggaaaaatgagagaaaatgtgcatgggtagcattcgaaccggttagactgcctggttttagagaaaaaccgcctggttttaaagaaaaaacgccattaaattggggaataaaaccgctgttgggggaaaatgaaagaaaatatgcatgggtaggattcgaacctagaaccataaacaccccaaccaccaggctatcatgtcctttgtgtttagatagaatgcttaatgtatttaatagttattgaactggattaaaccaacggttcaaccagttgaaccagtgaaccattgaatcgagagcctcaccggttcgattaccagtccggtcttaataactatgcgtaaaatgggagtgagaggagctggatggagttctcttactaaatgaactatagaggtagagctgggcttaggcaactctaaaactccactccagacctaatttctagagttaaatttaggagttagaaatctactaaataggcccataaatttgcaattcagaaactaaaagtgtctagtagagttctgcactgtcacaccctaaaaatcccaaatatataaattgttgtctaaattggaattattagaatttattttaaaagcctagaagagaagatctagttttaattaataaattccaatataaaatggggccagataaaatttcattaaatactttgcttaattctataattcctagatttttctgggatttatttgagctaaggaagtatttttaataaatggaattgcatttcatgaataatttaaattggaaaaggttttaaaagttctcttttggctttgggccgaaagtcggcccaaaacctctctctctctccctcggcccagtcggcccagtccggcagcagccgcccgtgcgcgcgtccgcccgctgacaggtggggcccacctgtcagtcttcgtcttcctcgcgccgctgccgcgcccaaaccctagctgagcagcgccgccgtctccttccaaattcggccgcgcctttcctttcccggtgaaatcaatagaggggaaatgatccccgggatcccctctatcttttctcttatggaatcgtcgccaattcggtttggaaatccgtggattcgagttcaattcagatcgatctctctcctccgaaccctaaaccttccatcgcgtcaccggtcgccgtgggccttcgccgtcgcctccttgcccctataaaaggacccccaagcccgccgctacccgccgccaccctcgccttcgcctctcgtcgccggtagagccctagcaccctgtagcctagcgccaccgtcgctgccgttcgtccagccgtgcgccgccgccgctccggtcatcgtcgtcgtcgctcgggaaggccgccatcgtgatcaccaagtcgtcgccgacctcgtccgcccctccgccgtcgctgtcgaccgccggaacaccgccgtcgtcatcaagccgaaggtcgccgccgcttcttcctcgacgccatcgccgtccattgatcttccgccgttgttttggtcactggtgagttcgccgcgtcgccctctacgtgttggttccctccgttcgcgttgtcgtgccgtcattcgccggcgagcatgcacgcccgagccgccgccggtggtgacgtcaccgctgacgtcatcgttgccatccgtcgtaggcctgtcgtggaccgatagatctcggccgttcgtttttggatggatcggtctcggtcgttcgtttccgtgagccgtcgccgtgcacccagtccatcgcgaaccctagccgatgacgcagtaattcccttttccttttcaaaaataattcattattgcgtcataattcaattaaaatccatacaagtgttttaatccgatttaatcttttaaaattcataactaattcatcttagctcggatttagttggttcaagtctctaaatttttctaaaattgagatctacatgttagaaatatccacatgtactgttcatgcttgtttatgtgctgttttggtgattttactcttttctgtttagattccgacgtttccggagagtccgttttcgcaggagaagaatttgaagagtttcaaggccagcaaggcaagtcacacagatcccaaataaccctttgagcatgttgatcccgtttaaagctattgtttctattcaactattgcatttattttcgaatgtcattgggtggaattaacctattgtttgttatagcccttttgttcttgattactttattccttgataccttgggttattataacttgactagttgggctttatatattggttcagctagatattagatatgattgtttagccatgcttagaaacattagcacactattgggataacttataactcactattattcaatgttggcttaatgatagctcatgatggttaatcatgattggttaattaattaatttgccaactaaaacctgataatggtgggttgtgagcacatggttttgatggtcgtgctcatgacaattaaggaccggttcacgagttttggttgtgaaacattaaccgtgccaaccacaagccagcgtgggcaacggctttaccttttgtatagcatggttcattgcggggcaccagactgagaagtggcggagataagcccacgggggtcgctggggagtccatgccttgtttataagggggtgattatgatccaggaatggtgcgctgtggtggattgtgttgtgcgaggggtactgtcacagctcctttctgaggtaccgtggtggtattgaggcgcatggtgacatgttgtggggctgtgtcttgtgggtacagtggtacacctctggccagagtaaaactattcgaatagccgtgcccgcggttatgggcgggtctaacaatgtctttcgtgattagtttcacacttctcaccataataaaagatgctataactggtaataatttgattcgctcttggtttggaatggtatattcctggttttgagatagaactgtgcagccgggatggttgttcagaatggttgggcctatgcaacaggatatgttgtatagcgttggattaatattttttaattactacttaactattttattaaattctgaaatgtttattaaatgctatttatgcaaatgaaaccctactatgccatcctttgttatcctgtgcacttgcatatttgctgcgtggcttgttgagtatgtcatatactcaccttgcaatcattcatcagaggaggagttctacagtgatgctgatggtgtggaggattaggtgtagccctggtcaagctgcctgtggagtggagtcgtctgcgccgtttatcttatttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgagcgtgacaagttctcatctagacagcatcaccacatcactccatgcctcattcttaccattccctgttctagccatggactgtaatcgtcatgcaccaagctctaatcatcttataaaccacaaacacaaaggatacggatgaagccgagtgtccccattgtacatagtattcgagtaatccaattgttttggcattaatagttacaaattctgaaattgaagcagtgacaaataagatggatattcctcatccaaatatgaagacacgaatgagatagcattttcttgggaagaaatgtttgaatcaaaacaggagcggaagctggcgaacaatgagcatgattatgaatgcattaaaacaacagcgaaatttcttcgtcttcatctactagtttacaagaggacatgcatcacattcaccagaaaatatataccccccacaatttccgtaatgagcaactatagggttggcgcacagtatagtagtatagtagtaaactacggtcaagtccgcaatgagcaaaatgtgatgccaaactttaatttttgcacttgcgaaagggtccgtagagaagtgctctgtaggcaccagcagcgcccaccccatcttgccattcgcacgggagtgccactattgcgaaattcttattggtgttggttgggaacaactataggtgttggtttaacagtaagaatcaacttggaaataccaatgcctaatagtatagatgtcgatttaataactggtacctatataattgataataggtactggttttgtctagtatccagtacttataattgataataggtgatgattttctctaaaccgacacctttaacctattatttagggttttgtagtagtgtgccgacggcattcaggtgccgttgcgtctgccagtttggttttgtattatactagcaagactttaaattgaattatttgagcactattttacgtattatgtattttgttcttttttgccgtgtacggtggcagaacaacatacatacgacaaatgttgggttgtttaatttcatttcttgctctcacttagtgccagacacattgcctagtaaatttcttcactacaagtaaattaaagcagaataaattgctctaccaaacatccatccctcttctagttatatacttcgtcccagggctgaatcagctggagggcttcctgagaaacggcgacagaaatagcatgggaaggttcttcgtcactcaaacaaataccccaaatttaggccttattagttttgaaggattcctaaaggaaatctcaattcctttggaataagcaatattcatgcattcggtttgtaggattcattggaaaattttccataggaacactatgccaatcctccaaaaatcctccaaaatatactaattccataggaatgaaaacattcactctatcctcttttgtttagctcggtggaggaaaaattcctgtgttccaatcctttgttttacacatggattcctatattattcctacgttttttctatttctgtgatttggaaatcctgtgaaccgaataagccctacttaggaagcggcaatgaaaaagaacgcgtaccatggcaataagagaaccttgtaaaagaagaaaaagctcctggaaatccaaatgttaccgacaactttagaacatataaaaataaaaacaagatctttttactaccaatagagaacaccataaaatggatttttttgtacggtggcgctaatacgcgcgctgcgcgtggaatattagtttgagcaccgcacaaccctctctccttccggttttctcttttttattatcactccaccttccatgtttcttttttctcttttccatctcatccgtgcttcatcaaaaggcccggaaaaatattaaccatccatattttttcctctttcattccttctctgcattttctttagcattttagttttctttatctttttagtaaaatatttatcgtgtagtttttctttccgggttttctgtttttctagtgtctatccacgtttcaaaagcaatgaatttactccatagaatttttcatttactcccagcctaccacatctgctcattcaaaagtaacaaatttactcgcatgaatgcccgtcatcatacaacaccattcctagatgtccgtaaaagaattactaccagcttgcaatgctagtaattcttttaccacagttatcaatattgtttagacttcgtgatctacgagtaaaacaacaccttcctctcgttatagcctatgatctcgtagccactatgcagtaatatgttactgatgtgttcaatacacagtataagagtaaaaactaatataggagtattgttaatccgtatcacaaaatggttgtacgaatgaaaaacattacaggctcaatcacacacgactgttaatataactcacagatgaattaaactaaaaaagaaaaaaataattcagccaaaaattcatgatgacgttgggatcctggtggctttgctggatctttctataaggatagagaggttggtttgtgtcatgtgactggtagtggagagggcaaccaggtgaccagcagtagtcgatgatggaatcatggaaagatgtagcggcgtggtacatagatgagctcacatttgcgcagtagcaaccttccatcatctagcgagcatgaaataa

SEQ ID NO: 71464 - DNA, 11071 bp, Oryza sativa
cctcgccgatctcgtccacctctccgtttcggtcgccgaccgccggaacgccgtcgaccccgtcaacccgagccgcgccgccgcctccctccgctccgaccgccccctccgtcgtcgccgtcaccccggggtaagccgtggaccgtcgcctcctttcccccttccctcccctctctcggccgccgctccgccgcgccggtggtcgccggcggcgaccatcggggcacgggcgcgccgcctcccgccgaccgcgccggcgtggccgcccgcgtgcgcgccgagtggctgccgcgtggggcccggccgtcagccgcccgcgccctcgggtgcggctgacgtgtggggcccacggcgccgaccggtgcgagccgggtgcgcccagtccaccgtggaccgtgaggctgccgcgtgggccccactcccgtggacccggtgcgcgcgcccctccccctcggctgacgcaataaaccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgctggttatatggagtttattagagtaaaagccttttcttttccgttggtcgtgtagacgctgcagcttcggaagatccgctcttcgtggaggttgaagccgacgtttgggaaagcgagcaaggaaagtcacatcattcttgagcatattgaatcccagtttataaaattattttgatttaaattattgcatgatcgctttacttaaattcccgcgttatcactgttttatttagccatgcctatttacctttgttatgaccttattattattgttattgatattattaccttgttcaccctagattaaacaaaaccccaactagtggacactctactcatggtaccactagtatgattttaggtagatgcttcgctggttaattaggcaacattaggtggttttacaactctagactttgggaatattctcatcacctggacaccatggaatggatggattattgtggaattggattcacaccttcccctctattcaaaaccctcaaaatggttttaggctgggctcggggtgcatggttttgatagtagcacctcggccatataaggaccggtcttcgggcctctgttgcaaagcactaccatacttccacatgtctagtgggtaaggcttagtttgtggctcagtctggttataaacaaaagtacacggatggagatggacgaagtcggggtcgatggacatctctaggacaaatgaaggctacacgagctgcggcccggtagtcgagatgtcatggcacagggccggtgtcctgctgctaggggctcaatcctgcctacctgtcccgggggttccggccgtaggtggggttgggtcggtactcttgtctatggctaggatgggttggaaactatgtcacgtcttccgtccgtataccgtggtggtatgtggcacatggttacatgtgaggaagatgtgtcttgtgggtaaagatgtacacctctgatcagagtataatctattcgaatagccgcgccatcggttatgggcaagccgagcaatgtacccaagttagtgtttttaattcttaaaacctgcttaacaactaaaatgtggaatggttggcctgggttagcttgggacgagctgggacccagggtcgggttgccagttcgatctgaatcatcgtaggccttgggttaaggcaggttcatgtgggttcacggccttgattaataatattatttagctctagaatcgtgtttacaaaatagctttgagcaactaagtgtcttttaatgctgtttactgcaaaccctaaccctttatattttaacccccttgtactcccttgcatttattctacacttgtgggtgtgtcttgttgagtacggtggttgtactcagtcttgctcaattttgcccaaacccagaagaggagcccctggaagatgaaggctttggtgtctagctcgtgcctgccgtcaagcgcctgtggtcgtcgtcctagtcttccgctgtttttcgtttatcttcttgtgtgctgggtcttcgccgcccatgtaataaattaattaattacgcttccgcttgttaaactctgaattgtatcaacttttggtgtaccttgcctcctgggacaaggaataatgcacgcacgtaaggaacgcccgttgggttatttccggtcgtgacacctcgcccaaccgccatgtggcgggggagcgaccgggaagaagaccaagccgaaccgccatcaatgcgcgcggcgcccgaattgtccctcaccgcgtttaatgcggtaagggcagacgtgcggtgccgcccgactgacccacgtcaatcgggtgtgaccagtctgtgaccggcctgttgccggtcacgtccaattggacgggcaggcgtgcccccacgttgcctttgtatccggcaaaatggaaggtaggtatgtcccgtcccattggagcgttatccggagttccctccacgtgaggaggaccgctacaagtcttcactcatttaagagggaatgacagggctgtcccccgtgtcaggcggggggcggcgccgggtcccactcaaggacggactgcttgtttagattccgggcgaaggcacggatcgtggtccggtcaaagtaaagtgggtccctctcccgtgaaagagtaggtagaagcggcgcatgtggtatccccttgaactataaaaggaggaccttgcccgccgaaaaaggagaacgacactgagtaggcctgaactctaggaagcgaagagcaagagcgctctccggagtttaggaacccttgtaacattcaaccactaatcccacacacaggagtagggtattacgcttcatagcggcccgaacctatataatcttgttgcccatacgcgatttagaaaccctgagggcggatacacgatctcgagaggcgaaccctttcccccggccgaactcacaaaagggggatctcacgatctcccgctagagaggatcactcctcgacaattggacttacgaagaaattaacgctgaccaaacttattaagattgaattatatttttatcctatgaactgaagcaaattttcttaggtaatcatatagattgattacctgcctaagatctttaggtacctgaatgctatcagatgaggttcactccacctgaaccaatctatatacaattagccaaaattcagtattcagagtaggtttcacacttctggaatatttgcattaaatatttgacttacctaaattatttatgattagcaaaacttattctgagccgcttaaacatcaaatgttcaactgatgttattgttgctttatcttgattcaaattgttctatctaatgccttgtgccctttgactaaattgctctggtctttaccatttgttgatccatccaagcatgtcattagactgcgaaatagaacagtcaacctcttgattgaacaagtattatatttttctctctgatgggatgtatttaccaagttgatgataccaattttccagtagtcatttacgattttttttggctcatttgattattatttttcgatgctatatcacagaaagcactgtggaaaatacaagttctgaacatgctgacaaagcttcacctgctgatctgttgtgcatatggtattcctaccccactaataagaatcggtaaattcaatcatatcacagcataataggtgttaaaaagttaattggaagtctttctaactgcaatctggatgcttttgttactatagtctatttatatttgtcaactgatgctctactatcggtgcttcagagtataaggtgggagtgctgatataatgataagctgaaattgattgtatattgtatgttgcagactatatatcaagaaaatagtatggacatatggttaacctgccccaatttacttgccaaatttataatttgttcagcccaatcaatattttgtaagctagcctatgccatatcatggcttatagagaaggttcttaaaccggcatcaaagtcgtgcaaagcacgactgtatgtggctagttatatatggggtagattagattttgcacctataaatgtccggtgcttcttatgacgtcagaacacgcaaacgtccatgcgagacatttaaaaaaggaggtaaaacaagtatttttcgctttgttgtttgttctctcaaaaaaaaaatcttcgttgttttgcctttattctttttatccaccgacacccccaaacacctcccggagcatccggcggagcgctgggccctcaaggtcgggcacaagttagcagcagcatggtaaacaagcccttgtgagctggcgcgaaacatgcgggatatggagcctttcataacgccaagcacaagcacgccctccacatgtgcctgcccgtacatctcattctgctgttttaagcccaagtgtcatctcgattttagtattgctggccgctgctctgctcctggatccgatcgcattttgcatcgtgctcatgttttcgtcaatagcaaggaattgctgcttgtgtctgggctaggaggttactaggagatagtagatgggaaaggcaccaccattgcatgtgcggcaagtgattgtctctcaagtcttaattgagggagttttttttttttttctttagagcgcaattgagtgaggcatgctgttacagcatggattaccccaaccattgatgacgatagcatattccctatattaaaaaaaaactactagtaacatattccctatattagaaaacaaccaacttccggttatgaatgtgaaaataaactttgttcagatttacgattcatagtttaaagttcattttttagggacgaagcgggtacttgcgtgtctacatgtagaacaaaatagatgggcgaaaataaactgacaaaaaaataatgtggtacaggtacatcagacctaagattaattcccgaatgccaaactatactgatttcttggggttttttattttttgaactttttaattttaaaataatccatcctaaaacttatttcaaatttaaaacttttgcccgcatcacccagtttaacatgacaaaacaatactgtcactctacctcacagcaggtgtgccattgttactaatagttggcgtggccaaaaagattatttagaaataagttttgaagtgtttgtgtttaaaaataaaaatttaaaacgtttaagaaacagtaaaaatttgatttcttgctcctgctatcctactgcgacttattttgccacctactcctacctatatagttttatttactttatacaatgtatttagaaggaccaaaaatatgtcttctaatgtgcaggttcaagaggttggtcagcttagcttctaccataccacctgacacctaattacaccaaccttaccccttccagcttgcgcacgtactactcattagaggaggtacaaacatattttaagaagataaatgaggagagagaaaagcagcgagctatagatttatagccagctgtagcacgaactccaagacctagtgtgtatgataggtgggaccaagtattaatagtgtaatatataactattatattaataagctattagattggctatatataaattggaggtagtagttggctatactattaaacttgctcttagaagtggagaatcataatgaatcacacagcacaaaaaaatgatggtctctacttactcatttccaatttcttcagctatccttgctgtcaggcctggaacattcattatactttcctcaaatcatgctgtcggtagcagcttatcgatcactaatgttcatgtggatgatatttttgatagttaatacagcaatgcagaagccagatggacaaaaatttacaagtaaaaaataaattattttctatttccaatcgagaaatatgatctagatgacacatcatggatatctgagtttaaatccatgtggcagcataattttctacacattagacaaataaattaattcctgccttgctcatgtaatcagaagatggccaacaaattttactaaataaagaacggtgaaaccaaaaatttgtggacaaaaacagtgccccagcttgcaatatattagtggtttctattgattcaattgatcaagaacctccaagagtacaggcttgaatcggttgcaatcaagcttgacgttttgcttatccatgaaggtctgcctgatgaattcaaatccatgtttgtggaacgaaagaggatttgtgaagatctcatgatctaggggatattgatcagtaaggctgctttcatgtacaccaatgctatactgcttgtaacgcaggcccatttgttccgctgggttgccgaaatcaattcttgatatccagtctagtccaccccatggcacaatctgaatcaatgtagcgttttgtggcaagaacacacagttggtgagtccagcaccatggacacccatcatcacatcaacagagttgacaaccttgccaaaatgggagagatcagagctcacattggcctcttcaaccaccacctcgtaacctatctcctcagccatcgccactatctcgttaagattgagaaacattcttgtcctctgcctggatataatgagcagtcttggcttggctttgggaatctcaccaagcgcagttacaaaatccctaggcagtgagtaggtcctgcgcatgaacctattaaaatccaccattgagtagttatgtggagcttttgatgagtcaattgtgaactccatgtaagcatgaaggccaacaattgcatgcttgaagcaatgcacttgatcgtcattgttgaagtcaatcaaggggtacttggatagcttatcaaacaccaccttatacttccttgtccaccaaatagccatgtctgtgattaggaattgaacttcgccattgaattcgcttgcggttgtgaaaagagggacaagcacgtcggtgaagtcatggaatagatttccagtgtatccagtcagagcaaagaccactgcaggcacattgtgatacttgctacactcaggtgccactttgcttgatttcacggttatctctgtaatatggccgaggcagagctcgtcacctttacgagggtaaggcttaactttccatatctcctctctctttgaactggcaggttccatgtacatgacagaacttgcattgggatgaatcctaatgttgccccgcatctcacagacatttgctctgaagtttgagaaatcacatagtggtttcttgttccactcctcattatcagtttctgcaatagagtatcatcaatgaaagagcagaaacaaaagactgaatgaagcataatcagtctaatttaaggttcaatctagtagttaggaatctgaagtgtatgatgccattggtctaggataccaaaatagggttttgcatctatggccaaaatcactaaattcagatggtccattttcctgtcggcatttattgaaatctaaaatcctaacctggttccacattgtctcccttgtccgcgtccatctcaaattcatatttttcattcggtttgccatctgcagacaaagtagggccatcatacccaccaagaacttgtaagcaccagcttaacaagtaccaaaacagctagtactacaagtaaagtccaagaaacacaagaagaaacagcatctactaccttcttgcttgccattgtcagtgtcttcagcatcacggatggtataattggaaacagtcgggagggtcaccttgctatgctgtgtgtgcccctcttcctcgccgttcttattatcctcttcgcctccaccacctgcacatcccaccaccaaagtactcatacataaagcaagcatcaattgatggcgcccaaatctctcttgacctctcaagaccccgtgaatcaaagcatccagagacagagctagacaaggaaattattgacggattggaaggtgacggctcacctaacacctcagatgcagtggccgcctcctcgttcttgccttgctcgggctcactactgagtagcctcttctcctcctcactagtccctatcatcatatataacgaaaaggtcagtacgctaggcccaagatttgctgactgcagcaaggcggcaattagctctggagcttttcacctttggcggtggcgtcctcggcgccttcgtcttcgtccaccaccttgggatcctcggcggcggggaaggtatcggcggatctcctggagtcggcgtggatccgctggcggatcaggagcgagcgcggcgcatgatccaccgacagccggccgttcactgcgaactcaaagaaacgagtgaggcgcttggtgttaccatcgatccaaggatccaagaagaaaaagaagaagaagatgatgaagaagcggcgacggcatggcgtacggttgaagaggagggcgtcgggcttggagatgacgacgaaggtgagtgtgacgaggaagaagccgatgacgaggacgagcaggcgcagccgccgcgactcctgccggaggctccgcaccagcttggcgcgctcgacgggcttcatctccccctcctaaatctcctcgctcttcttgccggccgctccactcgaccgacctcgcgcccgccgctgactttctcctatcccgcgaggagagaccggccgagagaggcggaatggggtttgggatcagcgtggttgcgagaataagagggatagcaatctgcaatcctgggctggctggatatgtgcgtgctagcttccttcctttccttgcctctttcgtcagctttccagtattcctcttcctctgcgctctcctcccagtcccagcactagcggtctctcagtatgtgtttggcactttgggttaaaacagtgatgatgggaggtggggttttattcttgcatagtttacccgttccaaacaaacggcggcttaggctcagttttacataacttttttccaactcacctcttgcatttttagcgcacacttcccaagctatttttctaaaataaattcctataaaaaattgcttaaaaattatattaatatatttttaagttttgttagctaatacttaatttatcacatgttaatccatccgtatataggggagctccaaaataatagccttaatcagtgtgaacactctcgttgcaggagaccggaaagcagctgagaggacatccattgataaggcaagacattactacaggagtatcatgatatcatgtatgataaagtcataggtctcaaatcagtttttttcatagtgttcagtagttctaaagctgtttcagtttttgcatgtcaacccatattatttcctattttagtcctcatattttacatcaaacatcccgaaaattagaaaaagaaatataaatacaccctcccatcctcgtccggtcatccccgtcacgctttctccaaatgtcggcacgtagctctctctctccccctccgccgctctcctcctaccaccagcacaactctccctttcctcctccgccgttctcctcccaccgttggtgcaaccctccctcttcccttccaccgctctccctccaccttcctcgtcggaatgctagcgccgcctcatccttgccagatctagcccgtggttcgtcgagtctggcctcggacggcggcgatggctgcgactccactccactaagctcgccagatccaacctggggctcgccggatctggccttgggaggcagcgacgacggctcgacgacatcggtgcagcaacttgactacggcggcagaggcaatgggacctcccttcacccgcttcctctacctcgccgaattcggctgaatctcgacagtgaaggcgaggatgttataaaactggcctgaaatcaccatcaacaaccaaacgcggaagaaacgccataggagatccaaacacgatgatgacacgaggcacgatatttgttaacgaggttcagctgaagcctacatacccgggacactgattgtgggtgctcatctgcgatccagcatactacaatgtatcagagttacaatgactcacgcccggacgtcgccggcagccacaccatctcgctgtgctaagtcaccatatgcggttacaacaggttcgtccctctatttaagagagatcctatgataaagtccgactctcactctatttctaatacctattacaactccaattcctaaactgtaatcgacattgtacacatattcaacataaactctaacaaactccacgttgccctccatgctgcttgcctgaccccaaccccgatgcaccccatctccgggagccacatcgtagtgcctggtaacacctctaaccgccaagagctcgaaatctctgctacgactcctgaagaaatcctactcgatctcctccctagccgcacgccaacgagtgtcaacgtggaaaacacgcgctggcctgagagacttgctttactctagtgtaggtccaaagagatcgctttcgggttcagggtgtgccagttggtttgatcctgcaaccaacaagaaacaaagaaaacaaccaacaagaaacaaagaaaacaaagttaaatccgtaaacgataaccgatcggctgggttgccgatggcgtgtcgtttataccgggctgatgcgatacagatcataccggccatgtagtatatggagaagggataattggacgtgctctgtcggctgtagatgtcaataatatataatctatgctttgaagtactcttgaaccaagtgattaggatagatcggtcagcgcgccgagatagtataaaccacttgagtccatgaacactttaaggcagggattatatacgctcacagcatagctgacaggcaaacccaacgtgtatcggctagtaatccgataccactttataccaagatttcggtatagatcaaatatgctaaacaggaatcaatctagtgtcagggtaacctgacagactgatgg

SEQ ID NO: 71465 - DNA, 3439 bp, Oryza sativa
tgccaaaatgatcgtcatctcacatcatgtggttcgattgtgccataaatgaaatacaaaaggttctcccattagtcgaaagagaagagcaaatacatagagcccttaggagagaaaaaaaaaaggttcatctacattatattgtaggagaaaataaataaaatacaataaatagcacataaaaagtaaggtggtaagattctttcaagtcagtcgtagtacaatcaatggctacagagaatcaatcgataagtcagtggttcatgagacaaacttttcataagtatcatatggaggcagttgcatacttcaataaaaaaaaataagaatgagtaaatttcacaaaaccacacattctttagccaaattatcacaaaattaaactacagatttaaggtgatgtatcacaaactacatatttaacactaaatttatcacagaactacagatttaaggtagagtactgcaaaactataatttagtaataaagttatcataaaaatatatattttggagtacatagcactagtgttatgtttgagttataaacgtctaagtttcgtgattaagttgacactaaatctgtagttttgtggttactttgttactaaatctatatagttttacgataccccacctatttgtagttctctgtgaaatttagtgttaaatatgtagttttataatacatcaccataaatctgtagttttgtgataatttgctcaaagtatctgtagttttgtgaaatttactctataagaattgatgatcgtagcaatcttatcttgcaaagttattattttggagatagcagagtaaattatttggaaggcagacgctagccgtgaaagcatcagttgcatcccatgtctctcttaacttgttggtcaacacatgaatgtacaaattaggatgagctctgaccttatccacatggggttgtgaagctaatggagaaccagcttcacggtccagatcaataaattatcttcagcactcctagaggtagtccgatttctcccaccaagctctaaacatgtctcagagctgggatttggtccgtgctttatcaggccggcccaagacatgatagcctagcacgctagaaattaaagcacggcccgtatatgggccgtgcctgggcctagacaacgggcatggcgggcagcacaaacgaaaaagctaatcggcgaacaatcgcacgcgccctccgccgcgcgactggacacgtgtcgcgcacggagggggtggctgacggcgcccgcgcgggattccttttttttttcatttctctttccttttttcggttatctttctgttttggttttcttcggttttgttcggtttctcttcctttttgttcggttctcgttctgtttggtttttttcccttttttttgtttctcttcctttttttggtttttttaagatatacgtatgcaaattttatattcatatgtataccaagttttgttttttttattcgtgttttttctctcggtttttaatatgtacatatacaaagtttgtatatatgcaaacttggtatacgcgtatacaaactttacatacgtgtataaaaagtttatatatatgtacgtacgggatgcaaggtttgtatacgcgtatacaaagtttgtatttgtacgtacgtataaaaacctaaaaaaaatacacgtatataaattttataaatgtgtatataaactttgtatacatgtataaaaaattggtatatgtacgtataaaaactaaaaaatacacgtatacaaagtttgtatttgtacgtatataaagtttgcatacatacatattaaaaacagaaaaagatatggaaagaaagaaaacagaaaaaaaacgaaacggaaggtacggaagaaaaacagaaaaaaccaaaaaaaaaaagagaaaccgaaaaaaaacaaaaaaaaaagggaaaagcgggcactcccaagaaaagagaaacaaaacgcaggcgctccaagcgacgcaccatccaccgccctagtagtagagaggagagactagacgggttataactgaccgcgcgccgtgcagagggcgcgactgatcgcccattagtgctccccggcacaacacgaccagtgggctatgggccggcacagcacatgaacaacccataggcacgacgaaggcccaatgggcttcgcaatagccatcaggcctggccgggcgcatcaaggagcgacgcatgcttctacatactcatcgtgtgaaacgcgcctccaccaccacgcacgctcggcctgcatcctgcacccgcgcacattgcatatctttccgtgccccggcaacaagctcggcactgcaagtctgcagcgcatcaaagcatctctgtctgcccgtcccacgcgtatacgagtctacgtctctacaagacgctcagagcatctcctgcaaagctgcgacggtgtcccgcgattcccttccgcattggcgcaatgaatcaaagcgtccgtcaactgcgctaccactagtccactgctgtcactgcaaggtcgactggtcgagtaccgaggacagggacggccgaacggatgcagacgcgcggcgctgggcaccacttgtgatttaccgctggaaaaacgaagagctcggactagtactaggactaggtagtaggtagtatgaaggactgggaaggctgggtacctgtgattcccttgcttggttgatcctgtcctgccccgctgctgtccgtctgcatcctgccatcgccattcgccgcctcgccacgaccgcacgaccgcacgacgccgcggatgtgtgaagaaaggctggcgcctgcctcggattgagatggagatgggacgacttgagtttagaccatgccacaccggcgcgaaggacatatacgccgggtcgcctggtgtagcagtgcaggcgtagacgagtagagggccagacctccagttgccagaggcagagtggcagagaagctgcatgggcatggtgaggcgattggctgcgccatgtgcctctgtggagcccgtaggcagcaaatgtgttgtgtgttgtgtgcaagagcaacgagaaacaactagctcatgagggcaatttgttttataaattcctcctcctcttcttcttcctatcataaaagaaaaatgcaccacaaataaacagagcaacatagttatttcctttccacagcaaaaatgtggggcgatactcgtcggaggtcaacctcgtcgagaccctcgcaaaggcgccgccaatgctcgcctggtccttcccgtaggtcggtcgatgcccgccaactatctcctggtatggatgactatgggatggataaccgccatatggatggtctggagggagatggggatgatcctacggaacagtccatcatcgaggccaatgacgacacggtcttgtctttgccgggaggcaaggccgagccatccacaccatctg

SEQ ID NO: 71466 - DNA, 4586 bp, Oryza sativa
tatgtaaacatggaggaagttggaatgaatattaacatatatcccatacatatatattacatggttaatattctaatcacatgtggtaagtccattaaaattttttaaaatgcccccaagctaccatgtggtgttctagtaaattagaaaaaatattagaaattctaaaaaaacaaagtatctattacttgattttcgtttaaatcggtgggtccaatattataaaccattagattaaattgatcttagaacaaactaaatattacgaggtcccacctctccacctttggtaggcacctatgtacgtgggtacctacgcttcccctccccattttcatttttccctttcttcttttctccatgtatacgcttccctccctttcttattatatcatgcgccttcatgagacaatttaatcgcaagaattttgagtatcttgatctcgcatttttcatttgtagccatactacaagcaatagtttattatttactcgagaaaaaaacatgattcaaaagtcgtaaaagtcgtaagtacttaatccatctcctactcaaaagtttgtgaatagatttttaagatatcttaagaaaaatagaacccttaaattattataaaattaatacaaaataacagtatccgaactttagttttcccttaatctatcatacaaaatttttgaacaaagaaaacaaatcttacctttcaataatacaagtgcccgcgcatacgcgcgggtcaccttcctagttaataagttaaagacactatggagcccacatgtcaatgaagcatgtcttccttccctatcctctctctcctctctcctttctccggttctccccacaacgagtcaatggcggtagcggccaacgaggaaggaaagcagcgacagtagctaatcaaggagggagctgcaacaacggaggagaggacagagtcgaggaagctatagtgagctcgaggttgcgaatcccgtccgccataaggtgctggtgcggccggcgaggaatgcagcccactgatatacacgccccactaccgtccctcgcctcgtcgggatgctccacaacagaggtcgtcgtctccaactgcgtatcccctttccaccgacagactcactagctaccacgacatcgacaacgtacgggagtcatacgttgaagcggagtgcgccgaggtggtgccctcttcgctggacaatggccccactatctccaatcaaatcctcgtccgatgctccacgcaccatcatcgacgccccctcgggcgccgccgcttgccggcgcaaccaccttctacttttttcccaaagcctactagtcccgctctacaagcgcgcctgcaagaaacaccactacatgaaacgctgccaccaccagcgcccagctccgtccggctcgtcatcggtgatgcaggccccctagcccctccagtcgtccagcggctcttgtccccgctttgggagaccgtcacgaccgcaagaatcaagaaaaaggaaggccgattttttttaatctacccacatgcgacctcataattccaaatgtgagcatgtattgtcctgattcctgtttctaatcaaactagctggcaggcacaaagcaaatgatccattaacatgtttcgctagtattacaattaccctttgttaagcagcttctatgtaaacaaaatcaagttttattagcacacataatattatgattccgatgatccaagcagatggattatatttcaaccgaccgccacagttccaattttcaaaacgaaaacaccatccaagtcaaatatggattaagaaaaaaaaaaaagccgaagaaagctcgagactaacggcatgacggcacggtgccctatctcgtaatggttgatccacccaattgcaaatggtaataagattttcttttctgacgacaaacaatcaattagacctaaacaagtcgctacgagctagtgatttgtccaatgatcagcaaccattagtttgttatatttcgtttgacattaagtctgatggaaaaccactgcacacacacatgtgggcttcttgattaaaaatagaactccatccattacctactcatatttggaattagaaggttgcatgtgcttaaatgtgaaaatttcggaaaggaagtggaaaaaaaagtgtagaaagagaggtgaagagggaagagaggtttctcgctgaaatatacgaccatcacatttttatttatttattttaactgaaatgccacgtaggataaacgcaccattcaaatcgcttggggaagtaaattgaattggttttaatagtttgggtatcgtcttttttgggttcagggacgctaatcaaactggggctataattaggggatgaagagtgtgaacttaggtctgttttggattagtgccaaaaacgtgccctaccaatactttggtagtttgaacagtgtatctggtgattttggtttgaagccaaatcattggcattgccaatgcccaatttgatattttctatattctactcaatgcttggttctaaattggcctcaaaccaaatacaactctaccctaccaaaaaattggtagtaccaaaacttgcctaggttttggcactaccaacattttggtagggtattgaaccaaacaagcccttattccaccgtaatatactgagcttttcaagggcgctgatgggccaaagcctgataagagcccatttgttttcttttgtaaccagtccactccaagcccagaaagtaattagcctaggcctagttaaaatcggcaaatgagcgtgggcttttatccaggccacagccgccgttgagttgaataaattggaaaaggttcactttaggtacctcatatatatgtagacttccaatcacatcccttaaccgtaaaatcgagtatagatcgtctcccaacttctacaaccagtgtaaatcgagtctgtcagtggtttttatagcggttttgattgacgagatgctctatacacggttttgcagttgtgggatccgattgcaactcgacctatactttagggacctaacattaacttttccgaacagaatttgaaagagcatgcagttgagcatgaaaataagcaagtatttccccatgggctatcttaacctaaaaaatgggccttaagagaatgttcttaattttctgagacaatataatccatttttgccaccaaattaattatgcccagctcacggtggtagtcgtaaaagaaacttactatacgtgcgagactatttcttgcgtacagctacggcattctcatctacctattgtatacgtgtacacagaattgcttggtttgtgtatacaagtatccacacaattaataatgtttgcagccacatgcagcaacaacccaataaactaattaaagagtaacatgctctcaatatcctggccggataaacctatttcggctgcgacgacataaaactattcctcatcacagtagtactttgagattcctaacaaagcctgcccattatatatctccaagagatcatgcactaacctaaaaatatagaggatcatggcgtactaggtatatccattattagtttattatatcacacatcgcatattcataatttccaaccatgattaccaagataattaattaaagctacagacaaaaaattaaaaggacgtacctacctaccgtgatacattgatacagggatgcacgcaatggcacgatcgatcgatcgatcgtacgtacgtacccatatatcgggctatacggtgtgaacgtacgtactgaagaattgatcagttcttcgtttcgttcccttgcagcaaaagccacttgatagctagtagatagttcgtcagttagccgatcacgtgtgctagctagctgtcacgggagtttgtgaaaagaaaattttttggtgtcacatcgaacgtttaactggatatcgaaaggtgttttcaaacatgaatgaaaaaaataatttcataactcgcctggaaaccacgagacgaatttattaaacctaattaatatatcattaacacaaactggttactgtggcacttatgactaattatgaactaattagtctcaaaagattcgtctcgcgattcaatacaaactgtgcaattagttttttattttatctaaatttaatgctccatacatgtgtcaaagatttgatgtgaccttttttgaaaaaaaaaattgagaactaaacaatagcaaactaacttaccacgcacttacgcaaaccaacaattaaactctcttgggattgtagggctcgttgcagagatcaaaccggcaaatcggtcgtggaaagaaagcgaccgatgaatatatatatatgtgtgtgtgtagcaagtgtatatatatgtgcttatgcgtgtatgattattgcatgtatcgcgcgggagtatggactacggattcggatccggagttgcagacaaagataaacccataaacatatgcatggctcgcgatctgatcggggatggaataatgcacttgatatttttctccggtcgattaatttaattacttcctttctcttttagaatataagatattttggtttttgctaa

SEQ ID NO: 71467 - DNA, 9669 bp, Oryza sativa
gtggttttacaactctagactttgggaatattctcatcacctggacaccatggaatggatggattattgtggaattggattcacacctccccctctattcaaaaccctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcagcccggtagtcgagatgtcatggcacagggccggtgtcctcctgctaggggctcaatcctgcctacctgtcccgtgggttcctgtcacaccccgaagttctcctcccaagcctaaatttaatttacaaatgaccctaagaaaataccggtgcaaagcaagagtaaacccttttaaatcaatgcaaataataatcggaattggcatgtggaatttttcttgagttctacatgtcgaaattctctaacaggatttttagtggaattttcagagccctagaaataattttaaccaattaaaattgagcaagcaatattttaattccagggaaaatcctttttcctttttctttttctttttcctcccttttcagaatgggccggtggcccattctctcctttcctccccctcctccctgctgggccggccgcaggccgaggcccagccaggccgccccgccgccctcctctccatgggtcgccgacaggtggggcccacctgtcgggtccttccccaacctcccgccgctcccgctgcgccgccgtgcccgcaaccgtcgccgcgcccacgtctccgcctccttcgggccacgtcgaccacgcccgcgcgtgcgccgcgttccccgcacccactcccctctctcacccgctcgcgcccgcgcccgagatggccgggattcgatattcgaatcccgcctctctctcctcccccacttcccacgttggccggcgaagtcccgcctctcccggccacgtccgaccctcccctcccctatttaagcttctccgtcgctccctctcactttttccccatctcgccgaactctcccgagcctcccatcgctcccgcgccgtgcaacctcttgccgccgccgtctccgctactccggccgctgctagccgccgctggggtcgccgccgcaccgcgccgtcgccgccgttgggttcgcgtggccgagatccaccccgtccacccctccttcgtcgaggttcgtcgccggagcgccattcccatcatgcgacgatgagggtcgccatgtctgccgctttcggccggcattcccgtctcctatggcccctctcttcctctctaacctctttcttttcgttctttaggtcgtcctggtcgccgtccgccgcgtgtcgacctctctccgtcgctcctcgtcgccggacgccgccgtcccctccggtgagggctccctcccctttcattttctttcccaattccccgtgcgtcgccgccgctcgcgctcgccgtcgcctttggtcgttgccgccgtccgctgccgccgcttttgcgtcgtttttgcgccgtcgcctccgccgctggatgccgtcaccggcaacgcgacgcgcgcgtgccgccgccgctagccctggccggccggtcggctttgatgccgagccgagcccggcggccgcctctatcgccgcccgtccgatcggcccgagggcgatctaggctgtcggtcccgtggaccggcggtggaccacctgcgtggtcccggtccacggtgaaccgctgtcccctgagccgttgaccagtgggccccgcttgccggcgccgcaccccctccgtgctgacgtcagccctggaaaatattgcgcaataaaatatttaaggatttttgttatagtaataaacacactgaatcttctaaaattcataactaattcatccgagctccttttaagcccattcaagtctcagtaaatcaagaaaaatgtgtagaatccattaaaaatggttttgtcccctgtttcagtagtcttatagcctgtttgcaatgtttgccttgtatgtcgctagattccggttcctccgacgctccggtgtacttcgaaatagtcgccgagattcctccagcagcagagcaaggcaagtcatgcttgtcacttgaacatgttgatcctatattgcaaatgctctattgttttctttcaaatattgcattgttttataatgttactatgggatggttacctattgtcatagccatgctactgtcgtaccatgtccctttgtcagcttggggttataacatgactagagattggactagggattgcttagccatgcttagttcaactagtgcacaatggggaaaatcctattaatgtttagactgttggttctaatggttttgttggtttagtgacaccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctctcctctagccgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctaagggggttaggcgcagggtcctgtcacggcctctttcggatatgtcgtggtggcatgtcggcgcacggaaacgtgttgtggggctgtgtcttgtgggtacagttgtacacctctgatcagagtaaaactattcgaatagccgtgcccgcggttatgggcggtcaaccagattcaccgtgattagtctcaccctagtgtaatcttttgaatttggatagtttaggtggatggttgggcctgttgcaacgtgggataacgttggacagtggatagttaatactaattaaatattacaactgtttaatctttcaacttctgtttataaatgctcgctttatgcaaatgaaccactccagctcttctttgataattccctgcatcatacccctattccggtatgacttgctgagtacagtgggtagtactcagtcttgctctatttttttcccaaccccagagctcgagtatgtgtcagatgaaggtttctccgaggagtaggctttgtccgtgccgtcgaggatgcctgtggagtggtggtcccgctgcagttctagtcaaggcttagctcctgttgtctttcttttcttccgctgcatttgtgtaagacttttatgatgtttgtaagacgtggatctgaatgtcaacattgtcgtttgtgtaccccggccggtcctggacggggattttaatgcacattctgcttggaattctactcaggaatttctgggcgtgacaagttggtatcagagccgaacttgaccgtaggacaagccaaatggaaaaacctaagagccctccgaatccttttcattgcatatgttctttgcaattggatttgttccgggaaaattgggatctgttcttgtggttcaaggggaaaaatcttgatcgctcgtttaagtgagatttgtcaaaacgagtcagtctagggttttagtaaaactattgagatttattcgtcagtcagttgggatttgatgggtgaaatgcattaggtcctagctcaggaacatgggttgcaaggtatttatgttattagtgttattatagtatgtatgtaatttccccactattttatcgttatgtgagtctgtcttctttattcgctctcatgcaaaatgatctatgcataaaatttcgctcttattcgattctcttattgagtcttttattgctttatttaaatttggatttgagcatgcattgatcctactcctttgtcttctctagatggccggccaccccccccaaccaccgtggagaaggcatgatcgactttgtggcagagttggcacgcatgacgctggtggtgggctaccccaacgcgccagagtacacgactgttccaccactcagtggcgagcttcctcaccgtgttcgcctggaggtccacggctacgtgggtacctgtctagctaatatggtggttgaggcatccggaggcacagcagatcacgcctgtcaggaggcaccatacctgatgatggccagactacgggagcgccacaactacatcttccacgacacggcgtaccgatttcacccttgtcgagccagcggtggtgatgtcagtactttccgtccgacagccggcgagaacgacaccacctttggtcacatgtgtgctgtgatgaggggattggataggatgcactcggacctgcacaaggcgaccaaggccttgaatgatgggaagctcatgaggatcgtcgctctgaaggacgagatagcgcgcctgaagagggagaatgctcagttaaagagtcttcccgcgccaggaggagtccggatccgcactacaccccgcaagacgacgacggcacctgtgcgcatccagcctgcgcccaggaacccacctccgcccgcagttcccgcacctccagttccgcccgcagctccgacagttcctgcagctccagcaccagctccagctcctgttcacgtgtcagctcccacgtccgctctctccttcgctccagcatcagctgccaggggtccagccagtggcaacggaggttggttgtctgctactcccagtggcagccgcgatctcagcagcaacagctccagtagctcagagtcgggcagcggcgagacttatctgccaggctccaggagtcgctcagagggacctggtgacgagcaggaggacgccttcgactccaccgaccgcaggagctgttccgagcattaggctcgttttccattagtttatcgactgtctagcttctgcttgttagtttgtgtgtttaggttgcttgtttgggatcagttgacggtcgatatcatgtgcctctgatatggctgtctaaataaggatttttgcttgctctttaagtgttttaattcagatcagaacaattgcagtttaaattcctatgtaataaagcttagttcctgagcatctgtttttcttctttcccccgtctgcttttccctccagatggtctacaccaggaatggtagccgcgcaacaggcgagggcagcaacggcgaagagcgcactgatggggcgcatccccacagcgattccggcaatggtccgccaccacttcccgagaatccgacgctagcccatgtaatggcacatcagacccagatgatggcagccatgatgcaacagatgcagcagcaccagcagatgcaccagcggatgctgcagcacgccgaacagcagcatcagcagtttggtccccctccccctcagtccaagttgccagagtttctacgtgtcaggccacccaccttctccagcaccaccaaccatatggaggcgaatgactggctccatgccatagagaagaaactgaatctcctgcagtgcaatgaccaggagaaggttgctttcgccacacaccagcttcaaggtcctgcgtcagcttggtgggacaatcacatggccacccgcccaccaggtactgaagtcacttgggcagagttctgccgtagcttcaggaaggcgcaggtgccagacggggtcgtggcacaaaagaagagggaatttcgggcactccatcagggcaacgggactgtgacggagtacctccatgagttcaatcgtctcgcgcgatatgcacccgaggatgtccataccgacgccgagaagcaggaaaagttcatggcaggtctggatgatgagctgaccaaccaactgatatctggagactacgccgactttgagaggctagttgacaaggcaatccgtcaggaggatcaacgcaacaagatggacaggaagaggaaggccgctcagttcagggcacctcaggggagtcaccagaggccgcgcttcgcttccgggcagcagggtggacctaccaccatgatcgtccgccagtaccgcccgttcaaccctagcaactttccccagggcgccagaggcagtcagaaccaccatggaggtcagcccagccgcggtgcagctccacgcccaccaacggcaccggcacagtcaggcccgtccgcgcaagccaagaaggagactggaacaaaaccagggtcttgcttcaactgtggcgagcttggccacttcgctgacaaatgcccaaagcctaggcgtgccgggacaaggtttatccaggctcgtgtcaaccacgcgtccgcggaggaggctcaagcagcaccagaggttgtactgggtacgtttcctgttaactcaatccctgcaacagtactttttgattctggtgcaacgcattcgttcatttcaaagaagtttgtcgagatgcatgggttaataagagaggaacttagcacaccgatgcgggttcataccccagggaatagctccacttcggttcaattcagcccttctataacaatagaaattcaaggatcaccatttctagccaacctcattcttctcgaatccaaagacctagatgtcattcttgggatggattggctgaccaagtttaagggagtcatcgattgtgcgaatcgtaccgtcaccttgaccaacgagaagggagaaacggtagtgtacgaatcaccagacgcaccaaagcgaggggtctctttgaatcagattgaagcggaaatcccagtggacactgtggagaagaacttgaggaaattggaagatatacccatagtctgcgagtatccagaagtattccccgaagacctcactaccattgcacccaagagagagattgaattccggattgacttggcaccgggaaccgctccaatttataagagaccgtacagaatggcggctaacgaattagccgaggtcaagaagcaggttgatgagcagctgtagaaagggtacattcgaccaagtacttcaccttggggtgctccggtcatttttgtggagaaaaaggataagacgaagaggatgtgcgttgattatcgtgcactcaacgaggtcacaatcaagaacaaatatcctttgccgcgaatcgatgatttgtttgatcaactgaaaggagctaaagtgttttctaagatagacctgcgatcaagctaccaccagttgagaattcgggaggaggatattccaaagacggccttcaccactcggtacggattatatgagtgcacggttatgtcgttcggacttaccaacgcacccgcattcttcatgaatctgatgaacaaagtgttcatgaaatttctggacaagtttgttgtggtattcatcgacgacatacttatctattcaaagtccaaagaagaacatgagcaacatctccgcctggtactcgagaagttgaaggagcaccagctatacgccaagttcagcaagtgtgacttctggttgacggaagtcaaatttttgggccatgtcattacagctcagggtgtggcagttgacccatcaaacgtagagtcagttaccaaatggaccccaccgaagaccgtgtcgcagattcgaagttttctaggactggcaggttattaccgccgattcatcgaaaacttctccagaatcgcccgacccatgactcagttgcttaagaaagatgagaagtttaaatggacagttgagtgcgataagagttttgaggagctcaagaagaaattagtatccgcaccagttttaattctgcccgaccagatgaaagacttccaagtctattgcgatgcatcccgtcacggacttggatgtgtcctaatgcaagagggcaaagtggttgcgtatgcctcgcggcagttgcgtccacatgaagggaattatccaactcatgacctggaattggcagcagtggttcatgctttgaagatctggaggcactatctgattggcaaccgctgcaaagtatatacggaccataagagtctgaaatacatcttcacccaaccggacctaaatctccgacaacgaagatggttggaactaatcaaagactatgacatgagcattcactaccacccgggtaaagccaatgtggtggcagacgcgttaagcaggaaaagttactgcactgccctatgcatcgagagcatgtgtgaagaattgcggcaggagtttgagcatctcaacgtgggaattgttgaacacgggttcgtagccgctctggaggcacggcctatgctcgtggatcaagtcagagcagctcaagtaaatgattctgaaatagcagagctgaaaaagaacatgagggtcggaaaagcccgagatttccacgaagatgagcatggcacaatctggttgggagaaagattgtgtgtacctgacgacaaggaactgaaggatctaatactcaccgaggctcatcaggcccagtactccattcatccaggcagcaccaaaatgtatcaagacctcaaagaaaagttttggtgggtcagcatgagcaaagaaatagctgaattcgtcgcactctgcgatgtttgccaacgagtgaaggcagagcaccaaagaccagcaggtttactccaacctcttcaaatcccggaatggaaatgggaggagattggaatggactttataacaggactgccccggacatcatcgggtcacgattcaatctgggtagtcgtggatcgactcactaaggttgctcacttcataccagtacataccacgtatacgggcaaaaggttggcggagctctatctctcgagaatcatgtgtctacatggagtacccaaaaagattgtatctgaccgagggagtcagttcacctcaaaattctggcagaagctgcaggaagaattggggacccgtttaaatttcagcacggcctatcacccgcaaactgatggtcagaccgagcgagtcaatcaaatcttggaagatatgttgagagcttgcgctcttgattttggtggagcttgggacaaaagcttgccatatacggaattctcgtacaacaacagctaccaggccagtctacaggtggcaccgtttgaagctttatacggccggaagtgccgcacacctctcttctgggagcagacaggcgagcgtcaactgttcgggacagaggtattagcggaagcagaagagaaagtcagaacaatcagggaaaggttgaggattgcccagtctcgacagaaaagttacgcggataaccgccgaagggagctcatttttgaagcaggggattacgtgtatcttcgtgtcactccgctctggggagtacaccgttttcagacgaaaggcaagttggtaccacgcttcgtgggaccatacaaaatcctggaacgaaggggggaagttgcttatcagctagaacttccatccaatatgatcggcatccatgacgtgttccacgtgtcccaattaaagaagtgcttaagggtacctgaagaacaggctgattcggaacacattgatatccaggaggacctaacatacgtggagaagccggttcgtatacttgata

SEQ ID NO: 71468 - DNA, 1571 bp, Oryza sativa
caaggatgcaacaccggctagaggatccagagattgccgatgcaccggcttgatagaagtttgtccagcaccataaactttaaaatcggagatttagcctcctaaaccgttcaaattacctctgagttactttgatagtggttttgttttttttttttttgagagggtacaaatcagaacgcacacgaacacacacaacactcacaccacaacgcacgcacacacgcgtgcgcgtccctaacacacgttaggaaagagattcgaggacctatgcctcactgtacgggaaacatacagtaccaccgaacacgcacgtatatgtaccctattacctaactaggaccaaccgaagttgactcaggaaacgggaaaaacccctgtgaggtccgtgagtcgatgagtggtcctcaaatcttaaacaagcagttttggaacataccaacagagctacgctcaggttttggataactggtatggcatgttcacatactgtcaatcatcggttatcaatttatattctatagtgatgtcatatcagtattatattaatcatccatttgtaagggggaaatttgatcgaacccgacccgtattcacccctttatcacataatcatactcatccaacgattatgtaaattaaataaaaactactatgcaaaaccattttaagtgtaatataacatctcataggataggattagagttcagggtgctgcatccacgttttcaaatcatagggggcatttggacttaaaaaaaaatgaaaacgcgaatataccagccgaaagtaaagctgcggcggatggggtgaatggctccctcctctccccgccgagacctcgacggctaggggaccgacggcggtagctccgcagctagggacaaggagcggccgatggccttcgacgagaagacccggacggcgtgctggcggaaggcggcggtggtgatgggccggcactcggagcggtggcgggaggacgccaccggctacatcgtgtgccgccgcttatggagctgccacggctgcctttgctacgagtacgaccacatcgtccccttctccaaaggtgcgtcccccccttcttgcccactcgatttagggagaatcctcaagttttccgtttcttgcttggagaggtggtggtcgatccgtcaagttcgtatctgtaggattctgatgcgtttgcttgccgcggtgtagttgcaatgttggatactcggactatttttgctcgatcaagtattggaggagttgtcgctgagttgagttcatccgcagatgagcactaattttgttttattcagaggaacatttagattaaggttgggatgtttaaaatcggatatgagtacacaggtgagttcagatggagaaattttagcctaatctcctgtgggtcagtagatgataattggaatctgtaatgccgtatgtttttgtttttttactaagtaaatcatttatgtttagttaaattagggggagatgccttctccaatcaataaagatggctgtgcaacaatatcatgtaacatttagcaatccatgttaagcaagaaacatgt

SEQ ID NO: 71469 - DNA, 945 bp, Oryza sativa
atttataataatgaatatgtaatcatgtatttcttctattttaaaataaatgatactgttgatgtttcgtataaagattgattattggtattttttaaaaaaatatatattatttattttgtaatgagtttttttatcgtcaaataaaatataatgttaaattatatttttatatatttttactaaatttttaaataaaaaaattaaatattattgaaaaaatttaagggtgttacatattttaaaaagaaggtactagtactacctaatgatctacataaacaattaaccatctcagcttgtttggcacaatggaatctaaagagtattcgacgtggttttctctgcaataccgctggtacagtgcagtaacagacgtactatggacaagtcgtacaaatgatccacttccaagctgtattttgtaattggcgccgatcgatgctggcaggtagttggatccgttcaggcccaatcatcgagttagagagagattccgtatttgtccccgtgaggcacgcatgatagaataagcatcttgagtacatacttgtttaattacatagtatattcgatgataaattaatactacgactaattgtgcttgattgccagctgagtgtttagcactgcactggctcagctggtacatgagcacgacatcagtgcccgataactgttttataaatgttcgatacaacattctcaaataagacatgaaacatcactacgaaaaatgtataacatttgtgtagaagttgtggaatatgtacagagatccgtgcaagataattgatgcaacatccaaacaaagggggtgaaacacgcaacagcgaaacagtaaaatgcagcacgtacaacgaatcgtcgaaaagatatgtaacaagagactaccagtttaattagaatttattttcttagccttggatcataacttgtcaacat

SEQ ID NO: 71470 - DNA, 1121 bp, Oryza sativa
ggccgtgtatttggccacctttccggccagagccaactcggcctgctgtttgttgccccagaggaggacaacatggagacgatcgtcgcgcaggatgcgcttgtatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaataagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactactggggttctgaat

SEQ ID NO: 71471 - DNA, 651 bp, Oryza sativa
attgctttgttactgtgaataattaggatcatgatgcatttgtctataagcaaggtgctataaaattgtactttttgaactagccataaaacttcaaaacaatcatgactttgtaaaaataaacaagtaatttcagataatatctatttcatgcgtttgttttggcaaactatgctgatttggccagaggataaaaagtttcaacaaataacatacatgggacctatttggggtagcttatagctgctgcagcccccaaacagtccagattgttacccagattctgagaatctgtaattgtagaatccggaactagaatccagaagctggaaaacccagcttctccagattctcggaagctagctactaaccagcagattcttagaatcttaagctcccccaaatagggccatggactgctcttatttatttttatatcttaagttgtcttctcattcctgaatcaggagatccaactgaatctctaatcgaacgtaactgttgtgccaactctatttagcatgaaaacctaccatggtagtttcgtatgacatgcaaatttaatctgatagtgttttttctttgtcagataaagaacttgatgtgattgaaatggctgtctatggggatgtcatccgtcctggaaagcaa

SEQ ID NO: 71472 - DNA, 745 bp, Oryza sativa
  unsure (1)..(745): unsure at all n locations
cgcgtggtttgnattagtannnnnnnnnnnnnnnnnnnnnnnnnnnnnnctttttcccctaaaccccaggacagagagaaaaagggggcctctaactccaagttaagctccagtcgaaaggtcttcacatagtaatgtttttgcttaattaaacgcagattttacattagtttccggtagcatgtctttaagctactaaacaatatgtttcataaaaaactttctatatagaagtcgctataaaatacagatataataattaaaacttaactaatcatgtgtattaatagctttcttgtttacgtaatttccgtctttatttctctttagataatggaaacttccatcttcatatttggtgcttctgacatactatttttcttctgcacaagatgcaaaagtcaatataaactcgctggctgaagaattggagcaatgcaaatatgttcttgttttgagcttgttcacgacctgtatgctcactgttaaggttgatatacaatttactagtaaaaaacagagagtccttttctttcttctgaattttcacttgaaattactagtgtacaactgtacatcaacaatgtgaatgctaactgagcgtgaaatgccatatactcctatcttttaccattcgtcactaataaaaatatttcgacagacaatgggaaatagtatgcaagagaaagagggaaatcgtttgttttttatgaaactgggacatagtatgttattgtacgcataa

SEQ ID NO: 71473 - DNA, 1829 bp, Oryza sativa
gcatattttgtacccacgaacattaccaacacattgcagcttacattttttttcatgctttctgaagtaacacgcatttttcactttttacagtcgtagtgaatctgctaatgagttctttgcttacacataagaagacccgaaaataattgaaggatcagtgtatggcgtcaaaacagaaagtaataatacagattgatcctaggtgggctcaggccctcccagtttgtggaagtgattccctgcattatggacggagcagcaagacagaagggtcaaggaaggaggaacagcacgcttggcagaagtgattccctgcattacgtcaactgccgcagcagctctacccgtggcagagcagctggcaaccatagcgagcgaggccagagcagcaaacgccatggtcggtcgctcgccggtctgttctcgtgccgcaacgcgtcctcgtctactgtgttctatggcgccgagcagacagtcttcactgctctcttaggactcggtggatcggctaggtggagacaagggggtgttttaactaggcttaagacagcaactgcatcgtgtcgttgtaatctttgttttcttttcgagaaatgataaatggaatggatattaatgtctatttctgttgtttattttgtctgatagaaatgataatttgtgaaacaatgcatttaaaatgaaatcattatcataaaataggcgctacatgagcaaggtgtcgttgtctgactttcggcctctaatctgtacattttatatagttacaacccactaagcctaaaacttaacatacaaacataccacctcatcatctattagtaataattacatatcaaagctaatgcaagcatgcacatcatctatattgtatcaaattctacgaatcaatatgcaagcaaatccaatcaacaccccctcgtatcatttccacaatattttaacatagatatctattatttttataatacttaacatatttccatccatatatctcccatcaaagtgaggtatatcatttattttgtttcgtgattagtactaataattaaacacaaacttttcatcaattttcctacctcttgcttcttacgatgcaaatcttacgcaacaatttaatatttcatctacaatctgctacatgatctattaaatttatttttcttgagatatggtttgacaaaccagttgttaataactaatatcctttttctcctaactcgattgttaacaaaaaaaaaacatattcaaaactaattagtaatcccacaagcaaaacgtgggaaatcaactaattaaattaatactcgctacatattctttcagcaaaattttagttttaccaaacccgcaattactccacgatgtcaagagagcactaataaaacaatgcgaacattgcaaataaagtagttattcggttctttgtgattttagatgaattgtggcatttcaatgtgtcactctagttaacggcctcgaatgaccccttaccagtagggatgaaaacggtcggaaacggtcggaaaaaccctctaccatttccattttcattttattttctcgaaaatggaatcggaacggtatactcggaaacggtaacgatatcggttatatcggtatctcggaaacggaaccgtcggaacgggaatataccgatatcggacggaagtcgaaaattcatgtcggaaacagcgaactggggtatcatcccgcatttaactatgtatgaagatgaccttataatttcacccttgcatcattacgctgccacacaacaccgttatatgatgattaataagttgacaataagattgataaataat

SEQ ID NO: 71474 - DNA, 3149 bp, Oryza sativa
accctcactccccggcacagaaaatgaagtagcgattagcacgtgattaattaagtatttgctattttttttaaaaatagattaatatgatttttttaagcaacttttgtatagaaactttttaaaaaaagcacaccgtttagcagtttgaaaagcgtgcgcaaggaaaacgaggaggatgagttgggaacatcttctgccgaacgcagccttaatctttatcttcatctgtatttcagtagattcaaacaccaaaaaaaaagtccatgaattgcattgaaattttagagagcatggtgttagcctcggggatgtaggtgcactttggttttatgcggaaccatgcagagtttttaataaattttctacatataaaaaatgcagcttgcgaaaaccacataagcaatggtaacagtcatcatgttgtactccaaataaatacaccaaatactacctccatattttaatgtatgatgccgttgactttttatctaacgtttgaccattcgtcttattaaaaaaattatgtaattatcatttattttattgtgacttgattaatcatcaaatgttctttaagcataacgtaaatattttcatatttgcataaaaaatttgaataaaacgaatgatcaaacgttagttaaaaagtgaacggcgtcatacataaatacggagggagtacgtgttatatatgaataataataacacaaaaatggaaacacaggcaggagtagtaagatggatcactgcatgctccatcccgccagtagacataatcatgcattacggttgtattaatttgtaagcaaatacacagatacataacatggaaaatggaacacgtacactgaggcaaccgcgatagtacatatatatggccatggatccaagctggcttactgcatattctatgctgatccatcccagtagacacataagtacgcattacgattacttaatttattcttaattaagaacaatgcaagcagtaaattaaattgttaagctaataagtaagcaggcaagggacacatgcagtaaattagtctagccaactctgggggtttcagcgacggtggcgctgccaaagatgcggacgcggttggggcgcagatcccgggtcatcggcgcccccaccggcagcaccacgatgtcggcgtcgggcttgtccttgagaatcgccgccttcgcctcctccatcgtcatccccaccacctccggccacgacctcttcgccgccgccgaacgcacaccaccgcccattctcgccggctaactagtatacgtagctggcttaattagcttgatgatctctctgtctgtaattaatcttaatctatctctgcacggcttgaaagattcatctggttgatgtgtatttatagagcaagcatatatatgaacacgtgacacacgacgatcgagctgatgatatgtatatatgttcatcgagaactttgcgtatattaatcgtagtaactatatatccaacttgctcaacaacttgtgtgtccatcgatccagtagttgatagaaattaaattaagaagcttgctagcacctaatccacatgttcacgtgaaacacaccaacatctaactagttagttatatatacgcagagtatgtattggccgaataggaattttgcatgaaacaaatttgcatggagcaaattcatctgaataaattataccataaatatcagtgtattccctttgtgctaaaatgttactccatccgacccataatataaaatattttggagggatgtacacgaaagtaattaatattgcaatatagtaccacctatttatactatctctgtcttaaaataaaatatataaaaagattatggctaccagtatggacatgttaatttgggacagagttagcttgctaagctgccgtagaaagtgaagctctggtaatattcaattaaaaggaaacatagatggccagctcatatattgctacttgaagttcaggaaatactgcaattaatcagaacatattcgtttgtaataagccgtcgtctctcaactttacgtcgaatttgtacagcattcccagggcgggggagccgccaccacctccgcccgccttagctacctttgcctccgcccaccgccgcgcttgcccgctgctgcggtgaagggagcaacgcctgtgagcggccggttgttagcctcgacgggttccttggcctcaccaacgcctccacctgtcacaccgcctccgccttgtgatgtggtgaagggaggtgagcctccgggtggctgtgaagagagcagcgcccacgagccgccagttgatagccacaatggattccttgggctcaccaacacctccaccgacggcaacgccaccaacaggttcatggctgtggagctggacgcagtgaagcaacgggtatgcgtcacggcgtgctactcaccgccgtcgttgttgccattgtcggaccctggggccaatgacccgccctcgaggaacgccacgaagtcgctcagcgaccgacggtgcgcgcccaccgcgacgcttcgaattcatcggccgcccaagctacgtccccggcgctagccttcgacatcaacggcgtccgatccactgccgttgtcgccactgtggaagctctgcctcgttgtcgggtgcggcggcggtggcggcaacggagcctctcaaggtggccgcctctcccccatttgccgccggcaacctccggagaagagaagaaagaaaagaaagaagagatgttggtttcacttttttttctctcatttacatgtgggtcccacatactttttttttactatataatgccacgtcagcgaaaccagacatctatactgctatgggacctaaattatatagtttaattaggggtgaaggtttctagtattgaggataaaggatgtcaaacaaactcggtgtaaagttgaggggagagaggtgaacttgttcatattcgttttgttgttgggcccattatctactatccagggtagtgcgcatatggcccagcccattaatcacatccaagcactttacaattaatttttgggccttattccaactaaaagccgcttcatcacgaatttttttctttttaaaatttatttttttaatattacagaaatattatgtcgg

SEQ ID NO: 71475 - DNA, 31593 bp, Oryza sativa
tattaatcatagcacttaacgtgggccaatgaaatttattagaatttaatttggtctacccattaatctaacaggcgcaaccacctacgttgcacagcgcgccctcgcgtgcggtgagtccacatggcacgatagggtagcatacgcgagacgggttgcgatacatggaaattgtgttgcggcactcaacaggagcagcgacggcatgtggttttttttttttttttgactcctatgtggttttgttcgggttgatgcaagctcgtgccgtcgtgcggtgtgggcacaacaggacgcagcactaccggctgggcttggttcatgccggggagcaacaacagcgagtagctccagcagatggcgatgagacaacggctgtgcaggcggccgtaacaggcaattccaacagctccctggtaatggcggtggcgacaggtgccaggtggcttcgctcgacaattaccctataccctatttgaaaaacttaagactataagaattgatagttatcttgcgagaatctagagaagctggatttttcagcttgtaacttctagtttattttatggattttacaactacaaaaaatttttaaaatctatataacaatcagaactgtttaagggaaggaagttgaagattgtgcgggaagctgcggttgctaaaaccttcccaaacaggcccctagccagctgctgtgccggaatctctagtggtccggttcggcctcaggttggttccgtgaactggaccaacagatagaggagccatgttagacttctggttatctccaacttaagcttgagcctaggcatggataaagagatagactttggggtagatgtagcttgggttaggtcggttaaggcctaagaagaagttagactttgaacaaagtgcaaatatatttttattgaagattttgaattgaattttgtaaaatagctttgttaaatattgttatagtggtgttaattcgtaatgataattctaattatatttgtattcgaatttcatatttgaatttgatttattttaatttttggcactagcacaaacagaaaaatgaaaaactaattaaggcccccttggagccaatttgaaaaattttttggatctttcaaatttttggttacgtttttagggtaaaaaattttaggatgttacaaacttcttaaataaacacatttataagacacgtaacatttagcagtttagaaagcgtggtaaaaaaaacgagcagaattttctcccgatccatatggttaattttctcttctcttatctggcctttgtattctcagatctgtttgtatcgtacggttgttgtcatgttggggctctgaagacatacagccttattgcttggcttatgtatacgtgtatttgtacgacttattactccctgtgttttatatttctatgttataagttgattgaactttttctgagtaccaaatttacatataaatttagcaacatttacaatattaaataattagtttcattaaatataaccttaaatatatttgaaaaatatgtttgttttgtattcaaaatgttgctatattttcatataaacttgatcaaacactaaaaattttgacttggaaaaaaaataaaaatgacttatagtacgaaacagagggagtactaactaaaaaataatttatagttaaaacttttaatatatgttcttaacgattaaaaataaatgttgtaaaataaaatatggtaaaaaactacaaaatcaactctaaaatttttaaaatttaaattttggcctataaacataaaatatgcacaaaaaaaaatgagttactgtattagacttggagtctccttttagagtcatgtttgcattgagcacttcttttaaatagatcagcgctacggaggatcctaaagaggctgtagcgatttagacccagatgacacactatgacacgtttaaaaactgctcgtgcactttactcttttaaatatatataccacatgaaattcctacgttaccataatggccatttgatcccagtgtgaggctgctagcaatgcctagccgcgtaaaagaactagtccgtttgcttttgtgccccacatcccccccctcgacatgcaactattttttatatttataaattgttgtgaatttcgtaaaaaaataaattcagtaagaaaatgtataaattttacggtagcacaaatccgtgcactacagcgcacaatattagttcgagcgccgcacaacgccctttcctccgcactacgtctagttttcccgtatttttaccaccccacctttcctccgcatcccacctttttcggttcattttttaccaccccaccttccgtgtttcttttttctcttttctatctcatccatgcttcatcaataggcccggtaagatgttaaccatccagatttatctgtttttcgctccttctctgtagttattctgttttcgcgttttagtaaaatatttaccatctagtttttctttccgagttttccgtttttcaggatctccacacatttcaaaagtaacgaatttactctgtgaagtttttcatttactcccagcgtccgacatctggtcattcaaaagtaacaaatttactcgcatgaatgcctccacatcgtatgacgccatacctagatgatcctaaaaaaattactaccaacttacaacgctagtaattcttttaccaatattataaatatagtttagatttcatgttctgtgagtaaacaattactacattcctcttgatatagcccatgatctcgtagccaccgtatagtaatatgtttactgatgtgttcaatacacagtataagagtaaaaattgagatttcgtagtttgcgagtaaaataattactaccttcctctcgatatagccatgatctcgaagccaccatgtagtaatatgtttaccgatgtgttcaatacacagtataagagtaaaaacttattgtcgacggtgggtacccgtagaccggatatagagggcattggggtacgctggtacgagaatctacgtagtacgacatcaaggaaacaagagacaaagattatactggttcaggccccttaataggtaatagccctaatccagttgatatgggattatatggagagaaccacaaagtacaaagggaataacagaactcgatgataccgatgagatcgtagttgagttgattcgactagatcacccggcgacttggctcctgtaggctccgacttcgtagactatggtcgttgtgttggctatgagattcgatgccttaggtcctcccggggggtcccttttatatcgcaggtcaggtggtctccaagtaggactcggagacatcggaccctacacgatatagtgacgaccaagtcctatacgggtaggaatctttccattagtggacttcgagatgactttccttaacatatacggagaacgtccgtacacgcaccgatgtgtcgtattgccgtatagcgtacatccaagggtagagggtataccttatccgtaaccctgacagtagcccccgacttctgcttaaatgaactcgtgtaaccgatcgcgacttctgatgttggagttgttgtcgttctcgactagtcgatctcagtgtggggatcgtagagataaggagtgatcgacaacaccatgcgaagttcaacggttatgagtgaatttaaattgaagtccaagaaaccgcctcgcgcaacggacccaaaaatttccggcggccatctctctcctttccttggaattcgcaccgtcggtagtgcgcctatttaagggagttttgagaatccattttagagtccggctgttgcgaaaactttctagcctccaaactctcttcgtcttctccgtttccacgcaaaccctaattcgctcgcctcggcttcttctccgacgatctccaacggcgatgaacctcgacaagtccacctccagcagtgcgtccttgaagaaattgcaggaggagggctatgttggaagtgaagaaggaccaggccgtggaggcactccgaggtcgcgaggtgtggttcaactcgtaccttaggagttgttgcaccgccatggccgtcgtctgcagggaactccgagtacctcgcgggaatcccgaggagtcagcggccggctatatctcgtggctgaacggggcatgcgctcagctcgaaggtatcggcaagcgtacgacgaggccctgaagcaggagtgccgtcgatcgagccggtatgccggagggcacgtgctggcatgtatacgagatcattgtccgcagctgcacctcaagttcctccacgaggggttttcttgttctcggaggactcccgcggaggtagacaacctagcgaagttgatggtgccgctggcggagaaagtgttccagtcgatggattggcgttggccttactggtagtctttgtatattctagatgtggtgtgcacgagtgtcttctcacttcgcgacttcgatcagtcacttgagttgtacactctccctagcccccagccttgttgtcggagaattcttctcggaagataaggctcttagacctttgacttgccttagttgaataagcactgatcctagcacccagccatgaagttggaaaatccatttctgattacacggcttggttaatacgcacggcgagaactcttacacgaccagatcttacatggtctttcgtctctgaaggatccaacaaggccttatcagctctgggcgtccccagccgaagttcccttaggttcctcggaggccttgtcaagacggcgtaaagggtcatgaggataggtttcaatgctaggtgtcatctgggtaagggatcatcgggaagggacactttgattgaaatctgcatcttaaaacaggctttattgaagttgtaagatgtcttacaagtatggatactattgacttatacataaaatttacgcaattggtcaatgttccacgaatttgctaactcacgaccgtcgccgtctacaatcttgaatacgcctggccgcaagacttgtgtgatcgtgtacggtccttcccatttgggtgagagtttgttttgccctgcttggcgttgaactcgccggaggacgtagtcgccgatcgaaagtatgcgtgctcggatgcgcttctcgtgatagtggcggagggcctgttggtagctagctgccctgacgacaacccattctcaatgttcctcgagtaggttcacgtcattgtttcgttgttcctcctaatcctcgtcggagtatttctgtactcgtgtactctgatgtcgtaactcggtagggagcatggcttctgaaccgtacacgaggaagaaggttgtctccttgttggacgttgtcggtgtggtgcgcacggcccatagtaccgaggggagttcttcgacccactttttgtcatctgacatgagcttgtcgtagacacgggtcttgatcccttgtagtactatgccgtttgccctctcgacttgtccgttactctgagggtgagaaatcgaggcgaagcagatcttgactcccagtccgatgcagtaatcctagaaatcgacgctgatgaactgggagccgttatccgttatgacgcggtgaggcaatccatatatgcaaaatatccccttaatgaatttgatggcgttgtcggccttgatttcccccatgggtgttgcctcgatccatttggtgaatttgacgatcgccacgaacaggaatttgtagccgccctgtcctcatgggaatggaccgagtatgtcgagcccccagcacgagaacggcgaagtgagagggatggtttgcagtgcttgcgctggtagctttgtgtgtttgctatgaaattgacaagcttcacaccgttgtaccatgccgcaagtgcctttgagggcggttggctagaaaaatccatgtcgaaaggcttttccaaccaatgtacgaccggcggcatgtgacccacagaccccttcgtgtatgtcgaggaggaggtgtttgccgttgtcggacgagacgcatttgagaagtaccccgtttggcgccttcttgtatagatcgttgccgatcatacagtagatttttgcttgacgggttattttatcggcttctgcattgtcctcgggcaactcgtcgctgcttatgaatttaatgagtggggtccgccagtcgtccgtggtctcgatgtcggcaacggcgcgctctgcctctgtagcccttgagctaatgtcgggggtgactgggctatcttcgtcgtttgcctctttcactgatggctttatcaagatgtccagaaaggtggctctcgtctggacacacgccgtgctagatcgtccagctcgatgttgtccttgcgatatacgtgtcggacctcgatcccatcaaatcttttttggacaactcagggctagagcatttgtaatctttgtgcacctggtttgtgactagttcggaatcccctttcacgatcagtcgcttgactccaagtgtagctgcagctcttatcccagcgagtagcccttcgtactcagctgtgttgttggtcgccctaaagttaaggtgaattgcatgcttgaactgatttatcgaaggtgatgtcaagatgaagttgacgcacatactccacttcccgttggccttccgcaccatgactgggttggctagccactctggatggagtacctctctgatgaaaccagctttgagaagtttatcgagctcttctcgtatggcttgtttctgatctggtgcaaatctccgcagtttttgctttactggcttggcatcgggtcgcaccatgagtttgtgctcaatcacctccctggggacccccggcatgtcggagggctgccaagcgaatacgtccgcattgtcgcggaggaaggtgatgagcgcgagttcctatttctcgttcagtgatgccccaatcttgactgtcttgtcggggttggtaatggacagtggaatgattttgattgtaccgtctggtttcggcgtctttgtcgttatgatcactttcttgggtggctcggctgtggcgggtgggctgggtatgtgctcaaccatgtcgaggctccgcttgtcgcattggactgccagctttgtgttcccttaaatagtgattgttcccttcagcccgagcatcttgagtacctgatacgcgtagtaagatgcggccatcaacttcgcgagtgcagttcttccgatgatggcgttgtatgatgtgtcaaactcagcaacatcaaatgttatctgctctgttcggaagttgctcgcttggccgaaagtcacaggaagcgtgatcttgcccaatggcctggacgaagactgaggagtgattccatggaagggttgtcgtgcctggaaaaataccttttccagaacgctagtgtattgatccccgtcccaggaaaagccggggtacaccacacaaacatgatataaaagacacatctttattatatcgataatatttacattattacgaaggcacttcagggctgaaaaacaaaaataaacagcagcggactagcgggcctacggctccatcttcacaggtgctcaactggggtataagccaggactccacctaagacttcttctctaaagcttctcttactgaagggggaaaagattgagcaagaatgagtacaaccacactactcagcaagccacaccggctgatgcatgattaatgcaaggggggtacaaggggataataataggggttaagttttgcagtaaacagcatttaaaagacacttagttgctcaaagctattttgcaaggacgatcctagagctatataatattattattcaaggccgtgaacccacacgaacctgccttaacccaaggcctacgatgattcagaccgaactggcaaccagacccaggtcccagctcgtcccaagccaacccaggtcaaccattccacattttagttgttaagaaggttttaagaattaaaacactaacttaggtacattgctaggcttgcccataaccgaggacgcggctattcgaatacattatactctgatcagaggtgtacatctttacccacaagacacgtcttcctcacgtgtaaccacgtgcgacataccaccacagcatacggacggaagacgtgacatagttcccaacccatcctagccataaacaagagtaccgacccaaccccgcctacggccggaacccccgagacaggtaggtaggattgagcccctagcagcagaacaccggccctgtgccatgacatctcgactaccgagcaacagctcgtgtagccttcatttgtcctagagatgtccatcgagccccgacttcgtccatctccatccgtgtacctttgtttatgaccggactgagccacaaactaagccttaccaactagacatgtggaagtacggtagtgctttacaacagaggcccgaacttaatccttatagtacccgaggtacgactaacaaaacccaaccacgcacctcgagcccagcctaaaaccattttgggggttttgaatagagggggaggtgtgtgtccaattccaacataagccaaccattccatagcgtccaagtgatatgagaattcccaaagtctaaaggatgatgtgacttgccttgctaagagaaaacggccttccgaaccttcggcgatgaccacgaaccacgcttcaggaatctccggaatgacagaagctacgcgaagcacacaagcaaagctacaagcctaaaaagaagcaataacaatacataaaaagaaagcacatggttctttaggttataacaaacattaagagacttgaacatggtcatccgaagtttaatgctgttatatggagatttgcggattattataattaagttttgcaactataaaacatgtgtaagcgctagcctggaaaagacaggaaggctgcgctgttgacatgcggaccccacatgtcaacctaagggaccacggcagaccgggtacacagagacgggtcaacggaagcggaccccgtgtgtcaaccgagacgagtggccgacaaacggactccactagacaccatgcgggctgcacacaaacacagtcaccacacgcacacacgaacgactaccgacaccggtacaagggtaccggggtcgacaaccgcacgacgggtacggggcgacaccgaaaggacgaggacgggagcagcgagaagggggatccttagcaccacgcgacaaggcgtgggaacgatgacggcgaacgggtgcggagacgaacgggaacgacggagacgaacggcgaggggacgacctcggcagcgatccttggatgaaggcgagacgcggccgacacaaggcttgacgacgcggagccgaggacgaagacgatgacggggcagcagcagcacactagacaaaacgtgggcgacgaacgctatcggcttgacggagggacgaatgccacgacgaccgggaacgacgagaggacgacgacgaccgggggccgacgaggacgaacgatgacgaggaaacgacgaggagacgatgacgacagatagcggaggggtttggatggaggggaggcgatgccgaggacgacgtcgccggctcgccgctgcgatgccggaggtggtgttggcgcggccgacggcgcacgggtggaggaagggtcgaccggggaaattccggcgaggcggatggagaggccggcgcggcacggcggtgttccggtgaaattcgggcaacgctgtggcctggccggggaagaggacggcgttccggtgccgggagaggtggtggcgacgtcggccggtgcacaggagacgcgacagaggcggccggaggcggaacagtggcggcaacgccactgttgccggcggggatgcacttccggaggtctccacgggaaacggagggcaggccggggaaggggaggcgactgcgacgctgggggaggcgacggcatggccagccagcgtgctgacgctgcggtaggggcggctggaggctgttggcgccgggagagagagggagcagcgacgggaggggctacggacttgggagaggccaaaacggaacgaagggaggaggagggcttcgttttatagggcaaggagggagtgccgatcacgggagagggcggaaacggcaccggaggaggttgctggcggcatcaatggtggtcaaagaagggattaaatcccgacgattggggatgggattaaatggggaatgttaggggaaatagagaggaagggatgtggattccatttctctaaccaatttgaattaatccggcatgaatggagcggatttgggggaggaattggtgcaagggttaacgggagagaggagagagagagaagccggccgggaggtagaagacgaccaggtgggtggacccatcggtcaggagcggggcacgcacgtgcacctcgcgtgcagaggggcgcgagggagaggagggaggcggcctggggcggcaggtcggctgggccgggatagggcaggggtggcccaagagagagagagggaaggaaaaagagaaggagaagatggagactttgggctgggctcggcccaaaggaggaaggagggattatttttaattttctttttaataaactttcttaattgttgttgttccttaataaatatttccggtgctctgaaaattcaaataaaatttaacaaaaattctccggaccacatttgaatttttattgtacgtattttagtgtttgccaatttctttttgaattttaattaattctattattccttttagagaatgatttttattttgggatgaatttatcaggatgtgacaaggattgatcggtaggtgtcaactcgcttcgtggaatccccatcgcgtccaaggtgctggcgaagagaaggttgatggagctgcctccatcgacgaggattcacactaccttgatattccgaatagtaggttcaaccacaatcggatatcgtcctgggataacagcagccttggggtggtcctcgtctaagaactcgatcttctgttcagaccacttcatcttgggtgcaaccccctgcaatgtcgaacaaacctcacactccacttttttgtattctcgctttaaagagtacgctgtcgaacctccgaagatgtgcgagacatgaagataggaatctaggtacgccaagtccgagtcctgagtggtttcctcagtggccttctcgactacacgtactcgcttgcccttctccaaagccagttgcttttccagcgacttcttgaagatgaggcactcctctagagaatgtatgtccgacttgtgtatggggcaccatattctctttgtatcactgccttgtgggtctgggtgtttgggtgggcgctcgtattcagacgcgaggacttccgcttgagctttcctcttcccactcttgccgcttttcttcttgcttggtttgggtgtgtccttggctggcttcttatctcctcccgcctttggcttgtcgttcttgcgtctcagtgcgtcgtctgcatgggcgcatcgatcgacaacctcgaacaaccttcgagtagttgtgattcgccttgttgccaactcctgggtagtatagcaatctctgacaccggttttgaaagcatgaatcacagaaacattggtgatatcggggatcgtatttctgcactcattaaagcgccgaacatagtccctcaaagattcgcccggattctgtgttaacgcgtgtaaatcgtcttcgatcgcgtggcgcttgtaagttccttggaagttagcgatgaattgctgccacaaatctgcccatgaagagatcgagtagggtgggaggtgcatcagccacgaacgcgtagaacctttcaacgccattggcaaatagtttgctaacgcgttgtcgtctgccccggcagcatatagtaccgtggagtagacctggaggaattcttcagggtcagtactcccatcgtacttctctattgctccgggttggaatctctcgggccatcggacatcacgtagagaacggttgaaagctctacacctagcgctgggggcggtgggttgtcggtgatcgtgtgtcctccgtggatgtctatcgaatgacgaaaatgaagatgatgacgatgatgacgatggttcactcggctccggtgtgcgattctgagggcgacgttcaggttctcgagaattctgttgtcatccaccattgttgtcctggtgccgatccacattattgtcaccgtcatgttgacgccctcgaccagcatcgtctggtgtccgctgttcgcgatcgtcgcggttgcggcggttgtgacgattatggtggtgttggtcttcgttcgagcagcctcctcgctcttcgttctcgcgacgtcgtgaagaaacacgatatcgggaatgattctcgttgtctcgcgcgcgtcgtgcttctcggcggctattcagatggtcgcggagctcgccggtgccgcgaggtggaggggtagctcgtctaggcgacgtccgctgctccggtggttcgccgtcggcaccgccagctgtcggtcgttccagttgtgctctgtagcagcttcctcgaacgcttactgagattggctaccgattcccgtagtcgttctgtccatcgtgtgagatcatcgttaagcacggggtcatagggagcttctctcaatattgcgttgacggtgccgagtagttgggccggcgtgaccgtctggttctccgcctctgcgttagcgtgtgcaaacgtgctagtcctaccgatggcaaacacgtcgcgtggtgtactggaagatgacaagccatagttttcgagcaagtgtaggactgatggctcatggggatcaatgtcgattactccaacgaatcgatccgaggtcaacatcgctccttgttccttgtttgtatccttaagggaggttcctgactgctggactttaggaagcgtcgttttcatggcgcggagaaagaccttgcagcttgagaagtcgtgattcttcgtcttgtgaataggacaatagacatcacgagttggagaagtacgctggattccacgctccttgcaagcacgaatttcggcttgtgcgttgagaaaaacccagcatgcttgcaagttgtgcttcctggacttgtggataggacactagggctttgttacctcggaagttatccttgtcagctcgcagttcttgtcagaaggacaaggtttggccgcactaggaaccttcgacaagggatcgtctggggttatagccacggcgttctcgtttccggtcattgatggaccagccgagattggtaccgtggtgtaaaccgggaagacgatttcgccgacttgagtccacaccagcattgttgaagtagggactccttgaatggggccggtgttgacgccgttgtcgacgaagcttgatgtcatagtagtagaaccttgagcaccaaggccccctacctggcgcgccactgtcgacggtgggtacccgtagaccggatatagagggtattggggtacgctggtacgaggatctacgtagtacaacaccaaggaaacaagagacaaagattatactggttcaggccccttaataggtaatagccctaatccagttgatatgggattatatggagagaaccacaaagtacaaagggaataacagaactcgacgataccgacgagatcgtagtcgagttgattcgactagatcacccggtgacttggctcttgtaggctccggcttcgtagactgtgatcgttgtgttggctatgagattcgatgccttaggtcctcccggggggtcccttttatatcgcaggtcaggtggtctctaagtaggactcggagacatctgaccctgcatgatatagtgacgacccagtcctatacgggtaggaacctttccattggtggacttcgagatgactttacttaatgtatacagagaacgtccgtacacgcgccgatgtgcagtattgccgtatagcgtacatccaacggtagagggtataccttatccgtaaccctgacacttatactaagagtattgttgatctgtatcacaaaatagtcgtatgaatgaaaaaattacaggctcaatcacacacaagcgataaaatcactcacaggtgaatcaaactagaaaagaaaaaaatgattcagtcaaaaatccatcctgtggctttgctggatcttgctataaagatgaagaggatggtctgtgacttgggactggtagtggagagggcaaccatgtgacgagcagtagtcgacgatagaatcgtggaaggatgtagcggtgtggtctagagatgagctcgacgttgtgtagtagcagccatccatcatctagcaagcacgaaaaaaaaaagcaaaaacactctcgttcatgtcaatagagatgacgagcaaaagaaaaattgcaaacaacctccatcaccggcggactccaccctatcctctgcgaccagccacatggagcacgatgtgcaaatgtaggacccgtacaacccatcaattgagataagttaatattagagattgcacgttaatttgatttgcaaaaaaaaaaagcttcatgcgtgaagttgaaggagagcacgcagatccaaatcagagtgtcagttccttacttgcttattgtatcaatgtcgccaacgtgaagcagccgctggttattgctatttggcctaggtgaacacctccttactggttaaggtgctgtccagtgtccgacagcgaggcccgaagcagtgccgtcgcctcaaccaccgccggccactgccatcaaccgccacgatgtcgtcgtcctcctccagggtgtgttgccaatctgtgggctagggtggtgtatcgattcagataaaaaaaaggaaaaaaatgaagcaggggcgagagtggttggttgggaacgggaaaaatataatatataccgaaagcagagaagttgttttttatcgaagtaaatcatttactccgataatggtgggaacacgatgcgggacgtggggtgggatcgaaagcaagaaagttatttttattatcgaagtaaatcgtttactcgaataaaggtaagtggtagaggcccgcgataggagtaaatcatttacatcgacaacggtaggagtgggatgacggcacgtagggtggggtgggtctgtgctgatgcatgtttggcgctcggaatgctgcgctcctaatagtagttctgtagattttaactaatttagtgccaaaaatttccgaaatggtaggacgggtagtggtggaccttacggtcagtaagttgaacctaatcacttgcacggttgcaccacaaatcagttcatttgacaagccaacacagtgattagagtgtagaaaaagaagctcacctaacttgttcatataactcagctgcttccaaagtcgaaagccctatttgaaaacgaagcctgagctgcttccctagaccaaaagctacagatgcacgatggatacatatccgatagcgtgcttccttgccttgcctcgcctccgcccccttttatgccaccccgtgacatcaccgttggcattgcacgaaatccaaatgaatacaacgtaaacagcttctgcccgccgggcccccatggccccatcatcggccatccgagtcaaccgagtgagccacccaccataccagcagctcccactcgaggcggacatcacattatcgtctcgtcttcccaccagcacctgccgcgctctcccccctcgattcccatttgatcccacacctccaccaactagctgccacgctcgctttcccctgcgacatgcgtgatgtgtgggcgctccacttgttaaccatctcgcgcgcacgccaggctcggctcctcgatcgacgccatgtcgctgcgccggctctgcttcgtgctgcccatggacgccgacgaggtggtggtggtagctggcgctgctggtgaggagcagcctcgacgacgagggatggcagcgagcgggaggctggcgtcgtacgtccgccgcaaggtcggccgcgcgctgcggtgcgggctctgcggcgcctggtgccaccaccgctcgtcgggagtctgcagcttcgaggacatcgccggcgtggacgcggtcggcgcggggaagctcggcggaggcgcgggcgggagccccaggatcttcagctactcggagctctacatcgggaccagtgggttcagcgacacggagatcctgggcagcggagggttcgggcgggtgtaccgcgccgtgctgccgagcgacggcacgacggtggccgtcaagtgcgtcgccggccgcggcgaccggttcgagaagtccttcctggcggagctggcggcggtggcgcggctgcggcaccgcaacctcgtccgcctccgcgggtggtgcgtgcaggacgaggaggagctgctgctggtgtacgactacatgccgaaccgcagcctcgaccgcctcctcttcagaccggcggcggcggcggcgcccgccgcgtcggctccggcgctgagctgggaccggcgacgccgcatcgtctccggccttgccgctgccctgttctacctgcacgagcagctcgacacgcagatcatacaccgggacgtgaagaccagcaacgtcatgctggactccgagtacaacgcccggctcggcgacttcggcctcgcccggtggctcgagcacgccatgtccggcgaggacgcgccgccgccgcagctggaggtgtccccgtcgcctcattccgcgcggtcgtcgtcgtttgcttccgcgaattaccagttccggctgatggacaccagccggataggcggcaccatcgggtaccttccgccggagagcttccagcgccgggccatggcaaccgccaagtccgacgtgttcagcttcgggatcgtcctcctggaggtggccacagggcggcgagcggtcgacctcgcgtaccccgacgaccaaatcttcatgctggattgggtgcgtcggttgtccgatgaggggaagctgctcgacgccggcgaccgcaagctgccggacggcagctacccgctgttcgacatgggccgtctcatacacctcggtctcctctgctcgctgcacgatcctaggtctcgtcccagcatgaagtgggtggtggagaacctctccggcagctgctccggcgacctgccaccgcttccgtccttcctagctctcccaaagtacgtctctctcacttccccctccgattccggcacgacgacgaacgccacggacagcacggtcacctctgcgtcgaagctctacggcacggcggccgggacgaccatttacctcaccgcggagaacggccaccgctccagaggtggcttggctgacaacagcggcggcagcagccagcgatcgacgcggccgctggtggtgatccccagcgtcgacactccccgtgagatatcgtacaaggagatcgtcgcgatcaccaacaacttctccgagtcgcagatggtggcggagctcgacttcgggacagggtacgagggcttcttggacaacggctatggcggcaatggcgcccgccgcgaccgcgtccatgtcctcgtgaagcggttcggcatgaagacgtgcccggcgctgcgcgtccggttcgccaacgagctccgcaacctcgcgaagctgcagcaccggaacctcgtccagctgcgcggctggtgcacggagcacggcgagatgctcgtcgtctacgactactccccggggaacctcctgagccaccacctcctccggcgcgatggcgcaggcgccgccgccgtcctcccgtggcgccaccggtacagcatcgtcaaggccctcgcgtccgcagtcctgtacctgcacgaggagtgggacgagcaggtcatccaccgcaacatcacgtcggcggcggtgttcctggaccccgaccgtaacccgcggctcgggagcttcgcgctggccgagttcctgtcaaggaacgagagccacggcggcgcgggcgggcaccacgttgccctgcccgccaccagctctgctgcgcggggcatcttcggctacatgtcgccggagtacatggagaccggcgaggccaccaccatggccgacgtctacagcttcggcgtggtggtgctggaggtggtgaccggcgagatggcggtggacgtgaggtcgccggaggtccttcttgtcaggagagcgcagcggtggaaggagcagagccgccccgtcgaggccatcgtggacagacggctggacggccaggttgatcgcccggagctcgagcggttggtgaggctcggcatggcgtgcacccagtctgacccggcggcgcgaccgacgatgaggaagatagtgagcatcatggatggcaatgacgagatcttgaagaaattcgagcagaggaagcagcagagcaaggaagagtgggagaccacaaatgctgctgctctgtccttagtaagaagactccatgctcttgcgatacactgaacacaacgtcaatatgtatatattttctctaatagagaaataaattctgttattatagttggacacgatatttttatatatatttattaatttcgttcttcaaaaccgatctaacgcatctcagcttgtccatctgattcatattataggttgattcctttttttttctagtcaatttttttcaagcttaatcaaatttatagaaaaatataatactattttcaacacaaaacaaacatattatcaaactatattcaatgtttcatattataggttgttttctttttttctagtcaaattttttcaagttttattaaatttatagaaaaatataatactattttcaacacaaaacaaacatattatcaaactatattcaatgttagatttaatgaagctaattttatattttagatgttgttaattttttctataaacttggtcaaatttaacatagtttgactaggaaaaagttcaacctgacttataatatgaaatggagagaatactttgtactaatgaacttgtgtcttgtggtacacaatcaactacgtctcgtaaaaaaccaacttaggacgatatatgccgtttagtagtactacaaaatatcatattcttattttaggttgttttttatgggacggacataatatgtttatgtaagaataaaaggggctatgagctgttgcatgcaaaaatgcaattcatcattcgatttcctagggtcgttagatctctgtatccaaaggccgggagcctgagatcactgatccacctttgttggcccgtggaccaccgatccacctaacgggttaggccgtattaatgggtctttttttttgtctggtttgttaatttgtttcccttttggatgaaaatgcacccgtttgttttttgggtttcttttgtgtgctctatgtgtcggctaggctgacaattattttaaatctatcaggctgttcgagtttcattttttttgccctatttggatgtgtattttgggtttcccatgggtcatttttatacttctcaaccttgacaactgagagcatgacaacatcagacacaatctctcgagttcttctctctcttcattctagagtatatatcaaagtttccgagcacaaccataaaccacatttatagtgaagaataaacaactaatagcattcagttgactgcgtaggacaatttctatccgacaaaatagttacaatctattttatttcgagaacacaaggtcagtataaaacctatttcttttacaaatggtcacattcgaagatataaaaaaaaattcacttctttggagaactagtagatttaaattcagcaaaccaaaaaaacttcatctcccataagttgagctcaggaaaaaaacacatgtgcgactttgtggagaaaatatgccttatttatctgttgtgacaagcatgcgacgacagacaataaaaaaataacaatagctaaactttaatctaaatacaacccgagaaactcttaaaatataccaagctaattaaggaagtgggaggccgacctagggtgtctatggttgtgctccacctggttgtcgcgcattccacataggcctcaaagctagagtctcaaacaagttacaagctcactcatggaattccgaggtcactcgaggtggcacaatatcttgctactaactcttggaattccgaggtgagaccagatccgttggaaagaggtttcaatatctttacattaagtacccataagcccaaaacagagctcatatgcacatttagcggcaattttaagtcaatttctgtaggtggctgaattggactcggaacttatacgatttaatctcgatatcttctagttaacttatgatgtgagcaatggttatatctatagtagccatgatcacatcatgcatgttgttatattgctcgaaattatggtagcagaattatggacttacaagaatgttgaccttgccctcgaacgaagtgtgtaccctgccgctcctctttgtcggtgcgcactgacacgttgcagacggagacgatgatggtgagacctttggtcatccgctcctcctggtatctactcaactccacctcatttggcacaggtgtgcactgttgcgctaaagcccgcgagctcctccacgatgaaacggctgcacacgcagttgattataatggacgattcggtagatagatgttatatagcgtgtgggtgaataaccactcagattttgatgagtaacctatgctttcactgtcgccggtgacaagcacagtggcgctagctagtgagctagggcagtgctagaacaaaatggaggaggttccactcccattcatcgtgtatttgctgcattaggacacggttgtcatcttcagggtctcaaccttgtccacacgtacgtctccagcgagcaattgattgagagatctctgaacatagcattgtaaatagacaaaatttattacaggacaccatacgaagtgacttttgaggaagacactataaacatggtaattttccagcgaacaccataccattaaaataataattttcggttggagaggagagaaaaatcgtgtgaaatgtcaaaaatacctctgcacctacatgtcagctctcccatctctcttctctctctatcggcgaacgaggagttgttgggcgtctgctacttggtgttcgatgtaatccatcggcgccaaggggggttggctacttggccgtggattcgctgcacggtgggatggacggcacgacgagatggcggttctcagtgttcgctattgagtcagctatccggtgcagtaacaaggtcaagcaggtctggatagtggcaggggtgcgggatcttctatgcgaaggagaaggcggcgccatgaggtggtcgcacgtggtgtgccgtgtgcggtgttcgggtcagtgatttcgctgcagcgatatgggcgaacgggtccttgtggtcgaagtggcaggaccggcgacgagactcgacgctgaggcagggccggctggtggcgcagtggtttttctatggagcggattgctactcgatgagatggatgcacggcaatggcaatgacaacattctgaaccattgttggtgtttggtagtgatctgctatggtagtgaggccggggatgagcctcgaagatgaggtgttagagtcaaaggaagaatagcggtgaggagggtgacggtggtgattggtgcagcgcatggggaggggcgaggcatatctgcacggcgcacagtcgggtttgacttggtgcagaagatagcggcacgccgtgatgctggctcgagctcagctgagagagagctcaacgacctccctctatcctaccgcgcgcgctgcttcctgtcggtggcaatgacctctatggctctgacaaaggggagagagagaagggagatgtcttctcctaaaagtctttttgtacggtgttatacaactaaaaccgtgaagttaaaatattatctagcaattatagcaactcacctttagatgttttttggtgatctctctcacacaaatagctataggtacttcacgggtgctcattgtttgtgtgctaagagttaggaggggatttatacgttgttgtgcaacagtgcaagtagccaagtgtagtgtactgtgtacattcgtgttcgtttccgtatcatcggaaaaataaaaaaaacttctcatgtactgtaaactcgagctctcgttgctgggggaacgccgttgcttgcagctgtctacacaaagcccatgtgaccatgtctgtttgggtcctcaagaaatgttcatgggcctgatgaatctgtccgtgctcatctcagcccattatgacccgttctaagcaagccggctgggccgcataggcattacgattcgtaataagtccactttgagccccttcaaatataactccaacttaattcatatctctgaaccacaaccataatacggatgtcttaaccctcaactattaaaaatggtataatttgactcctgtgacaaattttgaagaacggtttcactgacatgacactttgacttgttcaacttgctaagtcactatgtggagcccacccatcagtgactcttatctttcctctcacttttctctccatcggatcgacgccgggccgacgacgcctatttgctgcacggctcgtgctggcccctggcacgccgccgtccaactccaccacctcctacaacatcaccatgacgctgtcgctgcgcaaccccaacctgtacccaggcatcagctacgagcccgtcgcggtggccttctccttcaatggcacccgcttcgtcgagtccgccaccatgccggcgttctaccgtaccataagccgaggaagacggctacgttccacgtcacggtgggcagcattgacaagcccttcagcaagctcaccgcagcgggggtggtggcatttggccggctagctgtggtctgcccgctggagctatagcttgtcgactcggaggtcgccgccatcgcgttctagaggaccaagtgcaccatcctccgggccaacaagtccgcggggtgctagcttgttactaaccgggactaaagattctatagcgggacgggactatgtacctagtagtaaaaattctttttagtcacggttcttataatagccttaatatttgtgttttgagccattcgatgaaagatcagttctccagtagtggagaaaaacaaaaagataaatagccatctatttatcatttttatttgtcgttttgtaggtcatgtttagagacttcatttttttgtccggtaggttaatatacttcatgttataattttctttaaaactttttatgatattttgtattatatattagagcagggggattgtttttctaaaaatacacattacattacaaacgattacaaacgtagatattgataatgcatgctaactcctttaaatacacatgtaccttctatccctatgaccaacatatcttaaatttgaaaatatcatcatctgctactaactgtcaagaagtgtgaaatctataacttaaatctggatatctgatctcaccacagagaatccaattaaacaattaaactttgcttcacggtcgggagataattctagtccttccttcgagacgggtaaacacccgattgattgcaagtgattcttcttgtgagcattccacggtggcgtttggatccagggattaaattttagtccctattacatcagatatttcgacactaactagaagtactaaacatatactaataataaaactaattgcataaatgagagttaattcgcgagaaaaaaattttaagcctaattaatccataattagcacatgtttattgtagcatcatataggttaatcatggattaattaggttcaatatattcatattgtgaattagtccaaggttatggaatagattttgttattagtataaatttaataattctaattaattaatgtcaaacgacctccgctgatcatctctccgtggaaagctgcatgcatgcagatcgtgttaacgacaaaggcagcggtaacgacactgccatgcacccttgcaggcttgcagcgtacagaaacgaggctatcgagtgtatctcgcactctcaccatcacgagctctctgcatcgcgtgcagagcatgcgttccatgcaagttcctttttccttctcttatcttatcggaaactatgtgcgccgttttttgcacactcctcctttctaatcattatacggacggacccattccaacatgtactgatcagggttttccaaaccgctaaatccggagttactgtactccggtggtaaccacgattaccgcggtaaccgtgaaaaaccgtacaaaatttattaaaaatttaaatcatttttttaatttatttgaatttaaagaggttatcacggtttttctattaccgtaccccgcagtaaggccggtaaccgcggtaaccgcgcggttaccgatggtaatgtaaacccgggtaccgatgtatacgtggtagcatgtccgttatcttgtaaattgcaaagtcaaaagaatcaaatgagcctctactatcactactggaaatcgattttccccggctagatgcttatatttttccacgtggacggatttttttccaccaccgatccggctgcaaaatgcaggaggggggttgagatggccgtccgcatgcgaagatcaatcttcctaaacgaataatataaggcgttgcctaggaagatgcaacttcgcaggcgacgcctatgaattttttctactaggaagatgcaccacgcgcatgcattttttttcgttttaatgcttttttccctatgattgtggtggacctatatatatatgcaccttgatggcatgttgtcctctcatccattgtgcttaaatatgatgcttttattagccaaaatatatgtgtattggtcactttaataatcacctagatcaagaggagagagagaaaaaaaaatctattgttcacactccccacatactagtagaaaaaatatatctacgctaaatttgtacaacaccatcccctagttatttatatttctctttcccatagcgagcaaactttatttgtttgtaaattttattattctgttaatttaatttttaatataattgtaaattaatctactgagtgcaacaattcggtctgtcagcttctgtacctcccgtgcattctttggcagttgcatcaattggattacttcgacttttttaggattttttcttctaggcccccttcggacactaggaatcccagcaactggcccgctcaaacaccgaaaacgcatttttcggggtttaacttgattccggccaccctcgggttgtcgatggtctcctatagattggcggcgtgatcgttcaccttctgactcttgacgacgatgtcatcgacataagaataaatgttttgcccgatctgcctcttgagaaccttgtaaaccaatcggacaaaggtttgctcctacgttccttaggccgaagggaattctaacatagcagacggtgccgaagggtgtaatgaatgcggtcttcgcccaattttcgagcatcatgaatatatggtggtaatcggagtatgcggctaggaaactcatgagttcacacccagctattgaatctatcggctggtcaatccgtggaagtaagaagtcgtcatttgggcaagccttgttcaagtcggtgaagttgacacacattcgccatttgtcatttgccttttttactagtgctggatttgccgagcactcggatggtcaatttccgtattactccaaccatgagtaacttgtagactttagttttagctgcttcttggcgatctatctactgacatcttgcgaacgttctatttttggggtcttgcatcgggcttgaccgccaaatgttgtaggatgatgtcgggcgaaacaccgcccactttgtcagggctcaagacgaagatatcgagattgttcatgattacacgcatgatgcttcgcttctcttctttgcctgcctcgtaaccaatggagatagttgtggtggacaactatgtcgaacttgttgagcgtggccctgctgaagatcgcattgtagtggtacgggatgtccaccatgttaaacatgatgagttacttgcgcttgttttcttcagggctgaaggacaccctaagttggacctgacccaatgcctacagagatatgccatcgaaaccttggagaggggcggtagcttgcgaaagtgctagcgtaggctggtccattttcatgtaagcgttgaagaagatgatgtccattgagcttcttccatccaccaatatatgacgcacctcgcatccagctactacggccgaaataacaaggggatcttgatgtgggaagtgtactccctccgcatcagctgggtcgaaggatattttggatgcctggtattccggttctccgctccccctggagcccatggttatgtacgttctgctggcacttcgacatgtggccctcggggttcccccatgtgatgacttgtttaacccttcgctgcccgtctagtgcgactctgaactgtagcggcttattagcatattcgctagtctagggattcgtctagggaacttgaggctggccttggtgatgaggacataactagctcggatataaccatgactaccttatgtattaatcaaccaaaggtgcatatgttctacattagatttacttgttatatatttgaacaaacgttgctacacaatgagttttgtgtgttttcgtttgcagaggtacttgcttggccgaaggaaaagagaccaagtataacgaatgcatggatgatcaaagaagttgattagggacaaaaccaagaccttctccaagtctacttctacctcaccatgtcacttttggtccatagaagacaagagatcaagttttacatgttttggattcggattcgggcctcctgacagcatcaacttcaaacggatctagccactgatctagaaggaatttcggggcccatgagtacttgttggaaagattatggagtctaattttagatggttttggttccacgtcaaatttcctatcgagctgccgggaatctgcaaaacaaaccacgtatgtcatctagtccgaatctgatttgagttttgggccttataattgtgtcgtgggcttagcctaagggggtgtgcaccctagggcaaccctaggacgtccctaatcatatttatttggtagccgtcatcgtttagactcgggttttgcttagattaatttgtcaagaacagtttcgtcgctagattagtttgtggaaccccaaattcgagtgcttaatcattcatatgcaattgtgttgcaatctatcttgttcttgcttgtgttctttgattcaaatgcagggattagccttctcggtgaggttaacctggtttcggcatggttgataaccagaggagacgtggtgctgcgattgcgggggctcagtaacgtgttcgttcagaaggcggatcgagttgtgtcgcgactccacccaaatcgactttttatcaatacctatcggaagatcgggacctaacatcctcatcaaatggtgtttgatatttcgacgctcttcagttgtgtgggacgatgacttgccgtggtacaaacagtatttgtccttcttgcatttctttcttggcggcaagccttgttctccccccttacttggcattgaagttttttttgaaggttctcgacttcttcgatagttgttataggcttgacttgtctgttcaaaatttttgccatgccattgggacctaagccggccttggttgacttccgcttgcttcttgttggaccgctttggcctgaactacagctttgtcatactgggcttatatttcgacctggcacttcgtatcctattcgcctcgcgtgtacctgtcaatgatatgaaaaaggtggccgatggtttggggtttctcccagtgattttccacgtccgttagcttggtcgaagccctgccgaacggcatttatgactgaaacttctgtgatgtcttggacttggcatcttgcttgcgaaaatcttcgcatatactcccttgtggattcgctaggtttttgtcgaattccgaacaggtcttgttgggtcttgggttcttcatacgtttttacggctgttaaataccaaatttatgccgtcaattaatacctgcataaatctaaaaatataaaacatccaacatagttgtagggtttatttctaacaaattccatgagtgttggtgtatatttggatgcaagtgataaactaccaaaattgagataaaggaggggaagaattacattcatatccaagccatggagttttgggcccacaaacccaacgaaataccagaaaatggacccaaccactatgccactggaccaaggacccacctgccagggcccaggagaaaacccagggccaggcaggggcggccgacccccaggcctgacccatctggccttcaattttcacatgccggtagttaccgactatccaaggcggttgtgaccgtttctaccggaagaaaccgccattgagggacacttggtagctcaagagagaagttgctcctttggatgcttagcatctccacactccgaaggcacctcttggcctataaatacccttctcctcactcattcgcaacacatcaagatgtgagctgaattataagaggctctttgtatacttttacgtatacttagaataagggagagagcgaggaataaagagttggaggagttccggaattgtcggtttctctatctctttcttttgtaccttagcaattactttgttttagttgagaatattttaattaagtaattgagattcatcttgtgtgatatacttcttagttagttcctatttagcttgctcgatcattgttcactattgttcattaagaaatagtgattacttcagtgtttagctaacgctagagtagtaattatttgcatagacatggtgtctaggtaattaattaccaatgtttgctgcgtatgctatagtattagagattggtgtagaggtggtgacagccctcgagatcaccgtagtcctccctatgcaggtacggagtagagcgcgttctggtagcacgagcaagccagtgcctgaaaaatagttataggattgaagttaagctttctaaacaaccatgtaccacattagaaaatcctctccaccctttggtctacatttatcttgtgtccttagatgaacctaaagaagaccaaatacacatgttccctgtggaaattcaataccttcgaatactacaaggtgaagtactacatcggtatatccgtacgcttgcggattttatctgtgaacgtaagaaataccaacagtacgtcccatgaaatttcattacgaagacatcccgcaactgctcccatgagtaaatgttgcttgggtgaatgttgaaataccacgatcgggcgaagctgtctaggacaagatgtgcgaccttcaccttggtgttctcgtccccgtggactgtttggatcgttgacttgtggaacggcaagatctcgcttggttctgatttgcccgaatatcttgttatagtttaatactcgaaatgtggtggaattgggtgatttcgcaacccccaactcaaaggcaacatcttttccaatgcttgttgtcggaacttgctgacattgtggcgaaagacttgggtaaaggtcgggtgaaggatgaagctattccttatgcttgcgcttgcggctggccttacaatgtagcttggaccagccaaagctccttgaaacatgggaggtggggtttgggcgggcggtcgaacaatcgtcgggtttaccgttggccaaaccaccaccccttgacttgctcctcctgcggtcagagccgcgcttggttgggtcgcttgctgcggtgattgtgtgtgtggctcacccgaacttagctgctggacctaagcttggaattgggcttggagggtcgaagcagcttcggccgtggattgggagggcgagatcagttgtgccaaaggctgtgttggtgcaaggcggacctgcacctgtgcaactgtgggtgatgccaaggcttgagtcgaaggtactaccataactttagtcgaaggggctgcctacggtgctttggtcggtaaaatggccgatacagcccaggcttgtatggccgcctcttgagtctgttgctgctgctgctgcatctgtcagagtatttcctatagccgtgtcatgtcttgcctcatggattcgtgcttcgtcctcggcactgtggacgctttgggctcaggttgctgacttccttcggctatggccaccaccgaagcttgggcctatgctgcctacgccgcttgggccgcatcgattcgggccccttcttcggcttcggccccagcttcaacttcggccttgtcctagtcttcatctttgtacctcctcgacactgctcttcccctcacggacttcctcttgggtgacatcagtttgaactgaggttccccatggtcggtgccagctgttgtcgatggacaaatgcgtctatcgaaggacagacttcacccaaaggttggaaagtaaagtggtaaaatgtcctgattttttaaaaattggatctccattacatgcccttggggtttatatatataacagcgagtttacgtgggtgcccttatgacaaggtcacttacaggggtaataacaatattttagctcagttacacggcccatgggcctagatatctcctccacgtagtgttgttgggccttcatgattgactggcctagtggctactgcatcggcttcagcttccacctcggggtgcttcgctgtctggcgatcctcttcgacgattgccacctgatcggcttcaacctccatgtcaaggtgcttcgctgtctggcgacccctttcgacggttgccggccgctggcctcctggctgtgcgcctgtgcggcactgtcttgatgcctcgacggctgatgtttcagcgggctcggtcgaccttcataggatgcctccaacaacttctatttttgaaaaatcgcagttttgtatcactaatatcgatcagaaactaaaggccctgcgacatgcgacatgcctgaacaggcccttctggaagaattcagctgcaaaagcaaaagcggagatgaagaactggttaagagcacataggaaaaaaattaaaggttagccgtgactgtgatcgtggcgttaattctagtacttcgtaggtaatatcctgaggtgcatgcgactctcactctcaaagcatccaattcctctcttctttttgagacagcatagcacattagcagatttgatgcaaagcctgagtactccccagagatgtcgatatctctctcgacctcttttactgtttatctgttttttccttcatccttgcagtaaaaacttgaaacctaccactgttgtcttggcagtgctgatcttgtttctgcaagtgattaatgtgctgtatatatcaagctctctcaccgcagaaagagaaacaaaggggcttgcaggacaccaggagggtgcaggacatggtacatacggcatgaaaagagctctgccagta

SEQ ID NO: 71476 - DNA, 4859 bp, Oryza sativa
agcccctggaagataaaggctttggtgtctagctcgtgcctgccgtcaagcgcctgtggtcgtcgccctagtctttcgctgcttttcgtttatcttcttgtgtgctgggtcttcgccgcccatgtaataaattaattaattacgcttccgcttgttaaactctgaattgtatcaacttttggtgtaccttgcctcctaggacaaggaataatgcacgcacgtaaggaacgcccgttgggttatttccggtcgtaacaagttggtatcagagcccccttgaccctaggacgagccttagatcccaagccttagcaatatttttgaaataaaaatcctttcttatttgtgaaaatcctctagtctctctctgtcctgctgcttcatttatcgccaaaatctaatctttaaaatgttgcttttctcttttgttttttttgtttgtagacggccggcagcatcaaccgtcgtggtctggacctgactggtttcgttttggagctgcgcggcatgtgcgttgtcttggggtattcgcatggagtggactaccagggcaagcaactcccggagcaggagggtgacgatgcagagccccacgctacttgggaggtcactgcagtgatcctcactggctcacccgagaggacttcgttggcagtcaccgcgggtggagattctttctccgccgcttgccagaacgccgctctcctcgccatcggcactctgcaccagcgctacccggacgagttgcagcactcgccctaccgctaccaccctcgtcgcggaggagcccgtgactacgccacctgtccgggatgctagctcggaggatgacgccaccatcatgcacctggcgcacatggctggaggcgtacgacgcggctcgtttcgacttccatcatatggtgcgtcgtgggttggtcgagaacaacatgaagatcctggagctgcgtcaggagaatctgcagctgaagaaggacctatacgcagtggaggcgcagctgtgtcagctcaagatcgcccagggagaggtatgtcgccccaagcaccgtcgcgtctgccgcagcctgaagatcaccgcccgcaagagtacctccaggcccgagcttgttcgtcagtccccggcgtggacctgcttcgtcgagacccctcgtgccgagcccgcgcccgtggttcctcaggaggagggagcctccggcgttggcagcacggaggatgcgctgctgctcaccttccgccctggcccgtcgcagaagtagacgagcagttagtagtcttgcgcgtgtgttcttctcgtttgtttttctgctagagtcgtgtggggcatggttataccggtgtgtggtataactgtgtcggagcctgtctttattttatttgtttaagcaacttgaaccttaatgaaccaatttaatagcagtaataaattcaagaattatggtagtcgtgggtggttagttttaatagtcagctttctctgtttgccgattctgtgtgggattttcagatggtgacaaccaggagaagtgctactaccggtgatggcaaccaacccgaagggtagcaaccacaacaaccatggcagcccacctccgcctcctcccccgcctccaccaccaccaccagacaccaactccatcctcacccaaatcctcgcccagcaggccaacatgatggctgctttcctccaccacatccaaaatccgccacagcataatgctccacctccaccaccacccccgcaacactctaaactcgccgagttcctccgcatccgtccgcctaccttctctagctccaataaccccgtggatgctttggattggttgcataccgtggggaaaaagttatacaccgtgcagtgcaacgatgaggagaaagtcatctttgccgctcaccaactgcaaggcccgcatctctatggtgggaccacttccaggctacgcagccagaaggacaacctattacttgggcccgcttcaccgccgctttccggaggacccatgtacccaccggagtcatggcccttaagaaaagggaattccgagagttgaagcaaggcaaccgctctatgatggagtatttgcatgagtttaacaacctggcccggtatgccccggaggatgttcgtgaagatgaggagaagcaagagaagttcttggcagggatggaccctgagctgtccgtgcgtctggtctccggggattatccggatttccagcgtttggtggacaagagcatccgcttggaagccaagcacaaggaactggagtcgcacaagcgtcgcttggcaaatttccgcaaccaacagggggctaaccaaagggtccactacaccaatccctatccagggggatcctcctcacagcagcaacaacagcagcaacctcgctccgcgccccgacctcaattcgtggtgcgcgtcccacagccgcagcagcagcagagtcagcaagggacccgtgcgtcccgtcctcctacgccagccgtgcagcctggacaaggccgcagagacgttcaaggtcagcagcgtctgtgtttcgactgcttcgagcccgggcactttgcggataaatgcccaaagccgaggcgccagcaaggccaagcgcctccccgccccaacaacggtggtaaggatgtcattcggggtcgtgtgaaccacgtgactgccgaggatgtgctgacaactccagacgtcatcgttggtacgttcctcattcattccatccctgctaccattttgttcgactctggagcttcccactcgtttatatctgtgccattcgtggggagaaatcagttgggggtagaaaggcttaggaaccctctgctcatcaccacccctggaggggttatgacagcaaagtattatagccctgccgttcctatagaaatccatggaattccttttccctcggatctaattcttctagacaccaagaacttggatatgatccttgggatgaattggttggctcaattccaaggagtagtggattgcgcaagacgcactgtcactctgtaccgagggccggaacaaccggtagttttctttgcacccccaacctctgtcggcagttcagaacttcatcagataggactgtcggaaacccccatcgtcagtgagttcagagatgtgtttccggaagaactacccggtatgccgcccaagcgagagattgagttccggatagatcttgctccaggaaccactcctctgtacaagcgaccctaccgtatggcagcaaatgaactggccgaagtcaagaaacagttggaagagttgaaagaaaaggggtatatacggccgagcacttccccctggggtgctcccgtgatttttgtggaaaagaaggacaagacaaagaggatgtgtgttgactacagagctctcaatgaagttactatcaaaaacaagtaccctcttccccggatcgatgatctgttcgatcagcttaaaggtgccactgtcttttcaaaaatcgatcttcgctccggatatcaccaattgcgtattcgtgaaaaagatatcccgaagatcgtgttcaccacgcgatatgggctgtatgaattcacggtgatgtcgttcggtctgactaatgctcctgccttcttcatgaacttaatgaacaaagtgttcatggaatacttggataagtttgttgtggtcttcatcgacgacatcctggtgtactcgcaatcagaggaagaccatcagcagcatctccgtcgggtgttgggaaagttgcgggaacatcaattgtatgccaagcttagcaagtgtgagttctggttgtccgaagtcaaattcttagggcatgtgatatctgctaaaggagttgctgtggaccccgaaacagtgatcgccgtcactgattggaagcaacccaagacagtcactcaaattcgcagctttttgggtttggccgggtactaccgaagattcatcgagaatttctccaaaattgccagacccatgacgcagttgctgaagaaggaagaaaaatttgtgtggagcccgcaatgcgagaaagcattccaaactctcaaagaaaagctggtttcctcgccagtgttaatcttaccggatactcgcaaggacttcctggtgtactgtgacgcttcgcgccaaggattggggtgcgtgctcatgcaggatggtcatgtggtagcctatgcctcccggcagcttcggcctcatgaaggcaactaccctacccatgatttggagttagccgctgtggttcatgctctaaagatctggcggcactatctcattgggaatcgctgtgaaatatatactgatcataagagtttgaaatacatcttcactcagtcggatctgaatcttcggcagaggagatggttagaactcatcaaggattatgatgtgggaattcactatcatcctggtaaggccaacgtggtcgccgacgctctaagtcgaaaaagccgttgcaacactcttggcgtctgtgacattccaccggaacttaatcaacagatggaagccctgaatctaagcatagttagtcgtggattcttggctacgctggaagccaagcctaccttgctcgatcaaatcagcgaggctcagaagaatgatccagatatgcatgggatcctcaagaatatgaaacaaggtaaagccgctggtttcacagaagatgaacatggaaccctatggaacggaaatcgtgtatgcgttccggacgacaaggaacttagacagctgatacttcaggaagctcacgaaagtccttattccatccaccctggcagtacgaagatgtacttagacttgaaagaaaaatactggtgggttagtatgaagcgggaaattgcaaagtttgtggcccttt

SEQ ID NO: 71477 - DNA, 1634 bp, Oryza sativa
cgagagaggcagtatgtgagtcctcggggccaggcccgtccctcatcagtgatggggttttgttgcggtctgtccaagataattgataataggccacaacgaaaatccatcaccgatgagggtcatggtcatcggtgacgggccaggtataacagcctgacaaaaataactgtgaagcccatcatcgatgaaggttgatctttgatggggtttgcttgtggcccattactgataacccacagtataaataatgcaagaccttcaaggaattgttatcccaacctagtatgttgttcacacttcaggacagatggctagaggggatattttttttccttttaatttaaggaaagaaacaagatgcttccaaggtaataataaataaattacaactcaattttcgtataatacatagctatagatattatacctgttttttcacaatttgaacatggtgttggtatttgaaacggttacagataatccgcaagcgcacggatataccgatgtagcacttcccctcagagtattccaagggtatcgaatccaagggaacgtgtgtggtcagatcttcctccggttcatccaaggacaccaagcaattgataggctaggatagagatgattcactagtgagaaacagtgtctagggaaagcttaattttaatcctaacgcaatacttcaggcactggcaacccgctgttcccagatatcgctctactatgtacccggacagggaggacttaagtgatctcgagggctgtcaccacctctacacccacctcaaacgtaatgtgggatacgcaacaattactggataataattacctaaacaccatgtctaagcaattaatatctactttagtgtttataactcaccaaagcaatcactatattttagttgattatagtgaacaataatcccgtatgctatttaggaactaaccaagagataattctcacaagataaatctaaattactcaagaagaatatattgaattcagagtaataaacagaataaaagaaataggagaagattaccgacaactccggaattcttccgactccttctactctactctcttcctattctagtatacaatatagtacaatagagcctcttataattcagctcgagcttggaagtgaggtccttttatagggcagttatgacggttatgagaaggggaaatgtccgaactgcccccaaaccgtcattgggagaacatcaggagcgtccacgctaaaccccaggatcaacgatgatcccctggttcggccgaacctgggctgggccctcctggcctggccttcggtcggtgaactccctgtaccttcttctatccatttcgcggatttttgggttgatccactggtgtttcgatgaagttcgcaacccctccttgtatggatacataattttcctcactttagtctaaatttcctcccaacttcagggtttatcatctgcatacaactatacaccaacacttgtggaacatgtgagattaagcacctatactatgttgaatgttttattatctaaactttatgcagatgttggcggtatagaatcggcatttaacagccgccaacaaaaccccccacacttagctctttgctcgtccctga

SEQ ID NO: 71478 - DNA, 29595 bp, Oryza sativa
  unsure (1)..(29595): unsure at all n locations
atatatattaatgtgccttagctcgatcgatcggctttttcttaaaaaaaatgagagagaaatgccagagagctgcggattcaattaagaacaaaagtaatcgccttttcagttttttgacagagtccaggaaaccacgtacgcatatatgcaagggaagagttgaaaggttgggcaagaaattaattaaaaaaccacattccctttcttttggtttaaaatactagtatcttcacaaaaataagccttgcaaattaattaatcactaattaaaattaattaatgtgattggcatgcatctctagactaatgcaaaaccgcgtgtgacatgtttcataaagtttggtagaggtgtttgtgttggtaccatcgatcgatcagaattgaataccatcacaattcacaagtactatacgttcttcatcatcttgtcatgcatgtatgactcactttagagttaggatttggccaaccaaaatcttaagtactcgtaatatttaagtcacactaaataattaattattagttggcagcagcaccaaattaagctagcttcagatcagagtgatcgatatgaggcgtacgtgtgagatgagttgccatgtttgactaatcaaattaaaccctcaattaagtccatgtcactagctattacgtgcgtgtttatctcttcacctccaatgcaagctaattaagctagctatttgctggtcgttgctaatcccttctttctataaagttaaggctaaaagcttaaacctcgtgcttccacgtcatcatcaaattataaaccattggatgaatgtattagattgcttctcagacgttggatagaatacagcctagagcctaacccatcagtcaccgggtgagtctcttcgtctcctcagtgccaaatgtagcccacataaacatattggccatctccacacacatctacatgtatccagccgtcaatccgtataaaaaagctttatggctgaacgctcattcaattgacatgtgctacctaaattatctacaaattttgataaagctgctaaaaagaatttctccaagaaagctatttgtttcttctgtttcttcttgagattataccttttatctaataaattgatgttaaccaagtcccgcagcaacacgcgggtcatcttctagtatatataagtagttaacccataagctgcatataccatcatttttagtgaaaaaatatgtatataaccatttagttaaccagtgacggagccaacgacaccgtcaagcccgaatgacgactgaacggtgattcatagtatgatcgaccaattttgatgaatgttaatgatggtcgatcgatagtggaggtggtagtggcggagcctaggcagccatctcagttgctcagaagctgcctccaccactgtatataatattgaaatgttttcatggaaaaaattgatataacatatccattaaatagctcaaattaattaattgtgtacatatgcacacaatatcaataaataattgtgtacatatacacacaatatcaataaacaaggcaattataattgagatggatcgttgaccagctatcatatagatagctaacccttgccctagtacgtacatgtagcatagatgattaattagtagatgatatgtcatgcatgtgtgtcccctgctaagataagttaagcttgcttagctagcaacttgggctagctccccaactacttattatgctgatgacgatcgatatatgtatatatctcttttagggacctatcacggcctgaatatgccaactaattaacatttgcaaacaaaatccacctaaggtcatattagttagttaattaacaaattaatagccggccggagaatatttttaaaataggctgcacagatacataaaaaaagaattaaagaaaggcaccggagacacaggtagctaaagtatacttgtaacatgcatgatcgatgtcatagaatatcacgagtggatctagagaaatcatctatcaccaaactaaaccacatagaaacaatctgccttcacattgtttacccaataacacctaaatagaacctataattgtagaaatataaatgatgtagttttataagagaaaatagataatagtagtagtagtagtaatccaaatgctaaagaataatataaggtgaacctctgacactggaaatatagatgatgtagtttcataagagaaaactaataaaagatcagatccaaatgctaaaaataatttgaggtgattgtggcaaaaaaaaactatatgatatgtatgtgcgcgacttcataagagaagaaaggcaattcacactatagataaatgactaaaatgttaaaaacaattaagatgatgtaaggtaatagtaactacattaagcaatgtggattaactttataattatatagcttaactaacaagagttgatccattcacatccatcgtacccctccgtttcatattacaagttgttttaacctttttctagtataatacctttaagtttgactaattttataaaataattagcaacatctacaataccaaattagttttattaaatataataacattgagtatattttgataatatgtttgttttatgttaaaagcactactatatttttctatacacttgatcaaactttaaaaaggtttgattagaaaacaaagcaaaacgttttataatataaaacatagtgacaagttaagaattcagtcaaagggtatattacaagctgaaagtagaaatcatatcaatcggtagaatcatcgaaattaataaccatatatattaaactatccgcggaaaaaagtctttgaagaaaaaaaaatcatccatgaactagagctgccaataattgtatggtactcatatccatgttcatcgatgaaccctgagctaagtataatattaagccaaccaggtcagtccacatgcgagcttaaatggtggctaattaagcatgcataaatatatccttgtactatatgatatgcacatgcatgtatgttgctagctagctagttttcctccaatcaaggagttggccaggaagctaatttagctttgatcgagtaatactattaattgagttgctagcttcatctagagcgccaaaacatatttgtcttgtatcacagttaattactcttcattaaataagctgtcctaccttaacctcgatcctcttgtactagttgtactccagctagttatgtatctgaatcaaacaagacacgtaggcaaaattaagaaagaaaaaggttaattaatcctataatcgttagagcactataggtgaatggaagagtaggttaattttgagccgtgtcaacgcgcgttaagtttggccgcgccgatcataagcatgaatatacaacaatcaatcatcgaccagaacaacgaactcttaaccagtaattaattaattaattcgcagattaattaagtgggttattttcggtcttcggttagtttgacctgcctagctgctagctagctccacgagtatatgttttttttccttcaagaaaatttagtggatacaaattcattggtaactaccatttatcgccaagtttttaaacattgtaaaagaaaggagagctgctatacgtacgattatttgcgtacgatacttgtacaatgtaacatctgccagtcaaatcccatggtattttctggccgtttctaacgaagcaacacatgacatttaacgtatgttagcaatcgtacgatgatcgtacatataaaatcgtattcatagtattttcgaaaaaaaaacacggtcacaaataaaatactatcagtaaaaatctaaaataaaaggacgtgcgaggagacgcgacaacatgtctataaaagggcactaaaaaatagcccagctgttcttaaaaaaaaagttctaaaaaaaagaaaaaatatcccagccttaatattggtggtgccacctgtccaaaaaatttgggggaaatgggcataggattcctactaccgcaatactccggtttcaattataaaccaaattttcggtggaacatctgtctaataaataattaatctcctttattccttcctgtcccctaaaaaaaccacgagacacttctcccttttaattgcaaccgttccattcacactacttgtactactcctgctttctcttttgctgcccaacccgttgaccgtttatgaaatcaccaaactactccaagctaaaagaaaatagtgtacagaaaccaaataaaaaaggtcaggaaaagctaaaagagcaatttaaattgtacaattacctaaaaaagaaaatgctaataataatcttactgtagtagtatgaatgcaaaataaatgtgggtgtgtaataaagcagttattatcagcagttaatagtttcacggggtacggccgtactcctcctcctcctaccatacgttgagccagtcagtgagtgattggtggtggccccgcgatggcagtgggccagctaccaatggttggagggtattatggtaaatccgcgcgtggagacagcgatggacggacatggctggtcgtcggcgatccaacggcgcatgatggcggtgcggtggtgggctccgccggcgacgacggcgtcgtagcgatgggttgtccgcgtggcggtgggtttggttgacgacgacttgtcctcactgatgacttgaccaaacaacaagcttagctaaaagctgtttagctctagctgtgtccagcttactgcttgcgctgatgtccatttctcatggttaatgcttttgcgttttcttctcctttggaaacagtcaccccagtcaaacgttttccgtcgagatgtgcacgtgcattcattccgaacataccacgaaatttcatacttttactacaaacagaccataattactactcctaggttaattcattttttctttttctaaaaaagaattgaactttggttgcaggactaattttatggattttgcttatcattctatttaccataataagatactcatatgttccaaaattcaagcattcatgattatgtatgtagctagccagagcgatttggaacggaggtagtaagtaaaagttattcaaaactactttttattattattatttttaaaaaggttaaatctttaaatcagatgctatgctaatcaggcaatctcgtgtttgaaatttgcaaaagaaaaaagaacaaaaaaaaaaaagagagagggagggaggaaatgaggaaatgcgcgtggtttgggaggataacggcgtgaggaagcaaagcaagttgccaacttggaacacaagaaggacacaaagctctctctactcctttttccactcctcttcctcctcgcgacgcgtttcctctcctcccctttttttctcctctcctccgcccaatctcccaccaccacgccgttcctctcctcctcctcctgctgctgctgcggccgcgccgccgagcctcggcaaccaaccccctccaccaccaccaccgccggtagaggaggcgaggtcaacagcaacaacccaaacacaatatccatcccttcttgcgcgcggtggtttccgggcagatctgagacacaccaaacaaaagaaggtctcgatcgatggcttcttcctccccttcctcctcctcctcccccccttccgccgccggtgcctcctcctactggtgctacagctgcgaccgcttcgtgcgcgcccccgccccccacgacgactccgccgtcgcctgcccggactgcggcggcggcttcctcgaggagatgagcgcgcccccgccgcgcgccgcctacctccgccgcccgcgcgcgcaccacgccaacgacctgcgcctgcgccgcacgcgccgcgccgcggcggcggcggcggccggcgaccgctcgccgttcaaccccgtcatcgtgtttcgccgctcccccgccgccgccggcgacgacgactccctcgccgccgccaccagcttcgagctcttctacgacgacggcgcgggctccggcctccgcccgctcccggagaccatgtcggacttcctcatgggctccggcttcgagcgcctcctcgaccagctcacccagatcgaggccggcggcctcgcccgcgccaggggaacccaccggcctccaaggcctccgtcgagtccatgcccaccgtcaccatcgccgcctcccacgtcggcgcagactcccactgcgccgtctgcaaggagcccttcgagctcggcgacgaggccagggagatgccctgcagccacatctaccaccaggactgcatcctcccatggctcgcgctccgcaactcctgcccggtctgccgccacgaaatgcccaccgacgcggccggcccgcggccaagcaatgccggcacaaaggagaagacggtcgccctccccatttggaggctgccgggaggcggcttcgccgtcggtaggttcgccgaagggagaaggcccgagaagagggagcttccagttgtgtacaccgagatggatggagggttcaacaacggcggcgcgccgaggaggatctcctggggttcgaggcagagccgatcgacggagaggagtgccattaggcgcatcttccgcaatgtgttctcgtgctttggtcgcagccattcatcgaattctcaggcctcgtcttcgcattcgaggccggagttgaacgatgcgtctgaccggagcgccgtgttcagccatggctcaagaagccggagcacgagctggaggctcgaagatggccatgccgacgccatggtgcaaagataggcctcaactgaagtaaggaaggtcgtcgattgtttccatttcgcgcatatgtatttagaggaaaagaaatttgtagtagaacagaattgagaattggtgttgtacataggagcagcatcacatctactagtagatgataacttgcagggaagaagatgcccacgatggtgattctgaaatgagcatttgttgtttagagtgatgaatttgctcttgctggtagcaaatgtcgcttggaattctatgattcattcaaattcattgtggcgatgattctttgcatctgtgagaacggaatgaatgaaaccattttgatgtttgcagtcttgcaggattcaataaaaatcttgttccagaaaatctcttggcctcttgaatttcgacctattcatcagctttctgttgaaatgcagacgtctcatggcttgatagtttctggaggattgctatcatgctacgttatcacctttataattggtttgatgatcatatttcctggatccagtttttgtcacgtctttgcttcatttgtctgaaccaaagaacttcagtttcacgaaatccaccactgtaatttgtctgtagcctttctcatgtagcagatattttagtagtacttcctttttccttgacttatctgagacaagatttttacacatcattgtcctgatgtcaacatagaaagttgcaggcacatggaattactctcctgtactgcatttgagttcctttcctgcatctgagcacatatctcataagtgttgtgcagtaaaagcttggcttgtacattctccccatggttgactaccttctgcagtaaaatttgccttcctttgaaaccttaccttgtagtagtccttgaatagtactgacagcgttgtacaactatttcatttggtaaaccaaccaagaaatgctcctttcatgcatggcccatatacaggcataatgcagctactaaactgaaacgattccttcttcctttttttttttgtttgtacaacattgcagtgtatgtatgcatgtactggtacgtaggttaggtccaatgattaagccctgcccttaatcctgccactgatgtctgttttggtagttgagctgcaactgcatgcgagcagggttggtccaagttgaggtacgattgctaattttctgttcagttctgtctgcagaatatacaggcaagtattggcacagtatctttgatgccatcatcttgtccctgaacagtttctggctttgttttgtacgactgtgatgttgaaacggaagaaaaagggtctctgctttgctctttttactcgagtggaagtcattgtcctgtgatgagaagaaatcaagcaagtggtggtaggcatctgaatttaccacgtttcagattctttcctggggtgacatggacatgcttgtttgcagttgttacaaaaccacactggtgactcggtggatgtccattgagttgaacaaagggcaaagtttggttccattcactgagcaagcaaaattgttgtgatgacatgtggaaaatactgcaatattactgtggtcttgtgtagatctttagctcaggaattcaggaaacctgaaaacgacccacctttggagcattttcagaaacttgttccggattgttgagagagcttggtctgttgggcatgcttggaatcaatctagatatgttgctttcacgcatgacacatgcattgatgcatagtcctagccttgatcgattgctctggtttttattctctttctttacctcccatttccttaattgcagtttagtgcagctccaagcctccaaatgataagtctctgctcgactcggtaactccaactcctgaaagtctgtagtaatatacatggattttctccctgattccttttacttaggtggctgagttataaccgcaagcaacacggagaaagtcaattttctttccttgcgtgtgttgacatctcctgcgcattgtcagatgtagtaaacatcctactacaccttttttttttacctccatgtaaagcttgaagattggagctcggatgcaatcacactcttcacctctgttatgtctatgaagaaaaccatatgtgttcgatcagctccgatgaattacaggctttgcaacttctattcctagcttaggtccagaaaattcttgatatgtgatgaaccagacaggcagacggacagtatatatatactgctttgatgttgggtgagaaatgttagagagtaaaagaagtgggtgaaacagacacgatcagtttgcagatggtcacaacaacttgccatctccctccttgcacgattcacttggtacggacgcattgctcttgcttcagccttgttaccttgtactgcatctgtactatctcaatgtgaatcatgtgagattgatttcccaattcccatgcggatgacagatcacacacatcttcaagacccacacggccggccatgcatgttgagccgatcgaccacgttgattcttcttcaccgtgctgccattccatcgaacaggctgtgggtgggggtcggagtcttattctccnaacccccctcgggccgtgttggattgggaaaatgagaagccgacggcggaggctgcggtggcgtgctacagcggcaggggaggaagcggcggaggccatggccggagatgaaggtgggcttggacttacgtgcggcccatatattaactaattgggccaaaaactaaacccttaagtttaggggtgtcagtgctgactgtgactggactgtgggacccggtcatcttatccgcatcgcatggaggagaggaatcgcctcccttatcctctcgccatgcatttcctgccttgagtgtgaggatcatattcatattgcagctagcgtactgcactgatcgatttgctctagctagctcgtcgttagccacccatggctgcttctcctgcttccactgccgccgccgtcgtgaatgcgccggcggccaccggcgggctgctgctgccgcgggggaggagtagttggagttggagttgctgcaacaataacaattcttcgatggggaggaggtggcgggcggcggcggtgggggaggtggcggcggaggggaacacgtacctgatcgcgggggcggtggcggtggcgctggtggggacggcgttcccgatactgttctcgcggaaggacacgtgcccggagtgcgacggcgccgggttcgtgcgcaagggcggcgccacgctgcgcgccaacgccgcccggaaggacctcccccagatcgtctgccccaactgcaacggcctcggcaagctcggccagatcgacaagtaatcatccatctctacctacctgcttcatcgacgatccatccatccatccatcatcatccagctgccagcttctgatcatctgatcactatatacatgtgtgtatctcaccatctgtgtgcgtcgtctatataactatatactataatcgttagtttggaacgctggaataattccatatatatggtctaattccagtgttccaagccggctatatatcaatcgctacttaaattcaatgtacttgtgttgctgagctactttgtctctgatatacatattcattgtctctcgctgctcttccgtttaatggaacaatattaacatgttcttactactcaccacttttgtttatatttcttcttttttggatggactggaacgcgtcgttggcacatgtacgcttatcgctttattaaattgagacggttagtataagcgaatgattttgatatatatagctccgagttaaatactgtcctttttggagtatagagagagctagctggctctcaggcttttcctaagttttgcattgtgaatataaaatggacctatatatcagagagtaagttcgatatggaattacggagtatattgcaattatcttttccctctctttgtttggtatgaaactaattagcacacttgaatagctgtgtcatcttcaacttataaactgtacaataacacaaggcaagcaccaactaagtaattaattattaatcttcctgcggatgatgcacgataatcggcaaattgaaggccaagcctgaatagagggcttggtcactttaatgacattttcaatcttaccaaagttgacaaaaaagtggcaacatttagtttcctgccaaattttggtaactatataagaaatcctaccaaaatttggtaaggtttttttttggcatcaaagtaaacaggcctagagatagcatcactacaataaagtttttttgatgaaatccagcgcgttgctgcgagagttttatgtgatattagtaaaaataacatgtaagatagtatattttgtataattttcatctctggttgactattgaaacaaaaatctataaacaatttagattaatctctggctcaatgagagaaggaaaagaaagaaggtaatatatatataaattaatcatccaaatgtaaaactaaagtgctatgacattgcaagagaagaaaaggacgaagataatttaacaatgcatcataagtgccttatgatgaattctctgcattttataaaatgtatctatgtcttgtggcagtttcatatagacatttttttatgtctataagagagtagaagcattttctagagattaaattgtaccacaaccatatccaaccaatgcaaaagaaaaggagaaaaaaaatgctttcccttgttattgacaatccttgagatcatgacttgggtaaatcaatttcatcttccatgcactaatcaacttaatataatgtcatacctgtatatttgtgccttgtgttatttatatgtagttcctaagtatgaattaacattgaaaggtgtgcctctatatagcttaaaatgtcttttacataacatgcaatttttacagtacatgaagaatttctctacaagataaaatagaatcaaacatactaaaaatgtctctaaagtgtctctctatagtaaaagttttctatgcaattttcaaagtgcctctaaaaagtctctaccctataaaactcctaattttagagccaattaaaaaagtgtctctaccaaaagtgcctctatatggggttttttttgttgtagtgatggtactcatgtcaagccgttgtccaccttactaattatatccctcacctccgcaaacatatatacttcctccattcaaaaatgtaagttgtattttgttttcttagaacaagacttggactaacaattgctagatatatcatttatgtgacacaaaagctagcacaatcataaggaagtacttttgaatatgaatctcataacatcaattttgcgtcataaaaaacatattataataaagtaactgctagtcaaaggcttgtccaaaaaaatatgccatatattttcaaatggagggagtaccatatatatgcaggtttaatctagctctagtgtcatcactgtccactatgtatgctcccgccatcgccttaactcgaagtctacttgttaattttgtggtccactatggcactatccataacaataaataaaccataataccagggtgtcctagacatggctctagctgacgtgcgtatatatagtaagctccaaaacattgctctgaccaaccgttctttttatcgctaactatgacttctagttgaaactaaaatccacttgtctgagaggaaaaaacaaaccacgatcgcatccaccagatatatgtgagagtttgatctatcactagcgcgtcatcgctatttctagtacatatgcttctgtcatcaccttaattgtagtctatctaatcttcctccttttccacttgccaaccctaaacgaaatcgaattcactcgttgatcttgtggtcgactatgcatagtaaaattgtatgtagtacatagtaagctacaacaccttggtatagagtaagtggttttttcccatcactagacaacatttggcttcaaaagccacaaccatatccaaccaatgtaaaaaaaagagataaaaagtatgtccccttgctattgacaatcctcatccatcagatatacgtgagtgtttgatctaccactagcgcatcatcgctatctcagctacaaaaccttggtatagagtaagtggttttctcccatcaccggacaacatttggcttcaaaagccacgaccatatccaaccaatgtaaaaaaaaggagataaaaagtattttcccttgctatttacaatccttgagctcataacctgttgggtaaatcaaatttatcttcaatgcactaaccaacacattctcatgtcatacttgtacatttgtgccttatagtatttatatctagttcgttagtatattaacattatagagcttaaaattcctcaaaaaatgcctttacataacacgcatatttttaagtaccaaaagaatgcatctacaagagaaaattaaataaaatatactaaaaatgtctctaaagtgcctctaaaagtgtctctacactataaaactccttgttttagagataattcaaaaagtgtctctacaaaagtgcctctacatgtttttttttgttctagtgatggtactcatgtcaagccattgtccaccttactaattatatccctggcctctgcaaacatatatactccctccatttaaaaatgtaaggcacattttgttatgttagaacaagaattgactaataattttgcgtcacaaaaatcatactagtcaaagccttattctaacaaaacacaatacagcttatattatattttgaaatggagggattaccctatatatgtgggtcactatccactatgtatgcttccgccatcgtcttaacttaaagtctatgtgaactccctccctttttactcgccaccctaaacgaatgttgattttgtaacccactatccataacaataaaaccatgctaccaggcatgttgtcctaggcgcggctctaactaacgtgcatttgtatagtaagctccaaaccattgctctgaccaaccttttttttttcactaactatgaacccgggttgaaactaaaagtcacttgtccgagagcgaaaaaaatgcaccgtcgcatccaccatatatatatgagtttgatctatcactagtgcgtcgttgctatctctagtttagatgcttctgtcatcaccttacttatggtttatctaaacttccttcttttccacttccaccctaaacgaaattgagctttctcattgatcttgtggtccaccacgcatagtaaaattgtatgtatagtacatagtaagctacaaaaacttggtgtagagtaagtgcttttttcccttcactagacggcatttggcttcgaaagccacaagagtatagattaacattatgagaagtgcctctttagagcttaaaatgcctcaagaaaatgtctttacataacacgcagcttttaaagtaccaaaagaatgcatctacaagataaaattaagtaaaaatatactaaaagtgtctctaaagtgtccatagagtaaaagttttctaggcaacttttagagtgccactaaaagtgtctccactctataaaactcctgattttagaggcaactcgaaaagtgtctctataccaaaagtgcatgtatatagggtttttgttgcagtggtggtactcatgtcaagccattctccaccttactaattatatccctcacctctacaaacatatatacttcctccatttaaaaatgcaaggcgtattttgtttttttaaacaagagtttgactaacaattgctatatatatcatttatgtgacacaaaagtacgatcataagaaagtactttcgaatacgaatctcataacatcaattttgcgtcacaaaagccatattgtaaaagagtgattaatagtcaaaaccttattatagtagagtaatacaccttatattatattttgaaatggtgggagtaccctatatatgcgggtttaatctagctctagtatcgtcactatccactatgtatgttttcgccatcatgttaacttgaagtctatgtgaactccctccctttttgatcaccacccccaaacacatgttgattttgtggcccactatccataacaataaaaccatgctaccaggtaagttgtcctaggtgcggctctaattgacatgcgtatgcatagtaagctccaaagtatcgctctgaccaacctttttttttgtcactaactatgaccccgggttgaaaccaaaagtcacttgtctgggtttaaactaatgcgtcatcgctatctctagtttagatgcttctgtcatcaccttgattgtagtctatctaaacttcctcctttttcacttgccatctccaaacgaaatcgaactcggtcgttgatcttgtggtctccactatccatatggtaaagctggtacatagtaagttacaaaacactggtatagggtaagtgaattttccccttcattagatggcatttggcttcgaaagtcactctttcgttcgaaagcgcaaaaactaaggtaaagataaaccataccaaagcatatatagtatcaaacacgcgtcaaatatttaccgtgcgcacgtgtgttctacatgtacgcgaattattcggaccaatcaatcaataaattcctaaaaaccaagctattgatcctaaaaaatgtctatggtaatccttttcctagtgaatttacccatccatgtatacccatgcccctagctagatcaaaagcaatgcatagatctcaaaccaactaccataagtctgagatcgaagagagaacactgtaattaatactcaagcaagttaccaaaaagaaattaagaaagatgtaaggagaacaccatgagaagggaaattaaagatgtatgaggagcgatctaaagggcttattaatcatactccatgtatcggccggccgggaataaactgagtagaggtgatacattgatgagaaattaaaggaaatcgattaagaaaggcgactaatcaataaagagaaacctccaatataatccgacgcaggcaaaggatcgtcgtcgacgatgatcatggatggggtggcgagctagctagtactcgtcgcgccagcagatgagcatttggatgcagcggcgtatgatgtagaagcgcgcccggtgctccttcaccgtcttggtcagccgatgctttatgttctccgcggagtagctccggcacggcatcttcacttgctccggcgacgacgatggcggcggcggcgacttcttcaggcccttcgtcgtcttcatcacctgctccttccgcacggcgacgttgccgcctgcagcatcctccttcgtcttcaggttcttgcaggtcttcttcatcacatgcacttcccttgcgccgcctgctgcagcctccatagtcgtggtggtggtgatggtcgtggtcttcgatggagaaagagatttgaggatcgcgacgacggtgatgaggtaagctatagctatagctagagagagcggtcactcacacctggctgggtgtgccgcgcctggggtctaaaccacgcgcagccactgctgacgtgtggggcccacatcggccgtccgaggatgacgtccggccgagccgaccacacgcacgcacgagcccggtgcgggtcgtagcttgcttgctgcttcagttactctctcatctctcatctcttgctcgcggccacggccacagccactgccagcatatgatcatgtcatgctgtgcgtgcctagctttccagttgattccaagagagagaaagagaggagaaaaattatttttacaagcagtatatgtaatgtaaagtatatataacggatggatggaaattgcaatataatatatatggcaaataatattgttgctagctccatcttttccagctagcacacttttatttctttctgccacaatgaaccttgtgcaccacaggatattagctatggagaaaaaaacgaaacgatttatagttttacactacttgctgtctttattacgacgctctgattaatcattcttacctgatcaatgtcgtatgtacacaaactcaaacgtgcataaatatattcgcttctggccctggttttgatttttgaaatgttgatgtatcggatcatatcggagatcaaaacagaaaatggaataatggtcgatgcaaactaacttctatatattccactcaatcgccaatagccaagacttaattaattacttaaccaacactaccagaaactgaaatacccctgacggccgcaatttttactgacgtgtgtgcatacatgtcaggaaattgaaccctgacggacatatgtcaggcaaatttatttttccccgacaagctagttctgacggtgacatgtccggaactattttcctgacgggattttctttatttctgacgggatttagccgtcagaagtaatacaatttctggtaagatactcaaattcccacgtagatacgcatatatatgcttgcacagtaaacaaagatgagtatttatttaattttacatctctttcaaccgtatatatatatatactccatcttgtatagttcactgtcagaacatacgcatggttacactatagttacattacatttgaaagttaatttctttttagaaaaaaaacttatattacggtagctttttagataatttcaaattaacctagcaccggcagttcccgtgcaaaacagggggctagctagcttgcatgctagccatgcatatatagctttgatttttgttttcttgtgcttttcagggcttccagaagatgcagatgattgtggagtagaatactctatatcctagcttgctgcttttgttcgtttgttataagctttgtatggatgaaaaaaaagttgtttttaattaattacagaatgttaagaatctctcaagactctcagtagtggtatacccaatataatagtgcacctgacatgcatgtgaaagttaacggatggatgatatggatggatggatatgatgctcatgattccttactatttggagaattatctttcataatattcatatataatttacatgttgttaaattatacgatttttaaaaaaaagaattgatggtaaaagattaaaaaatatttgacttataacaaagctataatggcatctaatttaaaacagagagaatatcgggaatgcgtgggccttttttagggagataaatgcatagacttatagaaatagatgacttcattcatcaagatttaaattttagtgttcacgtatattacgcattggtgtgcactttcaatacgatttttggcgaggtcgagagatacccatgtcgtccatctatttaaccatgtgttatatatggacacacacatatgtatgtgggtatgggtgtgatgtgtgtgcacgtattcggtgttatgaaagaaagaatgcatataagttttacttgtcagtttcaagtttctaagtaattaactttgcgtcaacattatttgttgttgcgatttttttaaaaaaagaagcactatatgaatttgtatagaaatagagaacaaaatgaaaggaaagaagtagcgtgagcttatagtgtttcttcttgtagaacctgttgactcgggatttaagttacgactacttatttgttactaggggtgaaaagaaagctcgggttcgtgagcttagctcggccttggctcgagcttggttggcttggctcggctcgtaagccaaacaagccaagcccaagcctcctttttagctcgttgctgaaatgagccgagccgagctagctcgcgagccgcttgttttggctcgcgagcctaggccatcgtgtgtttatattgattattttactttatatagtgttattatttgtcaacttgaaatttatcactaagattttgaagaattgaatataaaaacttatttaaattttacatgttgatgatttgtttttactttttttcaataattacaaaatatatatgaataggtgtttcaacaggaaagcttgcaagccagctcgagctggctcgagccaggaaacgagccgagccgagcttaagttttagcttgtttccctaaccaagctgagccaagccaatcctagttttttgcgagccactgcaagccgagccgagccaggcttggctcggctcgtttccacccctatttgttactgatagtctttcttcggaggttcaggtgcttacagaagatgtgtgtgcgtatgtctggtttcatagcatcgtgcttcgtagaaaaatagagtaaatttcataaaaccccatctattatgatccaagttgtataaaaaccaaaataattttggcacgtgatatataaccttgggtattatgattctatagttttacaaaatcacacctttaaccattttgatttacttttatataaaaatttttaaaaaacggatgtaacatttatatgatgggataaaatccttataatttgagatatgattgtaaaactcaaaaatggtattgcgaaacttaagaaccataatacctgaggttatataacacatgccaaaatacttgtagttttgtgtaacttagactataatattatcggcggagttttatgaaatttagtgaaatgaaaggatggtaaaatggaacgcagggaggtccggcccacagggacatgcggcccagtaatagaagaagtcgattaggagcagcgggaaagcgataaggaaagcgacagccatagccactcgctgcgcctcctcctcatcgcctcgccgtcgccggagaagacaaccatgaccaccatcgccgcgcggatgccgtttgcgggcccacgcctcaggcctccctgcaacctcaccgcctcgaggccgggtcccaggagggccgggctggccgtcgtctccgccgccgccggtggcccgcttcccaccgtgctcgtcaccggcgcaggcggccgaacaggtgcaatgtactccttgcggaaacccctctcatgcccctcctcgccatcttgcccatttggttcctcgtgttcatcgaatcgaatcgaattttcttttttagataatggaatcgattttccttgcaagaagaaagaaatctagtttcgtgcacatctactcttgcaagaatttgactcggttttcccttttgcacgctgcaattggcctctctgtgatgatgatgatctttcaggccagattgtgtacaagaagctcaaggagagggcagaccaatttgtggggagagggctagtcaggactgaagagagcaaagccaagattgggggcgctgccgacgtgttcgtcggggacataagagatcccgcgagcattgctcctgccattgacggcatcgacgcgcttatcatcctcaccagtgcggttccgaaaatgaagcctgggtttgatcccagcaaggggggacgcccagagttctactttgaggatggctcttatcctgagcaggtgattaaatgtattttgtgtcactcacattttctgtatcaacttgtgccttcatttgaaattgatgttttctgctatttgctactctttgaaggtggattggattggccagaggaatcaaatagatgctggtaaaacatctttgtcttgcagatggattctttgaacttgtttcttttcagctatgctgttctttaaaccagtattatcaatgacttgttggtctagctagcatagctcctttttttttcagttaattcattccttgttcatgattcgtttatgttttttcgtcatcttcatgtagccaagagcattggtgtaaaacaggtggttttggttggatccatgggcggcacagatgtcaatcacccactaaataagttaggaaatgcaaatatactggtatataacatgtgcaaagtctttctttcttctaatttattcatctttatgtgtgcgtgttcatatgtatgcatgcatgagcacatcatatgcactgtttacaagctcagaatactttaatgttctttgaattcgcaggtttggaagaggaaggcggagcagtacctagcagactcaggtctaccatatacaattataaggttgtaaagcaagacatctcttgaaaatatagttgtgatttgtgaaatgcacgttgtcttgcagtctacataattttactagcacattagctttctagaacatggtttcacctttcttccctatagctataggtgcctgcagcctgatcataaactcaaaccttatgtatgtctgtcaggaataaagaacaaaccctcagtgcagttgaaatctggaagaattattgtaacttgaatcaggagattgcatcgacatactcttttcattttgtttttaatgcagggctggaggattacaggataaagatggtggtgtgcgggagttgcttgttgggaaggatgatgagatcttgaagacagaaacaaaaactattaccagagcagatgttgcagaagtttgtttacaggtaccttcacaactgtggatgacatgttactgttcataatctctgctcggtgaattttgcatctaccatgtctgatgtctccgagaacaatgttaatctaccaaaacgttatctatctgaaaatgttaatttaccaaacataaaggttgcaacattctctgcttgcacatgccatgtatttttatatcaagtgctgattctgttgcctaatccatctgtgcctgttcctttcctttgcaggccttgctatttgaggaggcaaggtttaaggcatttgatctggcatcaaaacctgaaggtgaaggagtacctacaactgatttcagggctcttttttcgcaagttaatagtcgcttctaagaagtataatctgtcaacgaggcacaatatttgtgatggaataatatgaagtgtgtattgagtgaggttagtttcctagcatatatgcattttttttgttcatccttgtattagtaggcagttgattctgcatatatttttaattatctgtgatctttttgttacctggtactgttttgagaaaaaaaaagttcgctaattgcataccaatataacaaaggcagttacttattactcaatcattcaatatcttcaaatcatttaagagaaatacagatgattgctatagtaatgcattcacagtaagagtatgttaagagcaaatttagttacccacccctaccgagaactccttgttcgtattaattggaaaaatacagagagcaaacataagtcggaaaaccaagccatcttccaagatcatctccaatatccatcaacacaagaaataaattgcaatacttagaacccttatgctgatgattgcataactagcttttgagaatattggagactgattgagatctgctttggtctttctgattaccacatgatcacctaggtttccactttccatgttgacagtgcctgtattatcctccccttccatccctgcagcagccagccactatcttcatcaattacaaagtcttcatgataaaattccttgtaatgtactgatctattcagaatggcttgattaacaggacgttgcttgaacccagccctgaggatcctcatttgccactgtttgtagctttctggcctctcaatcctttctgcaccttcgcatgctacagcattaagtgcatcattcccaaagagatccttctctaccaatatccttgcttcatggttcctaggaacattgttgtcgagcatatcaaaaagtgatgagtaatggaataaaacctctctgaatctagtcagaaagaatggggagctgtacaatccattcacaacaccaagaatgaaaacctgcgggttcatcctcttcatcatgtgtagtaccctatcccttgcactatcaatgttttctgtctcatcacctagctttctcattcgtgacatgcagttgattatgagtacctcatccttgtcaatactgagatcctcgatgcagatagtttcccatcttgaagcaatgccatgatactggaaaggtacgttgaacatatttgcatactctgccaaccgctttccagtctcctcaatcctttcatgagggcgaaaaccaggctggggtacatctacacctgtgatacgaagcttaggggggccaccttctcgctttgcaagtcgctgaattagacatggccactgaaagccgaagaggatgccaaaatcaacgatatgcaatgttgttttcccctccaatgcatcaatgatggttttgttggagaagtagtatgttaccatctcaaaagggcatgctacaaaatatagatgataggcctttagcatgtctctggtgctcgtttgtttcgccatcagtttttcgtacatttgactcccagtcccagccaagcgagccttgaggccatctgcaaagcagtttgctagcctctgagaaccatctccatttggcaaagcgtgatgccttattttcctcagtagctcactagcaaagggatggttgttagatgctatcgcttgtgcacattggatgagaagaacactgagatctattgcctctttctgtttcttcttactactgtgtggcttcctttgcccttttccatatcctttgctttgaaatttctttgggttgtcgcttgcttcttttgccatcattcctctaaggttagcaacttcaccagggagctgcctattgcagagcagaatactatcaaacatttcatcccgtattgtttcactagtggagatggccatatgcttactgttccttgcttccatcaactctatgtgctcaacatgaggatcatgaggatgattccttatttttgtctcatgcttgcccttctgttctgttgtctctgttgtttgtttgcaagcataaagaccattcttctctggatcatccaccaacttttcaatatttggaatgaacctctttgcttcctcaacacctctcctgaattgcaaagccaaacggtcaaattcagaagaccagtcggtggttatcgaatgcgcatcctgtgacccaaggagatcactaacaaagctaccactacatgcctgttcatgataactgctgctaccattatcagggtaatctgcttgactgtcaccgttaattgctgtcttcttaaatgaagatgggtatgccttcccaagaatatcataaaagggcttctctgtcgcctgaagtgcatcctgtcctttttttatgctgatcttttcatcaatatcctcctccatcaatattctgtttatataatcaagagttatgtttgagttggtctgacaatactcagggctgtccattatgctagacctgcattgctttaagcttctgaagcagaaatttgtgatctacaaaagagcaagtcaaccttttaaaagggtttctttaccagccaatgtcttttttttttgcctctcaaaacttgctaaaatatcaaaatagtcatagataggataataggataagttcaagagttcttttatggtcctgagaggtgccacgctaattaacaacaggagttgccaatatgaatgaaaacattaaaattcggaggtactggtacctcccaggactgtaatcagcaaaacatagttttttgcctagataaactgacatgtaaaaccatctctggcacccaattttgaagattgtatgcactacttacctgctatgtaaatcatacttttgacatggataacctccaaactctggaagacaccttttgttgagaaaaaatgttggtgtatcaaaatgtaggagttggtaacttggtataccaactacactgtagaatatatcccaaatatactttttatgatgtatactactattactgctgttacccaatgttaacagcagcaagagagattacatcagtatttacctagcttaatgatgtatctggcctatggtgaggaaggagggaggtgaaaaactggggactttattatgagccattgagagtagtggcattgtccagtccttatgagaggggctgaggctccttagttgtgctgatgggtgagcttttcttgttgatgtgaaaattgtttaatgttcctcttggtctttatttcttgttactttcttgttgacatctggctgattaatattagggttatttcttgtaaccttcttcttgacacttttctgatttataaaacatataactgtgacatgaaggtaacagatcatattccaaatggctttcttgtgatcatttctgttacaaactaggcaccattgtcattcatccaggctgggccttttggttcagtttggacacatagatgcccccaattataaccaaagagaaggatgtgacaactgataaaaggacatcatgtgcccaggaaaatgataagtaaactggaaattctaaagttattgtctaactatttaacgtattgtgctatttactctaatcccacgttaaacagtaaccggccattggaaatttagaatacaatcagtaatctaacttaggagtaaaaaaaatatgagaatatgagaactaaaagttatgaatataatctagaaattgtacttccaagaataatttactggtatacaatgaagtagttgtttccagccaaatagtttgctaatagatggaaagaacaattgcatgtcactggagcacaaacagtctcttgtttaagctgtatgattccagctattcattgcttgcagctttttttgtctccttctcaggtatttaaaattattatttttgcttccccattcacatgcacttagatgttgcactattacaacctattatgcatgaaagaacaagggatagacacattggttttagaaaacaacagtttcactactagagtagttttctattacacatttacactttgttctgaaataaaacaagaagacttttagtatggtccttagggaggaaccttgaactttcaaatagtacatattgttgagatggaaggactggtacctccttcaaaggtataaaaaaagtatgttatacacttcgtttagtttagtttctatatatgctcatgtacaatcaaatcaatacatataaaggatacatatatgttcatttattgtgtttacgactgttcaagtagatacagagattggcagttgcctatacacctttgagcaccatagcatatgtacatgaaaaactgtttgaatcttactgatccaaatatgattcatttggcttccatgtggatatggcataaattactctccctttccatccttgtagtagccaggcaccatcttcatcagctacaaagtcctcatggtaaatccctttcttcatatttattatctctttcaaggtggctggatcgacagggagctgctgaacccagccttgaggcaccgtgcttgccactgcttgtaactttctggcctctcagtcctttctgcaccctctcatgctatgatgttaagtgctttctgcccaaagagtcccccctctatcatattcctcgcctcgttatcccctggaacatttgcatcaatcatgtcaaccaatgaagagtaatggaacagaacctctttgaaacgtgtgatgaagaagggagagctgtatgatccattgacaataccgagaataaaaacccttgggttcatcatcctcattattttcagcaccctatcccttgcgctattcatagataccatctcatcaccaagattcttcatcctgaacatacagttgactatgagcacttcatccttgtcaatgttcaggtcctcaatttgtacggtttcccaccgtgaagcaatgccctgatattgaaaaggcaccttgaacaagtttgcataatcagccaaccgcttccctgtctcctcaattatttcacaggggtggaaacctggctggggcatatctatacctgtgatcctaagcttgggtggaccccctttttcatttgcaagccgctgaatcaatgatggccactgaaagccagtgcaaatgccgaaatgaacaatgtgcacctttcttggttgctgcccctttgatgcatcaagaatagtttggtttgcataggcgaatgacgccctttcgaaagggcaagctgaaaggtagaggctgtaagccttcaacaaactctcagcactggttcggcttgccatgagcttgcgatacacctggctcccgatcccagccaagcgcgcctccagaccatccaccaagtaaaatgccaacctctggttactatctccatctggtgaagaatgctgtcttatcttcttcactagttcactggccgaaatgcggtcgtcagctgctactgcttgtgcacagtggatgaggagattcctgagatcaactacatccttcttgagttgtttcataccccgtaatttccgttgtgcagatcctctggtttgtccattcagtgaattcttgcgtgcttgcttcgtcattatttttcgaagatttgatgcttcggcgaaattctccacaccatagcagagcagaaccctgtcaaacatatcattccggattatttcacagtaagtgatggcatagcgtttgctgttcctcccttccaagatatccaagtctgtggtgtaagggctgtgcctttgatctgtcaactcaaagattgcatatcttttcttgtctcctacttttgccttcgtggtcatttttgaaatggagagcccccggtcagtgtccaaatcgatcaccaacttatcaataattggaacaaatctctttgcctcctcggcacctcttctaatttggaagccagggatgccaaaggtagaagtccaggcagtgcttaccaagtgttggtttggaagaaaaagactcctgccatagctatatggactcaatggggttggcaagggctgtaacatgttgaaactggaatggctactatggtacctattatgataattgtttctgctactgctctcatcaggcgtatctggttcatttgcgctatggagtgctagccggtttagcgatggtggatatacctggccaagaatatcatagaagggtttctctgcagcctgaagagcagcctccccttggtgcaggtcaaccctctcatcgacgtcctccatcagcacccgacttatgtagcaaagggcatcgcttgatctgatcctctggtaccctagactaagcgctgcatcaatctgaaattgttgttgtccaagattacttttgtcattgcaaatcccagggatggtgactgcacctgacaaatacgttcttgatcctgtggttggctgggaaaacagctgcggatcgctggggctgtagttgtacaagctgagttgctgctgggaagaacaggaagacccatcatgtggctgttctgtttctgtggtggtgtattgattgtcaaagggaagctcaatcaccatttgttttttttttttttgccacctgaaaactgaatgacagatatatcctgtcccacagcaaatgaattcagtttgttgtctgtaaaagggaaagtgaagcaagttttgcatgagacagattctgaattcttcttcatgatcacggatactcaaaattatgttcagcctactcatttggtagaattcagaacatttgcatccccaaaccatagaaggttgtttataagagggaaccgcaaccagttagcgcattatttcctcaccctttttttctttggaaattcagcttataattgattcggtgtgaacttctatgaaaacaagcaaaactatggtctccagtaacaaattgaattgtgttgcataaattacacaacagtacacctgaagtactcgtttctaacattctgaatgttgaactgcaggaggctcctgatggaagagctcaagaacattgttgtctgctaattatggaaaacaggcaagtagttaaagtagacaaacacgcaccttacttatcagcagttccaattcagcaacaacatcatatataggttccttgagacacagaagtgaaggaagaggggcatgggccatgttcatttcagattatatagagatcatgttgtccccatgaaatgaaggtggttttccaatttcggtagctaatgtttggtagtgagaccagtgtcgatgtaaactaaaatctttgtatgtatctttctttcagggttcagattgctccaccgttttttggggggatattcttgatgcaatataaaaaaaggcgaatattagggatggcttgatgatctaaggctcccgtacatgttttttgcgagaaagtagctagcgagcccagctagaaacaatccttcttcttaagataatgagctaggaacatccttttatttgtccatctgtagttaactacaatgccttggcatcaagaatctccaatcaagaacacgttcacactataatgtgtctagcagcagctagcatcattatcctaaaaaaatttagctacatacataaacatttaaaagagtaaagtgtattgctggcacttaaatttgttcgtcttatctaggtccttgatattgttaaagtgtattattttgttctcaaattaccatgacatctttgagatcctatatggcactcacgtgtcaaattaccacgacacctttgagatcctatatggcactcacgtgtcatgtcacacgggtgttaactcattttctttatatttttctctttccttttcttctcttcttcgttcctactcgtgtgggaaaaaaatgagaaaaagaaaaagaaaatttaggaccggaatatccgtgtggcatgtcactttagtgtccatgtggcataccttgtaggatcccgaagaggtcttggctagttaggaccggaataacacacttaa

SEQ ID NO: 71479 - DNA, 14942 bp, Oryza sativa
tgtggcatgccaacgtactaactttgcttcattggggttggcaaatattctcttgaaacgatcaatgattggtagataccacacaaccttcgctggaccaccccactttgacttctttccctcgcccgcgctcttctttcgcttgtatcgagaatccttgcagacacgacaagcatctaagtccgcgtattgcttgtggtacaatatgcaatcgtttggacatgcgtgaattctccggacctctaaccctaggggacacagaaactgttttgcttcatatgtcgtctcgggcaatgtgttctcctgaggaagcatgtccttcagtattcccaaaagttctgtaaaactcttgtttgatcatccattactagccttcaacttcattaggtctaatgttgctgataatttggtgtgttttggcttgcatcctacgtataggaggagtctccgagtcactaaccaacctgctgaacttcatggaatctctctcgttcatagctgggtcatcaacgtcacgtaacatatcttgcagcatatcagggtccacatcaccatttcaccggccaatggagatgggacaaacatgtcatgctcttcttcatctccttcttcatgaatgtctgtaccacttccgtctgcagctgcaccatcagtacccagatcttgctctccatgcatcacccaacatgtgtatctctccatgaatccccggcgtatcaagtgagcgtgtacttacttttcatcttcccacaaaatctcattcctgcaatcgctacatggacaacacatgtacttgtcgtttcttcttatcctattctcctctgcggctttcataaaacttaatatgccatctctatactccttgtactgacgcctcaagccagtcgtgtacatccaactccgatctatcgctgaacaatgaacaaaatattagttaacatctcataacataagtactactaaattaataggaaatatttagtagccttttacttacttttatgattttcctgtttttgtttgcaaaaaaaattacaaaaattcgcccccttcaacctcccaccaaaatagtgaacagtgggataaactacagtcaatggactgctggagtatatatagtgtgcaaagtatatctcaatcgggccaaaaaaatgtcatctctaacgggcgcacactaatctctaacgggcacaaatagaagcccgacacctataagagtcatcggtgacgggcattaaggccatctcaatcgggccttctttggagcccgtcaccgatgacactcatctgtgacgggctcagtagttgggccgcgatgaaatagtggagtgtttctcaattgggcctaacttcgagctcgtcacagatgggtcatcggtgacgggctataggaatatgcaccccgacgagtacagtgacaacggctaaaatttacgcccgattgagatgacttagttctaacggtccacgttgtctaggcatgtgatgagccatcacagatgataggatctgtactaatggacgggagatgctccagggttaattagacccgatcttgatctaatttaatcttatatatcgcgaccagatatttggtatttgagaacacgtgcgtaaattcgtggccagtcaagtttagatattttatgccaccatctaatcttcgtgattaccaataatactcaatcatattaatcactaatggcttgtgtaagcagaataatcacgcgtacacgtatggcagagcctctacagacgtcaaaagagctagctttctttgggatcaaactagcttgctacacacataggctgttgatatcgcttccattgcactaaagatgattagagcaagttcaatagtaatctatagccaatgtaatagccaatttatacaatagttgtttactatactattaatacctgtttctacttatcatacatacattacatcttaaagtccgtgctacagctggttacagatctgtagcccgctgctattctctctctttttttatctttttaaaatatgtttatagctggcttatagcctgctattttacatgctcttacacaggttgataggctgctgatatgtttggccatatgtctgatagtttaatccgttgcactgaagaggatttattcgtgagtcgacgtacacatccgtagattacatgcacaggtatttcgtcgaatgtgcaagttctattcaacacagatttttgtaacacaccagccaaccacgtacctagagtgccacaccaagcatacactcaaaccactaactcccaaaattattagaaattttggcagagtctccgctgtaaatacggacatccacgacaggaaattataagtttaactaataacaatatcattcccacaatacgatccatccttataatcatggggaagaaactattagaaatctaaaagattattacaaaaccgaaccatgatatagtttaagtattattatggatctaggcaatatagtttgatagtgtgcagataaatgtgtatataagggtgctacgtcccgcccatgcatgtcggtctcaatatgtacctaaaaccaaataaaacacaagagtataaaaatactcggcaagtacaatatggaactagaaacacatatacacatcattggcaataaagcatgaacagaaggttttctttctttgataggaaacacattttcaaataccaagtcaaagaagatagtagttcccattccgggctggcatgaattgaaatagtagtttctatcccggacaatagtgaatacatcctaacatttgccggcaaagccgagtaagcgtgatcagctcttgcccacaggaatttgaataaagaatcaaattgcactcccatgactacgcatggtagttgaataattgaaaccggaatcaaagaaccaaattaaaaccatattgcacattcatggcaaacagggaacttgaattatttacccagaaccagaatccggaatattgaaacaagaataacatcgtaaacatatgataaacaagaaaagcaaaatagtgtgaacaaaaatatgaatataagcggtcacatgtcacatagaaatatatcggaaataaatagatagagcaaacaatccatcaatcacacacttagttcgtcatgcacttgcctccaatgaagggttggtatcatgcacgatctgaaaaaccaccacctaatcacaaacaaaacctcagcaaacacattcaacatgcatataaaacaatgaaaaaggtgaacctactgccctatcccatcaaaacgcaataacaaggaacgccgcttgcactataaacaatattgttgcttcaaacatttatatcttgaaatatgaaaaggctattaccgcaaacaaatacattttggaaatctacagaacaaggcctacaactcttatgtggaaatcatatttttattatgccattaaaatggtctaatttgcgcttgaaagcaggcttcacaatctgtctagaaattcagactatccgcactaaaacaatcataactggagttctacttgcccaatcagggtgtactttaccaatatggaaagctaagaaaaacctctacaactttgtctataggcgtcttggctgattccactgtttatcccatccaaaaatggttcaatctactactatccagattatgacataaaaacaacagttatactcaaaaattcgtatcatctaaaccacttgagataaaatcgcgccctttggtcagaagatagatataaatattatctacagcttcctagttatacactttcgcagaaaatatcattttgatctccgaaactttgaaaaaccgaaacactgtaaatctgccaacgtgcagaacagccaattcgaaccacaacaaacaaaactccttctctaaccttccttatccacgaaataaaccactaaaaccaccctagaacaattgatatgacaagggaaaaagcctcacctatggtttctttagagaacttgtgaggagacaataggggagactatgatctaacccctccttttactcctctcctcctcctcgttgcgtttttctattttgctttttatccaagttatgaaggcggagatctagggagagcaatttgttgtagaggggagagatgcgaacataggaggtgggagtcggttcccctctctctaagttttagggaaaaactaatgggttgggtttatgggccttctcatgttggcacacttctaaagatatttttcttttatttatttctgttaacttctttattttaacaagtcaacccaaactaaaaaaactaaatatattttaatacggggtattacaatttcttttttagtttgattgaaataatgaatatgttgctgatttttttggtgttgaattatatcttttatcataagtgcatggttaaggtaatcatgtcaataaattagaaaaatcccagacacaactataaaaaaaggtatttaatcttagttttgaaacaaagatatatattggtatattttctgtatacacagttgaaaactaccctctccatcccaaaatacaacttctagcatttaaaaattcaaccaaaaataaataacaactttacttttaaaaaaatatgacaacttctctactaatttttttctcaatcaattataacctttccccaatttaattctacctacttccttcatatttgtgtcataccctaaaatttattatattttgtgaccgatagtaataattaattttccctatgtcttttttttgtgtgtgtgtgtgtatatatatatatccatatgactactgtgtgcagtctgcaatttattgttatttgtacatgccgttacagttttatcatcataccaatttttctgacaaacaacacctagcaaaatattgtgccacagtagcaaaaaacacaacgccctaaaaactacaaaatttggatgatcgagactctaggataaaattgtggcacagtagcaaaaaactcaactccttaaaaactacaaaattcagatgatcgagactctaggagaaatagcaaaactataactgatcttaattagattttcaaatattgagattatttccaaaacaatagacaacaaaacacaccttgattggagtattatttagtgccaataaagttaattatctacatataatatgattcatttctggcatattaaccccacactttccttgtgtagtctgcaaatgttgttggctgggcatctttcataggacagattgatgaaacacaaacaagtcaggaaggtgcaaaatccctgaaattatgctctgaattgagtaagactattaaaataaattaatctacacatgtattggctgcattttgttttatcatgaccgttgatcatattacgaatttctgcaaataaaatataccttctggaacaccatagggtattcttgatttttttaactttaagttttcattccaaattgagtacaacttcaagcttattaattcctgagtttggaattattgaattaattaaaacgataaattcaaactccaccatgacaacaaataggtagtgagtaattcctgattttcaaattattaattagattatgaaatgctatagtggacactgcaaaccaaactgaccacaatccattatgtaccaattattaattttagaaaaaaaatcatgaaaaatctataaatcagagtccaagccatgtacaactcaatacttattaattccaaattttattcattagattaagaaaagaactaaatcaagaatccaatattaagtaaaggtattactaattaattccatcttcgcaaattattaacctaagaatatgaaagtaacaaatgagatgatagctaagatgtattatatatatactttataatagctaatttgaattttgaaattataaatttgaaaaatcgttatgtccttagaacaatgtaataattgtttacatactattaaaatttatctctatagtaattgggcattgcgagtcagctgccacattaaaaaaaagataaagacatgattaagtgatcatatcatcgtgaccgtatattatatactgagaatttgtattgcagataccgtgacactttatattagttcccttttctttctaaaattttgaattaatgaacataaattgtatctatttgaacttagttaacactttcttagttaaatttttgaatgcaaaatttgtagttacaaatagtgactaacatggactatttttgcatcgtaatatgctataattttgacaatgtaatttccgaactaatttgtgcattaaaaccctcatccaggaatcagccgaggtacacaaactgataatttaatgtacagattcatcaaaataactaaaacgataaatacttacataagaggcacttagtcctcaccatgaagaaaactgcagcggaaaataaaatctagcgaagcttcagctccactcccacaggcagcacaactgggatctaagccaaaggtcttctccttctggatcctttttcttcaactgaggtttgatgattattgcaagaatgagcatatgacatactcaacaagccacacagtatatatgcaagtgcataagaataccaaaggatggcataatatatggttcatttgtgaaagcagcatttagcaaagagttgagaatttgtaaaacagtagagtaattaatcatcaatattaatcagcactgaacagcacacccatgctgcataggcccaaccaaacctgaacaaccaaccctggtcgtacagatcaaacctccaaaccaggaattatccattccaaaccaggagtcaaattaattatcacattattatcattaatgagtagtgtgagactaatcacgaaaaatattgttagacccgcccataaccgcgggcacggctattcgaatagttttactctgaccagagatgtaccactgtacccacaagacacgattccacacatgttgccatgccctgaagtaccaccacggcactgcaaagggggaaatcgtgacagtactctttgcacaacacaactcaccacagcgcaccattcctggatcataatcaccccataaaaaaccagaggcatggactccccagtgacccccacggacttctcgccgcttcacagtctggcacaccataatgaatcatgctatacaaaagataaagccgttgcccacgctagcttgtggttggtacgattaatgtctcacaatagtagctcgcgaaccggtccttaattgtcatgagcacgaccttcaaaaccatgttctcacaacccaccattaatcatattttaattatcaattaattatcataacacgattgaccatcgtgagctaccattaaatataaccataaataataatgtagtatatataattcatcccattaatgagctaatgtttctaagcatggctaagcaattatatatatatagcatttagctgaaccaaaccaatatataaggttctagctaatcgaattataacccataggaaaataaagtcatcttcgaccattaattaattgggaaaggctcaccacccgatgacattcaaaaataatgcataagttgaaataaaacaatagctttaaacgggttcaacatgctcaaagggttgtttgggaactgtgtgacttgcctttgaaacaagcgtcttcaattcgtctttaggaacttctccaacgaacgaacgatcctccgaaacaacggaaaacaaaacctagaacgcaaaacgagaaaaaaacactaataaaaaccaaataaacagtacaattaaagttcataaataggtagagcttgaatttagatgaattatgagacttgaacgacctcattccgagttcgtatgaattaaatatgaattttacaaaatttaatttcaattaaacctattaaagaaaagactattccaaattgattaaacaatttacaaatgacttatagctgtgacaaaagattaaaacatcctccggaaatagattaggtcatatttggtagatgacatatattaaaaaggaataatatgccattgaaaagaaagaacagatttatatcgattttggacggctgagattaatctcgaccgagtcgaccaagatcggatggcttggattgacacacggcagcggcacaacagcggttgcggtggcacacatacagcagcagcacgacggcgacgtacaacgtctaaacagcgacgcggcggcaacaaggcagctagcgcagcggcgacgctagggcagcagctagcgacacagcaacggctgcgctagggttagagcaacagcggcggtgacacgaccaagggattgaaacctaacccgaggggacacggatagaagtctcaccgaaccaaagcgaccggagagggggggtcgacgatgacgatccggcgacacacacggaaacgatgacgacgctagggccaaacaacagattggattagattagattaaatccctagggataaactacaccggtaaacgacatgggagagaggagagctcaccggagaagacgacgacgacgaccaagacgacgacggcaaggggtgacggctagcggcagtggcgactagggcagcggcggctagggtgttggaggaggcggctaaacaggaggaggaggaggctaggggtggctgcaacacaaaaaaaaaggaaacaggaggggagaggacggcttatataggggaagattgaataggattaggtgggccaagggaggcccggcagagggggagagggagggactcggaggggagagggcagaggaggagcatggctgggagaggggggaggcgcacggctgggaggaggccgagagggggaggggaaaaagatacgggaggaggggttgcctagaaaggaaaggtgcgggaaacagatgtggtgccgttttgggaaaggaagaggaaacggaaccagaaagagaataggactcggctcgtcatacaaaacgaaatcgtggcggcaaagaggtcggcggatacaatgaaccgcagacagggagagtgaactgggaatgattcacaaccaaaggaggaaaaagaaagaattattaattacttttccaattaaattaatcactgaatgatctttcatttattaaaaatgcttccaatgctcaaataattctgggaaaaatctagaaaatacttggacattaaaaatatttaatacaattttatctatatcaacttaatgttcaaaattttcatagattttattcacacacttgctttaatcattaaataatttctaaaaattcctttttcacaacgatttataatttagcgatttttatggtgtgacaatctcacatagagagttaggagttccaatggacaaagatgaagtagaagacgagagcattccagactgggctcaatatggtggatttgatgaaaatacaaaaggaaggtggacagggctgttgaagataacgttggtgcgaatgatcttggtcagaagttgcgtgacgtaaaggaggacggcaaaagtgaaaaggaggtgcagaaacttgagcgcatatcagtggaccacaaaatgtcgttgtacccaggatgcgatccggggcacaaaaagttgggtaccacgctaggcacaaaattagagcgtatgttaacggaccacaaaacgtcactgtaccacgctggaattctcgcaatggaataccaaaattggtgtgagtgacaaggcatttggcgagttattgaaactcataaagaacattcttcctgaaagaaacgaattgcacgaaacaacgtacgaagctaagaaggtagtctgccctctatgactagaagtatagaagaaacatgcatgttcgaacgattgtattctctatcgcggtgaggagtacgagaacctagaagaatgcccgttttgtaaagcactatgatacaagattagacaagatgatccaggtgatgtcgacggacagccttcgaagaagagagttgctgctaaggtgatgtgctatttccctataataccacggctcaagcgttggttcaggaacaaagcgcatgctagaatgatgcgctggcacgcagaagaatgtcgacaagacgggatgctgagacaccccaccgatgagtcacattggcgaaacatcgatggaacatttcaagacttcggagtggatgcacgaaacattaggttcggtttaagtatgtatggcatgaatctatttggagatgagcagcagccgtaacacttggcctgtgaccatgtgtatctccaacttcccccctatgaatgaagccgaagtacatcagggtgtcgatattattgaaggcccaaagcaacctggtaacgacattgatgagtactaaagaccattggttgaagttctgaaactgcgtgaaagaaataaggtgtcctcgtgcgggatgagttcaaacagaagcaatttaacctacgagcgttgctgttcgttaccattaacaacctatctggacagtcaaacaagggatataaggcttgcaccctgttgacggaaaacacagtggcctaggggatctgcctaactttagtgcaggtctaagacttgtatcgagtgtgctaagggcgtgtcagcttgtttcatcctgcaaccagcaaggaaaaaagaaacaaggtgagttagcggatagccgatcggccgataggctgatgacgtatcgttgatggtctcagccgatatggttagaccaaattggctatagactgagtagatcaaagaatataaaaccctacatatcgtctgcttagtttgataaaatagatttcagacgatatcatgagaatagccgatggaacaatttttagagaaagataggtaaataaagataatatactagctaatactctagtgcaaacttatataaacaaatcaatctatagcaatctatatttagactaattgggcactttctatgagctctcacgttaatcagaaatatctaactgttgattaggtagatagttttatcgtggccatcgatctaggctggataaaattattacggcttggagttgattgttaccgccgagataataacagataattaactaccataattagcgtgatgtgcggcatatatgcagcatagcacggcatattctgccgctagcaggcacgttgagcgttccatccccagcagcaatcaacgtgtactgcatcaaaatcacagtgcctttcatggatcgatgaaagcatgcatagattggcagggctattgctcacgtatgatattcctcatcactcgcatcccatacagcttgaagccatcctgatgcatgcagcgcacatgaaatttgtacaaaacaaatatgcacgcttttttccatctcatccttttttttatttcttttaattcttatgccatttcatccatgctcgagctcttaattaattatttgtagtgatgcaaaacaatgaaaatctaacaaatctgcagctttgtgtgcatgctattgattcactaaattgtactccctccgtcccaaaataaatgtagttttgcactagtcacattcaacgtttgaccgttcgtcttatttgaaatttttttatgattagtatttttattgctattagatgataaaacatgaatagtactttatgtgtgactaaatatttttaattttttcacaaattttttaaataagacggacggtcaaacgttggccacggatatccacgcgtggctgcacttattttgggacggaggtagtattatcgtaaccatatatatcgtgcggagaattaatattaaataaatatacaataggaaatatcgttgactttcactttttctccattgtacccaaataataaagcatgacattttaaatagaaagtcggaattaataaacttgaagttgtacccatatcaaacacataatatttcgaaatttgaaataaataataagtaaattataagtaatatggacaaagttttaaatctaactggctatattttaaaattacacaatatcatgacaatagcccgtgcaacgcacgggttggtgactagtatatcaaattgagatcaattaccaggtttgatgacctagctgattactgatctagacttgatgtatttatatatgttgatctatctatataagtgataaatatacataaaacaagtaaagtagcatgtatattaaaaaaagatcagctgaaactctgattctatatctaattataattaatttcagattagtttttagggttctagacaagactagggatgaggcatctcaaagtaggtaaagaaacctaaagtctaaacaatcaacgaattaattacttttcaagatagtagatgccttagttaatctaatctagtaaaacgatttagccaataccaaaacgagtaccagccgatagagctaaattgagatactaagactaaattaactaagacatatgacaacagatggttatgataaaagaactataacatccaaaacgacatagtagccccgatagcacaagccattgagacgagttacctcttgtcgagagaactcgacgaaaagaagaacaaaaacggatgacgatgcgccgaagttgtattggattatttcccttattacaatgctctggggttcatatttgtaccccgagtacaaacatagtccattatgaacacgactcaaactttcctaaagataagatacaaacaagaccacatggcggtctgttgccaaatctctaacaatcgacttaaatatcctaattaatatatacaattgccttaatcgagctctatctctaattgacaatgacggttattccaatctagacccgaaacgagcccaagtcatatcgtatcggccacttgccatattggctaagccaaacttctattctgtctccagccgatacaatgcccagccgatgcgcggtccgacttcaaatacaacttgatcattcatcaaatccgcttcgatcttgttccttcttttccggatctgatacaaaattctgttgttaacacacccactacatggatgaaactgaaagtacgtatctaaaacattgtaggaaggtagtgtacatgggccatcgtcgattcctttttgcaagccacctgtacggaagaaaggaaagtacttcgaacagaaggcaagccaccgtactaagcctaaacattgcaatggaaaagtcatgtttgctatggtgaaagatctgaaagtagtatttggaaagggagctagcaaccaacctatagagagctaagatgcgcacgcggcgatctggaagaagaagtctattttttttgagagttaccctattgggaagtcttggatgtccgccacgcaattgacgtgatgcacctcactaagaacctttgcgtcaacttgctgggcttcctaggtgtatataggaagtcaaaagatacacatgaagcacgtaatgatctcaagcatatggaacaacgcggtggccatcatccggaacaaaagaagaaaggaagccattacttgagtaaggaagagaacgaaagtatgtttgaatgcctagagagcgtcaaggtaccgtctagatactcctcgactacaatgagaataataagtatgaaggagaagaagttcacaaaactgagcagctcacgcaaaaaattgctagtagcctagtatagccctgaccatgtacaaccttgctacgtagctttgtcagaagtgaaagtaaattttattgcccatccataaagaaggcccatcaacccgcggggggaggggggatggatctgctgccctcgaactccgcccaatgccgtcgtcaccctctcggggccaggggtggctgatccgccctcccgagggtggcgccgtcggatccgctgtcgccacccaatgtcgtggtcacctcttatgtggccaagggtggcagatccgcccctgccgaggatggcacggccagatccgtcggcctcgagctcatcactccggccagatcccatagcctaggacaccgccgttgtcgcccgataccatcaccgccgctcccgccgtcctctgtatcaaatcccgcggccgagctctgcatcccgcaaccgagggcaccaccatgcaattcgagggtgcttccgctgctcccgtcgtcatccacgccgaatccctagccgagggcattgctacggccgcctgagtccgctgtcctccgcatcagattccgtagccgagggcaccgatacccaatacgagtgtgccaccaccgcctctcacaccgtcctccacgctggattccatgtcgccgagctcactaccactcctgtccaacgctagtcgctcctacccgcgaccaaacgccgacccgcttgctgctccagccacgtgctcaagagggagagggagacagagaggggggaggggggggaggaggagtagaggataagagaggaaaggtggagtggagtggatttggtttttatatttagtttgcagtgatttttccaagtggacctcttaaggaggcgtctgtaaaaatctgattttcgcatgtggccacttaggaggctcgcctgaaaaggttagtccatttttacaggtggatctcttaagaggccgcatgcaaatgttattttgcatgcaacgctttgaactgaccccgtgggagggatttttgtaggcggaagcagttatggtccgtgtacaacctaaaaagggtctcatccagaaaaatcaattttgtagtggtggctgtactccgtatgagatatcctatctcacatgattagaattgggaagaaatccacgtaagtaaagtttttcttaccttgactttgcaatgtgttatgcaactacgcctaaccaaaatcaacaaaacatgtcttttagacttgtaggtttcatgactgcatcgttggagcagtatgaataacgacatctacgc

SEQ ID NO: 71480 - DNA, 5622 bp, Oryza sativa
cagtggatttgcgaagggggcggcgccgcgtccttcccccctccccctccgtcgctctccccaccaccacaccgccgcgtccttctcggcaacggcgccggggcggaaggtggccgaagcggggaggcggctctccctccctcctcgccgtcgcgcttcctccgtggcgctgatgagcaggggacctcgggggttgtggggggggggggtggcggaggacgactccgaggcgggcacggcggcggaggaccccgaagcgggcggcgacgaccccgaggttggcgcggcagcagacgcccccaaggacccagccacctcgagctccccctccaacgcggcagcgagctcatggtggtggcctcgccggtggccggagctctccctctcccctccgacgcccgtggcagcctctcccctctccccttcgacacccgcatcagcctctcccctatctcatccagcaccggcgcaaatcggggagacgggccacgaagcgcgaggccacagccgcacggccatgcccttctcccccgtccatttactgacgaagaatgcgtagccaagattggctacgcgaacctgggttggtcacgcagaaaacctagctagcagagaatctcctacgtggtaacagtaggtcgaatgccacataggaacactgtgaacgcccttaaaatccatacctttgtccattctcgtgcaacaaatatcgatcatgcacattcaattcaacagaacaaattttaggacaagaaatcaagtcatagatatatatacccgcgcaggaaaacttatagtacaaaatactgcaacctcctatggacaacaaatcattttgatatctctttgttattcagaaaatattgaagaacaagataagacttatttctccacccacaaactaaaaatagataaggtgaatctagtgggggatcataaccatgttcacgccattgcaattttattaagctcttgtactccctccattttttctaagggattttagcacgagactgtgctattttcattaaatatagcaggagaaaaatataacccctaagggcaaagaaaaaggagaactatacacaatgacgaggaggcctccttgtggtcaaagatcctccggttacgctcattccaaatttcctaaacgatgaggaggaatcaaggtacgcaggcccttctggggacgcccaccgaagcggccagtccctcccaccactcttggaccgtctgattctctccattttaaagcgcaagatttgttttattttattagaacggagacaatgaaatcctagtgtatcaccagaaatgatagagcctatagaatatcactcctcttcagaaagtaaggaattcgaactattgaaagaaacctccaataaaaccatacatcgataatatatgaggtcaaaaggaggctgggatgttatgacaaatacatccatggctctcgactacaaacgtggtacctttggtatttattactcccttcgggctgataatacttatcgttttagatacgggtcaggtcaaactttagaatctttgattatgaattagttttaaaatatttgtctttcaaatatggtgactacatgtatagattagtcttaaaaagtactttaacaaaatcatatatttgttaacacttttatatatatataataatggaaaataatggtcaaagttgtttatttagaccgtgccattgtccaaaacgacaggtattatcaacccggagggagtactatcacaaataaattcgtaagagcatggatatcgttgtagcatttcactcgggagtatttcaagagtattgttatttgtttctctgcaaggaaggcggcaatgtaaagaatgggccatcataatcataatcgtatgtagtatgatcaataatattgtagtctagctagggcaaatgacaatgataataaggtactgtgacacatcgaagaatcatttctataaataacaaaatagactaaggagaaagacaaaacataactatggtttcatatgtacttctatacttacaatgcttagattatactcaaacaaacacatgattatacaaggtttggagttggttctatgcacccagtggcgttatacaaggtttgcagttggttctatgcacctaggcgccgagagaccgctccttactagtctgctaatgtggttatggtattttatgaactcttaagtcatacccgaacatgaagtattacaaagtatggactaggctattaccgcacgttgcctacctctacggcccgtgaggcacgcacgcattcaacaacatttaatcaacccaagtaccatgcttgcattgctaaataatatgactagttccctggggacttctattctttggatggacaagtaagaactagtacaacccgttaagatcattggaccgatgtcgtgacatagatcgactagcctaaacatataaagcatatgatagaggtataaactactaatttacaaagcaatatatgaactatgaacaccaataactaaataagataatttcattactaggctcgaaatcttataaagatataaaagtactaaagatataccttaatctctgagaagactaggaaaccgaagaactactcttagtctaaactcaacttatctagatagtaatacaaatgagaaatacagagattgcttgttgagtgtgtgttgagagtgagagctttctcacattttatagctcccaaggatgattgcaaatgtcagtgaattaagtcggttcacccctaactgccatcaaggaccaaagtggagctggcacgtggaagacagagatgagacaggccagaactggtttggccgacccctggttctggtttgagccaatccagggccaccatctcttcaccgaccttctcccagagattgacatgtgggcccctagaatggcacatggtggattagccttacgtatgtcggtttagtctaaattgtagccttcaatccgtgtgcactctcgtgattggtcggatgtgtgtttctttgcacactgacttattttctccttcattttgtagaaaatccttgcatccatagtattttccgtggacaagtggaacaactatattatttaaaactaatatccgtgtaataaatgttcgttgtattttatttatttagataattgatggtctgagatcagtatttataatgaccgtcaacacactccacctaacaaaccagcaccatttggctgtcgatctctatggaaaaacactatttgagatccattgttaagctgtagattttgtataaggtccccggatttaaaaaaaaaatgtcagggattttcccttaaaatatgaaaaaacagggcaaatttcttgttgggtcccaggcaagaacccatagaccaatgggcaccatgttatatcttgcatgcatcctttttctcttttcactgtacaattaacagaagtgaataaatgatactgtatttaaataagaaccaataggtacagcttgggctagagttacttcattagtatgatctggaccaacttatctatacctaattttgcattgttgcaacacttccatacgggtttacataaggagtttgcattccaccttgacatcactgtcggagggtctttcatgcataaaaccccatctgaaggcaaggaaattcttggtcgtatgtcagaaaatacctccttcgttggacgatgctctgtacacctccctaaggcattagtgtcaggtcaggaggaaccctgtatagccaaactggaacccgaaccttccatataatcgggttcgactaagagtcctccctggagccatctccgaataccaaagaaattcaagctccgggttgcactcctgcattcagggatgatctttatgaagattatggaaacaccctgaattattccagcaaaaagaagcctcgtcccaagcataagacgttcgaggaggggatattggtatttcgttggtttcttctgaacccattgccattttaaagaaatgaagaccttcattgccctcataaaagcctaagccttgtccctctaatcctcagaacgttgttattgtttatcatcaagaaacaacctggttcttgcacgatgcatctcttgagaaggagaaccttcaggtcatgtacaagcttgagacatcgactctgaagggcgagagaaaacattccacaaatgagcattgaagtttttctttcaaaattctccaggattcatgctcgcatatggtatccccagagacctaccgcttctctgtgcgaggatcacaaccaccttacggtcctcatttttaatatatttagaagtgtggttgtggatgcttatatttatcataaatgctgcaaatctcatatttgtttgtggcactaatctagcatatcgatgtccacatggtcaagcttgtgaccataaacaaagcactatcgagagatagcccgaattactacggtaagtttcttttctaatgaaaataagaaccagtttttaggatagtatgcaccttccggtattcttggtcgctaactatttcaggttgatattaagaacgagggtcatgcaatgcctaagaacacggtaactatatcaactatacactttggtgatccttggtgttagaacacactttataagagactccaacattagacacttgagttttgatgtcttgcgacacaaaagtccaactgtggggtgttggtatttcttaacgacattacaagaaatataattcccagtaatggcgcagaaatactcctggtatattatggttacagagttcatctgcaagcgcacggatataccattgtagcatttcacccgagagtattccaacggtatcgtatttatttaatcccgggggaagattatagtagagagatcctgactaataatttatatgttacttgtaataatcatagtctaagcaggggttaagataaatctaagggtagagtgacacacaagcaggaagctactaattctcatactaaaatatctaagctaagtggaaagaaaaagagaaagagaatctattcctatagttctagtatacatagtatacatacatcctagttatctgacatactagctaataccctctatccgataccttcctggtacttcgagaagccacccctgactgccgagttccttacgacagcccatcatgaccatacaaccggggctaaatacggaggagtaccctccccaggaaattaacttaggactatatcacaagcggaggaatacccatactgagctgtcgccatcagcggcccacctctcatccgcagcatataaccccaaataatgatatcccgtaatctagacaccacgcctaaactacctgatactactctaatatcatcgtcatgacatagagtaattacataagcaaacactatacccataccaaagcatctcccagataaactagcagtataatcagtataacatgcacataatgtaaagttgacattcatatactcggaaagtattccaataccataaatgtataaagaagagtattccaataaaagtacaaagcttacaaaaagagaagataagagcaactagagccataccc

SEQ ID NO: 71481 - DNA, 1363 bp, Oryza sativa
agacccatcggccggtggcctggtcggttgcgaagcaaccacaatagccgttgacgcctccacgttcggttgcgaagcaaccacaatagcctgtgatgccggaggagaggccttatcctcatctcgtttcgcactatctgccatcgttctatattataggaatgacaataaaaattatttaatgtgcgtacatataaaagaatttgaatttattactaactcaaagtcatataaaaaaattaaaaatatctaccactcggacaatgtcatataaccgaaatctcatatcaaagcaccatcatttagcattaacagaaatgtcatataaaagcactatctaaatgtcatatcaaagcaccatcgtttagcattaacgaaaatgtcatataaaagcactatctaaatgtcatatcaaccgaaatggcccgaaaatgtcatataaaagcactatctactcggacaatgtcatatgaaagcatataacgaaaatgtcatatacaagcatttactgaaagtcatataaaaaaattgaaaatatcttcccaacatgttatttaattaaaattgaacgaaacgaaaccgacatttcctacattcaacacattcatcctgcatacaaaattcacccttatatatcacaaacaaaacccacatttccccattcacatgtatgagcacatagcacatagccacatctcatccaaaaaaaaaacaaacccggccccacatgtcagccactatcatcacacacacatatatatgccacacacacatgcacagagtcgtggatgaggagtcggggatgacgacgatcggccgagttgcgcggagagatggtggcggccggccggaggagaggaggcgcgccggccggagattgatggaggcggcggccggaggagaggcggcatgaggttggagtggacggcggccgcgagcttcgagtggacacggcggcggccggcccgggcgtagctaggaggccgcgccggccggaggagaggcggcgctagccgcgggtggcggcgctggaggacgaggcggcgctggccggggaggaggccgcgccggcccggccggatggagaggtcgcggcgtgcggcccggctcgaggagatgggcggcgccggcggccaaacggttacgaggcggcgcccagcggtggtggcctagcaggcggtcggcgccggcaagggaggcggcggtcggaggagaggcggcggtcggatgagagccggcggtcggaagcaccaaaaatttcggtagcctaacggcgccaaattttctagggttcccgcctggactttgagaatttggcgccggggtggtcgcgcttttataggcctcctatcttcgcaggcgg

SEQ ID NO: 71482 - DNA, 19383 bp, Oryza sativa
tatcttacgtctcaacagcattgtgccaacggaacacgccttcaaggcacaaggttcctgcactagaggtgtgtgcataaccaaaccactcgcctaagatggcatggtcaaagtgccttcctccgttacaactcgcatggagacagacgagagatcgacaatcatatgtgaccatgccactgctccagggattccaacatacctatcatgctggcagtaagtacactcaggtatgtgaaagatagaacaaggttcaccaaacctttattcaatagcaccaccatgtgaacatggcttgctcatatatgttatgcttcttaagtcaattttttgtatgacgtggtttgggtattctattgatgtacacccataggctttttaaattaaatgtggtgtttaggttgaaatagtctgctttaatcaaattagacatggtgtcgaattcgattaatgaaccgttagagctagtactttcatgggcattggatgtatatcttctatggactaacctctgcaggaaagttttcaatttgacgggtaagtcctcatgttcaattcacactagagataagttagggcccgggaaacatagcgataaattgcaaacatgcaaaggagtaacacatcaccttttaaggtgcactgtgagtatactgtcgaatgctcgttggttatattcgtgcaattttaccttagccctatataagttttgcctaaacgaaaatttggtgagcaacaaaaaaaattaaaaaaaatgtttttagaagtgtctctcaaaaaaaaataaatttggtgagcaaatttatgggacccatgcttctcaaaatttttttttgatgcaaacgcttctcaaattttgaacacaatttctctttagcgtggatgtaaacaactaatcttgaggcatgataaaatcttttcaattttttgtagtccaccgagtatttgttgtccactaacctcttgcacgaaataaaatgacaactaaagagcagcatacgataactccaataccaatactgtcgacgtttgatgtcgcgattccggtatttgtatggtatggggatcattgatactaggatatatgcgagattgtagtaaaagagatggagacgaagatttttatacaggttcgggcccctgaattgtcaggtgatagccctacatcaggttggccaaagccggtattgctcttattcaccataatcacaccagtacaatatttagggtagcctatctaactgttgtcgacgtggcgggctgtagtactgactcgtagttgacaacagggtagccctactcctcgaatccgcatccggcgagatcagagacagtgctatatctctcctgacggtagccataggcaccgtaggggactagccatgcctatctctgaaatcgatatctggcgtcttgtcttggcgtatgttggcttgtatgttgatcttctgtcttgatctattgttccgtgtcccctctcctcctaggggccttgtatttatacccataggtgtccccttgtccaagtagaactagggaaaccaatatggatacaacccgagtagttcttgtcttttccatgtagaactctattcatccttccttatacggaactcctcctatatccgtaggtcatttccgtataagacattgtacgtggtggtcctgccaagatttagtcgactactattaggtatgtggtatctataaccctgacagtagcccccgacttcaatgcaaatgaacaaattcatattctcaaccgcagaccttggagtaactgttatcgagctcacgtaaccgttctcggtgagttcagagataacgttggacttccttatcagcctcgtgcgggcacctatagggtttgtctgagtcaatctccgacgtcaaccaagaaagtacagagcatatgactacgtctcccgtcttgctgtaatcgagaatttggatggaagtcaagaaattttatcacggcgggtacaccatctcttcattccgtattccttgtcgagatccaccaaccattcttcaagcaatcgagaaggcgtagaatctacgacgaagccttgtcaacatttgtcgtactcgccttagtcgatcttggtgtagaaccatagagacatggagtcttcgacaatgtcgaatagaattttcctaaaatcaatactcagaaaagaatattagatagaaatagcccccgagcgaacgctcaaagggtgacatgttataaaatgtatggaaaactaaaaatgaattaaatttacaaaccaatgttttgtatatgagcgtcttctcttttaccgacttcgatcactcagtttgttgagtcatacactttccctagcccctagccttgttgtcggagaatcgttctcggaggataaggctcttggacccttgacctgccttggttgaaaaagcactgaccctaaccccccgccgtgaagttggaaaactcaatttccgattacacggcttggttaatacgcacggcgagaactcttacatgaccaggtcttacatggtcgtttgtctctacatgatccgacaaggccttatccgctctgggtatccccagccgaagttccctcaggttcctcagaggccttgttaggacggcgtaaaggaacagtaggattggtttcatctctaggtgtcatcgtggtaagggatctctgggtaaaacacttggcaatattgtgtacgtgatatcaactttgttggagtagaggtaatgggaggatcgctacactgctagtcgaaaaccagttgtagccccaactcaaccacttgaagtaaaggtagtgggagaatcgctacaccactggtcgaggaccaggtagtagtcgcaactcgaccacttaaagtggaaatagtgggagaatcgctatactgatgttcgaggaccaggtagtagtcgtaactcgaccactagaagtaatgtacgagagatcgctacgattgactggttgagaaccagtgagttggtacgagggccgctatgctgccggtcgaagaccagtcgcagctgtccctcaaccatctgaagtcatctgaagtcgtggtgcgaggaccactacgctattggcgtagtcgtacctcgactatttgaagttaaggcgtgagagattgctacgatttactggttcgagaaccagcgagcgagtagaattatctctcgaacaccaatggaagttgtggtgcgagagatttctacgatttactagttcgagaaccagcgagcgagtagaattatctctcgaagaccaatggaagttgtggtgcgagagattgctacgatttactggttcgagaaccagcgagcgagtagaattatctcttgagcaccaatggaggcgctagagttggtttattacatatgcatctcatgtggccaacatgactcacatacccaacttgtagcatatccggatgtccatccgcaatcatgtcgggtgatcaagccgacatcgtttgcgagcaattatccgttaacaaccttttctcgaatagcccagccatggccggtgctatagatagatcgtcggtcttcgtcggcaggttgggcgcgaggactctgcatttgtcgagatcgttctcaataatagagtatactcgaccacaacctactcgagtactcaactgttcctgaaaaatattttctagaagacaagacatatagcaggtaatatcgagtatgtactcaaagaactgcaagaatcttatagtattatcaggttataacgagcagattaaatatcagacattatgtaaacagtaaacaagcatgatttatacataaggaaatagagcgagcccccagtgttaaaccgtagttggcctaacatcggtaacactcgcataatagatattgtataaccatgctctaggtaaacataataaattattgatctgacaatattatatttatctaaataaaatagatatggtaaattatatataaaatattgcatacatgtgtagatatatgccggatatatctacagaatcagtagattaatttaaaaatcaatcctgccaattacctatgttgttatcgtgtacatgtagtagatttagctactcatgtacgcgtggaaatccttttattgatgcactgacttggttgtaaagaccaatccatgcacgtgactccttggtctagtctgacatacgtggtttttgccatccatcattgccgatcagggctctgttttcggttttaaatgtccgagtaggatttaaaccaaaatacagttcggtatgtgtccggatgacaaccgaaatcggtcgaccatgacatccagtacctctgccgtagatcgctcatatggtcggcgtgctgcgccccggttgtccgtcttgagagcaaatgttgcggcgtcgaaggtcttgaggcttggacgatctcgacacgtcgaattgttagcgacgatggttccgatctcgtcggaaaatatactccggttgggttggatctccccacaaccgaagtcgtcgagtagcttgttgtcggagaatccatctcttaaacccatctcgtttaaactctgaagcaccaaaatctccctacctgacgcgccactgtcgacgtctgatgtcgcaattccggtatttgcatgatatggggatcgttggtactaggatatatgcgagattgtagtaaaagagacggagacgaagatttttatacaggttcgggcccctgaattgtcaggtaatagccctacatcctgttggccgaagccggtattgctcttattcaccataattacaccagtacaatatttagggtagcctatctaactgttgttgacttggcggtctgtagtactgactcatagtcgacaacaggatagccttcctcctcgaatccgcatccggcgagatcagagacaacgctatatctctcctgacggtagccatatgcaccgtaggggactagtcatgtctatctctgaagtcgatatctggcgtcttgtcttggcgtatgttggcttgtatgttgatcttctgtcttgatctattgttccgtgtcccctctcctcctagggggccttgtatttatacccataggtgtccccttgtccaaatagaactagggaaaccaatatggatacaatccgagtagtccttgtcgtttccatgcagaactctattcatccttccttatgcggaactcctcctatatccgaaggtcgtttccgtataagacatggtatgttgtgggtcctgccgagatttagtcgactcaattaggtatgtggtatctataaccctgacaaataccatgctccttggcctcaagggaaaatagatgctcagtgaaccaagcaaaataaatgcaaagctttgttgcattaactcttgcatttggtttaaagcttggtaagacctatctagtaagaatctcaaacaccttgtgcatcatatctccaccctgttaagttacccatcacctccatgatttccatggaaaaaaaagatatgacaaactaaaataaaaataaagtaaatttaggtacttcatacgcctagagttacttgaataaaatttggctcaccggtatttcaccccggttgtagcctatttctttttctatgtttttgttgaatgaagataaggtacaaaataagtgtgggggagtcttttttggaactcttgacatgcaacagtatcaactcaacatgtcaatattatgaacacaggcccacggccacgcacaaaatttagcagccagaactgagtcctggatgggtcgaccgaaccaagtgttcgtccgaccattgcctggcccagctctgtcacccctttgccatgtggtcaggtttgtgcatctcctcacctgtttgtgagttaaactttcgcagaaaaattgaatacaatttagtttaactccaaataaaaattgaaaccattaagtctcaacaaataaaattttcctatgactaatcatgcatactttttattccttgctaacacttgtcacttgtgaacaattatttatcacagggaaccttactcatctaagtaattgatatatgtgatctggttatgacaacataaattcttgtccaactgtcataatacctgagattttgtttttgcgaaaattaaaattcttttcgagcaatactcctcaatgactatattattacctaccaaggccatatatgattttcatttcaaaaccttatatatgtctagtctgcttgacattacattgagctttgtcaaaatattatgacccgtgtaagatgcttttcatgctttcatgatcaaaatcacagacatccaccacatacacgcacttgtactaaatttctacactggaagttagtatatctcttttctcattcattccaactatcatccacaaaataaatactccataacatttatgcctcttcctccaaagttctttaaaaaaagagagaggggcatggctatgcaaaagaaagaaaaacaaagttttgctctcttataactatgaagcatcatgatgaaaaaaaagagaaaaagcaagaaaaaaagatagccatgcacaatcccaaattttcaaagagagaaatatggaggagggggtataccaaaggagttgctattatctttattttcctttttccatccacaacacttgctatacacaaacccatacacatatcatgcacacgcacactcttgataaaaaactatgacttgctatctccttgggtccagtcttttggctttgcaatatatgtgatgcaggtatgccccgattaatccctaccgagctccacatatacaaccttttagaatggggacaatttggcaaaactatgccttggtgaggatccacaaatcaacaccacatgagtgatttgagagaaagtcatttgagaagtatagctactttgtgaaaatatatgaaaacaccaagtgattaacaggagaaacaagaaagaattgagtcacgaccgttccatttatcaattacctgagatggtaagttagacaccgcaaaacttcacaggtacaggtatgtggcttagaataatttgtatacttatattatatcttggaaagtttattctaaattaatccttaacctttagttgggacgatcaaagagttaaacgtggggtttttttatggctattaaataccaaattcacaccgttcataaaactaaaaatataaaatatccaacatagtggcaaggtttatttctaataatttccacaagtgttagtgtatatttggatgcaagtgacaaactaccaaagttgagaagaaatacacataaaggaggaggaaaattatattcatgtccaagccaatgaagtcttgggcccataaacccaaataaatacttataattgggcccaatcaccatgccactggattaagggccaacctgccatgatcctggagaaaattcggagccaaatgggctgaaaccgaaactgacctgttcagccccaaatttcactggcagctactaccgacctcccaatgatggttgtgaccgtttccggcgctccaacaatcatcaggaggacatatggcaaaaggagagtgaagatgctcttaagattctccgcactcccaaggcacctccacctatattacccctctcttccctcattcacaacacaccaagtatgagttgaattacaagaggctctattgtatcttttatgattagaatagggagagagtaagggagaaagagtcggaggaattctggagttgtcggtactttcctctctacttttgtacattttcaattactcttctttaattgataatatctttttcgagtaattgagatttactttgtgaggattatctcttacttagttcctaataacgtactggaatactgttcactagcaatagtgtttactttaatgtttgatcggcattagagtagtatttaatagtgtagacatggtgtctatgctattgagtacatgtatttgttgtgtatcccatagtttgttagaggttggtgtagagatagtgacccgaagtcatccctatccgggacggagtagagcacgtcctagtagcagcgagcaagcccgtgtatgaagtattgcgataggattaaaatttagctttctatagacattgtttctcattaggaaatcatatctatcctttgcccatttttgctttgtgttcttggatgaacttgaagaggaattgaacacatacattccctgtggaaatttgataccttggagtactccggggtgtagtgcttcaatggtatctctgtgtgtttctggattttatctgtgaccgtaagaaataccaacaatgttgtcaaaacaattgaatatggtgtactagaaactagtagtggactaaatcaagatatagggttatctagacccggtgagactcgatcgggttctcactatagaaccgttgttaatattattgctactagaaaaaatggtcagagacgttttattcagtgatacaatagctattaggagctgagcaataaattgaaacattaggatcagtatatacattataattgaaaaagtcaataaaaatattcattcgttttgggccgaaagcccattctttctttccttttcagccccagctcagtccgctacctccctccgctcggtctgcttttcttcgacccagcccacaagtggagccacaaacctaggtcgcacagccatcttcaacctccagacagcccgttgtaccagtatgccggagccaatcctccccgtcaaatctgaccgaatctttctcaatctcccaaaattacttgagggcttttgatcctctcgatctccttttgtggttttttcccaaaatcggaacgaatatgcaaaattgggatgaaaagggtcgggccagccataatcggggactaagattaaatctagtgaattaaagccaaattaaaggggaaattatgagaaaaatgataagggagaagtggaaaaacaaattttgaaatcaattgaaattaagaaaacgtaatgggagacaaatcgacgtggtggcggcgctagggtttggcccagtagcggtagcgggaggcgcactgcccgcgcgtggaacgatggatgagataaaaaagggcaagggaaaaacaggaaaaaacaaagcggaaaaaagacagaaaaaaccacgtgaactgaaaaaaaagtgaaaaggaaatcagatgagaaataaaaaggatacggaaaaaccgggaaaaacgaagggaaaaaagacagaaaaaaccacatgaatggaaaaaaaactagcgaaaaagaaaaaaaggatcaaaatactatgcggaagcctttcttattttaattaggtatagatgtatcctgcaattcgtgatgaacttataaaccttggagaagatactgcacaaaggaccgaatggccaaaaatacatgctatagttggagtttttttagtcattttattttatttttagtgcacccttgatgcttgtcattcttgatacacaaatgatttatctgagtgtttgtaaagaagagagcattatattcttaatgcaatgacactcgtgcatttgccaaggagtagaatgcaagagttgaggtctgatgggtgtgttgcattccttgaaagggtcactttgttctgcaatagatatggtcttgaatttcatgaaatggatggtgtttatgtgccttatggaagatctcaaaggtttgcacgaaatcaaacgaatgatgaccactttagaagagaagtatatattgggatcattgatcaaattagccaagaatttgacaatcactttgacgaggttaatatgaagttgctttcctgtatggcagccttgaatccaactaactcatttgcatcttttggtacacagaaggtatgtataaatgtataattgttaatttcatttgtatattgtatggtattcctgaatcctgctaagggttgactcattttttttattcacacaaggtgcgtcgacttgctgagttctaccctaatgatatttcaagtgctgaattattgagacttgatatgcaacctgaaaattatattgatggcatgcgaaaaagaagatgatttaaaaggcctacaaaatcttgttgatctcttggtcaagcttcgccaaacaaaaaggcatatcgtttatgatttggtctacctgcttcttaaattggtattgacactacaacaaaaaccttatgtagagactcttttgtagagagacaacttttaaaatgcctctaagttttgaagctctatagtctagagacactttttagaggcactttcaaaatcgcctaaaatatttttactctagagacactttagagacatttttagcatactttgttaaatttatctcgtagagacatcttttcggcactttaaaatttgcctcatatgtaaaggcattttctaaaggcatttaaaatgttgtaaaggcgttttttcaaatattaatatatatcaagtaactagatataagtaacacaaatcacatatttacatgtaattatatgaggttgagatggttagtgcattgaagataaaaatagttgacttaggaggtcatgagttcaaggattggtaagtgataatatttttattttttatattgatttgctatagttgccgcaacatattaatgcctctacaaagtgcctctatttgcatagagacatcttataaaatgcctcttagttcatagagacaattcaccaaaaggcacttatggagacactcttcaaaatgtctctatagcactgtaaaggcattttaaaaatgtctctatagtattaggaaaatgtctctacaaggtatatttgttgtagtgtgattctgccggttgcgacgacaagtgttgaaggagcattttttgcttgaaatttatcaagcataagttgagaaataagatgtgtgatgaccttttggatgactgtctagtcacattcattgagcgcgttgttttctttaaagtggatgaagaagataaaataaacaatttcatggccattagaagacgtagacccgataagaaaaaaaagtagtatggtaatcttcttcaaatttttatagccatattactaattttatctattttaaaatgctttattaatatatcatggtatacttttggtctattctattatctatacttgcattgtatgtattatcatagttagatttactgtgtcaagaaaaattttaggttggtgttggcaactttttcggcaagaagacaatcacgattggaacatctaaacgccttgcggttatatggagtcgtcagccaccccaatctagccaaaggccaaatcaagatgtgttttgtagaaagaaaagctaaaccggctagcggagctgatttagagatcaaaatcagcctctaggctgatttagatcaatatgagaataattacccgtcttgtgggcaaacggaaggtttacgggacaaacctacaaagggggaatcgcactctcgcagcaacgacggacgatttacagtacaaatcgacaaagatggactaaagctagagtaaagtagaaatcatggctgaaagtaaagataaaagaacgattcgattgtgttcggggggaaagagatcaatcgaaccggccttgtcccttaaataggggttggtcttgcctcccacaagtcctcctccacgtccaactcagggtagaaaccaatggaaacccgaaacatacactgctggagaaaccctttttaatcccggttcgtaacccctctagtcccggttatgcaaccaggactatgaatctgggactaaagatgcccatctttaatcccggttgaaataaccgggactaaagatccatctttagttccggttggtaacaccaaccgggactaatgtttttttttggattgcatgatttcgagccccacaaatcattcataaaatcatccacaaatcattcataatccacaaatcattcacaaaattcccaaatacatctactctatatccccttatacatcacaaatcattcacaaaaacatctccgaaatctacaacaaaataaaaaaaattatccacaaattcatccacacatcatacatcgcacatcgcccagatcagaaaattcatccacatcgcacaaatcggggaggggaggagagggtctcgggtgccacgccggccgccagccctctgccacctcgggctccgccgccgcccgccaccttgccggccttgccgtccggccgcccggtggccggatctgggagcaggctcggctgcccgtggccgccgccgccggtgggaggggcaaggggaggggaggaggggcagggggaggaggaggtggagaggggagggagaggaggagaggagaagaagttaagaagataaggtagaggaagaagataaagagatagcttttttttctctgtacctgtgcgtctctcctcccgcgtgcgattttttctagatccctcatgcacgcgttttttttttatctttcctccgggttgatataaacaaccggttttaaatatcaaacgggactaaagataatagggtgcctgccacgtcctgatattgaatgaaccgggactaaagatgatttcttagtcccacaccacccaggactaaagatcactgaagttctaatccaggacgaaaaatgatctttagtcccagtttctatttaaaccgggacaaatgtggtttttagccaacgtagccaagatggtttctccagtagtgataccttcccaagcaagaaaacccgagacctgacaaaagcaaacttgggcacagagtctgcaggtctgaccggccacacaccttcggtcataccggccctcaagtaacggtctgaccggccaacatacggcggtcagaacagccctatggaggaaaccgacgatttttccaactcttagcaataattccttaatttgaacctaggtgtcaacagaacggccctatggaggaaaccgacgattttttcaactcttagcaataattccttaatttaaacctaggtgtcaaatttgggtgtaaatagttggatcacctctattctatatcctagctccgccaatcctctctgcctaactactgcagaagcagacggcagttcagtagcctgtgccagacgaccaaggagctaccggcatatgccggcgggcggctgccgtcgtgtcgtgcctcagcgcttgcggagacggaccgtccactagccgaaccaagaacgctcgtgaagggttctgggtatgatggcacgacagcaagtgcattactcgacccttcagtctgactcataaaaattcatgacattccatacgggaattgtttttttctggaagaaaagccattgacgatcattacttaaaaaagaatttttgcatgcggtgaaaaagggttttcacgtgcggatgcatatttcgcccgcacgcaaaaataaaaaaccgaaaaataagataaaataaaaaatccgaaccctaaccctagaagctgccgtcgccgtcgttgtcgtcagatccgctgccgccacgcctcctcccgactgaccgccggccgccgccaccgccgccagatccgcgcagatctgggcgggccggtcgcccctcgccgccttccacgcgcccaccgacgcgagcacgccggccgccgcaatccgccgagccgctcgccgccacgcccaagcccatcacctcgcctcaacgcgagcacgctggccgccacctcccgcctcgtcgcctccccactcccgatcccgccacctagtcgcctcgctcgccgccactcccggccgccaccgtgtcggcgtcaccgctgagccgcggagaggagaggagaagctagaggagaggagagaagagaaagagatagagaggagaggagagagagggatgagtgggaataaaagagagagagatgaaaaatttaaagtgagtgagagggaaaagagggatgggtatttttgcgtgcgggccttttaagaggtccgcctatgaaaataggctcatttttcatacggtccatttaagaggcatgcgaaaatcaatttttccgtgcggtccttttgagccgcacacaaaaatagaggacgattttcgtaaacaactagttatggtccgtctgcaatctaaagatatccctgtacaggaaagtcattttttagtagtagatgaaccaggggcagtaacctcgtgttgcttattatgactaagagtaaaagcagtattatcaacaactaaaggctttttatcaagtgtttctctacctttttcattaaataaatccagaatgcgcctgcaagaatgacgcatggtgactgtcagggaaagacgcagttttggacatcaaaaagttattcttggcagcccagaccgacaaggataatctttttttggcggtactaactatcaagaataagtaatttccttggcggttcaactgtcaagaataaataattttcttggcggtttctcggcagcaaaggaaatatatatccttgttagtccagaccgacaaggttatatttcttgacgctttcaaaagctcgcaatcttcttaatttgcttagcggtccaaccaccaaaaagatattcccttacggttaccagccaacaaatctgaatatccctaactttctagacttgacagtttttacttggcggtcagccgacggaataatgaacctttgcaattttcatgcaatacttgttggttttttaccgccaaggaaattatggattcttgttttctcagcaagcatgtttcgtcactcgataagggtaatggtagaagatgagtcacattagcttttacctcagttttggcatccgtaggggagggaaacgcgatatcctcgagacaccatgtcaatctactttgtagcttgccctcaccgccagcataacttcctcgtcatggcattcttgcgttcctccaacagttgacaaacctcctcgggaagttgctagagtaagccgacgttcttagcgtcgacattggaaagatcatcctcactgttcattgtagtcgatggcttgcttttcatccctagcagagtcgccaaaatttttgttggtgcaaatatcggctaaatatctagttctagaaacaggagtatcctgtattcacaaactcactgtgaaaacctacatacataatagaaaaaaagcctgatcggaccggcaattcgaccaaaaaaaggccggaaccagatgtcagcacggcttggtttcctccaaagaccagacatgtattcaaactgttctggactggatgaactgatcaaggaaagttgcaatatgtgggaatcgaaccctggtttgttggaggctccaagtcctagccatcaggctatccaacaaatagaagggaatacatgcacgatgtgaacatcggttcgatcgcctagcccaccggtcaaactagtgaactagtgaaccaagtggtcggtcgggtcacccactggtctgtttattttctactaggcctacaaacaccgaccccattggagcaggtccaccaagggttgctctagggtccgcagaccacctagagcgccttcaatcgctgtagagacgaaggtaggatagaaataagggtttggaagggtaaagtgcaaagagatagaagtaaaaagtaatagattgattttgtcgattggattggatatgtcaatcggccatatgaccctttatatttatagggttgataggtcttaccatttatacaagttgaatccataataaaatcgtgaagaacacaaactttacttttgaactttctaaaaccggactatccggattagctaacagaagcatccggttttcttctgagatgaaaaaaagcaaattaagttgccatgtcattaaaaacaaagttatttaaatgtcaaagtacgtaataaaaccactgacgaccttaaagagatattttaaccatttatgattgtaggggagtataaaatatctactagatggactgtatttcgtttttggagtaaaacaaattttgcttttcatactagatagcaatcacatatataggtcgttgtacttagcatgagtaaagccaaaagtggagcgcgctgttcattcaggacgatgcctggtatagtttctgtgacttctgtctttaaaggtggcgtcagatatgctatgttgtcgaagaaacgagtctgcagaacaaatgtactgttatatgtccatggaatggaacagtatggctgtatgggtgaggtatgaaataaaactagacatagagtagaacgtacggtatggggtcccggtagagtacaacaatacgagggacccgaccacgccgcttttacctttgctatgctgccaactactgggccgccaacgcagaaaaaaacaatgggcgccgtcaggaccgtggtgatggctgactaaagttttcgtgtgagaaaataatcccttcattgttccaaaatagttttatctttgtcctatctatttgtctgacgaaaaaattaatttttaagcaatcattataatataatttaataagtaacaacaaatggatttatacttgataaagttgaggacaaacacattgcgacttgataaaatgaaagatattatagtcttttagatcctgtgtcggtacataatattggctaaaaacaaagttattttagcatggagataatatttttttttaaagatgtgctttagtccatcaaatatagctgaaaagttgtctcgctccgtggaaaccctaagtgccaccaggggatcgggagttggcctcattttccatcttcgtgatacggatcggactgggtggaaggaggagtcctgttcgacgacgatagtggctcctttaaatctctacctagtgtttgctagtagggtgcttgatgttcaatctacagacgcagtgaagttgatgtggtgacgacgtggttcgtagaaccatacatctcgccggctggtgtttggggcaggccatccgacgaatctattcggtggcatggcgtcagaggaggatatgcgggtacgcaataaggatgaagggggcgccgcaatcgatgaagaaccaattgaagatcagggaggggaatcagatgagggggatgacgaagatggtgaagaggccgtgagctagtagaagaccaggggcagggagggcgctgaaggttgccggcggaggggtggcgggcggctgccgtcgcctagaaggactcgaggctgacgaatgcagccgccgcagcggcaactgtgagcaaggaggagacgaggagtaaggggggggaagggcggggctcgagccatggctaatggccagcgagcggagggggcctccgcccatcgacttcgatatccgccgccctgatttatttctccactggctactctacgccactgattcgtgccaccaccgccgaccagctcttgggttcatcgtcctagctctgacgatggcacaccaccgtagagtcatctctgcggcaaccaccaccaccacctactattgcgacgatgtgggaggaggcagagatgtgggcggcggaagcatcgttcacgtggggtcgtggagggaggaggacaagcggcggcgctctagcggctcccgagtgaaatagggatgggacgctgcctccggtgggtggtgaggctggctcccatgcaggtctggggaagaataggggaggaggggtgcagtgaggggaagacgacaccgtgctcccgggtctcgccttccttgtccgccttgccaccaccgtcgtcgacggcaaccgatggcgtccttcctctacaaagctagcttctcccgccggcccacgctaactcagcgctgttgaaattgccacggaggacaaaaccagtcgcatactgccttgggacttatattacacatgttttaatagttgagagacccgttttatctggttttccggttcgacgaaaatcggattcgttgtcaaattaagggacctcaaatgaacttattccaattttgtatgcattcataagccaagcccggcccatccctagctaggcacgagggtaaactaaaggcaacaaataagtacatgtgcgagactagttataattatgacatcacatttttatcacaaaacatttcagttttgtcttacgatgtaaattagaaaacttacatttataatgtcaaatttcacactgcaaattctgaaataagtttacatttataatctcaaatttcacactgcaaattctgaaataagtttacataattatgatagtgctttttggcacaaatctatacatatcatttgttttgtttgcaaactaagcatttaagaagttattgatggtcagaatttaaaaaaaaatctgaattttatcttaaaacatcaaatatgtttaaacggatggagtatatcacagcaaacttttcatttagccacaatcctcacgtacttgtacgaattgcacattggcatgtatagaggattgatacgaaaacacgcccaattattttatttttgtaattttaaaagtaaatatcatgatttggtttgaaaccaaatggttgataataaattataagacatctacaatgtgctataagaaagagccataagatcttacgagtagccatatacaatgttagcaactgtcataaggcattaaatactaaaaaagtcattctattaaaatataaacatggtcataatgtgagatagaattagtgataatgtttaagactaaaatcatagtatagaatttgactctcaattagcatcaattggacacactcatttgcaatgtcattctattaaaatattgataagagataagtactaaaccaaataagtctattgacctattgtttcggtattactctcttctttccaaattaatcatcatactctgcaccaagacaaagataatttaaatcacatcaatctaaatatcatgcacacatttttccacaatacatgcatcgattaaaacaccatatcaattacaccttagaatgcatatattctctcatgctgcattaattgtattctgatgaaatccgtgtccatgtggttatatgatgatcaatttaaataattttaaattttataacgatcaatttaggaaagatggagcattaataaagtccctctataaccaaatcaaccatgcatacctccgcagcgagctttatcaccggctcacctcatcatatatacaacccataaataaataaatatataaaaatatgtaaaaatatgtgtagtcaaacactacacgtccagtctccctccgccgctagccgtcgcctttcggtttaccctccccactgcccaagttaaaaacagcaattcgagagagacaggccaagcagcagcagcaggaggtgagagagtgaagagagagacacagccaaagctca

SEQ ID NO: 71483 - DNA, 541 bp, Oryza sativa
gacctgattcttgtgaacgaagtggcttgtgcaaaattatttatctgataaacgaactatagaatatggtggagatttactcagtttgtgaacgactgttatgtgatgacccatttatgtgggttcacatgtgctttaaaaccttatttttcagctggctgtttcatgtgctctggctttcaattgttcaactaatgttatacctttgatttcatttctctgcatttttttattgtctgttagttcttaactgtaccgcattctctcgccctctgtgtgtgtgtgtgtgttttacaagttattactgtggtgcatgactaggaactttagctgttaaaagaaccacaggttagtttttttttccttggtcatcattagcttttcctgtctcaggttgagaagtggaatgaacagagggagaatgggacatttgcaggaccactctaaatctcctgtttgagagtcttctcagatcagtccactgccctcgtcggtgtcactgctatcatctggtttgaatttatgctgctgcttttgttct

SEQ ID NO: 71484 - DNA, 9735 bp, Oryza sativa
  unsure (1)..(9735): unsure at all n locations
ctattcccaacagccgagcagagcgaccgtcccggcgcacggcgccgatgacggcggctggcatccctactcaccagaggtttgctgccaccccgaacgcggagccgcttggcagcctgcagggagcatgatgcatgggtggcagcggagaggtggaattgtcggaaattgactgccgccgcgagtcgatcgctcgatcgatatggataggggctcagttttttctaagtacaaaactgcccccttgctaatggggggattactctgttaatccacttttaatatccaccattgatgtgctttaatttccgtgcaggtttttatttgagaagcatagtatcacttcccttccctattttcttttagggtgcccaaagattacaggaagaacaaccccacaatctggaaaatgctaaaagggaaatcaataataatgaaagtaggcacacctgaaaacaattgatccattgcttttgcgaaggtagtctggaattgtcccggttagttggttgcatgacaagtttctgtataaagtgggatacaatctggcattaaacaatagacatcctgacttggtaacaatctgcaaacaaatttatccactaaaaagttttatatgaagggccggcagtgccaatcggacatgaaataattcgcttgaatttttttttaaaagtaaacaggtatattccatcatccaagtggcaatctcacataaaaaaattcctttatggcaaaaatgagatgtgtaaaaggagaattcttttaaacttcagtgcttcattttacttcaattcaattgtaaaaggagatgtgtcgataagtaggctgcagcagaaggtatattttcccttttgtgaggtgccataaatttctggtgtatgttgaaggacaaagattataaatacactagagcggtggatgtatcatattgcctttgtgacttgcactttgaaagtacatatacatgattgttaagagaactatacatgattgtgctctccagtgccaccctcttaggtaggtaaaaggttattatgcaacagacaatggaagtatagtcacacgcttttcattgggaatttttgttattttttgaacatttaaaattttaaatttaaaaataaaccatctcgatacttatttctaaatctgaaccttcatacccactgcgcctcacctcgcttggcgaaacaatagtcacaccacccgcatttgcgcatggcaaaaaaggaacttatttgaaaataagttttgggaaggtttatttttatagctaaaaactaaaaggttcaaaaaaattaaaaaaatctctgattggtcaatattatatttttttctgttcgatttcatatttctaaagagcacatagcttttcaatatgattagtccaattccctgttatactaccttggagttgtatgctcaaacagctagattgttcaactcatccaattttcagatgatcttaacgattgattgttgcagggtagaggcatacaaagaacaaacaataattttgtctctaaaatagctcaaaagaatatttagtgaaattttatcagggtgaatatgttgggatcatgagttcccagtctcaaattccctcgccgcaccaagtgtgaccctttttaatcaccggttcttaaaaatatgtttgtgtgttttgggtaacacaacatgaaaatgcaataatttttgagtgtttttatatgtaaaaacgtgcattgcacgtgcatgattactagtaaatggcaaaagcgtgaagattgttggcttagtgccaatcggacatgaaataattcactcgaatttttttttttaaagtaaaccggtatactccatcatgcaagtggcaatctcacataaaagaattcgtttaaggcaaaaatgaaaattacacagcaatcagatatacttcgtcttgcaagcatctgtttggatcatgatgctccatgttttgcaacatttcattgcctaatcaatgatcctggaaatatctatctaaagataagtcatatcaaattcctctagatgcgtgagccatttggagacattagtatgggaataagaaaatatggatgcatgtttggctcccatattctgccctacagcttataagccactgtcaaaatttaaattttaaaactaacatgatttgaaagtagattttgcatgttttttcatcaaagtttattttttacattgacttttaaaacttttaaactgctgccaaaataatgctaattataaaagttttacacacaaattaatatttttattttgttaataagccgtacagtttataatcagcactagagttacctacagttggacggatacagtgttgatgtatgccttcaattgtgatatctacgaattttgaaagctaagcacatgtgttgaaggaattctgatatattatagaccatataatatatattattcttgctctactttcagattcagattgccccatatgtaataaagaaagattcctccatatgtgtctttcaaatttaaaactacaagagaaaagcctacttttggtcatgcaactgtagccttggtccgttttcatccctcaactacatatgaaaccgattactgctagtctcattctctcgaagatgtggcaccacatggatagtacatgcgatgcaataaacctccactagttcttactcctactccctccgtcccattttaagtgcaactatcagtttctacgctaaactttgatcgttcgtcttatttaaaattttttatttagtatttttgttgttatgagatgataaaacatgaatagtactttactcatgacttatgttcttttaattttttcaaataaaacggacgatggaagttagacacggaaaccatggctgcacttaaaatgggacggagggagtagttaggatgggtttatataattttaattgcaccagaatgcaactgctcatcatttagttggtgttttccggtgattttaaatagcataaaactatccccattaatgtcagtcaggaatttcagatgtggctaatgaaaggcagtgaaaattttatgtatacttacaaatacttgagggcactaaacaatgtgaaattataggatatctgcccttgcaactcgctgttggagagatcactgcataataatttcaagcaatacaacataaatgaaaggtaccaactatatacaataaagcaagtacgatagcacgtgcaaatattccgaataatactcacagagatattatcctcatggttttatcatcaccaggattagtacattccacaccatcccaaacagaattagatggataacaaggatcacccatccaattcttccttattccgtactcatgtttaatggccatgatcgcatcaactagcatatggaaagaaatacatggaagaaacccaactgatatatttaattagtgtacattgttagagacagatagagcttacagtcttgggagaacgtcattggatattcatggatgatgcgactgtagacctcataagcattgaggatcgggggaagagaagatgtggcagtggcaacaagtttgatggacagatcttcagaatcactggaccaattgatgatagaccaacctttcaggtatggtggactgatcggtccactttgcatgccgctgtcaattgaaacggtgaactccctagtcttgttatcctggaagtcggcgaagtgcaggatcaccaagtgatcaccgggaagtctgtctcttctctttgaacgtaaaactagttcattggagttaccaaccggcacaaaagctgtttggagaacacgcaagggcaccataaatgtggtattcagttcgatggctgattgggtagaaatgtttgaataagggtcatttccagttaattcccacgcataccaataacgatcgtactgatcatcanganacctgtatttatgaaatccttgatatgaagnggaacatngcaattgaaaacaaattgacgatgaatacttacttcctctggtcgtaaatatttgactagtcctaaaatttgatgtttgtgacaatataaaactttgaccatcaaccatcaaaaaggaaatgagttatgttgaaaaataatacttatataagaagggttctatgctttccaaaaaatagtgtacgtacgaatccaagagcacttccattaattactgtaaaattaatagttagggtataaaaattaaagtctgatcaaactttatccttaatgtaaatatttttcaccacaaggaacaaaaggacaggttgatatagaaaattaggagttagtaaaatcagagaatatacaggttcttctccaatccatttgtacattatattaaggtgcaaattaaatgagctgctccttaattactacgacggccggaaattaggaaatacagtagtagtgctccaaccttattatatcgacgtcagcacctgatctcatgctcttccgttcatagagggagagtgactgattgtcggtcgggtaggccaagctttcaaacggcctcagctccaccgtggacacgaatggtgtaccaccgccggtattcaccaggcacaccggcgccgacatagcccatgcgacgaacaccgcggcgtatgctttataaccgtagtggatggtggtgtccaagatcacggtgtcccagtggttcaccccaagggtcaggttgaacgtcagggatgcgctgtccaggccatcgtagttgccatacagaaactccagccgaacattgtacttgtccccttttttggtgggtagcgagtagcagctccgttcaccggtaacggatgttgggaagctcctgagcgtgtagagtgtctggtagcgagggcccttccagtcgtccttgtacacggtggtcacccttctattttcgccggcgtcgacgtacgcaccgtcggagacgtaggtgattccgccaaccaggctgtctgttctggaatcttgatccaggccacagtcgatgcttaggaaacctaatacacacagaaaagaaaaatgacgttacacacaagtgatcgaacggaagaatcaaaatagccaaatctcgtcttcattttgaagcaaaccaagacaatacccactggtgtacagggcggaaaaatctcaggaaattggtatggaacaagaggggttttttcatctcaagatttttttcaacaccgtgttttttgtttataagagcaccgtgttttttgtttatgcgcttgaaaaagcatcgagaggtctatatcgtctaaatttgttgtgcagaccataagagatcaccaaaggaaatagccatatttttaccaaagaaaatacccgtattttcacacgcagttcttttaccaaagacggctatacaattcaggagacactaaaaaaccggccagcccaaccagctatggttaaatccagtcccttggactctcctcgtccgctccctcccactcccaggcgtcatggcaccatcattgtcaaccacagctagaaagctgcatactttccctccactacccagccagagtgccacactgattcagcagcatcggcgggcctagacagcaacagtgagcaacagcttccactactagaaaaatggttattaccaataccaggcttttatttctatatggagtaaaaaaataccctctggttactgcttacaaaaatagccaaaggcccccatgatttagtcccgcttggtcgaattttacagtcggagccataagaggttcgcttacgaaaaaagatgaacgaattatcataggtgagatgtaaagatgttagcatgcgaaaaggtacgagcgctcaaaaaatccacgcagctaagtctccatctattattttatcttcatcccttaggctgtgtttgatacttggggttgggaacccaactccaccgcacggaaaacggagcggtccattagcgtgtgattaattaagtattagttaattttttttcaaaaatggattaatttgtttttttaaagcaactttcgtatagaaactttttgcaaaaaaacacaccatttagcagtttgaaaagcgtgcacgcggaaaacgagggaaaggggttgggaaacttgtggaaagaacgcagccttagtctgctcactccctccctcaccctccactcccctcgcctaccctccccctgatctacctcaggggtggaagccagtagtgaaagcggtagagggggcatcgacggcccttccctttcccagatctggccaaagaggagtaggacagcggaggcaacagctgcagcagaagtagaaggctgtggtagtagcagcagaagaagaatcaaaaagcagtggtggtggaggcggcaggagcaacacaaagcagcggccgctacgatggcgggattagaagcagaagaaggtggtgacggtgatagcgaccagcgcatgcaatggttcagcgatagtgacccatgcatagaggtggccaaatgggccgggccaaacgggcggcccggagcacggccgaacctgtagcaggcacggcccggcacggcctgctacagtaacgggccgtgccggcacggcacgagtagccgtgccgtgcttgggccgctggccgagcccgcgggccggcacggcacggcacggctactgtagcgggccggcacggcacggcccgcggcacggcacggcacggcacgccggcggcccgtcaggcgcggacagggcgggcggcggtcgaatgggaaggcgccacgtggcactaacggctatttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcatttttttttattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaacttttcataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggcggagacagcttcggaaggattttccggaaccgcgagcggaagtgtttcgacacacaccggctcgaagagatcgagaacctctggtgtgtggcaaagcttcgacgagataaaggaaacctgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtgaaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaattttaccaatttctagaaactttttatgattgtactctaactttgtcacaagtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcagagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgatcacgtcgaaatgctactaagcgttaaagactgggagcttgctcgacaacatgcccaatacactgcggacaaccaagaattggccgcccagttcgagcaactctacctggatccagaccaaccccagtagaattttgttagaagtagttctgacctttgagctgtactcttttctttgtcatggttttctcattttcccctatgagtttttacatgacaaagtttttaacgagacagcatgtatcattgtatcctgtaatgatataaacatcaataaaggtcattactatttttaacaaattcttttgcaatattttcgcaagtgtggatttatctttaaattatttcaaaataatgaatcacaatctatatttttaaatttttcaacacaacaaaaaaataccattttttcttttttttaacattagcaaatcattacttttttaaaaaacttttatttccattttttaaataccattttttcattttttaacattagtaaatcattactttttttaaacattt

SEQ ID NO: 71485 - DNA, 685 bp, Oryza sativa
ccgcttccgcaataaaccacccgggcaccgattccaccgtgaacccgagctccaccgccactttgccgactccggcagcgcgccaccgccgccctagccaccaccaagccacgccaccgcctctactgcgttcgccgcgctcccccgtaccccggccgctcctccaccttcgttggagaccgctgaatcgccgccgtcgtcttcgccccgtggagcgccaccgcctccctccgcggccgctccctccgtcgccgcgtccttggtgagcccctcctctccctccttgcatccctcctctgtctcccatgcgcgctgccgcgccggtggccgccgccggcgtccacctggccgtgcgctgccgccccgctcgcctgggccgcccggacccccccttgtcgcgtcgcgtcgatctcccgtgcgtgccgcctctcccgcgccgcccgtcggtcgccgtcgccggagaccgcgccaccgccgcgccatggctcagctaggccggctttgtgccgtgcccgtgtgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaat

SEQ ID NO: 71486 - DNA, 1123 bp, Oryza sativa
agtgatctagcccgctctacccatcaaaatcccgtaatcttagaacgtatagacactcagatcagacagaaggatcgggaaaataagaccaaaacactggatcgagcgggcaccagtaacagccatctaacacgggcagaaacagtagaacctaagtgctcgtcagaacccaatacgcccgccacgaactcagcaccaggcgcggacatcgaggtgccatccaccccgaagagatccacacgacagcatccaaactctgaccgcgcgatcgacggattcaaatcgaaccaaggcacgtcacgggcagaacagatcagaacccccaacactcggcatgatctgatcggtaaagaggggatccctcaccgcgtccatctcgtggcgtcggagactggggaccggaggcgaggatgaggggggttggaatcgcggcgtcacggagcggaggaccgagccgagaggaagggggagaacgacgacgacgacgacgtggtagagcgtgggcctggtcaaaggcggaggcttaatattcggatctgggccgttgattttttttgagcccacaaaccagacgagcgatcgtggcactggcctgtaatgttgtgggccggaaaaggcccaactcggtgatacaaattataggcctgttcagttcaatgccaaaaccaaccatatcgaagtttggcaccttctcatcacaaaccttttcaatccctaccaacattttcacaaaactatatcaaaatttagcaaggtgtcaaactaaacaccgctttcacatcttcatttaaccaaaattttagctttatcagtttttggcttaccaacaaatggtaagtttttttttaatgaaccgaagaggccctatctcgctctctttattttttcagaaaaaaaaagattgcaagtacaattaagtggtggctactctgatgcggccaaacattgcgttgggttcgtgcatcgcatgtccgagaaatcaaaatcacgcagccggatcgatccgaatctgttcgacgcaggctcggcagaaatccggcgtgggcgctgcaaatctgcaatgggaaagcgacggcgcaacctaaatcgcttgtttgttctgttcacaggtgacggatccgaa

SEQ ID NO: 71487 - DNA, 1325 bp, Oryza sativa
gagaaaatataaatgacgcatataagttttgtttaattttaaatcacacatataataaatgacgaaccaaataatgtgtattaaaacaatattgcattattacaatttccttaagaatatatattaatgaatgttaatttgttgtttgccacaagtgactggctgtttatgatttcccatgaatttacaggaacaattaataaccaccttaatttttgacagaagttaataatatgtcaggcatgtaccatgtaagaatcaaatcacgcaaaaaaacaccttcaaaccaaaaatttgagatgtcttttgaagttattctgatgttcatgttgctaatgtataattttggaccaagagttgaggaaccgcaaaatcagattttcccagggtatcttacttgaatgatgaactgcttcttcttttcactgataataacttcgtaaaacttagagaaaaaaaaacactgatagaattagctctatgcataatgcatggctgtctctagatgcattatcaatccttttaaataagcacctcaaaagaaatgatggataattagctccaaaaaaacaaaaatgtttactctcccatatacaaaccgtcatctttcgtgcacatttggactggactatttttttttcgcggcaaatccatatcactgccggttggtggactaaacctggaatgacaaacctccagggatatttttgtgtcaactccaactccatcactgcgccacatgcagcctgccgtttcgaaaactggcagggatctcttgttgtgtaccagtgaaaataaaggggaaaaaaatgttggatggctaatgcaagtgggggcaaaagaattagacatctgaccttgtttggttgtgacattattccatacttcttctaaatgctatagccagggaatgcaaacgagaaaatcgatgaagctctgagttggcctcatgaactagagtgctaccactacgctataaatacagctagccatacaccatctctgatcatcgacaccaagcaaagaatcaaacaattcctagttccactttgccagtcctaccaaagcacattttagccatggctagtccatttttcaaagttattccagtacggcctgtgctccgcgatcagtgtgagattaccatgagattgtacttgcaccaagttgttacagggccaaaccacaaccaagaaacaatggtgccctcatcacatcccgcttcgtttggtatgattgttatcaacgattggcctatctatgatggacctgacttcaacacaagtactattgttgcacatgcaagaggaatgcatgtccaggtt

SEQ ID NO: 71488 - DNA, 31186 bp, Oryza sativa
tcgcccgtatgtgtaccacttaattaattaccacccctcctatgaatttttgcctcaaactctcatctcatctcttctccctatatatatgtcgtcgaaggcggtgccgcggcggcaacgggtgcaaggtcggcgacgacaacggcagcctgtaagtgagcaattgagcatatatacgcacgcacccccaaccaatcgatcgatcgtgtgtgtagttatcaatctggggatatatcatatatgtatgcaggatgctgatgtgggaggacgggttctgccggccgcgggtggcggagtgcctggaggacatcgacggcgaggaccccgtccgcaaggccttcagcaagatgtccatccagctctacaactacggagaagggtgggtgctgggtaggtgatgcagtgcgtaatcgtgtacagtttcgagtgttttttgcccccttggttctcgtggagtcagtcgacgactcgatttggtagtcatgtcagcctctctatcgcatcgcagctgcggatttcttcgctcgaccgtgtcacccgccctgttcttggattaggacccctgcatgcgcgattaatgctaatagtttccccatgattcctgcgtcgtcgtcgtcgccgtcttagagcaagtttaatagtagagttcactactttctattagtcaatattaaagctaacatgtatagtaggttgagtataaggttatctttattttcttcgtcctctctctttctctcactatgaatttaatgcatattttttagagtttgtatacagttagcccttgcatgagaaccaacactccccacttttatttatctctctcttccacataagcatataacttgcttatagactactgttatcctcgctcttagtgtgtgaaagtgcaactctattttggcccaaccagctagtactacactagtacgaccagtcaccagagagaggaggaaaggggaggagatcgatgggatgggcgtgtgcttttttttcatctttttcgctttaaatttggttccaatatttatctaccgttccttgctcgcctgctttgcttttgggtttaaatcagtgtgtgtggtttgaattagttaacctagggtttggttgattttcggatttggtttggttttgacgacgccggggcatcacatcacgcgtggtgcagcgggggtcattatgcgtgggcagaggcgtgggtaaactacaaattaacagccacttaccccctcctaagtcagtggctttaggcgagggctgtcacgtgcgcacgttcgttggggtgcgtgggggcggtgcctcgtatcgcataaacaaatcccggcgcgtcagtggcttaattgcgggctttgtctgcggattaacaacgcccctctgctacgcgcacaacaaaactctacacagcagcaggagcagcagaattgtaaaaaaaatgtttcaagcagatggaaatgatagaatttttttttctgtaccttttcttgtgattctgcgtccatctgtacgtctatgtgagcgtgtcgatgactttagcacagtaatatagtaatatctctgtttggctactgtattggggattaatttgggtaattactactggtaattgcgttaatctggtcgctttcactttgttctactactactaccgagcttttgagcgtgatgttggtaagacgatgattttgatctggaccgctggtgggtgctgctgcaggctgatgggaaaggtggcgtctgataaatgtcacaaatgggtcttcaaggaaccttctgaatgcgagcccaacatcgccaactactggcagagctcttttgatgccgtatgtaccatctcctgcactctcctcctttctctttctgcagagccccctggcccccttgcttttggggggaagagaccttattactgctactactacacacctcattaatcacttgcaaaaacaagctcagcacactgccacagcaacagtggtaggtctcatgtttttactgcgggaatgaggcaaaaaaaaaggaaaaaacaggtaaacagtaaaagagcccgagagagatatatcgacatgtctctggggagttctcaggctttgcatcaaatctgctcgtctgctctgctcccccaaaaagaagagaggaattggatgctctctctcactctctcatcaggatatcaccaagctagtatagaattaacgccgccgatcacagtcacggctaagctttattcctgtgagaacttaaccaaattcccctctcatgcttttgcttttgcagcttcctcccgaatggactgatcagttcgcctctggcatccaggcatgcacttctgttcacctagatcttttacatgctcgtcttagtttgtgattgatatttattagtgatgctaaacttttgcttaatttgcttgtagaccatagcagtgatccaagctggccatggccttcttcagcttggctcttgcaagatcgtgagtacagctatatattgctccctctatttttttaatatataacattgttaattttattctattatatcttttaaacttccatcatcaatagttctctgaatgttcagttaaaaaacgtaaattatactccatccgttctaaaataaactaacatcatactataatgtgatgcatcctattacaacgaatcgaatctgggatgcgttatatcttagtatgaccttggttttttttaagacggatggtgtactacataggtagattttacattataaatggctgtgcaacattacaattttattggatattactccctccgttccataatataatataaggcacaactactttttttagatgttacataatataaggcatgcatacaattaatttctcttctccattaaactattatttttttaaattctccactctcgagatctctaattctattggatgcatgtattatatttattagggtgatctaaactaggagatgataataattgtttcttggtctttggattaagagtggttatacattatattttggaacagagggagtatctttataggggcaattgttatatatatatattttttgatacgaaaataacggttaaagttactccacgcaacagaccgaataaaatgtgtcatatgcatttagtaccgagaggtacagtgagacatggccctttcttgacttgtttttgtcgcgttggtcaaagacgccgacgtggacgtgtttgtggggggcactagctaattgggcaaaacgtacgtacgctaactgtgcagataccggaggacctgcacttcgtgctgcggatgcggcacatgttcgagtcgctcggctaccagtcgggcttcttcctctcccagctcttctcctcctcgcgggggacctcgccgtcgccgtcgtcgttcccgcttaagcagcagcagccgccgccgccgcagctcttcaactggccgggccacgcgccgccgcagctcccgcccggcgcgtcgccgctcttcccgcccgggccggccgcgttccacccgtcgtcccggccaatgccgcccttccccggcggcggcaaggatgagagccacctgttccatctcccgccggcggcggcggccaagcagccgcagcacatggacgagcaccaccaccaccagcagcagccgatggcggcgccgcagcagcacggcggggaggcgcccgagggcgacctgaaatggcccaacgggctgtcgttcttcaccgcgctcaccggccggaccgaggacgcgaagttcctcttcggcggcggcggaggcggcggcgcggacgacgggagcaagacggcggcggcggcgcaggacgcggggcacggcggcgcggagaacgtggaggagtacctgagcctggagagccactccaacaaggcgaggaggatggagagcgcccagagcaccaagttcaagaggagcttcacgttgccggcgaggatgagctcgtccaccacgtcgacgtccccgtcggtgtcggcgtcgacggcgccggcgccgccgcagcagcagcaagggatggagtacaggggcccacacgagggcggcgtctactcggacctaatggagacgttcttggagtagcctaagctagcttagctagcgaccacaccaagctagcaaacatggaagcatgatcatgatcaagtgtttgttcttgtcacctcttagttttttccttcttttctttctcccaaactatgtttaagcttttgagcggtctggtttggagtttgcttctgtttaattaattaattaattagatcatgtagtaatcctttttgttcctccctagttgtactagctctctccaagtgcaaaaacatgaaacttgatactacatggggagcgtgcatgcatgcatgcaaagatgggcatgagtttgcttccgagatggctggcaagttatatggtgcaatgatggcgaggtacaagcgacatgcagcacctaataatttgctcttttatactctcaaaagtgtgtgctgcttggtcacaacactgtccctgttgcctacttattgctcaggctgcttttcgcgcccgtatttctttcttgtcgtacgtacaagttacatatgcatacggcaagggcctgtttaattcgcgactggaaacgtttgtgtgtcatatcatatgtttgatcggatatcgaaagagatttttgaacacaaatgaaaaaaactaatttcataacttgtctggaaactgcgagacgaatctttaagcctaattaattcatagattaattaggctcaaaagattcgtcttgtgatttctccctaactgtgcaattaattttcttttaatctatatttattgtttcatgcatgtgttcaaagattcgatgtgatgtttttagaaaaaacttttggagaactaaaccaagccatatataggacaaactcattcaaacaactctatatgccttttctgcgctctacttttacttactcactcctccgtttcggatgaattataagtcgtttaacttttttatcaaattttttttaggtttgacgaaatttctagaaaaattagcaacatttatgacaccaaattagtttcattaaatttaattttaaatatattttgatacaatgtttcttttgcattaaaaatattactatattttttacaatggttatactctaaggagtttgactaagaaaaaaaaatcaaacgacttataatatgatattataaaacgaggggagtacatgaaaaaaagatagctccattaattcaatatatcactaacacacaaattatttccacagtcaccctttctttaatgtttttacagggaacttaaaaaaaaactgtcaggttacgggaaaggtataccctctgcccttcgatatatatatatggtatacttgcgtgtatacggacgttttcggcatacgttaaggaaattcgccacggagttcacagatggaaggagtcctactcggacaggactgggtcgtcattgtatcgtgctgggtccaatgtctccgagtcctacttggagaccagttgacctgcgatataaaagggaccccccgggaggacctaaggcatcgaatctcatagccaacacatcccccacagcctacggagttgaagcctataggagctaagtcgccgggagatctagtcggaccttctcgattacgatctcggcggtatcattgagttccgctttccctttgaaatatgtggtttccaccatataatctcatatcaactggattagggctattacctatcgaggggcctgaaccagtataatctttgttttctgtctgcttgatgtcgtatacgtagatcctcgtaccagcgtaccccaataccttctatatccggtctacgggtatcctccatcgacagtggcgcgccaggtaaggggacttggtgctcaaggttctactactatgtcatctagcttcgtcgacaacagcgtcaacaccaacctcaaccaaggagttctcacttcaacaatgctggtgtggactcaagtcggtgaaatcgtcttcccggtttacaccacggtgccgatctcggctggtccttcaatgaccagaagcgagaacgcagtggctacaaccctggatgactccatgtcgaaggatcctcccgccgaagcggagaacggaacgtcgacgacatccgagcccgagaaggatcctagtgcagccaaacattgtcttttcgacaagaatcacgagccgacgaggatgacttccgaggtgacaaggtcctggtgtcctatccacaaaactagaaaacacaccttgcaagcctgttgggtttttctcaacgtccacgctgaaattcgtgcctgcaaagagcatggacttcagcgtacttctccaactcatgatgtctattgtcctattcacaagacaaagaatcacgacctctcgagctgcaaggtctttctcagcgccatgaagacgtcacctcctaaggtccagcagtcacgtatccccctcagggatgaggacaaggaacaaggagcgacgatgatttcagatcgatttgttggggtaatcgacatcgatccccacgaaccatcagtcttgcacctgctcgaagactatggctcatcgtcaacaagtacgccacacgaggtattggctatcgacgggaccagcacgtcagcgcgcgctaatgcggaagtcgaaaattaagtgactacaccagcccaacacatcagtaccgtcaacgcaatactgagggaaaccccttacgatcccgttctgaacgatgacctcgcacggtagacagaacgactacgggaatcagtgaccaacctcagcaacgcgttcgaagaggccgctgctgcagcgcacccagaacagccaccaactggcggtgctaatggcgaaaaccctgaacagtaggaatcacctcatcgagccacccctccgcctcgcggcaccggcgatctccgcgatcacctgaatggccgccgagaagcgcgacgcacgcgagacaacgagaaccgttcccgacatcgcgtctcttcacgacgtcacgatgacgaagaacgaggaggccgttcaagcgaagaccgagaccgtgataaccgccacaaccgccacgatcacgacgatcgcgaacggtggatgctgggcgatactggtcgaggacgccgccataatgatgacgacgatggagatcggcgccgggacaacaacgagagacgacgacaggattctcgagaacccggccgacgtcctcgtaatcgtacaccggaaccaagtgactcatcatcatcgtcgtcatcttcctcatcctcatcatcagatagacatccacgaaggacatacgatcgtcaacaacccaccgcccccagcgctgggtgtagagctttcagtcgttcgctgcgtgatgtccgatggcctgatagattccgaccaggagcaatagagaagtacgatgggagtaccgacccagaataattccttcaggacggtactctacgcggccggagcggacgacaacgcgttctcgaattatttgccaactgcattgaaaggctctgcacgttcatggctgatgcatctcccgccctactcgatttcttcgtgggcagacctatggcagcagtttgtcgccaacttccaaggaacttacaagcgccacgcgatcgaagacgacctacatgcgttgacacacaacccggggtaaatccttgagggaatatgttcggcactttaatgagtgcagaaatacaatccccgaaatcaccgacgcttctgtaatccgcaccttcaagtccagtgtcagagatcgatatactaccaagagttggcaacgagacgcgtcacgactactcagagattatttgaaattgtcgatcgatgcgctcatgcggacgacgcactgagacgcaagatcgacaaaccgaagatcagaggagagaaggactcagccaagcacgcacctgagacaagcaagaagaaaattcgcaaaagtgggaaaaggaaagctcaagcggaagttctcgcaacagaatacgcggaccctccgaagcgcccagacccacaaggcagcgacacgaagaaaacatggtgcccgatacacaagtcggacagacactctccagaagattgcttgttttcaaaaagtcacacgcaaaacacatggcattggaaaaaggcaaacgagtacgcatggtcgagaaggacgctgaggcggctactcaagaatcggactcagcatacccagactccgatctccatgtctcgcacatcttcggaggttccacggcatactcctcaaagcgagaatacaagaaagtggaacatgaagtctgttcgacgtggcagggagctgtgcccaagatgaagtggtctgaacagaagatagaattctctgaagaggaccaccccaagaccgctgtcatcccagggcaatatccgatcgtggttgaacccactattcggaatatcaaggtcacgcgagttctgatcgacggcggcagctcaatcaaacttctcttcgccagcacattggacgcgatggggattccacgaagcgagttgactcccaccgatcaacccttccatggaatcactcctcagtcatcgtctaaaccattgggcaaaattacgttgcctgtgactttcggccaagcaaataacttccgaactgagcaaatcacctttgatgtcgctgaattagatacagcatacaatgccatcattgggagaactgcactcgcgaagttcatggccgcatctcactacgcgtatcaagtgctcaagatgtcgggaccgaagggaacaatcactattcaagggaatgctaagctggaagtgcaatgcgataagcggagcctcgacatggtcgagcacacgcccagccctcctgccacagctgagccacccaagaaagtgagcaaaacaaccaagacgccgaagccggatggcgcagtcaagattgtccactctccagtgccaaccccgacaagaccgtcaagatcggggcattactaaacgagaaataggaactcacgcttatcacctttctccgagacaatgctgacgtgttcgcttggcagccgtccgacatgacgggagtacccagggaggtgattgagcagaaactcatggtgcgacccgatgccaagccagtaaagcaaaagctgcggagatttgcaccaaaccgaaaacaagctatacgagaagagcttgacaagcttctcaaagctggtttcatcatagaggtactccatccagagtggctagccaacccagtcatggtgcagaaggccaacgggaaatggagaatgtgtgtcaatttcaccgacctcaacaaggcgtgtcccaaggatcacttccctctccctcgaatagaccaactggtggactcaatagccggttgtgagttgttgagctttctcgacgcttactccggctaccaccaaatcagcatggcgaaagaggacgaggagaagacagcattcatcacgccgttcggggtattctgctacgttaagatgccattcggactaataaccgcaggaaacactttctagcacacggtccagggcgcacttagcaaccaactcggaaacaatgtcgaggcctacgtcgatgacattgttgtcaagaccaagacaagcgactcattgattgatgatctgcgggaaacgtacgacaacctcagacgatatcgcctcatgctcaatctagagaagtgcatgttcggagtaccatcgggcaagctgctcggtttcctcgtctctggcagaggaatagaagcaaatcccgagaagatcaaggcaatcgagaacatgaagtcgcttacaagactcaaggaagtatagaagctaaccggatgcatggcggcactaagtaggttcgtcgctaggatgggagaacgaggacaacctttcttcgctctgctgaagaagcaagacaaatttgtatggacacaggaagccgaagaggcattcattccactcaagcgctacctatcaaatccccctgtacttgttgccccccaacctaatgaagaattattcctctatattgccgccatgccatattccgttagcactatcattgttgtcgagagagagagggtgcaacaaccagtttactacgtcagcgaagctctccacgacgcaaagacaagtccatagatccaaaaactgctctacgcggtaatcatgacatcaagaaagctacaccactacttccaagcccatagggtcacaattgtatcctccttccctctcggtgaagtcgtgagaaacaaagacgttatcggccgcattgcgaaatgggtagtcgagctaagccaatttgatgtccacttcgtgccacgaacagccatcaagtcccaggtactcgccgacttcgtagccgattggaccatgcctgataacagatcagacaaccaaatcgacaacgaaacgtggacaatggcgttcgatgacacactcaacagccaaggagcaggggcaggattcatcctgacatcaccttcgggagatcaattcaagcatgcaattcacctcaactttagggcaaccaataacacagccgaatacgaaggactactcgctgggataagagctgcagctacactcggagtcaggtgactgatcgtgaaaggggattccgaactagtcgcaaaccaggtgcataaagattacaagtgctctagccctgagttatctaagtatctcgcagaagtcaggaagctggaaaaaaggttcgatgggatcgaggtccaacatgtataccgcaaggacaacatcgaaccggatgatctagcatggcatgcgtccagacgagagccactcgaacctggcacctttttggacgtcctgacaaggccatcagtgaaagaggcaagcggcgaagatagccaggtcgccccaacaacagctcgggggctgcagaggcagagcgcaccgttgctgatatcgaaaccacagatgactggcgcaccccactcattaaattcataggcagcgaagagttgcccgaggacgacgcagaagccgagaaaataacccgtcaagcaaaaatctactgtatgatcggcaacgatctatacaagaaggcgccaaacggggtactcttaaaatgcgtctcgtctgaacatggcaaacatctcctcgacatacatgaagggatctgtgggccacacgccgccggtcggacattagtcggaaaaacttttcgacaagggtttttctggccaaccgccctcaaagacgcttgcgacatggctcagcggtgtgaagcctgtcaattccatagtaaacacacaaagctaccagcgcaagcactccagactatccctcttacttggccgttctcgtgctgggggctagatatactcgggccattcccacgaggacagggcggctacaggttcctattcgtggcgatcaacaaattcactaagtgaattgaagcgacacccatggaggaaatcaaggccgacaacgccatcaaattcatcaaagggatattttgcagattcggattgcctcaccgtatcataacggacaacggctcccagttcatcagtgccgatttccaggattactgcatcagactaggagtcaagatctgcttcgcctcggtttctcaccctcagagcaatggacatgtcgagagggcaaacggcatagtactacaaggaatcaagactcgcgtctacgacaggctcatgtcacatgacaagaagtgggtcgaagaactcccatcagtactacgggccgtgcgtaccacatcgacaacgtctaacaaggagacacccttcttcctcgtgtatggttcagaggccatgctccccaccgagctacgacatcaaaatacatgagtacagaagcattccgatgaggatcaggaggagcagcgaaacaacgatgtgaatctactcgaggaacatcacgaacgagttgccgttcgagcagccagctaccaacaggcccttcgccgttaccatgagaagcgcatccgagcacacacgctttcgatcggcgactacgtcctccgacgggttcaaagccaagcagggcgaaacaagctctcacccaaatgagaaggaccgtacacgatcacacaagtcttgcggccaggcgcattcaagattgcagacggcgatggtcgcgagttgtcaaattcctggaacattgatcaattacgtaaattctatgtataagtcaatagtatccatacttgtaagacatcttacagcttcaataaagcctattttcaggtacatattacaatcaaagtgttccttcccgatgatcccttacccagatgacacctagcgttgaaacctatcctcatgtccctttacgccgtcttgacaaggcctccgaggaacctaagggaacttcggctggggacgcccaaagccgataaggccttgtcggatcctatagagacgaaagaccatgtaagatctagtcgtgtaagagttctcgccgtgcgtattaaccaagccgtgtaatcggaaattaattttcaacttcactgctgggggctaggatcagtgcttgttcaaccgaggcaggtcaaaggtccaagagccttatcttccgagaaggattctccgacgacaaggctgggggctagggagagtgtataactcaaacgactgattgaagtcgcgaagtgagaagacactcttacacactacgtccagactaagaaagcttagttatatagatttcttttctatttcacaagtacttcttacaattccgcaaaaatccaaaattatattacactcttccctaagatatttgtcataggacacggagactaccaggaaggccaacgccagtccatcgactggaagaccttctccgccagcggcgccatcgactttgccaggccatctatctccgtagaagttctccgagaacaagagaacccttcgtagaggaactcgaggtgcagctgcagacgatgatctcgtatgcaagccaatacatgccctccggcatatcggctcgatcgacggcactcctgcttcagggcctcgtcaatacgcttgccgatgccttcgagctgggcgcaggccccattcaaccacaagatgtatccagccgccgattcctcgggatcctcgcgggatactcggagctctctacagactctggtcatggacgtacagcaactcttcaggtacgagtagaaccacacctcgcgacctcggagcgtttccacggcctggtctttcttcacttctagcatagtcctctcgagttccgctacttgaaattttgtcctccaatattggatgagacgatcttggtcagcaagctggaactcaaatgggccggaacgatcactggcaactcaggctgcccgcgctgctggacatcctcgacatcaacatctctacaaacgacaacaaagtactcgagatcaaatgctaaagaaaactaaggtgatgactgcagacacgaaggcggttggaaccaatgagagttttacaaagcatgactaaagagtacaagggagccaaaatcctactcttcaaaaagcgggagaacggagtcccccagatcgccgacttcctccatcacatccttgcgcgcgttgctagccgccccctgatccaagatcttctgcagatcgagttcagcgtgcaccagcctcacacacgcaaggacatggcatgccctggtatagatcccgttagacgtctcctctccgatcctggccgcgtgcttggaggggattgcctccatcgccgtcgccagttctacaagcaaagacgtcagcgagaactcgtcgggattcgccggtatggtggtcttgacgccacactccccagcgagctggtgcagaccagtgtaggtgacccggaacgagccacggatctccgacaagttgttctcgagctctgacatacgatgctcgagcccttgccgttgtcgctcattgccggccaccagctccctcatcttctggaggtcctcgcgaacctccgtcagatcacacgtcagccggtcggcgcgctcattcgctgacgacgacgccgccgccctcgcctccacgatctcgcggtaatgccgcgagcaccagcttcaaggaggcgccccatctcgacctggagctcctcccaggtgaggacggtagacggcggacaccgaccagccgcaagatcgctggccgggccactaggcgtcgcctcgcggctcctgggcacaaccgcgacatctgtcgaggccacagtaggggacgtgctggaggtccctccagatccgtcctgtgctgcctttgcccatgccgccctgcgaaaggttgcaattgagacaggctgcaagtgtttgacgaagtgacaaaacctcaaattcatccacttacttctcgccaagcgtcacaagccgctatcgtcgcggaggcgggggagacgcgtccgaggccttgagtacaacgggtatgatgtgaggtggaagttttccggctacgcgatgaaacaccaggagagcttaccgagggggtgggtgtcttccgacaatttccgatcacggaggagattttcctccccttttcggaacgttgccaccacttattgtggcagcagcggcagcgacatcggacgcctccttgacgacgtcctccttcagcgacgccgccgcctgatgatccacgagtggcccgatgatatcagtcagagagagagaacctacgcttcatgaagttacaatgctatctcggaagaaaaatgcaaaaggaccgctgagtacactcacattgatggcagtttcgtgttcggctgcccccttatcgcaaagggggacggggacgttgttcgccattgtcgggccgctgatcatcaattggccgacgcggcgctccacggattcactgctcaaacctgtagatcgagaaccagaattcgataagtcaggaggaacacgcacacaaggaagtcaatttaaatacaagaaaaataccccaaggagaaacccgggtcgcgtcctcaggtccagaatagtcaaaggctaggtgggctcgagcctggagcggctagatccgtctaccaatgaagtcggcagcgacttcataccccgacaacccccgtacttggaggtcatcaatgatatcgatgaaagactggagggatggggccaaggcgggtttcgcggtccaagacgaaatcttgtctggtcgttcctcaggaacaacgaagactggatccgaattttctatctgaagatagaaccacctcgcccgccatatgctacaagaagaagggcactggaacgggatatagtgcgacttcaggccatcccggagttggaaaccgacacatgcggataccctgttgggttccatccaacgcaactcgtagtagaaacgaaagaggtcaagaaacggctctaccccaatgtaggcctcacaaagatgtgaaaaaatactgaggaaggcgatggaattggggctcaaatggagcagagaaaggccatagaaattcaagaccaagagaagaaattcagaaggcggaggaagaaaaccacagagaatgtagtcctcgatcgcaaccatgcgacccaggacaggctggggttcaatacctcctgcttctctctccatggtcccgcgaccgggaagggcgccatccgcctgtagtttctttagcgacgcgctggtggaggtggacttgtcgagatccattgccgccggagatcgccggagaagggaccgagatgaactagctagggttcttgcgggagcggagaagacaaggaacgctcggaggctggagggtcttttcacaacaggcggacttcgaaatggatccccaaaactcccttaaatagtcgcacttccgacgatgcgaattccaaggaaaggagagagatagctgccggaaatttctgggtccgttacacgcagcagtttttcatacttcaatttaaattcactcatgaccgttagtttcactgggcgttgtcgattaatcctcgtctctcggtcctcacatcgagaacgacaacaacctcgacatcagaagtcacgatcgggttacatgagttcatttaagcagaagtcgggggctactgtcagggttacgggaaaggtataccctctacccttcgatatatgtcacatatcgatatggtatacttgcgcgtatacggacgttttcggcatatgttaaggaaattcgccatggagttcacagatggaaggagtcctactcggacaggactgggtcgtcattgtatcgtgccgggtccgatgtctccgagtcctacttggagaccagttgacctgcgatataaaagggagcccccgggaagacctaaggcatcaaatctcatagccaacacatccaccacagcctacggagttgaagcctacaggagccaagtcgccgggagatctagtcgtaccttctcgattacgatctcggcggtatcatcgagttccgctttccctttgtaatctgcggtctccatcatataatcccatatcaactggattagggctattacctatcgaggggcctgaaccagtataatctttgttttctgcctgcttgatgtcgtattacgtagatcctcgtaccagcgtaccccaataccctctatatccggtctacgggtatcccccgtcgacaaaaaccatctaaaatatataatggggtgcctagtcattgtccgtatgtgatttttacaagaggtcatcttaaagaaccgtctataaaaaatagaactttattttacacataacatctctagtttattttgtgctaacgctccacccaacccaactccgctcacatttcaggtcactataaaaatacgatttttctatacgaggacccatttaggttgcagacaacccatttaggttgcagacagaccgtaattggcatcgaccttcattttcgcgtacggctcattaagagacccgcatgcaaaaatctatttttgcagacgggcctcttaagggggccgcatgtgaaaataagacctcttaagtggtctgcatgcgaaaataccaccccttcacatttttttttatcttcctccactatcttttccctctcactacttcaattttttttttgaactcctctcctctctctccccctctcctctcctaattatttactctcctctctctcccggccccacaatgggcggcggcgggcggtcatggcgccgcggatctggtgttggccccgcgacggcgggcaacatggagcggctggcagcgcgtgtggatccagtgatgacagcgggcgaccgggagcagagcagccgaaagcggcgagcggcaccgacgaggtagcctagagcaacgccaccctgtgtgaattcgacaatgacgacgggtgccggcgaccgggagcgggcggcgatggctcgtcccctcgtggaactggcaccagcgacgacgacgccgaccgggagcgggcagcggtggtggcccatccccacgtggatctggtgccggcgatctccatcgcgtggatctagtgccggcaacgacggagggaggtgggtccggtggatccgatggcgccgccgctgacaacgatggcgggcggcggatctgatggcaccgacaacaacgacaacggtgggtggtggatccggacggcggcggcggcaggcccgagttcaccctggttatttttatttttatttttttcactaaatttatttttgtatgcggctggtatatgaaaccgcatgagaaaatggaatttttgcatgcggttgtcctggccgtatgcaaaaaaaatcccattttcacgtaccttttggtgcatgcagttgggatggccgcatgcaagggatcacttttgaccgtttgtaaaatggtttccgtagtagtgagtgaggctaaaactatttgactgagaggtggagttggagctgtgctaaacagcccggagtatacactactgcactatatatgctactccttccgtcttgaaatataagggattttgaatagatgtggtatatactagtactacgaatctcttatattttgggacgggtgaagtatttattgaagagactgtgcatggattgggtcctctctaaatcctaggtattgtttagatcagggactaatcacatcggatgtttgatactaatttggagtattaaacatagagtacttgtaaaattaattatataaatgagagctaattcgcgtgaaaatttttttaagcctaattaatccataattagcccatgtttactgtagcatcatatagggtaatcatggattaattaagctcaatagattcgtctcatgaattagtccgggttatgggagttttagtccatccaagccccccaaagttggctgcttacaagggtaacctacgtacacgtcgatacatcatacatggaatgggtcctttttcaaagaaatgattacgacgttcggtgcgcaaagaactggacagacataagaacacgaaaggcagaccaacgcatgctagaaaaatttaaacgagaagattagaccgtgtgctcaccaagaaatggtttcaaaacatcctgtgtatctcaccactatatagaaataactatctggaacgtctgaacgtgtcgagtagaactgtttgtgacgtaccataccatcgtggctaattctactgtctgtcacgtctacaagacccttgtatatatgtatcggtttttagatgttggctcatttaaaatcagcatatagatagttttccatcttcgagcaatgaaaatatatagaaccgacacctttgagaaactataggtgttggttcaataggaaaaaatcggcaccactactataggtgcagaaattttaaaacaaccgacacctataaatatatggaataattgctcatttgaccatgtttggaagtctaactattgatctgaccttgcttttcatagtttgcttatttgaccatgcttttcaaaatctaataccccatctgaccctctttccattacaccgttagtgtttcatttagaaaaaagaaaaaaaatatatttactatttaaaccgactaaaataccctcaagacactttaaccctacccagcccaaccctatatatctctctctcctctcctctctttctatcctctctctctctcttcatgtcctctcgtactccgagcgggagtgggcggtggcgggcggcagtcgggagtggcttcggtggccgcgaggacgggggatcaagcagcgccacccacgggagggctggatctaccgtcctagggagcggcaactggcgacagcgggcggcgagggtggtggatccgacgacgccgtccccgggagggcctgatcctccaccctagggagcgattgcgatgacgacggcgggtggcggatccacctacgctgccctcgagggtggcggatccgccagctccccctcttcggatgtggtcagcagcaacaggaggggcgtgtgtgccctccagccccttcccggcgcgcggcggcgatggcgatagctggcgaaggtgcatccgtcgacgctggcctcgagggtggcggatccgcgcgggctcctcctccgatgaggtctgcggcgacgggagggacctgcgcgccctcacccccttcccagtgcacggtggtggtggcggcagttggcgacggcgggtagggcggcgacggatggatgctcccgatttttcattttttatttttattttttttggccgataatcattttcgcagtcggaccacctaacacttcgcatgcgaaaatcccgtttttgcatgcggttgggctggccgcatggtaatatcgccatttttacatacacctaagtgcatgtggttgctacatccgcataaaaaatgcaatctaactatatcaaaaagggttcctgtagtagtgttagtaataacgagtgtaaaccgcttctagataaatcatcttataataagtgccctatattaaggaaacaatcagtatcggactagctcatttggattctctactagtgtctataacttccttagaccttatcaaaacaaacgggctcatatattacaacacgagactattcactcaagagataggtgttgcagccacagcagtctgtgcagagaaaggcagtagtgcatggccgttgcccaagatattcttctgtgctaaagccggccaacgcaatgcctagaggacagtgtgggcgtggatttggaggcacgggacgacggtgccgtctagaaccaaccctgtccgttggtggtaacatctcaaagtggcagccatctttcactctctccctttccttttaacaccagagagatgtcacagagagggtgcgtgcatgctgtatagtagtaaaccggtggtccaaacggctccccatcccgtgcacgcctttgcatatgtaatcacccaaaagttggggccttttgggcgagccatatcgaagagatatatcacgaactctcacgcatgttacggtcgatctgatctgacgaccgtcgtccaacctacgctttcaccaaagacagccgtggaatcgtatagattccctactccgttctaggtcatcacctcttatagattttagctattgttaaagatataagaggtcagtgataacttcacctcatctctaatgaataaagacatgtcagtgatgatcaatacctcggatgtgtgtaagcagtccgtcacattaaccattgacccagcggtgttgccacatactccctccgtcccaaaaaaagacaaaccctgatttccgtgcccaacgtttgaccgtccgttttatttgaaaaaattatgaaaaaaaattaaaaaacaagtcacgcataaaatattaatcatgttttatcatctaacaacaatgaaaatacgaattataaaaaaaatttatataagacagacagtcaaagttggacacggaaatccatggtttgtctttttttgggacggagggagtatcatagatgtgagctcacaaaccagttctaacccgtcacaggtcatgagcttagctctgatggattttaccattaatgatgtgttcttcggaaaaacaaaacccacgtccttgataaacccagaaattccttagatctgggcatccggcaacatatccacatccatacataggagaactcacaactgtcaggtttgtacatgaagcttggtaggtgcaaactctatacctgtcgcaagtgagaggttacctctggcggacctatgtgtttgcccgttagaagtgatttatcaggtgcaaattaaataagaggcccatcacatataacctagctcttacctgtaatgagccgcaccctacagcttcatctattaccctaattgaatctgtcacacatgtgatcattcacgatgagacacttttatccatcacaaataaatcgatatatagcgtaatgatattctcgtggtcatgctagctgcagccgcctgtagatcacttgcagctagctagctagctttgggtaagtaggtaattggataggttaggtatatatgtcgctgcacttttgtgttggggttcatttcgccatcggttaaacggaatgtgaactaacagcaacacgaagattaattaccaaacagattaacggtgaattggatgtacggaaacagctagtagcgagtaccttgttgcccgggcaaatttcattcttcgagcacagctaactggctaattaacaagctgtttgggtttggagcattgtaccgctcaactgaaacttggcaacggaggttggcaataatcatgaaaagctgtaatactatacgtgaaaggtcattagagtaggtataataccagactataaagctagctataaacatattttaagaagataaagagaagatagaagagttgcgggctatagatttatagccagctacagcacggactataaaatacatctgtgtatgatagatgggactatatattaattatgaagtatatgtttatatgtatctatctatctattataaactaaaagtccattaaacttcctaaaaatactcttaagccgccacgtggcactcctataaactctcctagaccgccacatggcactatctaatctcaccgttaattttcacttaaattggtggacccattaatttaaaccattagattagatctattattaaaaaggtgatatcttttcatgcaaataaaatatgcaactggtggcttggggaaaggaaagaaaacaaaaaatgtccgtacgtaagtataatcgaaaaaaagaaaacaaatgaaccttcctcccattagccggaaggaaaaaaatgacatctgcgataaaaaataataaaaccaaaaataaaagcgtacttattactaggaaaaaacgacggtctaaaataggattttgtataatataatataaatatcaaatatcaaatcaaagtctctaaacatcatcttttaaattatttataattatatgcccaatttatgatccattgtattcgtttaattatataaactatcgatgtataaaagttattttttagtcttaaatacatcacgacacatcgagtcgacatataatagttaacgttggaaactaaaagtccattaaacgttatataaacgctcctaaacagccttaggacactcctaaaaacgcttttacgccaccacgtgatgctctaataaattagagaaaaccttataaatttagagaaaaaagaaaaacatccaaccctcattttcattggtggacctactatttttaaaccattaaattatatttatttaaaatacatccatgtaacctccccgaataaaaaaaacaaccgtgaactactcacgaaaaaaaagataaaaaaaaatgtaattacaattggagaaagaagaattagccctgccacggtcccacctaattgtcaagagtgacacgtacatacgttccgttcacccaaaaactgaaaaaaaattctcacatgtacaatacgtactattattcaccggattaagaaaaaatgtactattattcacctgattaagaaaaaataaatttccagggtacgtacatactacgcaccgtacttccctcattgaatcttatacatacaagaaaaaatcacccgtcccctaataaacttatctaaattagatgtacatgggaaaatattaggactacatttgatattaactatattttaatttaaaaattatcacatggaaacatatttagctcttcgtccattaaatatccaataaacactattaagcagccatgtagcacttctacaaacgcacatacaccgccatgtgacattttaataaattagaaaaatcagaaaagttatgagaataaaaaaaaaatccgtttatcgattttcactaatatacagtggacccatattgtgcggacgtatctctccacctatttcctttctctccttttttttccagtttatgttagatggaaaaactattttaggataacaaatttaaataattatattatctaaatcatatagctaactttttattggtgcataccattagattatttactataaaacttaaaattgaagatccatgttaactatattattaaaaaattcatgctttgggtcatatatattctatggactagttattgttcactcatccatactttttcaaggaaaaaatcatatagattttaaaacctttcgattaataacgtactcttaacttagaataattttaaacaatttaattggtttaattaaaaatacaacacccaaagtacttcctaaaagatttatgattaaatgtatttatgaaaatagatgactcaaaactaggaccgacttgatctattttaaaaacaataatctcctctgatcctcctgcctcgtgtatatctctgaccttccctatctgcctcagccatcaactcctctccaattcaattatctcctcttctatttttttaacttaacacaatataaaaatattcataactattgttttatttataattaaataaataaatcgagatcgcattagccatattttacttatagaagttaacatacaacatttgatggtagaccttatcgtttgcttggcaactaaataacaacgataaattaattgaacatatgtattatgttatactaaatcactgtatataacaaaaatcaactaaacacccctatagcgctcatgaattgctgtataatatgtcataaaattataagaaaaaccaattaaattgacgtatccatgatttttaactattagatctattttttttaaaaaaatattaagttgcaatgtgtcacatcctataaaaaacaggaaagacaagataatgaaacatcccgttattggctttcacttaaagcacttagaaaaattagaaaaataaaatctccaccacctcctcacatgtacaaaatactatcgtcccctccctattattttatgtattaaattaaaagagaaacaataaataatatttgatactctttttgagaaacaaagtataaacgcagacgctcacaatgcgcgtacatttactcctatgaatgtagacataccgctatgggtacttccaagagactaggctgacatattttgacattgacgaagtcgccacatatacctcgctgtcgacgggtacatcgcctaccactaaaagaatttgtcaagtccgggacttaaactcgagtgggcaagttccaccacaaggaataatattagatattaaaacaatcataatatttaagctacatttctagaatacccctatgacgtttaaaccggtggaactattatttctaaccgttagatatatcttatataagaacaaaaagcgtgtattcatggtacatcacatttcaaaaatattattgtgtaattatatttcgtcgttattgtattcacgtctacctttgtttcaaatgatgaataagattataaataattgcttatagatattacttaaatataatataatatagttagaaaattataaaagcatgccgactaaaacaatttagggagaaatcgtggtaaatgttctccggttaatatttcactcgtacaagtgtctcaaacttagtgtacgatgtatatccacgtatccgggcgggctacctttctattgtatgaattgtctattgagttgtacttgctcttaggacgtggtttttgatgtggacttaattaaggacataggggtgctacgtgcgcacgtggcgtggcagtgggtcgcagcctcgatcgtcacacttaaacaaattgcgatggccagtcagagatgctggatcactttgggaggagcgcggaaactatacttaggaggagctgatagtaatagcaagtttaatagtatagccaactcgctgcaaattatctatatatagtcaacttaatagccaatttatataatagttacctataaatatatactacacaattaatatatggtcccacctgtcatacacacatgtgtcttggagtccgtgttgcagctggttacaaatctatagctcgctgctcttatctcttctcttttacctctttaaaatatatttatagttggtttataatttgttattaaaatatatttatagttggtttataatttgttattgtacctgctctaatactctactagaaaaaaatttgcaaacaggctaaatcggtctatccaggcagccttcggatttgcctgcaggcaaaggcctgtgaacgcaggcagcctttggatccgcctacgaaaatcattttgcaggtggcctcttcttttttgtagccaccaaattcacccgcctgcgaaaacattgccagcgcacaaaaaaaaaattgcctgccaccacccctacccgccgccgccctaccaactccggctagatctagggttttgggagggagagggaggggagggaagtcatactgctgttggccgctgccgccggagctggaatggagggagggaggaagccgcaggccaccaccgtcagatctggaaggagggagggagcaagccgcatcgccgccgtcctcccgccccctccggctagatctgggaggtggggccgccgccgccaccaccacagctacaggggggccactgccagatctggaaggagggagggaggaagccatgccgtggcaaccctcccgccctcttcggccaaatctgggaggggggctgccgccggatctagaaggagggaggaagttgccccgccgccgccctctccgaccagatctgggatggggggccgccaccaccaacgctgcaccctccgatcggatctggagggaggggagccgctgccgctacaaatgtgctccgcgccgccgagtgacgaagggagccacctccgcgccaccaccatcgcgtgcccgcgccaccgcccttgctgcgtccgggggagccgtcgtcgccacgcgtccgtgccgctacctttgacgtgtccaagccgctgccgttgggatgagagagagggagagccgcctcccatccacgtcgcgccgccgccaccctccctcctctggtcggatctggaagggggagggagggaggggaggggaggggaggagggaaggggcacagtgaggggaggggaggcagcacagttagcagaggcaggtgagcgactgtaaggggagggaggtgaggagtgatttttataactaaaaaagccttttgcaggtggtatttttgcaggcggagctcttagatggttcgcctgcaaaaatcgattttcgcgggtggacaataatctcatcccacggatgagattttcgtaggcggcgaattagctccaagagacctacccacctgaaaaaaaatgccatcaactaaaaaaatggtttttctagtagtgatagatggatcgattatcaattggactaactgtattgggcgagcgcttgcttacacgggttctttatatatatttcgattgatctgtaaaatatatggagaccaaacaaggatccaggttgaaaccgatatagccgtagaaaaacctatagatgctggttctaatgagtccatataggcatcggttccggtatcagcatcgattattcggcaccaatgacacaacacattggtgccggttcttaaactggcacttatatgacaccataggtgccttgccggttctaaatttagaaccgacacctatagtggtgcaaccttttaattttccaagtgctaaaaaataaaaaaatagtatttaattaggcacctatacagtcacagttcacttcccacaagtcatatgattttctcaacccatatcatgtacatgctttaaggaaaattcaaagtcaagacctttctccgtgtcatattatatgctgttttgattttttatagtcaaattttgttaaatttgaccaagtttataaaaaattagcaacatctagaatatcaaattagattcattaaatctaacatcagatatattttaatagtatgtttgttttatattgaaaatactactatatttttttttaaatttggttaaacttaaaaaaatttgactaagaaaaaagtcaggatgacttataatatgaaatggagaaagtattgtcttgagactattgttatccaaacttataatccatatttaacatcatatatgagcttaaaagaaaattgtgtcaactacaaaaaaaaattgtatgtcatctatacctacaactttcaactttcaaatagattttgcatccatccgagatcgtttttagaaaatttaaatattcacttatgtaaatagatctaagaccttataacatattttcggacatccaaacaactatcaactacaacttttgtagatctcatcgagctctacaaatttgatattaagtttatctttatccgaatttatataataaaaaagtgagataaaaacacacacatatgagttgtgttatcataggtgacaattttagttgtgaactgaaatttttattaagaatcggcacatatatgattcccatacgtatagattaggagaaatttactgagctgcctcttcttagtttgctagttgattaattacacattattatttaagagagaatcccttatatgccactagaatttggccagcttccttatatgccactcaaaattggcttctcccttatatgccactagttcaagtttttccaccattttatgccactcccaccactatagtgttagttgactgttagtcaaaggttagttttttcgtaaatgaccaatatgccctctcaactaaaaaatgtgtaaacttcaaaaaatcataactaatttattttaaatcctttttgagtgaacaaaattttgtcagaaccagtgaaaaatgctctttatattaaaaatattgttggaaaactgcatgttttatgcttacattgaaaatttatttgtgatggtaatggctaaaattgcatgtgatgcagaaaaaatcaattttcatatgttgtatcctagctatattagtactaaaatatctattattggttgtatactaattctaaagggcaaatgcgtctttttacaatgaagttaacggaggagaaacttgaaccggtggtataaaagggagaagccaatttgaagtggcatataagggagcccgttaatttagagtggcatataagggattctctctattatttaatccatcatattagatgtattctctattcttatttagtgtacatccaaacagtcctgctctgatttatggccaacttagttaagtactccatatgtatgttttgcatctgttgcttttagtttatttgagcatacacatcaaagctaatttgaagcactttttcatgataatattaatgtgtatagtactactctctccaagcaatagctagatgtctttttttagtaacttgaaggacaatatacatatatgcctaatcttacatagttcttttggtctgtagagttcctcaagatgtattgaacatcctaataatttgccttataatatgttacaacctgtattttgatcatatgcattcttaatatttgacatctgatttttcctttacgttactaggtagtattggattgatcatggataagggatggatagaagcatctaggtcgagtgttgaatatagtatcggcgttagtatatttctagagctcgccttgtccaattcagccaatgacaatacaattcttgttggtgtttattacggtcacaaataaaatccgcaagcgcacggatataccgatgtagcacttcaggaggaagtattcccatgtatggaatctgcagggaacatgtgaggttatctcttcttcaggtttatccaaggacacaaaataaatgtgggcaaaggatagagaagattttctagtaagaaacagtgtttacagaaagcttggtttaatcctattgcaatacttgcaatactttaggcactggcttgctcgcagctaccatagcgcgctctactccgtactcgtccagggaggactgcagtgatctcgagtgctgtcactacctctacaccaacctctaactatctgtgggatacgtagcaattgctggtaattaactacctaggcatcgcgtttatgcaattaattaccactctagtgttagctaaatactaaagtaacactattactagtgacattaatccagtatgctaataggaactaactaagatataattctcacaaagtaaatcttaattactcaaaagaatatttctattaaatcagagtaattaacaagatacaaaaagtaaaagtaagagtagattagtgacaactccggaattactccgatttcttctaccttactctctctctctctattccaagtatacaataaagcatacaaagagcatgttataattgagcttaagctatatcttggtgtgtgttgtgtatgagggaggagaggggtatttataggaggagtttgcttgagaggatgatgatgctccatggaatccaaagggcatcttcactcttgagcctccacctatcctctctatgacggtttctaccagtaaaaacgctcccaaccgtcatagcaagtcggcaagtaattgcctctgaaaaatggggccgattgggctccttttgggtttggccaaaccatgggttcagccgaacccttgccggctctttttgccccgaattttctcgtgggctctggtgaagaatccctcagcccatatgtatggtggatgggcccatttgaatgtgttttgttaggtttgtgggtgcaaaactccataggcttgaatgtggaagtttaattaacctccttctttatgtatcttttgtctcaactttggtagtttgtcacctgcatccaaatatacaccaacactcgtggaaattattagaaataaaccctaccactatgttgcatgctttatactttcatatttatgtaggtattgacgacgtaaatttggcatttaacagccgccaacaatcctttgcccttgcaaaaatcgtggaaatagatattggttagtgagcatctgatttgtgatggattcttggttgtgcacacctcatgtattcatcatggaggaagcatgtttacttccaagccaagtgttgcctcaagttcacacctcatggattcactagcctatgccgtcgtacattctcgcgaccctaaacattctattatgttacatggtacgtgaaagtcacagtatatatattgctcacaaaaaacgtgggtcacataagtgatattatcttgatatatatatataatgaatggcttaatatatattgcaaactttacatccatatgagtcatcatcttataactgtatgtattgttgcatgacccccttatcctctgcttattttccgttggtgcgtatgctttatatgtcatacacatattttctaaggtttttaagcatttaggttattttaattttaaatttgtatgaaatcattaaacctatagaaaaatcattatgaaatcattctaaaaattcaggtgatcatgcctgtcttgttagagggaatgtgtatctccttgtagcgatttttttttctcaaacatgttaaatattaattgttagaaaaaaataatatttggtcatatatttcgaatatgccctgaatagtgcaatattgactaatgaatccttactaaagaatgagggtttatttgtaaaataattttctattatatgtgcaaatcgtaaaattat

SEQ ID NO: 71489 - DNA, 9741 bp, Oryza sativa
ttagttcctcacatgatatgtttttctaagtactttaacgcactactatagatagggtttttccatacggctgagaaccatctttccatctttccaagacatcatttttgcatgcggacctcttaaggagacccgtatgggataatcgatttttccatacgggcttcttaaggagctgtttgcgaaaatgccgcgcgatttttgcaggcgccactagttatggtccgtttgcaaaaatcatggggtctcgcacagaaaaatcacttttgtagtagtgcgttgatatgttttaattttgaacagcctttcactactgcaaagagcattttttttcaaatagtcaaaaatgtattttcgcatgcagatccgtggcctgcctgtaactgaacgatcataaaaattcgacattttttttaggctgttaagcacatgcatgcatgtgaaaatcgtttttgacgcgcatgccaaaataaaacactagatcctacaatatataggctccaattcagaaatttacaatacaattctacaatcaatcatcggtgccgaatcagtcgatttagcactgctttccgattcatcaagaagcaggaaactaaccaaaaacttacagccgaggattctcaagggcctcaaggcctgagaaggtgagcgcgcgccatcgttaattgaagctgcacccgcacaaaacaaaacttcagcaatcctcgcagcgcaataattaatagcactggagatctacggtgaatcggcgaggtcgtcgtcaaatttaagtaattattaattattttcctatcatttgatttattgttaaatatgctttcatgtatatatataattttacatatttcataaatttttttaataaaacgaatgatcaaacatgtgcttaaaaagtgtcaaacatttagaaacggagggaatatttacatgtaaacttatagatttgtatttaatgagttttatagttacataaaaggttagatttccacgcatgagcagccacgatttctgcagcctctctctgccataatctcgcttttgtaccggtcccacgcctctcgccgtacgtcccaatttgtacttatcaaatcccagattacattactttgtatacttctctggatcacaaataatcagtactgcacatatttacgcaatatatagtttgaaatatgctaacatatattgtcaacttcttctcaaaaagttattgtttgatataggagctagactagtcgtcgactagctactagctagctagcgatcgacaagcggaaaattgattttacccgagcaacaaaaagaaggaagagaaaagccagccatatatttatatctttcgtattttcttagcagcaaaagcacacgactgtgtgcacgtgcacgtcgtcgtcgttacgcggaggaggctcatctaacttatactatagcttcctctaacttcagttggtgagagatatgtgtcgcttatatgtgaacccataaaaataggttctacctgttagggatctatgtctctgtaatttaaaagtcagatgagttcctttcgcattacgcccaacggtcctttccgaaggagcacaatttgtcaatttgctagagtcagttaaaacccgtacggaaggtcattaataacctacgtttacatatgatgtacgcagctgagaaaaaaaaacaaataattcattcattcggtgctccacagggttattactcttgtaatacgtaatttaatactactcttacatttagaaatggagagtttatgtgtgtgtatatatatacggtgcaaactcgatagcttcgctccagcatcgtcccaggtgatcacttatcaggtctccatggcgctcctggttttgctcgcttactactacgaaaactctttttgcatgcaggcgagaagcatatttgcatacggttgtgcccatcgtatgggtaagaaggtctgcaaaaatcacgtttttcacatgcggccggcgtaaccgtattttcacatgtggtcgcttatactggctacatgcgaaaataaattcagcaataaaaaaaaaaccaaaacaccctcccccaaccctagctgccaccggagcgccgtatccccgccgcccgagccaggcgcacgtcgttgccggcgccagatccatcactcccgccgcccaccgtcgtcaccagccctggatctgttgcccccgccgcccaccgtcgtcgccggcgccggattgacagcccgccgtccacgccggcgcgggatcggctgctccaccacctgttgtcggcgccaacgctggatccgccagccccgccgtttgcgcaagggaggggcgcccttggcaccgaatccgcatgaggcggtgccgcccctgccgccgtggcggtgagggggggagggttgcctcgtcgtcgttgtcggcgttggcagtgagaaggggatggcggtggcgccgctgcccgcgttgccgcccactcgctggatccactgtcccaattgcgcgcccgccgtcgccgtagctgcagccgctccctagggtgacgaatctgaccttcccgagggaggcgccgcctgatccgccgcccttgctcccggctgccggcacccactctcatagagggagagggagaggacaaaataaaaagagagggagaggagaggtgagagagaggggggagagtgatataatagaaggggtgagagtggagatgggttggaaaaaatttgatgtattgggagcgaaaagagggtgtagggagatgaaaaaaattagggttgtatttttgtatgcggacctcttaaggggctgcatgtaaaaatatgagaaatttgaatcgaattttatggtactaaatcaacttatgtgaaaaagttatcaaaaacaaagttgtagaactcattgagatctacctttttcttctggtcatctctccatccaagtttgattgaactatataaaatttaaatattaaaatataagatattcaaataatttttcgggtagtaaatgattttaaatgaacaaattgttaacaacaaagttgtataacttatcaagatctacaacttttgttttgatcattttgctatttgactttgtttcaataatttgaattcgaatttcaaattatgataacttcagacaacattttgaagtactaaacgatttcaactaaaaaagtcgtcaagaacaaagttgtatataactcatcgagatatataacttttattttggtcatttcttcatctgacaaagtgatagtaacattattcataaaatttacacatctcttatatagttttataaaataaaagaaagatatgtaatttttgggaaaatattactatcactttgttggatgaagaaatgaccaaaacaaaagttatagatcatgatgagttatacaactttgctgttgatgaccttttcagctgaagttatttactacttcaaaatattatttaaaattttgaaattcaaatttttaattgacaaaacaaagttacaagaaaaaatggccaaaataatagcagaaagaacacaatgacatgatagagcatgattttggaaacatttagaaaaaatgatcatccaatttggagttcatgagtgagataaactggtttcaattttttaaattttatatgcaggctcttaagtggcccgtatggaaaaatttattttttcatacgggcgtgttaagtagccgtatgcgaaaatgccgctcgatttttttcagacgcggcaagttatgttccgtttgtaaaaattatagggtcttgtatagaaaaatcgtctgtgtagtagtggctgtagtcgtgttagaagcagcggttcgagcggacagccagacacaggtcaccttgatttttctgttctgttgtccctttcactgcaaaactcttactatctaattttacaaggcatgatcttaaaaaaaaatggtctacacatatacacataataaatgagtaaatttcataaaactatagatatttcttttgaaaaaaagataaaatatagatttaaggtggtgttgtatcacgaaactacatacatacatagttttcattgagttcattgtgaaaagtcgctgtatatatggtaaaactatagatcgatcgttaatttaagacaaacctgaagtggagctgttcggtgggacttgttgcagcatcctggctgtgctgttaaggtgatgacttcaaatgtaaatgttaaggttatcaactataaaattataaaattatatatcttacttactgtataattttgatatagagtttgcgtcgatttcaattcatatgaaaattttaaagcatttatcaattagatctgataacttctatcacacatatatatgatcacataaactatgtcaaataaaaaattgttcagcaaccacgttgtagatcttgtcaagaaatataactttggcagaaagtttatctttgatcatcgacttcatataaaaatattattaatttctttatcattttcacttcgatacgcagttaatggtgggctgtcacgcccagaaattcccgaatagaattccaagcagaatgtgcattaaaacccccgtccagtaccggccggggtacacaaacgacaatgttgacatacagatccacgtcttacaaacaatataaaagtcttacataaatgcagcggacaaacgatagataacaggagctaagccttgacttgaactgcagcgggaacaccactccacaggcatcctcgacggcacggacgaagcctactcctcggagaacccgccatcggacacatactcatacgctggggttgggggaaaaataaagcaagactgagtactatccactgtactcagcaagtcataccggaatggggggtatgatgcagggattcaacaagggatagctatacaggttcatttgcataatactggcatttataaacagaagttgaatgcgaaaaacagttgtaatagtttaaccaatattaatcacccactgtccaacgctacaccacgttgcaacaggcccaaccatccacctataccatccaatttcattagactaaactaagatgagtctaatcacggtgaatctggttgaccgcccataaccgcgggcatggctattcgaatagttttactctgatcagaggtgtacaactgtacccacaagacacagccccacgacacgtttccgtgcgccgacatgccaccacgacatatcggaaagagactgtgacaggacccttcgcataaccccctctagccaagtacaccacacctcaggtttcacccccgtccccagcgggcgacgggcagtcccctctcatacctaggtgaatccggaagcgacagaggccgtcgcagggcccaccccgctccatcacgcccacccttgccaggatgcgtcagctagagaaaagctacactacaagcccagccgttgcccacgctggcttgtggtaagtacgaggagttcttccagggtttcccgcgaaccggtccttacttgccatgggtgcgactagcagaactatgcacccacagcccaccatgtgattcattttaattaactaacaccaaagcggtggtactaatccaacattatcatataaacctacagtctatattttaaatgagatttccccattgtgtgctagttgaactaagcatggctaagcaactcctagtccaaaatctattcatgttataacccgagctaacaaaggagcaaggtaccaaaatagtatggctgtaacaataggtaaacatcccatagtgttattgcaaaacaaatgcagtatttgaaggaaaacaatagaacatttgcaatgtaggatcaacatgatcaagtgacaagtatgacttgccttgctctgctgctgaaggaacctcagcgactatttcgaagtacaccggagcgtcggaagagccggaatctaacgacatacaaggcaaacaatgcaaacaggctataagactactgaaacagagaacaaaaccatttttaatggattctacacatttttcttgatttactgcgacttgaatgggcttaaacggagctcggatgaattacatatgaattttagaagattcactgtgtttattactataacagaaagcccttatataatttattgcgccataattcccagggctgacgtcatcagggggggcggcgccgacaggcgggtcccactggtcagtggctcggaagagaggggaagggcgccggcacacggccccactcggcagcggctcaagggggccggtccaccatggaccgggaccacgcgggtggtccaccaccggtccacgggactgacggcccagatcggccccgagccgatcgggcggtggcggcagaagtggccgccgggcttggcttggctccaaagccggccggccggccatggctagcggcggcggcacgcggtcgacggcgacggcgaccggcggcacgggaggcggcggtggcggtcgaaagcgacggcgcgcgatttgaagcggcggcttggcactaggagggagaggaaggggaatagaggagatgaatgcctcaccgcgagtggccggcgctaagggagacgatggctaacggcgacggcgagccacgggaagacggcggcgacgggcggacgagcttcgggatgccctaaggaaggaagagagagagattagagggagggagatgaaccacgcgggccggcatccatggccgaaggcggcggtaggggtagggctcacctgagcgcgaggggatgcgggttccggcgacgaatctcgacggaggagcggcggacgaggtggagttcggcctcgcgaacccgacggcagcgacggcgcggtgcgacggcgaccctagcagcggctagcggcggccggagtagcgggagcggcggcggcgagtggttacacggcgtgggggcgatggagagctcgggagaggccggcggcaaaaggaaaagcgaggaggaggacgcggggatggattttataggggcgggaaggtcgggaacggcctaggtgctcccgatttcgccggcgacgtgggaggtgggaggtggggagagagagagagagagtgggggaattcaaaaaacgaatcccgcccatctcggttgagggcgcgggcgagagagagaggggggtgggcgtggggaagtcggggagcacacgcggcgtggccgaagtggctcagaggaggcggggcggcggtttcggcggcggcggtgacggccggaggttggggaaggacccgacaggtgggccccatctgtcggcgtccccgggagaggagggaggcgggcgggctggctgggcctcggcctgcggccggcccagcgggggagggggagagggagagaatgggtcggcggcccattcgaaaagaaaaggggaaaaagaaaaagaaaaaggaagaaaaggattttccctggaattaaaatattgcttgctcaatttgaattggttaaaattatctctagggctctgaaaattccaataaaaatcttgttagcgaatttcgatatgtagaactccagaaaaattccacatgccagtttcgattattatttgcattactttattagggttttctcttgatttgtaccggcattttcttagggtcatttataaattaaattttaggcttgggaggagaacttcagggtgtgacatgggccagactatgtggtccgttaagcatagtgcctgtttctattatgaatcagcagtgatattttcaatttataccactgtgggttggtattttcaaatcatatcattgttggttcatatcgagaaccgacagtgataattgaagtatcattgctgtttattgttatgaacattagtgttggctcggaataccgtttctatgctataatgaggacatgttagtagaaagaaggaattgtaatggggttgatgaggtgggagaaatcagtaccattgagttgagacctaacatctggagagtgtagaattagaagagtaatagacctataattgggacatattgtatggaggctgccttaagaaattaaacaaagaagttaccacgttagcttctatactaacaggtggagattaaaaattttttatggcatttctctttgggcaataggtttcataagcattgactgcggcctggaggcagacagcagctacctgggcgacctgaccggcctcacttacgtcccagacggcccgtacatcgacggcggcgagaatcagaaggtgaccaccgtataccgcaatcgctggtggggccctgacacacgtactctccacacggtcaggagcttcccatctgccaagggtcagcgcaactgctactcgctgcccacccatatcgggtcgaagtacttggtcaggctggatttcttgtatggcaactacgacggcatggacaacccatcgctaaaattcaaccttacccttggtgtgaaacactgggacaccgtgagtatagacaccaccgacggaaatgatggttataatgttcacgaagcggtgttcgtggcatgggcgagctaggcgccggtttgcctcatcaacatcggccagggcacgccgttcgtgtccacggtggagttgaggcctctcggtatcttgccctacccggctgtcatgggcaatgtgtcactctccctctatgttcggagcaacgtgggatctagccctgacgatgacaatttagtaaggtatatatgttcttaatttccttggatcttgtacattttgcagctcagttagtcagttgtacgttaaccaatatatcacttgaagctattttctgattttattaatttagctaaacaacgcactacaaactgggcattactcgcggttccacattaccagctatgtttgggagacgaccagcagcgatactgatttttacaaaagaaaataaaatgattttaattcatacagacaaaaaaggatcctaaatgcacactgattcaaaaatagattcaatttgaaagtagtcccggtttttggtgtgaaactgtagttgcacttcgtttgaatcattatatatgccattttgatttaataaatccaaatttaaaaaatatgaaaaagtaataatataatatcaactatagatttcttgttggtgtggagtaataattagttttttatgatttaataatttgaagtttaaattaatacatattgtgttgtcctcggaagctcaattgtcatgtttggatgatttaacaattgcagtctgaattagtaaatacctagatggtattgatttttttaagaaaacaaaactatggagctcgtgcgatcactaggccggatccagttatctgtgacgggctctaaccctcacctttgacggatttggttctggtcagagacaagtggtcactgatgactacacctcacttttgacgggtgaaagcccgtcactggtaattaaaacctttgacgggctaaaaaatatagccgtcacaggtgactcacacatgtgacggatgactctttgcaacccgtcaaaggtgacgaaacagctgtgactggttttagttctcacccgtcacagatgtcaaaaatcacccaaaaaaaaaagaaatgcctcagcccaaatgtacgaaatgaagaaaaatcaaatacatctcaagatgcacatgatacaataactttgtattttaaatcaaatacatctcaacaaacaactacacatgaagcaatctgacaatatacatcacacaagtatccatg

SEQ ID NO: 71490 - DNA, 3959 bp, Oryza sativa
cctgcagccctctcgtcgttcccggtcgtcgtggcgttcgtccctccgtcaagccgttctcgtccgtcgtccgcgtccgtcaagtgtgccgctgcagccccgtcgtcgtcttcgtcctcgtctccgcgtcgtcaagccttgtgccggccgcgtctcgccttcgtccaacgatcaccgccgaagtcgtcccctcgccgttcatctccgtcgttcctggccgcctccgccgcgcccgttcgtcgttgttgttcccacgcctcatcgcgtggtggtaaggatctctcctctcgctgccccgtcctcgtcctttcggtgtcgccccgtacccgttgtgcggttgtcgaccccggtacccgtgtaccggtgtcggtagtcgttcacgtgtgcgggtggtgaccgtgtagtgtccgtgttagtgtgcccgctcggtagccgcgttgtttccacgtgtgcagcccgcgtggtgtctagtggagtccgtttgtcggccactcgcctcggttgacacacggggtccgcttccgtcaacccgtggaccgtctctgtgtactcggtctactgcggtcctttaggttgacatgtggggtccgcatgtcaacggcgcagccttcctgtcttttctaggctagcgcttacacatgttttatagttgcaaaacctaattataataatccgcaaatctccatataacagcattaaacttcggatgaccatgtcttggtcatacgaactctgaatcgacccgttcaagtctcctaatgtttgttataacctaaagaaccctgtgctttctttttatgtattgttatttcttctttataggcttgtagctttgcttgtgtgcttcgcgtagcttctgtcgttccggaggttctcgaggcgtgggtcgcggtcgtcgccgaaggttcggaaggccgttgtctgcgagcaaggcaagtcacatcatccttgagcatattgaatcccagtttataaaattattttgatttaaattaatgcattgttgctttatttaaattctcgcgttatcactgttttatttagccatgcctatttacctttattatgaccttattattattgctattgttattattaccttgttcaccctaggataaacaaacccccaactagtgggtactctattcatggttccactagtatgaatttaggtagatgcttcgctgattaattaggcaacattaggtggttttataactttagactttgggaattctcatatcacttggacactatggaattgttggcttatggtggaattggacatacacctctcttcctctttcaaaaccccgaaaacctattttccggtggggtttgggtgcatgccagttgtgggaagtagcaccccggccaatataaggattaagctcgggcctctgttgcgaagcactaccgtacttccacatgtctagtgggtaaggcttagtttgtggctcagtctggttataaacaaaggtacacggatggagatggacgaagtcggggctcgatggacatctctaggacaaatgatggctacacgagctgcggcctggtagtcgagatgtcatggcacagggctggtgttctgttgctaggggctcaatcctgcctgcctatcccagaggttccggctgtaggtggagttgggtcggtactcttgtttatgtctaggatgggttgggaactatgtcatgtatttcgtccgtatgccatggtggtatgtggcacgtggttacacgtgaggaagatgtgtcttgtgggtaaagatgtacacctctgatcagagtaaatctattcgaatagccgcgcccccggttatgggcaagcctagcaatgtacccaagttagtggtttacttcttaaaatttgcttaacaactaaaatgtggaatggttggcctgggttggcttgggacgagctgggacccagggtcgggttgccagttcggtctgaatcatcgtaggccttgggttaaggcaggttcgtgtgggtttacggccttgtttaataatattgtgtagctctaggatcgtgtttacaaagtagctttgagcaactaagtgtcttttaaatgctgtttactgcaaaatttaacccctatattattaccccttgtacccccttgcattaatcatgcatctgccggtgtggcttgctgagtactatggttgtactcattcttgctctatcttcccccccttgagtaagagaagctttggagaagaagtcttaggtggagtcctgacttataccccagttgagcgcctgtgaagatggagccataggcccgctagtctgttgctgtttatttttgtctgtcaagcctgaagtgcctttgtaataatgtaaatattatcgatataataaagatgtgccttttgtatcatgtttgtatggtgtaccccggcttttcctgggacggggattaatacactagcgttcgggaaaatgcaaattttctcgctcgcgacacaatgcgaacatctattgtgactagacacttactatagcttcgtagactagttgatcttgtggatttggcatgcatattgtcccatcatcattcttacgataccaggccctggcccagttccttttccgagggtgtgggatatcgccaaacacccgcggcgtgttcgattcctctgcctcttcatcctcctgcctccattcctcatccttgccggcatatccggcggtgccaagtcggtgcgggtgctggttcaacgtttggagtaaccgatatgcctcgcttctagctctggactcgggggtcgacttcttcgcgtggaatgactcccagacctgatccgtgatccaaggaaatttcactgttggatcgggattcatcgggttgaagacgaactcatcgaccttaaccttaaaagcagcctgcttgataaggtcctcgtgctctgcaggataatcgaagctctccttgaactttagccaagcacttttcttctctgctatcggcacttgcttgatgtcatcttgcagaatactgaatttctccctccctatgaccccgcagatagacctaaatcggctcaatactttccggggacctgtcggcaagcctacttggttcacctctgttatgcagtaccgttccttagggattttgttccctgtcctaggagtaggtgcccttaaggacccaccagttgtcgtcgatattgatttgccttgctgagacgtcgtttaattttttacaaaataacgaaaatacacaattaagtgcttaaatggctaattatccaaagttctaaaatcacttagtcacataaataaactaaattgcacatctcacagtaataaaatgaattgaatatcacatataaataaattaaacatttcatcaagtcctaaaatcatacattcacctcatatcatctatttatccacatatcatctatcactaaaatcattcatgcaccacatttcatttattcatccacatgtcatcgatcacaaaaatcattcatgcaccacatttcatcaatcactaaaatcatctatcactaaaatcattcatgtaccacatttcatctattcatccacatctcatcaatcacaaaaatcattcatgcaccacatttcatcaatcacacaaataatgacaggaaccacagttcatccattcaccacagggagcagagggcgatgcgatggaggactaacttgagcacggctggtgggggtcggtggtgagctcggtggcagcggcgctgggatcggtggagggcgtcgccggtcggtggaggggccgggctcggcttgaggcgtcggcggtcctcaaggaggtcggaggaggccaagaggcgggcggcgtcggcgtcggagaggagggggcgacgacgacgaggaaggacgtcgccggtcggtggatgggccgggctcggcttggggcggcgtcgtgcatcggtgaggaggtggcggcagcctgaatg

SEQ ID NO: 71491 - DNA, 751 bp, Oryza sativa
caaatcagcatatacatgaatacatccgtccatgcggttgagctaacaaaatgatgaaacgagatgatcgccagattaatccattgtttacatgcagccaaagtacaatgacagttgacaaccttcaatctgcaggcaataatttacacttttcttttaaataagccttttttttcctcttagaaattaaaccgaagctgtgagcaagagcacatcatggtcagttcttggaagtcttttgtttgacacacacttgaattgctcccattttttcccaaccaatttgccacctaccatgcctatctgcacgcacccgtcgcgcggtttattagcctcttttctcctgcgaatcacggcgagctgatcagcgattaggcgaagcaaacgtaccaaattataatgggtgacgcccagcggcggcagcttctcctcgtcgccctcatgctcgccgccgccgcagaccactcgctggccggcttcttcggcggcgcgccgccggcgtctggtcccgccgccgccgccgccgacaacgacgaggtacgttagagagacatagtatcgttaattactggaaaggttaaagccggcgatttcgttggtcgatcgttctggctaattctgatgttcttttcttgtttcttttggctgatcgatgatgcagaagtgcagccggacgtgcgagtcggagcactgcctgggcacgtatgcacgtacgtacgtatatatataccactctccctggccgatcgat

SEQ ID NO: 71492 - DNA, 682 bp, Oryza sativa
tccacttggcttatcctacagtcaacctggctctgataccagcttgtcgcgaccgagaaaatttgcattttcccgaacgctagtgtattaatccccgtcccaggaaaagccggggtacaccatacaaacatgatacaaaaggcacatctttattatatcgataatatttacattattacaaaggcacttcaggcctaacagacaaaaataaacagcagcagactagcgggcctacggctccatcttcacaggcactcaactggggtataagctaggactccacctaagacttcttctccaaagcttctcttactgaagggggcaaagatagagaaagaatgagtacaaccacagtactcagcaagccacaccggcagatgcatgattaatgcaagggggtacaaggggtaataatataggggttaaattttgcagtaaacagcatttaaaagacacttagttgctcaaagctactttgtaaacacgatcctaaagctacacaatattattatacaaggccgtgaacccacacgaacctgccttaacccaaggcctacgatgattcagaccgaactggcaacccgaccctgggtcccagctcgtcccaagccaacccaggccaaccattccacattttagttgttaagcaaattttaagaagtaaaccactaacttgggtaca

SEQ ID NO: 71493 - DNA, 520 bp, Oryza sativa
  unsure (1)..(520): unsure at all n locations
agccgattctagtcgtagctgatctggactccagccgattcttactttggtcccgcaacaatccttatctccaactccggttcgatcccatcttcacctccgacgctgatattaccaaattcggttggtacacatgccccccaagtccgggatatttggtaatgttccggatttgccgggtactgacttcgagcaagtttcgcactttgctgttttccgaccgttattggcgggcttgaaatactaaccggcaccctcgagaaatctcacaccgtgacttctgttttcaccgctcaagcgaaactttatcctctctctctctccggcgattcctccgacgcaaaagcgacttccgggtgacttcatctncagcgagacctccgcctgcagcgatgtcgtcttccaccaatccatctgatgtgccatcggccgagtatgctgaggtaagtctccactggctagatcccctttcttagcagcagatcgattttctcctatcttatatcgctctctttctctc

SEQ ID NO: 71494 - DNA, 554 bp, Oryza sativa
ctgcaaatttcgtcatattgttactgtaaaaagtgtagtaacaacctataaagtttgcagtaccaacctatacatttttgcactaacatatgatgttactatccttctgggataatgttactgctgaatcatagtaacaaggtatgattgttacaggtacataactgatttgttcacaaatcattatatggtaatttgattagaagtgcttgccatgaaccatgagatcatgggttcaagtcttgtattcaccaatttatttttattttgcctaaaatagagaggagggagagaagaaaaatttatttttatttttcctaaaaaagagagaagaaggagggagagaagaaaaaagaagaaaaggagagattgggggatgagagattgagacttcgggagggacagatggaaggtgggagaggggcgtagaatagttattctaaggaaggggtgtataatagagctactctctatatacacacacgtacatataggtctaagcatatatgaaccaaagttcatatgctccatgaatctcaacctttggtcggttc

SEQ ID NO: 71495 - DNA, 995 bp, Oryza sativa
tgatggtgctggaggggatgaaaagggtagcgctggcatcgatggcgtgatcagagcaggtggagctgacgacgtgggtggcggtgtgctcaggagtgttggagcagcgacagagagcagtggctgactagccgggggctagcagtcaagccggcggatgcaatggtgatgaagcgggtgagaaggtgatagaggcggtggcggtagcgcgttttgaggatgatggcagtgcaaagatggccggtgtgctttttgtcggcatagcagttgccagttggcatcagtgtcgcacatgtagaacaagttaggcgtcagccccatagaaatggtccaatgaggacactttgggtatttaaaagaattggataaggctaacggagttggatggacggaactccaacggtaatggacagatagaatatttcctagctgtgtgattaatttgtttgtttggtaaacatggatcgaatttcaaagtataaacttaataataaatgactaacttcttcagggctgaccaaacataatagatgaagaaattccaaattagtcagaatactatataggaatacattctttgcacgcaagaagatgcttattcctttgtagttaagttacatgcatgatatattttggtgaccatgtgttaggctaagatttagatgttgtgagtttggaaactcacaggccaatgtacagccagccggaccgctgtcaagctaggaaatgcccaaattccaacttgtttgtttggtttagtgatgaattatttgtacaagtaacatataactgaatgacgtcgtacgtagtacgccaaataacatattcagtaggtatgttaattggttagatgggtacagaataaaattttaagtgcaaattatggttgagctttcagtttttctattggtcaatttggctataccaaatgagatactcgtattatcaggcaaatataaaactttccaatcctacgtagtgtattatatcaacag

SEQ ID NO: 71496 - DNA, 10790 bp, Oryza sativa
aataaatgtgtcgtatctaaatatggaacgtttattggaaaaggttataacagcggaggcttgttccgcttttccttggatgatatgtgtaataaagttgtgaaccatgtaaacgatgatgacgatgagtccaatgtgtggcattcgcgattttgtcatgtgaattttggttgtatgacacgcttagccaacatgagtttaatttcaaaattcactttaatcaaaggctctaagtgccatacttgtgttcaatcgaaacaacctcgcaagcctcacaaggcatcttaggcgaggaatttggcaccactagaacttgttaattccaatctatgcgaaatgaacggtgtgttgactaaaggggggaagaaatatttcatgacactgatagatgattgcactagattctgctatgtgtacctattgaaaacaaaggatgaagcattacattactttaagatctataaggtcgaggtagaaaaccaactggaaaggaaaatcaaacggttgaggtctgataggggtggagagtgtttttccaatgagtttacttctttctgcgaagagtatggaattattcatgagaggacgcatccctattcaccccagtcaaacggggtagccgaaagaaagaaccgcactctaactgagatggtgaatgccatgttagacactgcaggacttttcaaggaatgggggggtgaggcaatattgatcgtgtgtcatgttctgaatagaattcctactaagtataaggaagtaacaccattcgacgaatgagaaaggaataaattaaatctctctcacctgtgcatatggggctgtttggccaaggtaaatgtacctatagccaaaaagcgtaaacttggaccaaagaccgtagattgtgtgtttcttggttatgctatccacagtgtgagatataggttcttaatagtaaagtatggagtacccgacatgcgtgttggtacaattactgagtccagagatgccacattctttgagaatgaatttcctataaaaaaaatgcacctagcacttctagtcaagaacctattttatcccctgagcactttgcgtcgatagaacacattgatcaaacgcttgaggaaaatcctgaggaggataacattgtagaaactcaaaaaagtaagagacaaaggactgcaaagtcttttgaagatgactacattgtatatcttgtggatgatactccaagaaccaatgaagaggcatattcatctcctgacgctaactattggaaggaagcggtacgcaatgagatggactcaattatgtctaatggtacttaggaagtcatcgagcatgcatatgggtgcaagcctgtacgatgcaaatggattttcaagaaaaagcttaggcctgatggtacaattgaaaagtacaaggcagtcttgtggccaagggttatacccaaaaagaaggcgaggactttttcgacacttattcatcggttgctcgcttgaccacgattcgagtactacttgctctggcagcctctcatggtctactcgtccatcagatggatgttaagacagctttcctcaatggagagttggaggaagagatctatatggatcaaccagatgagtatgtactagtgtactagaaggtcaagagggaatggtgtgcaagctgttgaagttcttgtatggtctgacaatacacttacatctgctggctttattgtgaacgaagctgacaaatgtgtgtactatcgctatggtgggggagagggagtgatcttgtgtttatatgtcgatgacatattgatctttgggaccagcctcaatgtgattgaggaggtcaaggactttatgtccaaaagctttgaaatgaaggatttgggagtggttgatgttattcttaacattaaactactgagaggagatgagggtggattacacttgtgcaatctcactatgtggacaaggtcttgagtcgctttggttatagtgactggaagacagctcctactccttatgatcctagtgtgctattaaggaaaaaccgaagaatagcaagggatcaattgagatactcctagattattggttcattgatgtacttagctagtgcaacgaggcctgacatctcatttgctgtgagcaagttgagccggtttgtttcaaatccgagagatgatcattggcatgctcttgaaagagtaatgcgctatctaaaagggataatgagctatggaaatcactacgctgggtaaccaaaagtactggagggctatagtgattcaaactggatatttgatgctgatgagataaaggccacaagtgggtatatgttcacacttggagggggcgctatttcctggaagtcttgcaagcagaccatcttaacgaggtcaacaatggaagtagaactcacagctttagatactgccacagttgaggccgaatggtttcgtgagctcctgatggacttgccggtggttgaaaaaccagtaccagcaatcctgatgaactgtgataatcaaacagtgattattaaagtgaacagttcgaaagacaacatgaactcatccaggcatgttaaaagaagactgaagtctgtcagaaagcagaaaaactccggagtgatagcattagactatgtccagacggctaaaaatctggcatattagtttaccatggggctaccacgtaatgtgatagactgtgcatcgagggagatgggcttgagacccagttagagttgcacaatagtggaaacctgtccattgtgatcagagatcccgtgaatttggatggcgaaacaaactattgtgtaactgagagaagagaccctaaaatgggcttatcttcatgatgcacttctcttctaatctgtatggtaggatggtatacaccttaatgtgattcgagtggcttttcataaagcagagatgttggccaacagaacatcttagaaggaacacacctatatgagtccgactgctagtcacagtctatgagatctgagtgatctctagatactcatgaaaaggccaggagtatgacttatacactccaaacagaggggatgcaaacggcagcctagtaccagttaagggtttgagtgaaacctgaatcacacaagactaacaattcaaggcatagtccattgttcagttgtgatctggtgtagctcttttcctaggtggaagttaaacttaatagtctccaccgaaatactggtataacaaacaggattagaatcgagagcatttcctgtgagccatgaaatttggtggggattgttagattaatgggctaggcccaattaaatcctaataaattccattggcccacattaagtgctatgggtaataataccaccttggaaatctaagtgaagaggtctcaacttaaatacggagctgttgagatggtgcgcggacaaccaggcggggcgaggcgaggcgaggcgaggcagacagttgttgctgctgcgctctctcgttttgtaacggacggtaataaacacggagaatcgatttcatatcaatgaacgcatcggttacggaattaaacgtcgtaaatttattccgtcggttacgaaattaaacaccgtgaattgattccgtcggtcacggaattaaatgacgtgaattgattccgtattaacgagcacgtcggttacgaaattaaacactgcggttgatgactccgaacattactctcgcgcttgcatatatatactccgcagcgaccagaaggacagaagaagttttttctgacctctcttgcacttcgagttcctcctcctctgttcctgagctgcagaatccttccctggttctgttcacctgcgcacacaggtgtacgggacgagcaggtgcctccgaaactccgtccgcttgagaacctgcacgggtaggcaagcgatcaagtttttgggtagcgcttcaagcgcgactacccttattcttcacggctactgctgctgcatcgacgccttcaccaagatgtcgacgaagattagaaacaagatgatgaacgacatcaacggaggcaatacttcctcaaaattcaacggtgggacgttctcggggtatactttcattctcccgattctattagatgtttctttgttaatactcttcgcaatggcagcgcattgcgttactatgtaaatgttgatgtttatttcatattaagcatactcaagttgtatacatctagcactgtcactagatctacttatattgcaactgtcatgtttattgtcttaatattttagattaaaatatgctgaattatgaccaaatttccaacggtgactgcgcggctgcgccgcacccgccagcgccagtccgctccataggctggctctgttgcggcggcacagtgtcagcctcgcctcgcacagtatccacggatcgcacccgctagccatcacctccgtgggcccgcctgtcgtggaaaaaaaattggtggagactgggtgtaaaccggcctgctctggaaaaaaaaagggactagctatatttatggcgccatatttttcacaaaatatagtcggtatgtgtttacattgtaagtcactaaattacatatgtaattttagtgtatttacgatgtaagccccaaaattacatatgtaagtattaaaattacatatgtaaatcctaaaattacatatgtaaatagtgtgttagtgatgtgtaactactatgtaaatttatataaatatataatttacaacaacaacaaagtttaaaaagcatatcagtatgcatctacgccgtgtcagaaccaatcatagcaaagcgtgtgtgctgatgccccatgagcacgaatcttcatgccaatcctaaggctgaaaattcgactgcgtttgtgggaaaaatctgtcgtcataattatagccgatccgaaaaaaaaaaattgatggagactgggtgtaaaccagcctgctcctgtccagcccggccccaatgattgctgcgtggatacaaacaagagatcaatcatctagctcgttgcggctccaagcgtagcacaaataaagtttgatacgttaccgtaagtatagcgcggaaatatatacatcggcgttgaggcataaggacatcgttgctaatagtgcttaacatactattgatcgatgcaatactccatacgaatattgttattgaatcaggaattaaaattgcgctctaggctaatcctggctaagaggtacgacctcatcgatgcgggactcatcgttcaacacaatagaggaagaaagacttggcggctacagccagctttgcctattagagtggtattcatgcctaggttttaaaggtgttatttcattgataggtagaagtggtatttttaagaatatctatatggatttggaaataagtgagttataaacggtgatgtaagtagtgatatattttagtgtattaatgatgtattaggtcttttacatatgcagtttcatctacttcctccgttttacaatataagtcattctagcatttccacattcatattgatattaatgaatctagatagatatatatgtttagattcattaacatcaatatgaatgtgaaaaatggtagaatgacttacattgtgaaacggagaaagtattaaataatactcagcttttaaataataataataagtagtagtgaaaatagagaaatttatatgcaaccgggactaagtgattttttttatctggacatattctattaagtatataaagtgtacggtctactttactttgtagaaatggtgagacttttttttttacgaaaccgcatatctaggcggcttccttggttcgaaaaagttggtcagcaagattttctttattttttctaactaagaaactataactgcattctcaaaagaatctcaacacgaatcccaatcctaaagtttgacgatttttgttaatcttttattagatattctgggattaaggggattaaattttatgtattgttagccgtgctcctcaaaaccactccttgtaaaaaaaaaaaagcaaatgcaaaatgcgcgcatgaatggttcccttctctactgtaaagtacggagatggatctctctcggatggatatcaacccgtttcttacatacaatctaaataattatgaaaaaaatctaaaaaaatatataagatatgttaatatgtaacatatcacttcacaaacatacaagttcaaattcgatttctacaatttataacaaaaataacaaattaaactctaactagtatacgtatattcacagtcaaatttgttatttttgttataacttgtagaagtcaaatttgaacttgcatgtttgtgagatgatatattacatattaacctatcatgttaatttttttgaaaaatttttataactatttatatagcatgtaatatatataatatacagatagacgaccacctgagtgtttaaaacagtttcctataaagtactactccaaactccaaccatacgtcagggggcctacatctagccacatcaagccgtggaacaaaactagcagagcaaacaaatacttcgctggcatcagctaacaaacagatcgacatgcactccactcaacatctgaaccttatctccgtctaatataggagtattaggttttgttctattttcaattactcgatctcggccattccgtgctttttgtgctctaaaagaagccagtacaacagcactagtacatgctaattaaacacttctattactacgtacagagcagggttacgtaggcagatactagaccacgcccggttctcaatctgatcgctattaccagtggctggcactctggactaggtaccggtgcggccgcgcctcgccgctgtgccggttgtgatgctgctgctggtgcagaacacgagcgggaggagacgacatctgatgcgccgcccaccgggatgcgcacgacggcgcgctgccagtctgacggtggtacagggcatggggtaccgtcctggacggcggcggcggtgtcgttgtcgtcgtccttgggaacaggaacgccggatcttgagcggctggaggcggtcccggctggccgcgtcgtactcctccagcaggttggcgaggtcgtcgtcgccggtgacggagacgagcgcgtccaggtcctccgtcgggagctggcaccgcaggcacaccgcctcccacccgcacatctccctcagcttccgttgcaactctggattcacaatccaaacgtacgttgtaagagctccgatcgatcgagagatcgaactaccagtctcactcaggagcaggttgcaggtgtaccgtggaaagggagggagcggtcgacggagacgacgcggttgtcgccgccgacgtagcgcaacgcgccgtcggcgtggcgagggaggatcctcccgccgtagctgcagaggaacttgacgaacgtcccctcggctgcggcgtccgctgccttgacgacgcacgcgacgacgacgtcgtcgtcgagagagccgagcgacgacgtgcacgtcgaggacgatgaccaggaggaggttcccaccatggctctccttccttggacggacgaacggccggggacagcgagaatctcactggagaatcttggctagctatagctctttggccttgctgcccccatgagcgaaccgcttccagcctcgtctcgtcgacacgaacgccacatttataatgtgtggagagcgtgacggttttggagatgccaaatgactggttgaaacaaaactctctgaccggccaattttgtgaaacggcctattgggctgaagcagaatcgtgtcaattgcctacaagtattcaacaagctgtagaatcaatcgaccatagtggatgcacatgcacgcacgcatttcctgcggttaggacttaggaccactaggacgagctggatctgtaacagacggtccagagcaggcgcggctgcgatgatacgaatatctcgtcattcattcactcgcagctgtgaacctcctgtttgtttggttcggcgatatctccgtccgtgtgaattgaagatgtgaataacggtgattatactagtacacacggaacgtcatggaaccggacaacgtacactacacacgtcgcgcgtccgggttcctcaaatattccgaggcttatcctcccggagatcatcaagacatatattgcaagtaggaacaggacgaagatgtgaagcaatcggtgaaggctggagtccggtccaccagcagcgccgggtgacgacagtgctacagaaataatgcagcggggccccgttgcccacgtcaattctctgaggagctagctgatgacgacgaagagataaaagctttcagctcgccgcggggcacgaaaatttcaaaataattagagtaaatttcacaaaattataaatactttgatcaaatcattataaaaacaatagatttaagatggcgtatcttgaaactacatatttgaaaataaatttatcataaaactacaagtaagtttaaggttaagcatggctaaaagcgatttttctgtacgtggacctatttagattacagacggaccataattggttgcgcccgggaaaataagttcattttcgcgtgtacggtcctcttaaacgaaccacacgtggaaaggagattatttttacatgcggacctattaagagagccacacacaaaaatacccactctctctccctctctctccatgctactcactttaaattttcccatctttctctcctctcgtctctcgtctctcctctctatatcattttcttgactccccacatctctcctctctatctctttttccccgatctcttctctcctctcctcccgagtcccgacggcggcagcgggcgtaggcgacgacagcggtgcatggcggcagcagcggcgcgcgggatccggcgggcggcggccggccgccctctcccccgcgggaaccagctcccctcccctcccctccccttccttccctccccagatccggcggaggggaagggcgtcgacggtagtgcggccagagggaagcacggattaggcggcgagccgccctccccccctacgagatccggctcccctccccagatccggtggaggagaggggcgttggtggcggtgcggccggaggggagcacggaggccagtggcgggcggcgcgaaggccggtgggatagtagatccggcagcgggcgatgcggaggccgccgacgagggtgggaggtgtgtcctcagccgacaacgatgacgaggaggaggaggaggaggcagccgggatcgcgcggtgccgccgccggattcaaggttttcatttttttttgaaattttattttttttagatttttgtttttccgtgtgggtgcgccacccacacgcgaaaatcggatttgaccgcatggaaaaacctttctcgtagtagtgaagtatcgcaaaactgctaattttataataaaattatcacaaaactatatattttaggcattaaatttccatcacaaatgttatgtttgatttataaaacttttagttttgtgataactgttagtatttcgtaatgttcacagataaagtccgcaagcgcacagagatatcgctgtagcacttcacccgtgagtattccaaggtatcgattttccatagggaaacgtgtgtgttcaacttctcttcaagttcttccgaggacacaaggcaaaaatgtgcaaagggtagagaggatttcctagtgagaaacaatatctacagaaagcataatttaattctatcgctatacttcaggcgctggcttgctcgttgctaccagaacgcgctctaattcgtacctagacagggaggactacggtaatcttgagggctgtcactacctctacaccaacctctaactatttgtgggatatgcagcaatcactggaaattaatgacctagataccgtgtctatgcagttaattactactttagtgtttataactctccaaagtaaacactatctataattcaaatgaataatagtccttgtcgttgcttcatgcccctatcttcccctcacagatctagcaagcatgaggccggatccggtgagctcaaagtccacaagctcagcaacggttagggagggagccttgatccgcaccgacaacgtcaaccgggagggaggagtgggagctctagatggcggctggggagggaatctcatcgctggacagcaagggatgaaaatggattggaagctagctctatcttattcgtttcattttttttccggaataggaatcggaaatccggatacagaaatagaattgaatagaaatacggagtgaatacgaaacggaacaaatagggtttaaccaatatttgctggaatataaatgcccctcctattgatcttgtaatgtttgttttacacttgaaatatttacaaatacaaatatcataaactacaaagtggtagatccattaaattctacaattttgatatcgagcacgtctacatcggatggtgtttaagttgttgatttaatattttgtaaaaacaaatatggtattttgtaatgaatatttagacacctaaacgatctcaaataataaagttgtcaacaacaaagttgtagatctcattgagctctacaattttggtataaatattgtcttcatcagtgataacgacgtcacttcatcggattcgtgcatatctccacaagttatagtgacaactcgaagtccagttcggcctctagagacaatactgacttcaaacggacttagcgtcgtcttcatgtcaactccgatttggatgatcttgga

SEQ ID NO: 71497 - DNA, 1067 bp, Oryza sativa
cccccccccccccccgaaattttttatttttgttttatttgtttgatattttttcacgcttagggacacacaagaaccaaccatagaaaaattgaactcaaatagacgtaatatgtgacatgtagaatttttcctctcctctcttctctccgaactagtgcagaggagagagatgtgcaacttttttatttttattttattttttgatatttttttcacccttaggaactcacaggaaccaaccatgtaaaaaataaactcaaacggacgaaatatgtggcatgtggaattttccaaagctccaccgaaaaacttctctcctcgaaaacacaatcttgcaagcggaatttgggggatttaatatcaccgaacccggcaaagctagggagaattggatgtaactttttctgtagatgtccgtgcatatattattttcctgatttcaagtccgtatgagaaagttacgcctattttaatagatgacatattttgtccgtttcgatagagttttggaaaattctacatgtcacatattttgtccgtttgagtttattttttatacggttggttcctatgttctcctaagtgtgaaaaaaatatcaaaaaaatgaaataaaaataaaaaaattgcatctctatgtactgtttaacttatatatgtcatttcatgtggttatattttgaattagattaagtaatttcatatagtggtagagtgcattatgtttaacatgctgatcaaagggttttagtaaaggagttatggtctaattttagtgaaggtgcaaagtagactaagtggtatgctagatattttcagacttagctaagtggtagttcgagtttaaattttttttgtggttggttgtatcgtgatcctgagtgtgaaaaaacatccgaaaaaataaaataaaaatgacaccgttgcaactccatacagagaaacaggaatggaggcggcggcgccagccatgctggcgccctcctccttggggcggcgccagcatagctggcgccctcctcctaccacgttggttcgcgtgcgccatggtggcaggaggacggct

SEQ ID NO: 71498 - DNA, 6678 bp, Oryza sativa
tggcgccccaaaaaggaccatttctagaataagtttttttaggggtctatttgcgaaataagttttttaaaaggaccaaaatatgaaaaatccagggccctgtgccgcgcccctggccaccgcgtgcttggccaccaccgcgtccgcgcagcgctcccctgccgctgccgccgttgaagttgttgtgggcgccgtttttgttgccgcgcccgccgccgcgattagcgacgaaagcagcccctccctgaccggtgttgcggtagagatcaaggagagtttcaaagttgaggagttgagagtacagctccccaaccgtgatgggatcggacttggtgcagagagcagagacgatcgggctgaagtcttcatctaaccctgagatgatgtactgcaccatatcctcttcatcaagaggacgaccggcggcagccatctcatcaccaagagctcgcatcttggcaacgtattcagcgaccttcattgttcccttcttcgtgttggtgagggcgagcctggtattcaccgatcttgcacgggtgcggctggagtagagttcctcgatggctcaccaagcttcagccgccgtcttgcacatggcgacttgaatcagaacatccctcgaaagagatgacaggagatagccaagaacaagttgatcattggcttcctaatcttcgaatgccgggttcggctttgtcacagtcttcccatcgacggtgactgaaatctcggcgtctagagctttcacagcgccggtgaggtagccctggagacgggctccgcgcactgcagcgctaacttgcgctttccacagtgcatgattgcctttccgagtttctctgtaacggaatggccctgagcgaggtttacagctgccgcgcctgaggaagacgacgacggcatgagtggtggaagatagatgcaatctaccgaggtggaaaaggctctgataccatgtgataaaatgtgaagcgttgaaccctttgcctcgggccgcatctctgttaaatagtggtagaaacagcctctaccgtggcttacaatgttcagttacaagtgataaggagatagaacaaatttggagataagaaactaatcctaacaaccttatcactggatgagctattacgggtgtgagcagctgcgccattatcgcatgcatgcgccatgcaccatgcgaacccccacgacaccgacactgtccactgcttgtcgccgtggtagcacaccgactgctgcgccacgcccgccgaaatggcgccgtcatcctcgatctctccttcctctgtcgcctctcccggaccgcccgacgacagccatcggtggcgtcgccgccggcgcatcggccctcggccctcggcgcgttgcagttcatgacggcggtggaggagatcgcgcgtaggcgggcgacgccggtgctggcgccagcgtggggccgcgacgcaatcccgtgcctgccgtccgccgccgtggacccgctccccgccccgacggagctccgcctccagtacctcaccgtggacatctcgccgccgctgccgccttgctcccctgctcccgcgtcgtctccgccgccacgtcgccggccgccggacctcctctcccacctcgcaccgtcgatctcctccccacctgtcggccggcggcgccgggctacccagagtcaccagagagaagagcgagagagagaaggggaagggagagaagagaggaaagaaatagaggctgactggacaagctgacatgtggggcgcacgtgggtcccacgctgactcattagacacgtaggataaaaccgggatcgaaaccgccaagggacctattgtgaccagttttatatagttaagggatcctatatatctggttttgcggttcgaggacggttttgtatcccgttgacaagttgagggaccttcggtgtactttttcctttatccaaccatggtaaaggtgcagctagggcccaaacactttactggtcctgtttgtgtgtgtctcaccacggcccaattatgtaatgggctgattctgggttgtttcacagaaggtccaaccacttgtcacgccattgacaactccgtttgcaattttgctttatactccctccgtcttaaattataataacttaaaactggataggatataaaccaaaatataataatttaaaatcggataggatattttctaatactatgtcccatcggttttagattcttatatttcgggacggatgaagtatttgtttgctcagtttgacctagcaaagaagcgtatcattgctacaccttctcttctctctcttttttcgcgaggaattttccaattattgatcgctccaagttttcccgtgtaagttgaagttttgtcaaattcatgcaacaaaactaaagtaatccgacaggaatgtatggtcagaaattaatggcctcaactgagaaatgtatagtcagaaattaaggacctcaacggtataattcgacctaccactcagccaggcctctgttgtacgtgtgtgacaggcataaaagaaaagggaaaatttgaaccatgccattataattttgaaaaatttgagctataccatcctgacccacatgccattgactcatgtgggttctacgtgtcattgagataccgatgacatatctcaaacgttacaaaattataatgtcatggttccaaattaccaagaagaaaagggaaaaatgtttggtctagactatagagcaagatgattttgatccacaaaggcctcaactgaagctgacacgcaactccttggtcacatgcataatcttatatggactgcagatggattcagaatgcctaattaattggcccaataccacttgctgtgctgaaaatggcgtggtttagaaaatcttcggctggtcgttgcttattctgagacttttgagttctgacgcggaaaaagaacaagattgggaaggttgatcctgttgcttgctgtgctgaattgaagcagcaaccaagccactgttgtcacttgtccctgcttgcaaattgttgtcataatctaatataaggattcagaacttatgcagtttcttgtcaagctttcactgaaaagagttattgcagctaaccgaaacaaatcagtactgcactggcaatcgtctccctcggatgggcattagttcattcgataccgtcaacgagtaggagttttctgttggcctcatcaatactgtaacaagaactcgggtactggactaacctagtgttcactcccccaaagccaataatacgcgtacttgacccggttgacaatggcatgtggcttcggagttcatacagcgaagcaatgtgtactagcaaaccaacggccgtcagacagtcagcattaaagctttatgttcctcatcaaaatccacttttcatataattggcttctatataataattggctgtagctcttttgagtaaaggccgggatatttatttattccattatctaaaaaaaatcaaaatccacttttcatatactcctgtccttaataaacatatagtaatacccagcggagtgtagaaaagctctgggattactgcgaaaatcgaacaaaaaatacgccttttccatagtgatatcatgctgcttcttttttctcaagagatgcagcaaccggcaggcagagcgcacgatcgatcacaaggcgagcagaggttcgtgcatccacccatcacacgcccggcgcgcgcatcacagctcaccgcgattcggtgaaatcgcaagcttttggcaggacgacaacgacgacggccacggccaccaccaccgcactagcggagctaacctctgattaaccggaaaggtagcgacctttctcgaccagagcgagagcacctgccatgatgggagtccatccgagatgatgagaaagcgagctcgcacgcaacaaaccccggccaatctctgtcgaggcaatcacctcccaactcaactgcccatgtcgatggtggtttctagctaagcatgccccatgattgcgagcttttcatcagcaagtttattcgccaaatctgcagccgttaatgtatcgagtttgactttttaaatgcatcgatgagaatgatgaagccggttgaccttagtggcgcgccggtgagagcctgagactgagaggtgatggcaacagccatcaaacgagatcaaaagaactgtcaccgatgtagattcagaatttcagatcaaggtggcagtggaggatatgcagtttcagaagttacgaaaacctgcagctgggagaacgggagagccaacctacgtctgttggaggaccagtctgaagatttgctggatttgttgaccaaaacttcatacctgttcgagtacctcatcctgtacattacatgcaacgcgataacgtcaacgaactagtaaatgttgccaacggactgtgtactgaatccggcaactgtcgtcgtgtggttgaaacagtgctcgactggaagagccataccacaattatagtttcccggacgaaaatggaaacaatcgcttggtgcgcagtgtaccggcaaaagcaatgaagaaacaacaggaagagatcttgaatttcttgatcatgtcaacctctgccttcagaaaaagagaaaaaaggggacaaggtctctgactagatggtaaaatggataaattatccttatgaccttatcataaagttgattacgattctacaaccatcagccacgatccatccacagtgcccactcatcagacatcagatcgtggagggttcatgacttcatggatgcatgagtacagagttactccaagttgacattagcagttcagcactactgaagtactcccttcgtccaaaaaaagacaaactctggtttccgtacccaacatttgaccgtccgtcttatttaaaaaaattatgaaaaaaattaaaaagataagtcacgcataaaatattaatcatattttatcatctaacaacaataaaaatacgaattataaaaaaatttcatataagacgaacagtcaaaattggatatgaaaacccaaggtttgttttttttttttgggacggagggagtaagtaggagtacttagttctcagagttcagatcttcaattcataacgctcacattcaattccgctcacatggcttcattccctccatgccagacacacaactaaatctattggcttgggaatctcaaacacaagaaagaaataatatcttgaaaataatttaaaagctaggagtaatcctgtacatagataatgcaagaagcttttttttttacagtggcttgcaacatgttcaactgacaaacagtaacctttgacaaacgtcggtgcctacatgtcagtgggacagcttgccagctcgtggttggccaggatgaattcttcttttccagtttacacgtaaaggtaaaaaggaaaaaagaaaagcctcccaaaagggataaataatgtcggagcgcgggaaaaaaattaataaaggataggatcaccggaagcggccgccgtcggcgagcttccatgaccggcagtgggggagcgaggagccggaggagaggcggtggagcggtgacggccccagctcgccggagaaggcggcggcgtccggcgggtggcctcccccgcggtggtgccgcgccgggctgggacgaacgagcgggctgatgcagacggcgaagcccgagacgccgccggccccagtcgcgcctcccggtctgcgccggcagggggttttccgcatcggcgaaggtcgccatggcgactccgccggcgagctcccctcctcgccgccttcgtcggcgtacctcatcgccggcgagagcccgcggttgctgatcacgtggcaagagtgccgcggcggcgacgcgacggccggatccttcttccgggggccccagggtgccatgatcgccgcgagccaagaacggtgcttccgctccttgctactgcgcttttcctccgacccgtgttgccgatgggctccgaagagcgcggcgagcacgaagaacttgctgctgcggcgccggatctcgaattctatgtccccttcctcgaatccacttgcgccgcctccgccgccgccgccgccgccgtaggccggccccacctgcggcgtccggaaaaagaggaggctcggcgtgcgcctcctcgccccggaggcgtcggacttccggcggcacacgtacggcgacaccgacctcgggaaaaccggcaccggctccggcggcggcggcaatgaggaggcctcgttctgcgcggcggcgagcgcgagcaggcggtcgcggaggcacggcgcgcacacgccaaccccgccctcgtacgggtgcctgctgcacttcattgccctcttctctttgccttctccattatcaagcacagcagcagaggggagggaggaaggaaggaaggaagaggaggacgacgcggtctctcctctgtatatagaggcgccgcttttcaccttttcgtagttttcgtttgttcgatcggttcgcatctctctgttccctcgcttgcgtggctttttatggaagtgtgttcctctaccctactctaggaatagatgcacggttgcacactagtaggacaaaaacttccgataagaaatattgaaaaataggccgagtttagttacaaaattttttcttcaaacttctaacttttccactaccattgt

SEQ ID NO: 71499 - DNA, 504 bp, Oryza sativa
acggccggccggccagcgccgcgggcgtcgcgtcacaccacgagcgcgcgcacagtacacggaatacaagacgcccgtacgtacagccgcgcagctacagtcccccgtcacgttgggctcgctcgctcgcgcgcggcctgtgcactaacggcgtacgtcgactctggtgtacgtacgtggtggagaggccggccaccgggcacgtctcgccgtaagctagcgtataccggtatacgtcgatcgatcggcgcgctgcgcggcgcagcgcgcgtggagtcaaacttccccgcgcctgcacgtgcgccattagctatctaagccggtcaagcgcgctcgcccaaatcggcaaacaacccggcggaacccgatcgacgtcgacgcgcgcttgtcaccgagccgtgtaccgctccgccggccacacgtggcgtggcccgtcggcatcgcaccgtacgtggaggcgaagcatcgatcgccgcctacagagactcctccggcccgggccgc

SEQ ID NO: 71500 - DNA, 7804 bp, Oryza sativa
acacaaactttcaatctttccgtcacatcgttccaattttagcgccacattttgaattgaatttgttcaacattgttcgaatgcagctttgtataaggtgggtttagcactttagatgcccgcgtggccgcgtgtgtgcgcctccatcgtgaccgtcacgagacatcgcttggactgggatcgcagcagccagaggccagagccaagatccaaacctgcgtgcgtcgcaattgccacttgccaacccattgaccaggcgcgcgagcgcgaaaacgagccgcgagtccgtgaccgaagcttcaccgcgcggcaggcagcctccccacgtgccactcggggttggttctcccggagccttttccgctcgcggcggcgtgtgcagcagcggcttcacccggatccctgtcagccaccacggcgaaccaacaaaaggtggcaacattttctcgacgggaaaaagtggtcgcggtggcggccgtgacggagtgatcgagaagagaagtaaattacggcgttttttcccgtgctgggttgcctgaaccatctttcaccaagacgaaccataccgattggatgtatcctctttattactcttccatcgatcgccccaaccaccggcagagaaaactcgcgcaggacccgacgacgaggcgatgaggtgatgaggcgtgtgttcttgggcaatggcgatcgacgagcgacacgatcgtctttggtgtttcgcctggaatcgacatgggagtacggacgcgcggtgtctcggagaaggtggcgagcgttgatccatcgtctggtggtcgaagtcgaagggggaggactgactgacgacgactcgtcgtggcgcgagttgggaggctctcgccccgacagggctgtcgggtccgcgtgctgtcactcctcgcgcgccgcgctttttggcgtggctgtcaatcctcgtgcgccggtgaacgattggccatttttgtacttgggcgggccggcaaatttgatgatttttaccaccaatttttagatcaggtgatacatgggaacaaatgcgcgtggtagtcaatcatcatcagatctctaatctaaataggtgacaaattatcgaatcagaacctggatgatggttgatgagttgaagaagaatcacaggaggagtgcgccgtacgcaggagactttcttgtacaccacttgatcagaggaacgcaaaaaatggtcatgagatttgcacaagttccatgagggaacgaaagaaactttgccgtcgtacatgggcttttagaaccgtgtaaggggggcccaatattttatgggccaaatctcacttctggaccaatgctttctcctttcaggcctagttttcaccgggccgtcacgggcccacgtcgcagtctaccccgccgaaatctctaccgcgcgggaactccaatttccaaccccgcccaattcccctccctttcggccattccccttccccttctcggctcctctcctctcctcctcgccttcccaccaccttcccttcccaacccgatcccccattccgccgccgtccgccgccttcgccgtatcgaaccgcctagcgaccggaaagaagaaaaccctagtcctcaacacagccatggctccacggaagcggacgggggcggcggcgggggcagcttcgaagaagccgccggcctcgcagccgtcgcagccggccaagttcggcattctccacttcttcgagcgccagtcccaggcctcctcccagaacgccaagcgccagaaggccgacggccccttgcagcctcccgcgccgccgccgcctccgccgccaccgccgctcatcgaggaggagccatcggaggtgtcgccggaggtcaccaagactctggcgccgaagcgggtcaggttttctcctgggatggtaagtattggtcttgcgcttggtccgatttggaatgcattagttggcgtttggatcgactcttaggtttggtggtttcttgtttggtgcggtccagctgattaagcagagccaggacgatgggggtggggaggttgtgacttggaagatctcgccggtgaatgatcgcctgcgcatggtcacttcaaggcagatgactggtatggcgcttcatccgtgctcaaacaatgaggtatatactggagtttctttatgttcttgcgaggtatataccggcgtgcaatgcacgtatgtatgtgcattggagccggtggagacacaacactttcttgtgtgatgaaattaatcgttttttgtggctttctggtttgctattcgatatgtaattgtattctagaagcattcctcggtcgagtctacaaagaaatggcattcatcactgctgggcatgtcaagatgtactgcttcagcacgcaatttggatatgtgtggaactggtccaggtggctgtgacggtgtggaggacacccaaagcccatttcggactcctccatcactgtcctataggtgcagtgaggtacatacagttatacgatgaattgttgtgtgaatgctagctaatgtagttccaaatcgtgttgatggagtaatggttttgtgcatgaagcagcagcttaatgggggtgtggtttctgatggaggacctgagcagttgggggcaggggagcacaaaaaggtgaactaagataacactaaatgtcctgggtgccattggtttcatgatattattacatgtaagaactaagttgccaaagaattgatcgacaaaactatgccatttctttttaccaggcactacttgatcttttagatcaagtggaagatgcaatcatggaagaagaattacctgctgatggtgagaataaaggagagcagctcataaatggtgatccgaaaaacattagttgttctcctattgctgacagcgatcaaaatgtaccctcccagaagtcccttgatgccccgcccttcgatagctttttggtgttggaggtttgctttctttacctccatgggttggtttctatcgaagttggagctgctctagacttctagtacaatagagatttatgtgtttaattacttttcaggtgtcagaaaagcacaaaggcgataacttaccatgtgatcgctatcctgttaaggtatatatcctctttacctatctggatgagctagtttgcaattaaatttttgttattttgcaaagttgctaactgttttgacaggttttacgtttgctgaatgagcacggtgggaaagagcatgcagtccatttgtgtgatgagtggtgagttcctatatgcaactattgacatgattccatttttattttctatatacatatgaaccttcatcaatctattgcctatatatttcaaaccactacaggttccatagccttattagcccaggcgacacagtaagtgtcattggagaattcactgaccatggaatatgtattattgatcatgacaaaaatcttgttatagtgcatccagaattactcatatctggaacacgggttagtattagcctccccccatctctttattataacctttgtagtcaatatcccagatcaatatgaacaagctgctatgatatcctcaaatattattttataagaactgtttgtaaaaatacattcatcttatcttgtcatcatattttgatatatagcttattttaggttgcttctagttttcattgtccaagaaggtctgttctcgatgacagactaaaaagcaatgaatattcaacaagtgctttgattggtactctgctgcatcaagtattccaggttcgttggtgcaagaaaaattggcagctctggttaatacatcatgcactttatcttcatgtaacagttgtgtgtgcctcactttgtttctttcctcttgtgcctcaggcagggctacttgaagatgttccttcaacgcaattcttagagcagcaagccaaagaagttcttttgaaaaatattgagagtttatatgcatgtggaggtaagattcgtgacaacatttttaatccataaaaaacacactacacaaaagtatgacactatgacatggactgttcatgacttattatgttatactgagtgccctgaccaataatgtttttcttactctattcttagagcaccgattcagtaaggctatagttatcagtaaattatcatgtgctactaaattttttgtgaaactttatatttaatttttgaatgttgctttgactaatttgatccaattttctgtgctatatccttcctattatttttatatgtttacacaaggaacatggaatgtcattccaaaagttctgcaaatctgttgtgtttgttctgaaatatcaacatacattgtggttgttctcatacatcctcatttactcaagtcatattggtatatgtcatgtttgattacagtactgtactgtagctcagcttctttattgatatttataacattacacaaactatcttatatccccagccatgtgcatatcttactggttttgacatttttctatgcagccagtgaaagcaacacgcttaaaacgctgattgaagcagtccccaaaatattgaattggtacaagtgctttatgaaggtggagtagatgacttgcacagcagttttttatattcactgttggggctccttaaatgaccacaagaattttcgaagtccatagagttgcaccatggtcatgaatactccacttatttttgttgaattggaacctgttgttatacccatatggcactcttctatttcttttcagaggttctaggcaatgattaatcactcgattgagccattttgtttttaattgctaatatatgccatttctattacggagtataattttttaagagaaagttttgatctagtctttcctttatcaatcctggactaacttgcctgcaaagttcaccggtggatatattgcatgtcttgtcctttacttgtttaaagaagatactgttacatgttctgcgctaatcatcgtcggcacatccaggtatcaaaatgtaacaatgtaaattttggtcaaattgaaggacaaaagactgttggagttgtggaggtaggcaacatcttgagcttgcaaaactttggaatatgaccttttcatattatgtaacttatatgtaatatctagcaagttcgtttcatgatggtaaactcctgtagtccttgtgattctcagccatcaaaattaggccaacacagaactttcactctccccatgtccttcagtacttgagtgttgacttgcacacctcattcttaatggctttattgaaatgaatttcaccttaggtaatggatattgaggagatggcctgggctccaagatatggtttgaaagggattattgatgcttctattagatcaagggtttcatgcaatggtagttcatacgacagagtaatgcctctggagttcaaaactggtaaaggaactagtggtcaggtaagcatatgctcctggatagtggatccacttgaagatatattatatctttttctggcatgagatatttttgtcaccggggttctggaaactatttatgcaataaattagtgaagtattgcaacaaccaggcttcttgaaagattgtgctgattccataatccatattaattcttacaagtagtcatgctctcaattttttaatcaaaacctgacgagttcattgaggtttatattgcacaggccagaactgttgttttctgtctgttttccataatgtaattactggttgcttacttgaattagattccctgctctattttatccaaaactttaagctttagttacaattgactagaaacctgtcaaccacctagtcatgtccattctgtggcaacaaccaatcaataataatgtcctacaacaactaatcgtaccttaaaaaaacccaatcatagttcattacaaaataataattaatcaataatccggagcctcagttccattctactttcacaaggtcaacatccttcagtagttttgataattaatacatgtcacatgtagcggcatccaaatatatattttgataccttttttgaaatgtgattgtgactattagtgttatctttactttatgtccatttctgaaaagaatattgtgttatttttgtggtgtttcacatactgtgtagcactctagtgtctcctatttacctaaccatgtctgaaaaaacaacaatttagtccttcagaatagatccagttacttctctattgctcttcacaatggtttatatatttccagacagctgtggaacacactgcccaagtgatattgtacacgctattgatgacggagaggtatgatctatctatttcttccactgcaggctttccatatatatatattccttaccatgcttttccatgtcttcagatacttgaacaaggatattgacttgggtcttctgtattatcttcacacagaccaaacattggtaatcttctaaaacgacactcaacataaattctgtacccatccttatccatttcttgttaatttctgaagggcatcaaagtcaagaggtctgatttaattggattaataatgcgtcggaatgagcttgccactgagatcctgaaggcatcgatttcacagagttttcccccgatgatacaggtggaactaaaaacttgtacataagtaattcatttgttagaactcaaacaaaatctttctttcagagtccatctacatgtaatggatgtcgacacctggtttcatgcaccatataccacaaggttcaataactctattctttttaatataaatgtgttttttgatacagtcctgttggtacaaatttgttcaattacataatatatacatgtgaaaagccatacttatattctgatgcaacaggcgcatggaggcaatgctgcaactagtgggcttggtgatttatttgataatctcgtgaatcacttgacagttgcacatcatacctttcttaaacactgggacagattgatcgatcttgaagctagagtttctcaggtatctttagcttttctcacgtgccgtgtatttgatttgtactctcttgatctcatctcatgcaaaattcaggtcaagaagaaggaaattttccagccacatcattcaaatactgggagcaggcattcttccccatcttattttgtccttgatgttacaaatggacattcaatagattcatctggaaaaagcaaaagatacatatatacttttctgcgccagaagttgcagcctgagacagctgatcagccaggagaacatgttgaaagtgtagattttagcctcaaatgcggtgattctgtggtaaaccttgtacactttctgtattcaatattcagcaacattactatgttagctatttcaagttcccagcaacattgatatttttattgcatatatttggcacaccatattgcaaatttgtaatgtatggctccatctcattttgtttggagtgtagggttctttccgtttgaactgttatgtgcttaatgttggtaaggaagtagaactataggttcatagaatatgctcagtgcatataaggaggttaaatggcaaatataataccagttgaaaacttctgcagctactgctaaccgatcaatcagcaacagccagctaacactttggagtattgtagcgttatattactttgtttttatcctcctgttttgtgatgtttactttagtgctgtaggcctatggccacaaaggggtcatttttttatgcgttattacacatatagtagctcacacccctttgcttcatggatacttagctattatagtgatgcatg

SEQ ID NO: 71501 - DNA, 605 bp, Oryza sativa
ctgcccccaccgccgttcgaaggtcctccgtcgccgacgcatagccgctacccgccgtcctcccgaccacctctagccgtcaccaacccagacggtcagcgcacgagcccggctgcctctggccaccatcgccgtgcctccgcctcccacctccccgtcgccgatgtcctagccgccgcgcagacgccggtcagctttggcggtggtagggccggatctagggggagaggaagagacacagttgataattgttggaagcgatgaaaatgaatgagtcgtccgacaactgaggagaaattccttggaagtgttcaaacaactgttaagtgcacattccaaatgcccctatgcatttagatctctaggtacggtaactgacggtaccaaatcgtttcacgatcggaaacgatttggtaccatgaggtactagtacctcgaggtaatttttggtggaccggagcaaatctcatgcatttaagttggctgaataataagtattccgagcagatacagagcatgttcaattcaaaatgtgtagtcacgtagaggaaagagaatcaaaatacagaaaaaaaactgaagaaaaatgagtttataaataggaa

SEQ ID NO: 71502 - DNA, 7054 bp, Oryza sativa
tgaggcagtgtatagttttaaaactgagattgagaggagatctcctggtagtatagtggagatagagtatgatgtgattaatgagaagcataggttcattagaatgtttgttgctttgaagccttgtatagatggatttttgaatgggtgcaggccatatttaggcattgattcaactgtgttaacaggcaagtggagaggacaattggcttcagctattggtatagatggccacaattggatgttccctgtggcctatgctgtctttggatctgaaacaaaggaaaactgggaatggttcatggtttgtttgaataaggcaattggatctccagaaggcctagtactgtctactgatgcaggcaagggcatagatgctacagtgacaagggtgttcaacaatggagtagagcatagagagtgcatgaggcatttgtacaagaattttcagaaaaggttccatggagaagtatttgaaagaaatctgtggcctgcctcaagagcatctgaactctgcatgcagagttgtggttagggttgttgcttatgttgagtatatggataatggtagccaagattatcatgtttcatcttcacataagtgggttgtagataaagacaccataagcttgatagatttgatgaaggacttggatgatgaaatcatccgtggtagtgcgcaggagcttacagtgactttctgggacaagagagtgggaccatgtaatgtagtaatgagatgaattgtgatgaatcaaaatttgtgcatttaatgtaatgaagtagaactatgtaatgcagtattacaggaaatatttgtttttgcccaaaattgagatgtaatgcaggaaatatttgttgttgacatttcagaatcatatggcatatgaagtagcaattatctgaataataaccattcctccatttcagcagtaggactttcatagatagctgaagtcatgtcttgcaacatatacataggttgctaaagtaatggcttgcaaaataagggatatctttcagctggcaatttcacatatacacaaaagacaagtcttggtactacttcagctggaaatttcaacaaaatagcctactctaatagcattggattacagcttctttgcagtcctggtaaccacagccttccttttgttggctttaaatggacttgcatgtactggggatgcaacactcctgctccttgtaactggtccagggctgtcatccacctgcatagcaacttgtgcaggggcttgatcagcagcagcagtagcaccagcaagggcttgatcagcagcagcagcatgggcttgatcagcagcaggggcagcagtagatgtggcttgatcagcactatcagcaatagcagtaggaggcctgtgaaagagatattgaacaaatatttaaaaaacaaaatggcaactgaaattgttgatcaaaacatgacacacttacatagtgttgttaccacaagtaggcacttgttcaggcttagatttcttctttctaactctcttaggcttgggtggagctgggggagaggcatctggatcatatacaggttcattgcatgtcttttgtaggtggccaaagccatggcacctcttgcatctccttcttttctttcctgaaccaccttcttcaacaccaatgaacttccttgttctaggtcttccagctgatctcttcagtattggtggccacatcttgaatcctgtgtccactttgtcccataggctcttgtctggcattggaggcacagttgtggaacaggcagtcctgaacatggccactgaatagtaggggctgacatagtcttctagctccacttctctcagggatccaataaaagagatggcatgcctattttgtgggaaccttttttgtggtagcatctctggtaggaacattgtcagcctgacttgcttgtgtgggtaaaaccatactcagtggaaccactgtttcagcttcatccacacaagacacaatttgggaacaaggctcactcattgtcacatgcaatggaagcttcctaacatccctgtattggttaaatgcctctaataacacagcatcagaacaaatttctacatccctacccactctcttgtcccagaaagtcactgtaagctcctgcgcactaccacggatgatttcatcatccaagtccttcatcaaatctatcaagcttacggtgtctttatctacaacccacttatatgaagatgaaacatgataatcttggctaccattatccatatactcaacataagcaacaaccctaaccacaactctacatgcagagttcggatccatcctacaatgcgacggcaaatgaagagaaaaatgggatcccaaatcagatccaccaaaccatgcatctcaattgaatcaaagagagaaaaaacgaatcaaagataagaggaatccaaacttaccctttcggaatccatttcggcatcggcggcgctgccgccagcgcagattctaccgcctcctgtgacggtgaagctatcaccgccggtcaaacttgcatcccaccggcgacaatgcctgggcacaactagtatcgagggtgacagaatcggtggaatgggcactgtttcggtggaattgatagagctagggttctaccacccgtactgcttgcgaatggagccaaaacgagtggataagaggagtctccaccgtccatgtatatggggagtctcctttgaggtcattttcaaattaactgtacctagggatgtacttagcagctagctctacttaaacactcttaatgtctcaactaaaccaccacatctgacatcacacacgggaagatggcagcgtccctgcttttggagctcctgccccagcaatggcagctctcaatcaccagcctcatactcctcgccgtctccgtcgtcctcatcttctggagccggcgccgaaggaaccccagcagccgcctcaagctgccgcccggcccgacgaggctccccatcatcggcaacctgcaccagatcggccgtctgccgcaccggagcctggaggcgctggcggggtggcacggctgggcacggtgtcggtggtcgtgctgtcgtcaccgaaggccgcgcgggaggcgctgaaggtccatgaccccgagtgctgtagccggtccccgtcggcggggccacggatgctgtcgtacggatacaaggacgtggccttctccccctatagcaactacgtccgcaacatgcgcaagctcttcgtcgtcgagctgctcagcatgcgccgcgtccaggccgcttgttacgggcccttctaatgggcgatcgatcgccagcaatcgcactgggcgataagttggcgccccctcccccctttcctatactcctccctcttatcacatctttctcctcccctttttctcttcctattacagtataaaccacacaaaattttttaaaaaaacaaaaagttagaaaaatttatgtatagaaatactatatataaaaaatttgaattcaaattcaaatttgaattcgggtacgtaaacttttgacttataaactttgggtctataaactttaggtgtataaacttttagatgtatagaaatactatatatagaaaatatttgaattcaaattgaaatttgaatcgggtatgtaaacttttgacttataaactttgggtccataaactttaggtgtataaactttagatgtatagaaatactatatatagaaaatatttgaattcaaattcaaatttgaatcggatataattcaaattcaaatttgaaacgggtatgtaaacttttgacttataaactttaggtctataaactttaggtgtataaactttagatgtatagaaatattatataaaaaaaatatttgaattcaaattcaaatttaaatcggatatataaaattttgacttataaacttttgctatctaaactttagatgtgtaaacttgaggtgtataaactttaggcgtataaatttactaaaatagaaaagtaatgcggtgccaaaaaagaaaaccatgtggaggggtggagggagggagggggaggggatcgatcgctacctcatccccatagcgatcgatcgcccatcagcattcccggcctgttacgctagggaggcccaggtatttttatatgtgcatgcctttctgttttacctatctatcctagactcctagtgtatagctatatctatatatctattattatatctatacttaattaaaaaaatacgttatctatatctatatctatacctatatatacctaatatatataattaaaaaatacgtaaggtttccgtaaaaaaaatttcgtccgtcccttttttttcgattcagtttttccggtgatttttcgctgttttttttccgattcgtttttctttcgtgtttttttgtccttctctttttttttccgaatcagtttttcccgtgactgctcgctctgttttttccgctgtttttctttttttttctttccgattcgttttttttcgtgttttttttgttgtttttttcattcggtttttatctcatccaatctattgcacacttgcacttcaatctacttcctcttgtgttttctcctcccaaaaatcgataccctactccactcttgttatttttctcacgatttcctcaccccactctattcttattatttttctcatgatttcctcttttaattcactagatttaatctcatttgttgatgatggtcggccggccgtttttatcccaatcccaaattttatggatccgttcacctatcaaaaaagatttagatttgatggagaggatcggctccgcatacgggcaaggtactatgccaccggatctacatgcgggtagccgccagatacgccgccgccgtcgtagccggcgtgagaagccaccatcgccgccggatccgccgcgaggagccatcggcaccatcggatccgccgcagaaaggcgccgccaccaccggatcaagccgtaggaagcagtcggcgccgtcggttctgctggatctacccgcgggaagccaccacactccacccccctctctccttatccgcttgcgaatagagttgtgccctcgtcgtcttcacgccgcgccagcgtgataggagggagaggaggagagggactggcaacgctggtgaggagaggggaagggggagcaggagcggcagagagggggcggcgctgccggtcgggagagggaagggggaggaggtgctcgcgatggtgggatgggatggggaagtgtgattagggttagtgtttttggcaatgacggtttgatggatatagaatcgatccgacccgtccatcaaaatgaatggcacagatcgatcccacgtcgagccggcctccatctcgggccaccgcactgctgggccacgcacgcttcatgggcaaggtgcgcaatagcaggccgatagggtccaatgggccttttctttttcttttttagcacttttttatttctaaggaatatattttttgaaggctcgtatcatgataaactaaaccgtaatcatctaatatttttatatttattataatttcagtttacccattgcaacgcacaggtattttttctagtatatataatatgattgtttctagtgatacttagggtcgattcttttctccccgttactctctcatatatcatacacacgcttcccgaactttttaaatggtacgttttttaattttttctatagaaaagttgctttcaaaaatcatattaattatttttcaaagttgctttcaaaaatcatattaactcatttttcaagtattttaaaactagtacaatacttaattaatcatgtgttaatttgtcactccgttttacatgccgaggggaagagtttggtaggccatttggagtgggacttttccatagcacgtaaacgataaaatcattagcgcatgattggttgtattacaaacttaaaattatgtttatttgattatgtaaaaaaaaagtttctatataaaaagtttgaaaaaaaatattgtgtagccatgtgggaagtgtactctcgataaatgagtcagttgtaaaagccaaacacactaccgaacacagccttataatgcttggtttgtagtttgtactagtaaccggccataataatacctagccatgttgggatggtaataaaaatgtgtagtttgtacaagtcttcccacatttttggctcaaaaacagttgacttttcatctatccgatgacgtaagtcgagattcgtgtattccttggcctttagtacacggaagtctccatggtttgagttgtgtccacgctgatttctagtataactcctagtcacgagggagttttaactcctagtgacaagggagcttaagattatgagaaacaatggattagtaaccagcttcttataatttagaaaaactaggtttctaaaattatagtctctagtttatctctgaattctataactatatattttaaaaatttagatgagaatctacactgtttgaggagctggagatcctagaaaaaagttataactacgagaaaacccattatctcttttctacttcattaacgtgaactcacgtatttttttcactaccgtgacgggagccaagctgctttttcagtgccaaaatagtgaagttgtgtcactacaagaatccaagatttttttttggcggccaaataaacaaagccgccaatagtttatctctggattctataactatatattttaaaaatttagatgagaatctacactgtttgaggagctggatatcctaaaaaaaagttataactacgagaaaacccattatctcttttctacttcattaacgtgaactcacgtatttttttcactaccgcgacgggaaccaagctgctttttcagtgccaaaatagtaaagttgtgtcactacaagaatccaagatttttttttgcggccaaataaacaaagccgccaatagtttatctctggattctataactatatattttaaaaatttagatgagaatctacactgtttgaggagctg

SEQ ID NO: 71503 - DNA, 4001 bp, Oryza sativa
aggaggcacaaggtagtagtcagagacagcgtatcaagccactccaaattggtgaacctttttctgctggtcaaggacagtcgcaacagttgaatatcggtggtgagatcaaaacagagactaatgaaagcaatgaagttaatatcgagcaagctaatcagccggtgccaattcagcaggatcagtctcaagagaataacagtagtggaagggagcagcaggtatgtttcaactgttacaagccaggccactttgcaagagagtgtccgaagccgaagcatcagcagccgcaaggtcaggtcaacaatattgtcgtcacaggagccaatgcagtgccagttgcgtcttcaagagttgcgtcttcaagtgttacaactcagccaccagtttcaaagaagcagtagttttctttaaagccttagaataattatcggagttatggaataagatagactgcagtttacctattccctttttctttctagccgttccgattctcgggacgagattctttgtaaggggggtagtttgtcacatcctgatttttgtttcaggatttataaattatttaataaattaataatataatttatattaagtgttctttaatttacaagtgaagttaaatgtgggaaataaaatttcctaaatataaagcatggatggatttaatttttattaaattctccatggttaattcaactctctgaaattttctcggatttttcagagctcaattcctaaatgatacaaagaacagttcagtaattatttgatcattaatgatctaattataattgttaagagcttttcttgtttaaaaatccttaaattataaattgttgtttaaaaggaattattagaaatgattttaaaagcctagaagagaagatctaattttaatttgctaaatctcaacataaaattgggctagataaaattttgttaaatactttgcttaattctataattcctagatttttctgggatttatttgagctaaggaagtatttttaataaatggaattgcatttcatgaataatttaaattgaaaaaggtttttaaaagtcttcttttggctttgggccgaaagccggcccaaaacctctctctttccttttcttcctccccggccagtcggcccaagtcggcccagtccgccgagccgccgctctcctctctctctcagccgctgacaggtgggtcccacttgtctgggtcgtcgtcctcctcgcgccgccgccgccgcccgaaaccctagcgcaagccgccgccgtctccttccaaattcggccgatcctttccttctccggtgaaatcttttgaggggaaataatcttctcgatctcctcttccttttctcttatagaaactccggtcaattttctttggaaaccggtggattcgagtttgattcggattcgtttttccccaacctttccttctcgtcgccggcagccgtgggccttcgccgccgcctcctagcccctttaaaaggacccccgagctctcctctacccgccgccaccctcgccttcgcctctcgtcgccggaagagccctagcgtcgtgcacccttgcgccgccgtcgctccagccgtgagccgccgtcgctctagccgtcgccgtcgctcgggaagaccgccgttgtgctcgccaagtcgtcgccgtcctcgtccgccgcttcgccaccgccgaagaccgccggagcatcgccgtcgccgtcgacccgaaggttgccgccgcttcctcctcgtcgccgtcgtcgtccgttgttcttccgccgccgttttggtcaccgatgagttcgccgtgtcgtccgcttcatcccggtgctttccgtttgtgccgtagagccgccgttcgccggcgagcgtgcgccgtccgagccgtccgagccgccgagccgccgctgccggaggtgacgtcatcgctgacgtcatcggagtcgtccgccgtgagccggtcgtggaccgtttgatctcagccgtccgttttggatagggttgatctcggccattcgttcccgtgaaccgttgccgtgcacccggtccaccgcaaaccctagccgctgacgcaataatctttcttttccttttcaaaaataattcattattgcgtcataattcaattaaaatccatataagtgttttaatccgatttaatctttaaaaattcataactaattcatttgaacttagtttaatgtggttcaagttgcaaaagttgtgtaaaataaagatctacatattaaaattgtccataaattgaattaaatttatttaattctttttaaatgggctttaaatagatttaatcttgtaaaattcatttgaagtcagaatgaggccgttcaagactcataattcatctaaaattatgatctacatgtttgtttactttttatgtattgtttatttggtttttattagtctttttcttcgttttgtgtgttagcttgtcgtttccgtcgttgcgaaggttcgcgagtgcgccggaagtattcaagaagattaattgaataccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgatcttgattactttattccttgataccttgggttattataatttgactagttgagctttatatattggttcagctagatattagatgtgattgcttagccatgcttagaaacattagcacactattgggataacttatgattcattattatttaatgatggtttaatgatagttcacgatggttaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtataacatgattcattgcggagcaccagactgagaagtggcggagataagcccacgggggtcgctggggagtccatgccttgttttataagggggtgattatgatccaggaatggtgcactgtggtgagttgtgttatgcaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcataataattatagatgttatacctggtaataattagcttagctcctggtttggagattagatctgttcagccgggtatggttgttcagaatggttgggcctgggcagcacgggtgtgctgttcagtgttgattaaaatttctgattaattactccaatgttttacttctcttaaatgttttgctaaatgctgcttttacaaatgagccaatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcatgatgaggactaagtgcctcataagtaagtatttatcgttttagttaatttgatgaatctgtatattaaattgtcagtttgtgtacctcggctgattcctggacgaggattttatgcacaaataagttcggaaattactagtgaatttccgggcgtgacagacatgatcgaagatatcatggatgacttctcagtttatggaaagaatttcggtcattgt

SEQ ID NO: 71504 - DNA, 12783 bp, Oryza sativa
tggacttttagggatcaattcaaaaacatggcagaaactagtgtagaaggcaatgggatcagtacggtagatattagcaacagctcgcccgccaaaaggttgcggatggagacctgagtagggacccagacagggtgtaccatcttgatccaagttttggaccgtttaagagggggaccaatggacctgttgtatggcctaccattttagtttcattttgtttttttaacatattggaaacaattatgaaattaagttgtttttaacagtccaccagtgttgcaagttttgaactgaaaggagtgaagtatgaattacgcgggtaatcttttgctctgattactactaccagtgaaagatgtagccttgaaagttatcaactctagagtaaatgccatttagctcaatcatgcgtgcagattgtggataaaatcaatatttaatccatctccgtggatcctttgttggaatgatcctctgtgggcctatcttcttgccaataattctcttaatggaacaggctggatactactgtggtagtactcattttgttttgacttttgaggaaaacggtctgcaatatactggttttgtgcattatactcgtgtcgtttggactttttgtgcattatactcgtgttgttttgacttttgagaaaaacaatctgcaatatggtttagactttagaatgcttgagactacccggacatctacattgagatgatcggcgtcttcggaagcaattcagatggtccgttcttgttcctttctatcagaacttctgaaagacgctttctatcagaacttaagaaagacgcttctgaaatatctatgctgactagtctttattgtgtgttagttaacggaatgcgtacaccaggaaagaacacattcaaaggagcacgtcgttctcagaactcggaagagttgctgcaagccatgtgcaaaggatccaagacctaaatgaccgtgataggatccggaaatttaacgaggatgctacaaatttcttcgctgtcagatgtgattgccgggcccaacgtcgtgtcttcagtgaacaaatcagcttgtgttgtttatcaccaagtcattgtactgatgttgttgttcttgacctttttcaggtacgtatgtgggtttggatcgtcaaactatcttggccatccgaatgcttaagctcgatatctgcagatatctttgcacagaaactcatctcctcatcgtttatacttaagctcatttgtttgtttgtttgtttttgtgtgtgtcgaagagagtttgttcttcacgcgctgacgcgcacgggggtggggtccttccgtccctgtgaatgattcgacctgacgagatttgactggtacgcagataacgaatgctctaccacaaattcatacaaaccagtattactccgttttacatatatcacatgtgtaaaagcgatgtagaatgtagatgcatttaccatcggtacgctttcgtcttccaagttccaaccacatgtttgatgtgagggcctgaatattttctgaaaaaaaaaggggttaatgatcgtacttggcctgagaaagtgacacctagggagtagggacactcagtcgtaacatttcaggcggtcattaacccattttagtatctgggctccaaacagttgccatgatatagctaggcgaactgcaagcgaggtcttgagaaacagaacccgctgcagtggcacatttggtgaggcttcgggaggtcaccagaattgttcctgttcacacgggctgctagttcttcacagctatctcgtgtcatccgagcagaagcaactacctaccaataagaggttgcttcagacccaaatggtaagaggaactgtacctgaatccacataaagaaaaggggaaaggggagaggttcagttccatggggatttgtttgtttaagctgtatgtgccacactttcttattcctgaaaagaagattggtttccctcttcaacttcatactccgatgttcttgcccctctatagctcattaaaaagttagtagttgagttcatctcagctgctcttcttctggttcttttatcttttgtttttttggtggttccttgcaagtgctttttctcgaggaatgtcccttttggttctgttgcctgttggacctcagttcttatttatttaatgatttgtgctcctctgtaacctggtgttctcgctttctaatctgtaacgctatacctgtgcttaacaggcatcgtcaggaatttttcctcggttattccagcatgtgcgttgttacgttgaaggatgaattccaaaagagcactacattaatcctctaggtcactttgtcaccatgaagttcattttctatctgttcagtattttctgttgtctgtgttcctgcgcacaaagccaaaacatctctgggaggcccgatgcagtgagaattggagctcagttcgcaaggaattcaacaattgggagagttgccgcagttgccgtccttgctgctgtcaatgacatcaacaatgattcgaatatccttccgggaacaaagctggatcttcatatgcatgattccagttgcaatcgctttcttggcattgtgcaaggtaatccattcgtgctttttctgccactgagtcaagcggacttatgttaccacatggtataaaacataactagtttcttcttcttctttgcatttgtcagccttgcaattcatggagaaagatacagtggcaatcatcggcccattgtcttctaccaccgcccatgtcctttctcatcttgcaaatgaactccacgtacctctgatgtccttttctgcaactgatccaactctttcgtcacttgagtatccgttctttgtgcggactaccgtcagtgatcaatttcaaatgactgctgttgctgacttagttgagtattatgggtggaagcaagtgacaaccatatttgtggataatgattatggaagaaatgcaatatcctctttaggcgatgaactttccaagaggcgatctaagatcctgtataaagctccatttaggccaggagcaagcaacaatgaaatagctgatgtgctgatcaaggttgcaatgatggagtctcgggtcatcatcctgcatgcgaatcccgactctggacttgtggttttccaacaagcactcaaacttggcatggtatccaatgggtatgcgtggattgcaacagattggctcacttcataccttgatccatcggtacatctcgacattggattactgagcacaatgcagggtgttcttacattgcgtcaccacactgaaaataccagaaggaagagtatgttgtcttcaaaatggagtgaattgcttaaggaggatagtggtcacagcagattcttgcttagtacttatggcctgtatgcttatgatactgtctggatgcttgctcatgcgctggatgcatttttcaatagtggcggaaacatttctttctctcctgaccccaaactaaatgaaatttcaggaagagggttgaatttggaagcattgagtgtctttgacggcggacagctgctactagaaaaaatccaccaggtagacttcttgggtgcaactggcccagtaaaatttgattcaggtggtaatcttatccagcctgcatatgacattgtcagcataataggatctggtttgcggacagttggttactggtccaactattctgggctatcagttatatctcctgagactctctacaagaaaccagcaaatcgtactagagaaactcaaaaacttcatgatgtgatctggccaggtgagactataaataagcctcggggatgggtttttcctaacaatggaaatgagataaagattggagttcccgatagggtaagttaccgtcaatttgtatcagttgatagtgaaactggaatggtgcggggactctgtattgatgtgtttgtcgctgcaataaacttgttagcatatccagttccgtataggtttgtaccttttgggaacaacagggagaatccaagctattcggagcttatcaataaaattataacagatgtaagtcctaattctgaaacttgcatcatgcttatcagcttatgattgattggtttatgtgtatctttcatggctaggactttgatgctgtggtaggcgatgtaactatcatcacaaatcgaacaaaggttgttgatttcactcagccatatgtgtcgtctgggcttgtggtccttacctctgttaagaggcagaactcgggtggatgggcctttctgcagccattcacgatcaagatgtggaccgtcactggactgttctttcttatcatagggacagtagtttggatgcttgaacatagaatcaatgatgaattccgtggccctcctgcgaaacagcttattactgtgttctggtaaggctataatttcgtcagtttgtatttatcgcgtgtacaattcctgcaaatatcattccatgttttctgtcaccattatccagattcttggacgatgaactggttttatttgcctgacacttcatgttctacttactttgcaggttcagtttctcaactctgtttttcgcacacagtgagtgaaacgacagcttgtcacattctcgacattttcaataaccatgatggaattttccagctcataggagctactctttcttctatgtttatacaggagaggacaccaggagcactctcggccgcttcgtgatcatcatatggctgttcgtcgttctgatcatccagtcgagctacactgccagcctgacctccatactcaccgtgcagcagctcacgtcgccgatcaccgggatcgacagcttgatcaccagcgacgttcccatcgggtttcaggtcgggtccttcgcggagaactacctcgcccaggagctcggcgttgcccactcgaggcttaaggcgctcggctcaccagaggagtacaagaaggcacttgaccttggccccagcaaaggaggcgttgcggccatcgtcgacgagcgcccgtacattgagctcttcttgtatcagaaccctaagttcgccgtcgtgggctccgagttcaccaagagcggctggggcttcgtgagttctcctcttttttctctcacagtttgacagtgggagatggattatctaattcaggggacatctatcttttcttacatttttcttacatgtcaactaaataaccattaagtttttttaaaaaaattaacaacatgcatggttaaatttgatcacttcaagttcaaaaaaaacaaattaaactaaaaatagttaacatacttgcaattataattgttatcgttcgtagttatacttgttattttattattatttttttagataagtttgttattttattataacttgtagaggttgaatttacacttgcattattctatagtgatatgttttataaatctatattattaaaaaaatatttttttataactatttagatggtatgcaagaaatgattgatatcttcggggagatgaaaacactttccttttgatagtgagttccatgcttttttttttctcatctcatgcaaaacgtgtgtacgattattgttaggcgttcccgagggactcgccgctgtcagtggacctgtcgacggcgatcctggagctgtcggagaacggcgacctgcagaggatccacgacaagtggctggcgagcgacatgtcgtccatgtcgcaggccagcgagctggatcaggatccggaccggctggacgtgtacagcttctcggcgctgttcctcatctgcggcctcgcctgcatcttcgccctcgccatacacgcctgcaacctcttctaccagtactcccgccacgccgcggaggaggaccccgctgcgctgcagccgtccgccagcgacggcagccgctccctctcccggcgcagcaagctccagtccttcctgtccttcgccgaccgccgggaagccgacatccggagggcggccaaggagaaggcgtctggtctgggcggcagcggagggtccatgagcggcgtcagcttcacgtcaagcggcagcggcagcaccaccgcttcatgctaaagccttgataattagttaattttcaggttaattactttacctctccttgtgctgcagaattgtagagatacgtaagcacattggaacttttgctgcgctccggcgcttactgaaacactagtatagcaatatactgaaacacattggagtaacattttgatcgactaaaacggcacgacctactatgatcatggtgcatgatttcacggacagactgtggaacaatatcctctaccctaagccactaactttgggttactaataacatattaatccactttgttacatatttatatgtcagtgatctaaagttaatccgcattgcgtccatagactgtacggcatgaatctggcaaatggattgggctggattgatagtttgggcctctagagttgtacaaattctgacacttgtactcgtactccctccatcccacagtataagggattttgaatttttatttgcaacgtttggccgttcgtcttattcaatttttttttgcaaatataaaaaatgaaaagttgtgcttaaagtactgtggataataaagtaagtcacaaataaaataaataataatttcaattttttttgaataagacgagtgattaaacgttacaagaaaaactcaaaatcctttatattatgggacgggagtagaagttaaggccaccagcttggactcggctgtatctctggcctctgcggcgtttttcccatgtaaaccatgatggatttgatggtgaagccacgcgcccatgatgaggcgttgaggatgggcatgattcactcactcaactgtttcagcccctcttcattggggagctcattctctctcgtcccattggttgcttgctcgtgaccgtgagttgtccatactccataggcgagagagctataaagacgagctcgtggcgccacactattccagatagctggatgatgtacagacaacagcaatcacattcatggctctgcattgtgcaacacatagtacacactctactccgtacgtgtatcctacagttctgcacagtggattactatcatttgcagaagccactgctatactggaaagaaagagagggaaattgcttttttactgctaactccgtttcacaacataagtcattctatcatttctcacatttatattgatatatatatattagcataaatataaatgtggaaaatattagaatgacttacactataaaacggagggagtactaactaacctgacctgttgggggtgttacttcgcagacactggaaaaacatcctgaaagttcattccacaaaaggccaaccagagaaaggccaagagcactatgccgacgaacaatcaaacaaatggctgatgcttttggatctgaaactgtctgaacaacaccaaaatttttcatgtcaagtcatttcgggaattgtcgggtgccagcttcacgtacctgttggtgttgggtttaggtgcatttgcgtgcatattttctcttactccgacatgagcgaagccgtccacatgcgtgttacattagtttagatagcacaaatattcccaagataaaaaaaatagaggacttatattggcacaatatcacaagttaacaaacaaaataatgataattttcacacagacgagaggggtgaccaaccaacgcacgcatcacgttccacggacacgattcgattatgttctttccccggggaaaaaaaacagaaaacgatttgtgtccggttcaaagaattattcgccgtgtctgaaagtgtacaggtaaccgggatgtcaactgcttgattgatcaaaaaatgatttcgttttggggcaattgtgtttgtgcaaagcgctgcagatttgtcttgggcgattgcagcatcggcagttgcattattatatcgatcacgtcgctgcaaattgcagcctcctccatgtgccgggataggggggagagcacagaaacaaaggtccacggtgtagcagcatattggtgtactctgtactcttcttccctctggtttgtctgcacgtatagcctaggtgaaaaggtcatggactcttacgtagttttaatatagacatggagattgtccccaaaataaaattatactaccgaacagattcccagggcagatcactgcgctctcttcgagagaagaaacaatgcttgtgataaactggatggatggcattggagataaggatatctgagcacccaattttgcatactttagaacaagtgtccacatgcaaatatccataggtaattctgtatcattttggacaagactttccgaaaatattatttgaatacttatatttgtcaaatgttatattttgtgcttagtgaactagagattttgagaaactagattatccgactggtcatggttactcaagtccgatcttcttttcagttcagtagctacttagttttagagtttttgctattttagaggtattctaggagtagctatgtcattaatgatttaatcttttattcttctgaaaaatgggaatgaattttttttaagtgaaatgaaaatgaaagggtcttcagattgacagtggggcccaccggcaccaaccgcgattataccgtacggcgaaaggagaggacggcccatgaggagaatccaagaccgaaaaaccccacaactatctcctcccttccacctcgcctccctccctccctcccctccccaagtatccactcctctcctctctcgcctgactggcacaggcaccagcgccgagagggggagaggccagaggaggagaagccgtacgtacgggggcgctcgctagggtttgccacgccgcgccgctgaccccgcgaggacgtccctaccgccgacgacgccgccgccatggcgcggcgtcacgggtggcagctccccgcccacaccctgcaggtgcgctcgctgcttgcgcgccgtctcgtctcccctcctgttgctgtctgtgctcgcgcgcgcaatgtggctacggatctcgctgcgtctccattattccgcggtctgacgagcggagctcgctgttgctggtgctattgcttacgcgtctactactctactactagtagtatgttttaggttccaatgagtcagtatgcgttgtttgatttgatacgatgtttttactctcttgtgtagtctctactccgtaggtatgtgtgtgtttgatgcaattggttgcttcgcctgaatattgtttatgcttctaggcgagttcactctatagtctatgtctagaaccacactagtattccagtacgaggatttgatttgcttctgctgctgtgacacgaaattgtacgtcgatttgattttcttaatggttcccctgatggcatatgctatctgaattttaggcggatgctacgttcctgatcccgtgcgttgtagtatatgtggtgtctgatttgatctggcagtagctttgggcataaaagtggtactttttgttcgttttctgttggtctcgtctgctctttctttctctgatgtgatgtgcgaccctggacttgggggctcccctaggccctaactctccttttgtcttcttcctatttgcactatggattctctggtttgagtttttcttttttttgagggcctcctatttgatttctttctcacacctgagttaaacattaggatatctatggattcgtgatttcctgttgatttttcagatgcagaattttagttactccaacctttttgatgttatccgtttagagtaggagtagaaaagatgcatccgtgtttgaaatgatggagtgctcagttcggtgccagtggctttgccattctggacaacgttcattttttttttccttttctttgtttttatatttcttagtatctctttgttgcatatcgttttatgctagagccaactttcgtttctatcatgaaattcttattacccggcaaaaatcattaaattcttattgtcaacaattagcactgcttcaactaagttatactagtgaaatcaaattagttaccttcaactagagactaaggataataatccgaatgacgttttagcgtcatgttggtggtctgttgggtttcaaaaaaatgttggtggtctgtcctattatgttgttagtgcttttacctttttatcttacggtcccagttatgcactttttcagctctgtttaatgtgtcatgtgcaagaatttatctggattcattgaagaactgtagtttacctgtgtaactgcagtatcccgctaaaatttagatcaacttgtgtgcattcttagtcatggactcatggctctggtctatgttgttttatctgcactacctcactaagtttacatgttttggagatcaaacaagggaagaggctataaactcttggcaaataaagcttaatctttcataaaagcctgtaagatctgagcatgcatgatcgtcttgtgtaattttgttttaagtttttcgcctataaacctcatactcaaagctcttgaaatattcaatgtttgtaagaatcccctaggatcagtaatgttcagccttccttttaactagaaagatggtgtatatatggggatcttggactcttagtcttctactcttctttatctgctgaatttgtagcctcttaattagatcctgtacttcctttcatgtgctgatgtcgatgcatgctatcccatgtttacctcttattaaagcaagtgattgaatattttttttctttttcttttttgcaggtggtagctataacggtgttcttcttgttgtgtatagaattctatgctttcttttcaccatttcttgggaaggacttgtatcaatttatcgcaataggtgtttatagttttctggtaatgttcttcctgttcacgcattgaattttggagtagtagattttgtttgacaagcgtttgatgttcatttctggcatttcaggccttatcagtactgattctatatgtaagatgtactgctattgatcctgctgaccctggaatcatgattactgtcaacggtgctctaacctataagtcagaaggtatctgctcatacttggaactttgatgtaattcatgtagtagtaggcacatgttatactaatgtagcaaatcatcttgttttgctcaaaagcaaaattagacacacaagacgaaacgggcaaatcagaatcgagaacctatgaggatgtccaaaagcacaaatcatgtttaggagctggttgtttgtgttgtgctatatttgtgaaagaggattgtcgcaaagatgacgaagcttaccaacaagaagattatgatgaagaggcactcttttgcaccctttgcaatgcagaggtacttatccacagccccatccttagcgtgtgcataccataccatttttaagacctcgtattcattttctctgcttttgcaacatatatggacttggtattttgaaaaacataattgaactgtaaatacttacctgctgcatccattgattcaagtttacatgtctgtttaacacctgtatatttgacctgaacatagtggtacaaggctattattcatggttgctttacaacagacgcacataacaaagtcttatcgttcatttgtatcacttcgaattatatttgcatgaatgtggcctaaccagagttataatgtttcaagacttctctaacagtcaacaggtgctatgtaagaggcaaaacttttgaaaaagcttttcattacaagttcttcgaatcaatttttgcctatagacacacagaatttagaattcttatgacaatacagggacatagatgcccgggaaaatatgtggtggaaacttggaaactaccgttggatcgaaaaatggacattcgatattcatccacgtcatcacaagtaaacagtaaaatttttactcatgatgatgtggatgaatctcggacgtccatttttcgatccaacggcagtttgcaagtttgcactacatatgtggtttccaccacatattttccctggatgcccagatcaaacagaattaattagcatggtttaacagctaataaagaaaactcgtactaaggatgattaggaatttaggatccaagtatgaaataactaaaaaaaaaatcccctgttgagacattatatcagttattgttagtgccatcaacattttgtgcttcttaactattttggtgcttctgaaatattagtggatcgtgagtagagaccatttaacatatttgtttacagcagtttttattcactgtatatgctaataatccaaagttttggttcatactcagtaccctttccttgtacattgatataggtgcggaaaaatagtaaacattgtcggagttgtgacaaatgtgttgatggttttgatcatcattgccgggtaggtttatgttaaagcttctgtttcataaacttcacttgtccttttgccctttcactttagtttgttgacatggctattctgatgttgttttggtgtttctgatgcagtggctgaacaattgtgttggaagaaaaaactatgtcacatttctgtgccttatggctgtgagccttgcttgggtatgtaaaataatcaaaacaatattaatatttctatcaatgtttatattcttttaactgctgagaaacttgtgtcttgtggatttggtgctctggaagcaatttttcatgtttctaattgtggttgttcataatcttaaatgcata

SEQ ID NO: 71505 - DNA, 26135 bp, Oryza sativa
  unsure (1)..(26135): unsure at all n locations
ccaatagtttatctctggattctataactatatattttaaaaatttagatgagaatctacactgtttgaggagctggatatcctaaaaaaaagttataactacgagaaaacccattatctcttttctacttcattaacgtgaactcacgtatttttttcactaccgcgacgggaaccaagctgctttttcagtgccaaaatagtaaagttgtgtcactacaagaatccaagatttttttttgcggccaaataaacaaagccgccaatagtttatctctggattctataactatatattttaaaaatttagatgagaatctacactgtttgaggagctggatatcctagaaaaaagttataactacgagaaaacccactatctcttttctacttcattaacgtgaactcacgtatttttttcactaccgcgacgggaaccaagctgctttttcagtgccaaaatagtgaagttgtgtcactacaagaatccaagatttttttttggcggccaaataaacaaagccgccaatattatcttggcggtcataactagttgtgaaggatacactactggaggagcatctctcccggttcgcaaccccctttactcccgggtagcgaaccgggagagagaattcgggactcaagatgacagtctttagtctcggttcaaatacccaggagtaaatatccatctttagtcccagttggtaataacaaccgggactaaagttccccagccccccgacaggggactgacatgccctgtcagggggcgaaccctttagtcccggttagtatccctttgtcccgttgaagttaagaaccgggactaataaaccactttagtcccggttttttttggaaccgggactattgtggaaatcacccgaccttctaaagatcacttctccagtagtgatataattattttattgagggttatatatgttgaatcaccaaggtatatgaacatttccttgtgcgtcataggagatggaagaaagtaaaagcataaaatggtaaatagagaaattacatcatagctattatgatgatttgtttgtaatattaaatgcatttacactaacttttttagatttgcttgtgatattaggtgacaaatacattaggattatgttaatgatttttattgcttgatattctttttatgttacaatttgttgttaatcatgtacttcctccgtttcacaatgtaagtcattctagtattttccacatttatattgatgttaatgaatccagatagatatatatgtctagattcattagcatcaatatgaatatggaaaatgctagaatgacttacattgtgaaacggagggagtacgtaaaaattgactatttttgtctggaaaatatgccaaatcgcatataagcaggcccttatgataaagtcaactcagaacatttcccaaccttgatggaaataaattatatcaaagttgtagatgcagccattttgaaagggtcaggtgacatcgacatgcaggattagattaatcatcgagcaaaatagtgataattactagtatggagtagtagatgtgaactcataataattactgctccctccgtcagaaaaaaactcaacttagaaggtgtataatggaggggtacaatgaatatagacaagaggcctaattggcacagctccatccctcctggagctggagctcagccaaacagttccagctccacaaaaaatgggagtggagctgggtggagctctttcacaaaatgaactaaagttgtagagctgggtttaggcagctctacaactccactccagacctaactccttgagttaaatttaggagttggagctgtcccaaacagatctaaggttaggctttttgggacatagggagtatgtattaaaaataacctaagtactcatatgtgcagcaccctcacacaaacacatttatttttcctattctaggtaagtgtgtataaaaaattagaattgtacaaacttatcggatcggactatcactatcgatttgtgaaacagaatgtgatgattgtatgagttctgttttctcaacaggcagtgatgctccccgactattactgctgcatggttagtgccaattcaaaagtagacagtgatagtaaaaaaacatacaatgatattaaacaaaacagacagtgattttatattataaattgttttgacttttttataaattattttttaaaagtttatggagaaatatagtgactcttataacatctttcattaaatctaacattttcattaaatctaacattgaatatattcttataatatatttgttcggtgttaaaaatattattatatttttctataaattgagtcaaattaaaactcgatttaaaagaatcaagataatttataatacaaaaaggagggagcagcaatttcgaaccggtgcttagggtgtttttctgtagtaggaaatccatggaatgacatttggccatgtcatgttttaattaggtcgagaagctcatcgagaagctgacccgaaacgggcggaacgcggtggccatcaacgagcacatcttctccacggtggacggcatcatcggcacgttcgcgctcggggagacgtacgcggcggaggagttcaaggacatcagcgagaccatggacctgctgagcagctcctccgccgaggacttcttccccggcagcgtggccggccgcctcgtcgaccgcctcaccggcctcgccgcgcgccgcgaggccatattcaggaagctcgaccgcttcttcgagcggatcgtcgatcagcacgccgctgccgacgacgacggccccgccgcggctcgcagaaaggcggacgacaagggctcagcagggtcagacctcgtgcacgagctcatcgacctctggaagatggaaggaaacaccaagcagggcttcactaaggaccatgtcaaggccatgctcttggtaattaagtgttactgtaaacctccaagatcacggtggggtttccggtatctgtcaagttttcttgtttattcatctgatgaaacgtaactcaatttcaggacacattcgtcggtggcatcaccactacctcagtgaccttgcactgggcaatgtccgagctcatccgcaatccgagggtgatgaagaaggcacaagacgagattagagccgtcgtaggcgagaaggagcgggtgcagcaccacgacatgccaaagctaaagtacctgaagatggtggtgaaggagaccttccgcttgcatccccccgcgacgctactcgttcccagggagaccacacggcacttcaaggttggcgggtacgacatcccggagaagaccaaggtcatcgtgaacgcgtaggcaatcggcagggacccgaacatctggaaagatccagaggagtttatcccagagaggtttgaggagatggacattgacttcaacggggcacatttcgagctggtgccatttggctctggccgtcggatttgcccggggctggccatgggagtggccaacatcgagttcatcttggcaagcatgcttttttgcttcgattgggagcttccccatggggtgaggaaggaggatatcgacatggaagaggcagggaagctgacgttccacaagaagataccactcttactagtcccaactcccaacaaggcaccaaactagtgatcgaactgattaattagcaaggtgatcagaggcttgctgtgcaactgtgttgcactttttgccacagttaatttcagtattattccagtaacttttgtataagtgcttcgccatttctgtctttataaactgttgaatgctttcaagaaaaaaaaataaaaatgtaagggaaacaatgattgcacttcagtttatgaaaccatccttatagggcgacggcgtgacgtagttcctgcagcagagttgctggtggagatggggggcggtgcggaggaaaccggtaggaagggcaacgagcagcagagtggcgagtgaaggggcaattggcggggtgggagtgcgggttggggtgtggtttgcggtgcgtgacagaggggggagggggagcgattgcggtgctaggggaggggagcggagggatttcatgattgggaatcaggaagaaaagtgcaacgtgatttcagggatgctaggtgagagaaggtgatgcttgcacggaagctattccgaacgttagacctcaatgaaataatctggaccgttccatgaggaatgaaagaattattaatgagtgaaatcatttgttgaattataaggtagatatgagagagattaaccgaacaaaccggctttagtaaaggaaagcagcatggaaggataatgttgaatatgatggtggaaacaccatcaggtctaccattacatccatcaatggatatatatgtttggtatatagagattagggggaggaaggccagttaaaaagttcaggagtatatcattcatatacacgtaccgtaggaagttaaatatttaattcttttacattgttcagacatcagaagtgcactctaaagaattacaggcgaaaaatggctttgctgatcactggacttacaatgaaactccacaacacaaatctgtcgtagtcttagagtataacaaaacatgcttcacaagcaaagcctggttcactctttcttcggtgggatatggttgccaccagttgcaattttgaacaggtagaacgcagacatcaaagcactgcaataacgtaaaagttagcttcataatgcatacatattgtatttgcaagaggaatacaaatgaaatatctgcaaactcagaaagttttcagaatacagcgatggaagtgtatactagttcggagagggttttacctgaggccagcaacgacaccagctggcattatctttgaagtctcaaggtatctctgccccataacataagtcaaagctagtgcacatactgttcgacaaagcaaaattttacagttaataaagacaaaaggacaaagcaatgaggtaaagtgcaggaaaaggtggacgtaaggtaagaagacagaaatgaggtgaagtgcaggtctgcaggaaatggtggatacatttttcggacaaagttcattccgtggtatatttccttctcagttcctttcgtcaaaactgatttattaacttaaagcaagggtcattagcttaaatgaatcattttctaaaaaatagcttaaatgaatgatactgatgagatcttttcagctcctactagaagcaatactgcgataactaaatattgctaaaaggaagatctgaagatacagtcaaagcattaaacacaggcaacaatgctacaatttatattacagtccattgagttagcgaatctagatctgactgaaaggtggaatgtttcaataaaacatgtgcacattaattaaactgcacatacttttactgctttccattgtcaataaagatacgacaacatgcatagatgatctctctagcaacaaatttagaactgaaattaacaaaaacaaaagtatatacagtatacagttacaaactctaacagagatctaaatagtatatcattctttgcactaattggaggccttcctagaaaggccccatgttaatcctagattggtaactaagaggcaagaattcgtacattaataaaaattatctagttgataaaacgaaataaaaccagccatataatatatttaactattacatcctacagatgtccctaatcaatatgatgagtttgttcagattctatgcaagtgtcgagactcaaaagtcccaccaaacaagaaaataatcaaaccaccatgtgcacatacttaacggagtccgagttgatcacaaaagctatctggcatgcaaactaattttcatcagatatcaatctgcaaactaaatacaaacatcgtagaaaaaaattcaatatctaatatacctacactaaaacatgctttccatgccctggttgactagtactaataaaatttgcagagaatgaatgaaaaatgagctaccatgtaaattcaataaggcattgagaactactgcaaatctaaataccatactctgttagggaatatctgagagtgattagcaactattcaggcattgaggacaaatgtgttcaacattctccaatgctagattcactaatttggctatgatcaatgcctattgagcaaaatctgtaaatcttaacaatcgcaccaatgcaatcaattgccatcgttgtaagggagcaatttagatagcaatgaattcagtagctaccagcctttattatggtgtcccatgagatgaaatgcctccttgctggagactggggagtcattagtagcactagattatcagacaatgggtaattgaagctatgactaccggattcagaaaaggtgtttagttttgtcttcatacaaatgcaggactatcacatagagacagatttgctgccgcactgcctttggcagtatgagaggaggatcctggtatccatttccctgctgcccacaacaatctgaacgaaattgacaggaattcccaagtgcttaccactgagaacatccctcccttgaaaatgcagccaaagtgatattcctaaacacatctatacgtccataagtgccacagaatcctaaccttaacaaagtcaagttgctagactactagagacgccaccatcgccatctatcactccatttcaccactaaactgcacatcccgacatggtataacacccaaaatacatgcatagccttttttgggggcaaaattatgcagcgatccaccactgcgcaaattcaaaaaatgcgatctgtacttcacctccatccatagcacgattccaagaaggcaggatggagaagaaccaaccatggaacatttgcaccgagggcagcgaaaaaatggaggacgaggagggggcgtacgggtctcgagggcgagggcgaggtaggagttgcggcgcttctcgaaggtcttgaggctgacgaagcccgcgaggaggaggagcgcgccggcgcccgcgccgccggccagggaggcggtgctgccgcggcgggcgtagcccagcacgccgccggccaggacggcgaagccgtaggggatcgtgaagcagaagtcgtgcatctcgctctctcggcctccctccctccttctctcttaccagatctcgccccgcctcgccggtgagatctcgagagcagtttcttctctctctctctgactctctctctcaatctctctcgtactcgctctcgcttatttttggctaatccgtggtgcgccgcggagagaagtcgtcgatcggtggtcggtctggtctgcggcgggaggcgcactttcgtcatttcaggcggctaatcgatgaccgggagggagacggagagaagagaagtgtgccacccactcaccagccgccttcattgcaacgaataaaaaatgcggcgttcacatgcatttgcatttcttttttcaaaaaaaaaaaaggaaagagccactatatcaaagctgggcatgtgccatgggcagccagatttgagaaaagctagtttgaggcacattatctgtgcaattttcatgctcgtgtttaattacgccgtaaatttcaatactcactttgttcttttcaaaaaggtatattcagcttatacagattaagaataagatggaaatacaatcaaatgttgaatactccctccgtcccataatataatataatggattttgagattttgcttgcaatatttgaccactcgtcttattaaaaaaatttgtgcaaatataaaaaataaaaagttgtgtttaaaatactttggataataaagttagtcaaaaaaaattgaataagacgagtggtcaaacagtacaagcaaaaatttaaaatcccttatattatagaacagaggaagtattaaacaaaatgatagtattactcttgtttgaatactatgggagtatagtgatttgtaggaaaagaaaattttgtcaccatttttaattggtttgatgttcacgacgtcatagatcgtgagtcgtgacactactaattccatattacctcactcaactgccataatacctctgtaaactttaataccgaacacaaatgtacatatattaaaaacacattcgctttaacctggcttgtctaaatgaaaaaggttttcaccaacgcgtaaatgcataatgacagccagtcaaaaaaaatttaagaaatgagtactccgtttgttcgtattataactttgtgtttgttattggggttagaactaatcctctaacagaacaatagattaatatataattaaataaatattagtcaaaaaaagcttaaaaatatattagattaatatttaaaataacttttctatagaaaatatttaaaaaacatagtttatcagtgcgggaaacatacgcgtgaaaaataatatagtggaagttgggaaggggtcaatgttttaaatagcagactaagacatttagcggttagcttctcaaacagctatagcgggctaaatggagctatagcggctaaattgtacattagagcaaaaaaaactagaacccttctcaaacagctatagcgggagatttaaaaccctaaaaggggtatattcgaattcacctaagtcgctttgattgatttttaagttaaacttcgattaagtttatagaaaaatttagcaatatctaaaacaccattttagtttaattaaatgtaacattgagtatattttgataatatgtttgtgttgattggaaatattgcaatttttaaaaaatttaattaaactaaaaaaattaaccaggggaaacaaaatatcctaatcccattttattaccttggttcccgtcaaatccttggatgggaaccaatgttcccattttattaccagcacatcccatgataccaaaacgccctaaaaccctaaaatcgagcaaacaccctcgcccaagccggccgcccccaatcccctactacaggatacagattgcacaccgggtcggccggtccatccatggcggcgaaccagggcgaggcgcatcggcgggagcccgaccagcgccgccccatgtgcggcgtctgcaccaagcccctccgcctctgcctctgcggctgcctccgccgcccgccgctcgacaccgccgtcggcgtcaccgtcctgcagcacctcatggaggcgggccacccgctcaactccacccgcgtcgcccgcctcggcctccgcaacctcgccgtcgcgctcgtcggcgacgtcaaccaccgcgccagcttccacctcaggacgctcgacgccgccgccgccgccggcggtggaaatcatgaccgtcccgacgggcccggggagattcaggtgctggagggcgacggttttggcggcggaacgggaggccctgctggtcctgtgcaatgcgaaggtgaaacattagattctgcaatatgctctaatggaatttctggcgaatcgggtggagcagttagttgtgcaaggcgtgattatgtgacgaagggcatcaatgcttctagtgatttgggtgtgaaagctgcgaatattcgaggttctagcgatatcggtggtgaaatattggatcttgtggatatccctgataggattggctttgatttggatggagagatctgtagtgttaaaagcgacttaggtggaggtgaggaattggggtttcagagtatgaagaggaatggatattgctcagattctgaaagactgggctcctcagctaaccagacaggaaactcctttgttgatggtatccacggtgaaaatcatcacagtattggcgaggtaaatggtaatctccctcgtcatttagtagaaaacgcctcagaatttcaaatggcaactgcccaaaactgcaatggtatacctagagaaaatgttggaactgttgctgctattggtcaagactggactgtgaaaaacatggataagtgctctattacctatacggagaaggaactcaagattgaaattgagcgtggtgtgaagcccaaaatcagatggttgtcaagaggaccacttggtcagtcagctgtctccaacggttttactgtcacgaaaatacaaatgaagaagtcaaaacaaactggggaagtttcggtgtttgaggaattctcaatcaccataccaccaaagtcagctctgctattcccgtgccagcgggcaatcagcattgatgcttcagactgtcagttacaacatttgattgtgttggatggaacttgggcaaaggcgcaacgtatgtaccatgagaatccatggctacaacttctgccacatgtgaagctagaatcagatggtgttagcttgtatagtgaggtgaggcatgagccaagggctgggtgcttgtctaccattgagagcatagttgttgccatgaggaaacttggagaggatgcaaagggactggatgatctgctggatgttttcgagtcaatgattgcagatcaacggagatgcaaggatgagaattggaaacaaaaactcgagtccaagacataaggtggccctgtttttcttttgttgtctaattctattcatatgatttctggatgcatttttctgtccagatgtcatctatatcatgattttatactagggattttcgtttgctgaaagcaactgtctgagatattgtacttttgaactgtcaccattgctttcaatcatagtggcaaaagctgaccattaccctagtttacaaatattttgtgttggatacaaccttttccttgagtattgcaacactttctagtctacaatatactgaatgagttcgttagacatggtctaatcaagatttcttcatacctttgtttggtcatgatcgatcgaaatggtctgatctttttcttgaaatttggttgatatatcgtgtgtcctactcaacttttgctctccatgccatggcacatgtgttcttctgtctcgaagcaataaagcaactatgactagaattttggtttgtattgaacgtgtcttctactgaatttcaccttagagacattagcaaaatcagctgtaacatatatttcatatcatgactcgtccagttacataagctaaacattactgagaatgtcattcacttggcgataaccttgtcgcatacatacagaaatatcttgcacaagctacagtatcttcagattaggcaatactcaaatacggtaaaaagcttcttacatgcattcaacatcaaaatctggttataaaggctaaatatgttttataacataatagcttgattatttttcgttcagcattcacaaatgtatagaaaaacatggtctgagagtatgatccaagacttctaaatacattagaattaatctgatacagaaaaaagaatgtctaagagtagtaggataactgattggtcttcatgctactctatatgataactcaatgtctgagagtaggataagttaatacattaccttttgatttagaaaaaaaatggttttggatttagcctggataactgaatgggatggccccatcttttcgcttatacttatcagccttaaatttagagttgattttaaatttttttcatcgtagtttatttttcagcctttgcatttagatcgttaaaaacactacataaaaattttattcataattttttttatttgcaaatatgccgtttcgcttatgcttaaaatcagcgaatcgatggagctgttcaatgctactctatagggaactccgattgctttttagtttacattttatggtatcattcatttgagatccattgcaatgaagtatgatgaccaaagcttgacatcgctagctggtattggctcatcattgagaagctttagcaaactgatcatctacttaagaaataacttcgataagttcacgtttgcatgttggatggaacgtcacatgcaacaacattctggctgcacctgcacattaaacatgaagtcaggtatatcattcaaatatccaaatgcacatagcctttaggacgaggacttgtaaagaaaaggaacacacccactaccgccctgaaacttgtacagctgcattgctggtgcaatctgtacgaaaagtgaggctacaccttgatgctccatcgtctcacatgtgcatattgctttgatttctgtctcatgtcctgatgtctatcgaatgaaaccaaaccgttcagaaaagcaaaatgaactggtattgataattaccagatgatgtatatatctaattttgcggttaggtagaaaattcatactcgagttgagagaggtaagcagtagactttctcctttccaaacattttcgagcgtcgccttgtcaacatattccagcgggacggttttttatctcttttttttaattatttttaccaacacggtgtactttaataagattacattcgccattacaaattagtaaaacttctatttttctaatcaagacagtgatttcattataaacgccccacattttctactgctgtaccgtagagcaaaatttttgcccaaaagaatgctgaccaggtgatatttttcacgcaggtagtattagtattgcacactatcaaattatcggttgacattatttttcgaggtgacatggcccgtataaaaatctcccgtgaccactggacacgcttccgaaactactagacagtgtattttttttttaaaaaaaatatgtgcatgttgctttaagaaaatcatatcaaccaatttttcagaatagctaatacttaattaatcatgtgctaatgagtcactcctttttatgtgtgtgaaggattagtttccaacgtagaaaaaattacaaggccaccaccatgggaggcagtagacaggaaagaaaaaaaccaccaccacacactaacaacacctacatagaatctaggagaaggctagcactggaccagccgccgctagatcaacaaaaaaaaagagctatagctaaaccacccaaaaccaatacctaagagccgaacaacgcactcaactatatccacgtctttgggattggaggggagagggtgagagagaagaatggaaccgctctcccccacaagacccaccaatatggccagtttgcattagctagggcatcgtcacaagaggacaaatatctagagagagcacacacaaactgtctgagagaaattttggtcaggggcctcctagacgatatctctagggagaaaagcgtcaatgagcaccgacgccactgtccgttcgaggtttcaaagagaactaagacaagttttcactcggcaactccacaagagggagagggacggcttgataacgccacaagaaggaaaacggcacccaaaacatcattgttgttggcccggtaaaaccgagttaggttttacactagccgcatgccaaatgtcaatccacagccaacgctccattgctccaccacctagccaacctccgtcagcgcatggacatcgctatacaagcgccccccaccaacagcctctgcgtgcctccacgtggaaagcagcagacacgtcgtcccgggcctctcccttccccgtcgtgccggccttcttgccatcatcgcatggcctcctacactgttagctggccggcctccttgccgttgcccacgtcaacctctcacgctgccacccgctcaccgcttcggacttccacggtcccgtcgcctccgggcgtgccacctcacgccacgtcggcctaccaccgttggtcgcgtgcctctgtgcttcgccagcattccactgggagtagccatcccgcacgacagcaagcatgaggaatggagagaggacgccttctgctcccaggtagcgccacacgctttctctcatgcctgtcgccacttccacgttcctcctgacgttggcactgcacggccgtgcccgccgtcaacgcccgctccaccgcacccttcgacctcgctccacgtagttgcatccgccgcctcgtcacgctgccgactcgagtgcgtgcaggggagccggtctcccgcgccggggaggccagatccggacgggagggggctgaatctggttggggacaccatatccggcagtgctgcctcgccgtcgttgcacgggtcaacgcctcctcaccggtccttgctaccactctcctcttcgccaccagtagccagctccttgaggcgtcggctccagtctagcgtcatcctggatctagtcacggtcgtgggctccgaccccgctaccttgggaagaaagaaggtcccaccgtcactgtccttggagccacgcggtttgcagcggctcgctcgggcggagggtgcctgccctatgagcgacgcaaggccgtataattgagggagagagctctcttattaaattcaatcgtagaagtcgctcccgctgctgctatgttcctccactcgtccaagagaccaagtaaagtaagcgagaaacaaaaaaaaaagcaggggagaatctaaacagaagctgggaaagctccgcgacgttaaatcacacctcgtcttcttctcggcaaggcgaggtgcagtgttggaaaatggcacaggatcgcacacgcaaatcttgcctactgttgcaaatctgtcaagagctttgcaaggaaaacagaggaagaacagagcaaactcgcaaggaaaacattttggggggcaattttctacttcttttgttaggaatcaaacaccatgactcctttaatacatgttctagcttgtgctatatatagactgtgtttagttcacactaaaattggaagtttggttgaaattggaacgatgtgatggaaaagttgaaaatttgtgtaggaaagttttgatggggatagaaaagttagaagtttgatgaattattttgaaactaaacacggcgatagaccgatcgaatcaccacgtaaacgcgtacgctcagtcgctcaccatgtcagccgttcaccgtggtcaccacttagaagttactaggagaaacatgcggccaccattgcatgcaccaccggaacgcctcacagccgtagtcttcctttccggtcccgtgcatgcccaggacgccatgggccacaaccgagaatagcatcaaccttgccaccgctgctgcttcgccggcgccaatgccgatgtgagcccggcccggccgccgcacccccctccccctacggcgacgacgtcacgcgcgcgcgagatgccattgttgcttctgtgaggggggctcaccggaacgcgtcggcattgacgacgacccggacgaacgcgcggcagcatgatgccgcgcgtcctcatggcgtctacggaggacacggccacggcccctgccggtgggccgccggagcccccgccgcagtcgtcgtcggcctcgccgtcgccttcccctcctcctcctccaccgacaccgtcctcgcctcagcggcctcccccgccgccgccgccggccactccgcccccgcctcctccggcatctccaggcaaaaaccagagtcccgcgtcgccgtcccaagattcacctccgccagtggcgtccccgtcagtatcctcacctcctccggcaccgacgacaccgccctctccgcccccaccaagcaagtcccctccaccgccgtctccgcctcctactacgtcgtcgacaccgccatcgcatcaatcacctccggaagaaggaacctcgccgccaccttcgccatcatcaggggctacaacaccttcacctcccccaaatgcgcagtcgtcgtcgtcgtcttccacacctcctgccggcgcaggaacctcgccacctgcaccgcgcgaaatgccatcgcccgggacgccaccatcgccgccgacgacgcttattacgacacaggcgccgccgatccagccaccaccaccaccgggcggtaacagcatgatcatgccgagctccctaactacagccggcacgtctcagagcccgcctgacgccaccaccgccggcgcaccaccacctccggctccatcggtgggagcatggggcggcaacgtgccgagcgggttgctcatcggtgtcgccttcgccggtttcctcctggcggcggcgtgcatgtccttgaacttgtgcatcaagaaccggtggaagaggaggctgtggtcggcacacttgatgaacctggcgcccaggacaaccctcctcctgcccgagcgtaagtgtagtagtccatctgtccaatgtccatgcatggattgacgtcggctcgtgtcctggcatgacatggcatgagatgcaggtgtggcgtcgccggaagtgtaccagccgtcgaacggtccgacggcgtcgccgagcgggacgagctcgtacgagttctccgggacgacgtcgtggttcacgtacgatgagctggcggcggtgaccggcgggttcgcggaggagaaagtgatcggcgagggcgggttcgggaaggtgtacatgggggcgctgggcgacgggcggtgcgtggcggtgaagcagctcaaggtggggagcgggcagggggagaaggagttccgcgccgaggtggacaccatcagccgcgtccaccaccgccacctcgtcaccctcgtcggttactccgtcaccgagcaccaccacctcctcgtctacgagttcgtctccaacaagacgctcgaccatcacctgcacggaggaggcctccccgtcatggattggcccaagcggatgaagattgccatcggatcagcccgtggtttgacctacctgcacgaagactgtacgccacaccttttttctttctttcttttttaaacaaacgcaattacacttaatttggtcttcagcttaattttctgcattcatttaaccgttcaatcgactctattgtatttgcaggccatcctaggatcatacatagggacatcaagtcggccaacatcctcctggatgacgccttcgaagcaaaggtgcgaacacaacttgttcctcctcagcattccacacagaatgacaaactgacgacgattgaatttcttgccgatcggtgaccaaaaaaaaaaaaaaaaaacaggtcgcggatttcggtcttgccaaattcaccaacgattcggtgactcatgtctcgacgcgcgtgatgggcacattcgggtaattaagcacttcgtacgtccgtacgtcctaatgcagatcatcatatatatcatggtttaattcgatcgatcgaaatttctatgtaggatgcatggctttcgtatgttgttacatgacacggattgtatatttgtatgtaaccttggtcgttgttgcacaggtacctggcgccggagtacgcatcaagcgggaagctgacggacagatcggacgtgttttcgttcggggtggtgctgttggagctcatcaccgggcggaagcccgtggactcgtctcagcccctcggagaagagagcttagttgaatgggtaattaagtatatatgcatgcgatgattctcaagttaattacagacgccgacgcgaaagcttttgtcagtctgtcttgttacatggtcacatggctggtgatctgtgtccggtggatgcaggctcggcctctcctggtggacgcgttggagacggacgacttcagggagctcgctgaccccgcgctggagcgccgctactccaagtcggagatgcggaggatggtggaggccgcggccgcttgcattcgctactccgtcaccaagagaccaaggatggtgcaggtaattaaactgaaatcatccctcaagggccgtatctatcgtttctgacatgttatcttaaataatcattcaaagatttcaagatgtattagatgtatcactccgacgaacatacaagtcaacttctattagttataacaaaaatgatttgataaatataattgccaatgtatatatgtatctgtctgtcaatgcaaatagtgtattataaaaaaactatatattggatatataggtgtggcgatcgctggacgtggaggggagctcgccggacctgaccaacggagtgaagcttgggcagagcatggcgtacgactccaaccagtactcggcggacatcgagctcttccggcggatggcgtttgccaacgacctctccaccgctgagctcggctactccggcaaggacgacgtacgccgtccgccacgctagcagcagctccaggaccaggcccagctgagcactaacggcacatgcgctgttgttaaatttgttgtcgtaactaacacgcatgcatgtatgtaagacggggtggcagaattggtgtatatataaaaaggctttgaatagcaatcctgttgatttggggaacagatttcctttttcttcttcttctaagctcggttgtgacttcgtacggtgtgtgcattgacattggcgttcgctagccttcgcggcgcggcgacaacctcgtccatcgatttcgtacttactgccacccttttcaggcgtgacgtgtgaccgttgagagtgtgcaagaatcagttagtacgttgttgttgatgaaaaaatcgaacacaccgatctagaagatctgcttagctcctgtgtaggtccaaatcttgatgagatgcgagcgtgccagtcagtttgattctgcaactgacaagatatgcaaatagtagatcaaaacagccgatcagctgacaagccgacagagtagttccaaccaatagccgataatagccgatgccgataccagccgatagcgatagggtttaagcaatcggctatatgtctaatgtagatgatgatataaaggcaatcgggtgatgatgatgtaataaaataacaatataatccagtataaaccaatcggcaaataatgatatgataaataagcatcgatccgaaggttaaaacacacatcggctggaggtccgatgtcatgaaatccacaagattggattaaacagtgaaacttttgttgtcatcagctaaatccaacatatatgtatatgcaattcttatgagccgatgcaacgtccagataactcaccggctgaaaccccgatgaaacccttattggcaaataaaaagcaggctagagattatggttttaagcacgacttagtagatcaaacttaactgatgcaacactaagtatgaaaagaaacatagtatctagacaatcaagccgttgactgagttttcagggtggtagatgtctaagctaatctaatctagcaacgcgatttagccgatactagcagaaaccctaaaacgagaagcagcagatagagctaaattgatatgctaagactagattaacagagacatatgataaatttgtaggcaaatatatcatccaaaccagagcaatccaagaagtcgaatatactgatgcagccttgaacgacgccgacgtaaacgatacaattgcccgggccggcggaacattggacttaccccttagccggagatcgaacaccgatgcagccccgcgtcaggtgccaagtcccgccggacaataaaataaagtagaaaaggtaaaaggtggcaatacgccgaattgtattgattgtgaagatagattacaatgaccctgggtgtacatatttatacccatgaatagatactagtccttgtaggacaagaaagaaactttcctaaagataaaaggaaaacataaagtccttataggacactaaatacactttcctaaagataaaaaggaaactaacaaattattcctagttaatagatacaactgccttcttcggacttgatccatacgtggcaatcatcatgaagcacgtngatgctacttnnnnnnnnnntcccnanntcacctagccagaatcggnnacatnggnttgccttgtccgattcggtaactgccgatgcacactgtaccgatgcggttttttttccccgggagaaaaaaaaggccccccccggaaaaaatttttttcaaaaatatttaaaaaaaccccccccccccttgtggggggtttttttttttcccccccccgggttttttaaaattccgggaatttttttntctncccttncnccaaatccnngcttcggccttaactccaaatccgatgtaaatttaccaaatttggtcgttaacagttgtaacataacatatgtttcatatcatgactgtcgtccagttacacaaggtaagcattcctcagaatgccattcacttggctggctacaaacattgttgcatacatcaagagatatgtcgacaagctacagtggtatctccagattagccaagattcaaaatacagaaaaaaagagcttctgagattgtattttagcaagtcgtaaacatatatacaatatacatggcaggcacttagactatgctactaactgtagtctgtatgtctgttcagatgttcttaaggggacatcagaattttcctgtactcatgactaccgtcctggatgcacccggaaccagccagcgacgttatccacacatcatccgttctcactggttcttcgtcatcatttctgtgccaagtccagtgagcatgcgtggcatttactatttttagttcaccatgcccaaagcttgcttcccggaagactgaccaagctggtttcggattgcggtacctgaaaataccgaaaagttgtatataatgacaccaaagtgatttacattcagagctctaaccatggtattataatggtacctgtgggccaagccttccctgtttccaccatccccaattgttatgtgaacagccccacaaggatcaagtccccccttgtagactcgctccttcatgaacaatgaaatcatcaaatggaattgtcacaaccatggactaaaaggtcagaggccaaagttttgaacaataatattgtgcagctaagagatctgataagagccataccgcacgttcataagcatgcacatgacctgcgattaccatatccacatgagcagcatagagcaaaggctccattgcagccatcatactgtcaccttcgccttgatgagcccaattgctattataccatggtgcatgcaacaatacgatgagccatggcgtccttttcctgtcaaccttagctagatcagcctgaaaagcagccaagataatccaaggaaaaagtaatctgctgtcagtaagagtaaggtggatttcaaagttgagcgcatctttttttaaaagaaaaacatagagaaatatgccagctaggagtgactaattgagtaactgtaacaccccatcccaaaatccgcactagagcaggcccacataggcatagtacccgactgacacttttgtccttgtttcgtgtaaaagggttaacccgtaggtactattgttggagcatggatcccaaacctatctaaatttccaatgtgtgactaatcccaccatacaagaacacttgggccacacgggcccaaacaagatcccacatatggaccgaactagaacacactaatgggcctaaaccggaattaatgggctggggtatttcactagcaactaagtaccccacaaagaaaagtataatttgaaagaacttcaaatgtagatgcaattgtcaacaggggcacacatggtatttctgggtcctgtggaacttctatgatgaaattgcatatagagaagttagtgccaatacttccagcattccatctttaaacatcattaacattatggctgaagctaactttatgatttaggaacacatggtcgaaagggaaaaaagagaagaaaagaaaagaagagcaccccatattacttccacaattccgtctttaaaaggaagatttttaacaaccaaatataatgcagcatgtatggttgtatcatgtagcacccagtatgataaccaagcatgaagcacactaccatagcaatgatggtgttgcagaaaacatttatgagcaaatttgctcactaccatagcaatccgtgctgacgtgcaacatatcgtcacaattcacaaatataaaaggttgcaaaaataccattgcagaactacaaaattcttagagaagctaatgctgttgcatattccatctaacatagctgctgcaagcccttttggggggagagagaggttcgggcaagttaaataacacccctatggatcatcacgccttctggtcatcaaaacgtatcacacgaagtccaaaattttcagaagaaagtcagtgatgcacttttgtacaactagagctcaagaaaatatttatagatgttcaatagattttatttaatttacaaaaatcaattgctggatgctagatactatgaaatgtttttctagttgtcagctttttattagaacaatacccaaagattcggaagctgaattaaataaactcaaaatggacatgtcatatgatgaaaaatggtgatggtttgcaatggtagtgacacattcactcaaaatcaagaaggagataacatctcgtagctcgatatattgagaattaaggcataataaataactgacattagcataacaaattgggaattaagatagaaatagttagttttcgcatgagtagagacagatcagttgtctttgtgtaaaaataagtgtatgcaaagagcgaaaaaagaggacaagcgctaggttgcagatggattgcatgtttataccaaattaattgaccattgagcaaaacataaactgaagaaagaaggtcccttaattggtggggccctttatagttgatcactttgcacacccatgctctacaggcctggtcgtgaatggttatctaatataaaaatcttcttatcccaaataaatagaattgatgctgtcagaaacgagcagcataggcaaatcaaatgcgatatggagataagagatacgaagtaatataccttaagccaagcgtactgatctgaactttcatcataatctgtataagaacctaacattatagcatgcacccctgcaactttgaaggagtagtagagatttgatgtggattcgctctcttcataaggcatcttccatcgtgcattgtatgattgaaatccagacttaaaaaacggtatcctttccttctcatgatttccttctgtcaccatccagggcctggtgctagcaagtggctccaccaatgtaccaaaagaatcccacaaatgttgcatataatccgcataagagagatcaccagggagtaaaagcatatcatgtgcacactgcttaatgtgattaagtgtcgaagttgtccaactggtctgccccagatcacctacaacagccaatgacaagggaaattgggagggtggtgtcttaaactggaattccggaccatgtcctccacaacggtagtagtaaactgtgttgtcattaaggggcccaataacaacatgatggatctttcctgaactatacattaagtagctgtatgatgtgctttctccttgagacgttgatgtgtatgtgcctgcttcagttccatagtctacaactgaagggacggagttatcatcagtgacaaatgtaactctcatgtgcttttctccagctagtgaaatgtgcacctgtaaacatattgcgcattttagtcactggttatctattagaaaaatgttcaaaacaaatacaagaattgaattctcaaaaaagactccatatatactcaaggatggcatgaaggtttagttgcatagagactgcaaattttctcagatattttttacatgcatttgagtgcaattctgtgctagtaaaggacatgccccccccccccaacacacacacacacacaaagatctattcgccaaacaagtgaagacagctgtattagttctaataatctaagtatctaatatagtactgtcacatctgatactgtggaaaccagagcaagtattaccatttgagtccaactgatcacacacatcaacgtggcaagtatctctaggtaaccatagttcattcagtcattctaatgagtaatgagatgcagttaaaattcaaaccatggaatgaggttgaaatgttatcactggtcaacaacctcttcagtcctttgcataaatacacaacgctgcatgcgaatgagcaagtgtatgaaaaccatttgaattttgaattatgattgggtacacttgcaaaaccacaacaagcaagataaaaggggggttaatagtgcatctggtatctcagcttatgccgatggctcaatttaggcaaaatatgtaatgtaactttggccaaacttgtcccaaatatccaaacattggctcaattccaccaaattagcatgtggtctcagtgttttgcacatggacccatcacctcagaagcatgaaagtgagagaacgggcaaagttatgggattgatttgcctacttattgtcctttgtgaaatttgaggaaaaactcagatatcacaacagttaatagtacaaggacagaactgagccattgcggcaatagttgaaggatcaaacgttatagagtttcttggattcaacataatcatctgttataacatacaattcaaatagcaaaaatgcactgttatagagttagcatgtcacatctaatacagaacggacgagttcactcgcctgaagcaaattgcagaaccagactactagagcacaaataggcccataagctgaaattggtaattttcgaatttagacatatttctagctaagggaaatgagctacactaattgaacacaaaataaatcagctacaaccagttcaaaatttgagccaaaactgtacaaaacagggaagttggttaccaagcaatagccacaaactgattgatcgatccccgagccgattcatgtgttttctaatcgatcgcttcttggattctcagaacataaccagacccgacaaaacttgacttatactccaacctacctcggaacaaatcgggaggcaagccaagccaagccgacgccgcggaagaatcaaggatctcaagagagaggtttcacctgctgcggatcggaggcggaagaggagtccttcttcttgctccacgggaagaggctgaggagggccttccggtggtggaggccgcagcgccgcgccgccgcgggcggccggacgtagtcctcgcccacgggagccccggaagcggcggcggcacaggaggagaacgaggagagcagcaggaggaagaggagaagcggaggcacggccatgggaggcctcctgcgcgctccggctcgctcctccattggacgctggacggcgtgtgcaaagctctcgatctgttgctgctgatgggggtcaggtcaacacaagtacacaacactgctttctagatcgggaacacctatacatttatccgtcgataaatttttttctaaaaatttgacatatataattatattataaacatagtgtaattatactgtaacttatatataattacactataatttgcatgtaactacaatataacttatatataagtttcacataattttaaatcgttaaatctattacaagatttattttgttgagaaaaaaaatcacagcacacacatatgtgtaaggatttgttcccacaacctccattttaccgaaataatatattacagaaagatttttgaaagttacatacaagttacactatagttacagttacagtgtaattacatgcaagttacagtgtaattacactatgattgtactataattacatctgtcaaatttttagaagaaaatttgtcgataaatatatagcaaaatcgttctagatcagcccctctaacctgctagtgtattttatcactgacatgtgggcttgatgagctcttaggttcaccgataaaggtatggtgtcattaaaggtataatcttaatccctgctttctagggtcctaacatttcaggcgttctgggcgatatataaccgtgaagttcctataaaacattttcttttttcattataacgtaaagtagatatttaattaatcggaaataaattaaactaggatgtgtggcaaattacattactacatccgttttagtttacttgtcgttgtagcacatctcatagcagtaataaaccaggatgtgtggcaaattacattagtacacgttaattacatcataaatatcaaaatttaggctgtgttcttggtggggttgggaaccctcacctcctgaaaaaaaaagagaatggattagcgtacgaattaattaagcattagcttaaaaaaaatttaaaaat

SEQ ID NO: 71506 - DNA, 960 bp, Oryza sativa
gtagccacgttgtttccacgtgtccagcccgcgtggaatctagtggagtcggttgtcggccactcgcctcggttgacacacggggtccgcttccgtcgacccgtggaccgtctctgtgtactcggtctaccgcggtcctttagattcacatgtggggtgtgcatgtcaacggcgcagccttcctgtctttttctggctagcgcttacacatgttttatagttgcaaaacctaattataataatccgcaaatctccatataacagcattaaacttcggatgaccatgtcttggtcatacgaactctgaatcgacccgttcaagtctcctaatgtttgttataacctaaagaaccctgtgctttctttttatgtattgttattgcttctttatatgcttgtagctttgcttgtgtgcttcgagtagcttctgtcgttccggaggttctcgaggcgtgggtcgtggtcgtcgccgaaggtttggaaggccgttgtctctgagcaaggcaagtcacatcatccttgagcatattgaatcccagtttataaaattattttgatttaaattaatgcactgtcgatttatttaaattcccgcgttatcactgttttatttagccatgcctatttacctttgttatgaccttattattattgctattgttattattaccttgtttaccctaggataaaaaaaaccccaactagtgggtactctattcatggttccactagtatgaatttaggtagatgcttcgctgattaattaggaaccattaggtggttttataactttagactttgggaattctcatatcacttggacactatggaatggttggcttatggtggaattggacatactcctctcttcctctttcaaaacccctaaaacctattttccggtggggtttgggtgcatgccagttgtgggaagtagcaccccggccaatataaggatta

SEQ ID NO: 71507 - DNA, 691 bp, Oryza sativa
cctgtctctagttctggtctatctttcctggcttgtttcctctctcacctcaatccctgtcatagatgtttaacagagaaaaatgaaagaatgtcagggggtatgcctccagtaactcaagttttcaactcaatccaccactagcctgaagagagttaacaagggcacacccttggtccattccgagcatgctgcatggttcacagctaccattggttggaagtcaagaccaaaatcagtatgtgtttgatcgagcatttgccacccaggtcaatgagcttccaatgccagaagatgatgtccccttttgtcaggattgtagagagcaaggacactatgccctgaattgttcatgggtatatgccaaagaagccccttcctttggtttagcagggcagacatcgctaaaccagcctcctcgcaccaagtcaagcttgcagcctagtgtgcaaagtagagagtccaatggagagaatccattgaatcccgggaaatgctttcctcctagcctttcgtaccacgtggggtcacgtgctaaacaagccaaaggcaagaagagtaagaatcgaaaagaaaagcaccgatgcgaactgaagaagaagtacgtaagatgacttttaccagcaccgaatggcctccagcagggataactcttcctagacgtcaaagaggaaatacctttcaggctgca

SEQ ID NO: 71508 - DNA, 779 bp, Oryza sativa
ccggaagttgaacactggtcttataaaatgctactccttgtaagtgcataccttctatacttgtgatatgattggactatatctcctaattaaattagttctaatacataaatgttttatggttgtgttggatcgagagtcgtcgccttggtaatcaggttgggttccttgatccatccatggtgaacgaggttaatttacgacagagcttcactgaggtggttgactatgtcaaccggtgtttatgggcccatcaagacaaggaatacatcatatgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggcccatatgtggaaaagggtggtagcacaaggagggcaaggacgaactttatcatgacaccaagtttacatgcgcacaacagatcggagaccaatgtggtttccatgtgtgccacaacatgtcaacacttctaagagaggtgaaagatttcgaccctgaggttgttgctaatggcgaataaactcatttcaatacctacattgctattaaaacgttctaattaccctcttatttattaaacagaaaggtagagctggcttcagatctcacccatcaaccccccgctatc

SEQ ID NO: 71509 - DNA, 586 bp, Oryza sativa
gctgaaactatttggctgagctccagcttcaggaggggtggagtaaacgcaagtactataagcatcttatcactaattacaagatgccatgtagactcaaatgatgatgtggaggagaaaaaagaagagagagagaggagcagccacccctcatgtaaggagcaacctccacacaagtttcaagaaatatgagagacagagagttggacaaaattagatgtgaccacctcctctgttataaaacttgacctaagaaggctacctgctgctgtgcttgctttgattattgcgagatgggatcactcgatcagggccggctggctgcactcaatcagacgatcaacagccctcgtcggcttcttcgcttcgaggtcaggagagaaggcgcagagacgatgggagagaacggcgcggcgcagccagtagatcgatgggatcgaagacgaagcgacgtgcggtggcctgggctgaattcctgaatggccgcgcgcccacgcgcccggtgagactcggcctctactggagtactgggccctgtacgtcggctgccacgggtgggggcctgggggatggagagttggtgggt

SEQ ID NO: 71510 - DNA, 1365 bp, Oryza sativa
ctgtgacggagtagcaaataaaggcccgtcagaggtgacctacatgtgacgggcctttacttttggggccatcacaggtagatcacctgtgacagcttctaactacggagacctcaacctctgacggcctttatttaaagggccgtcagagatgagttacctgtgacgggtcctaactcgccctaggctagcggagaccaacacctctgacggccttctagtaacttgctcgtcagaggtgggtgtcacctgtgacggccggccacccgtcaaaggtgactggactcaccagtgaccactgatcactcaccatgcgcgaagccgtcaaagatgagggtttgggctcgtcacaggtgaccttggccagtgtagtgaacgtagtgcatgttctgtcaggaagagttcagtatttttaagaaatacaattgtgtaccacttgggaggaatcaccatggtgatgttatataaggaaaaaatgatggcgtatatattaattgatttttcattatttaaatgtaccgaagcacaaactagatcaaatttgtaaaacttcaaaagtaattattaataaatcaaaatgttgaaatggacactcgctaggtgttaatatgcaatttatttgattttggactttttccccctcttttccgcacagtccatgcactcatttatactgaaattttcaaaacataaaaatatgctctagcaagtcacgatgacatttaaaaaccaaggatgtttttcttataaatatatatagtggctgtcgacgggttgtacccatctatgggatttgtatagggtgggaaacactcgtactaatatatatgagagacaacgattaagtaggtggaagacaagtgatttatatatatatatatatatatatatatatatatatatatatatatatagccctaggaaatctagttgatgaaactattgtctagtttggtgccaaaattcaatcagcgaaaatgataaaatttgagtttaatttctagaactttttgcagccaaataatctgcagcaaaaataattgcagtgtttttagtataccaaggtcatgacgtcctctaggcacaacaaaattaacgccacaattggaacaccgtacgtagaacatcaaataaattgatcctcgctctgtgtgatgctctatctgcactgttccgatgccttgtcaacgtaacgctgcatccgtgcacgcacctatacttggctgcgttcgattctgtccgtcgggaactcattccctccgcatagaaaaaggatcggtttattaacacatgattaattaagtataagctatttttttaaaaaatagataaatatgtttttaagcaaattcatatataaatttt

SEQ ID NO: 71511 - DNA, 707 bp, Oryza sativa
atatcgcgctcccaggtgaaagtgtagccacacaggaagtgggttagggacagccaaggtagggagcagcttacaattttaagaggtccgagaaagacctgaaatgtaagctgacagtagacagagatctgaaggaagcgaaggggtatgccttgcagatttccagagaaaatcacccaggcagagagaacagtgagtgcaaagacctagcaggggtgggaggtgggtcggagaaggggcatgtgcgcctgacgtcagggaaaccatggggagctgccatgtgactttcaaacacttgaggatcaagggcaccacagtttccaatttaattaagctcactacagcaggtgaatacttcccattaaaatgtattacatgcgaatgctatttctgcggctctttgggatgtgagcttcacataaaattgctcggtcatcgagcatcgtggcctccatctgcacagccgccacctcccactagcaatttcatgcacgtgatgaactctccagcaaatttataggatattattcacactttggtttttctcagaaggaagaataataatgtatgctgctccagcaaattatcttttccacagggctttcatgcacggggtctcctttaatttgaagctcacaaagcatgaaagggagggagctgtaggcgcgccctacacgaggaaactgaggctttcaaggggtacacac

SEQ ID NO: 71512 - DNA, 2838 bp, Oryza sativa
ttttacttcctattatttgtacaggacatgtttgcgggaggcagcgagactgcggggacggcgttgcaatggatcatggccgagctcataagaaacccaagagtgatgcacaaggtacaagatgaggtacgacaaacacttgccggtcgtgacagagtaactgaagatgcaataagcaacttgaactacatgcaccttgtcatcaaggaggcgttgcggctgcatcctcctgtgcctctactactgccacgggagtgtagaaacacctgccaagtcttaggattcgatgtgcccaaaggagcaatggtgcttgtgaacgcgtgggcgattagcagggaccctcagtattgggatgaacccgaggaatttatccctgagaggtttgaggatagcaacattgatttcaaggggacaaactttgagtacacaccattcggggcaggacgaagaatgtgccctggcatcgcatttggtctggcaaatgtagagcttatgctcgcaagcctcctataccatttcaactggcaattgccagatgggatggatactgcggatctagacatgacggaggagatggtggttagtgcccgacggctccatgaccttttacttgttcctgtggtccatgttccattgccagtagcctcatcatagtggtgtatacaactactagttgggatagctcctgtacttgtatggctcgatttaattaaaagtttaaagtccaacggcgaacttctttgaaaaaaagatttgaagtcgaaaaatagagttattttgtgtgtgtgagagagaggggggatctagtaatatgaaagagaaggctcaacacatgggataggccaacataccagtacaagaaagtaagaaagtatgggtatagcaaccaatgaatataaaacattaaaaatacttggactgccttaattgaaaaggtcaaacaaccaaagtttcatacaaggacatccacacattgtccttaattagcaacttgaggggatacctccctgaaaaagaaagatgattttagcagcttattatggggttgtggtattaaaaaatttgaacaattattggtatcttgtgccactctgagacaagataaatgttggtcatcagttcatcaccacatgcaactgttcacaaataaacgaaggcccatacaaggtatattattgagatagtgttagcaagtctttatataaccgaacactttagactcatcatcggaccggacagaaaattaggggcctgaagtgttcggttatactgcgccagaccaacttttacttgttcctgtggtccatgtcccaacacttagcattatttttcccaaccttgcctcctatttgcacgaatctcaaagcaaatccaacgatccaaaatttgaatgttttgccctcaagaaaacttccaacagatgaataacgatctattcgtgtataatacgactagttggatagctcgtgtatctgtatggttcggtttatttaaaagtttaaagtctagcagtaaacttctttgaaaaggagattaaaataaaaaataaacttgtctttttctaaaagaaaaggaaaatctaggaatatgaagagaatagagataaggaagagaatagagataggacattgagcatcaccaagagtttccatatcattccctatgagagaatttgagaatccttttttttcaaaaaccaattccaatagactccctacctgcactcccaaccgatcaaactcccaaatccggatgattcgttttccacttcttatagggaagagattttgctcccaatccaccacacaccgcttttctgtgagtgcttggtgaaatattcccgtgcggctcatcttcggtaacatcggcgtggcggcgcacggccaccgcggcgagtcgggagccaagctcttggacgtgcaagcagagggtttttctcgtgaaggagatcgtcacactgctcccagtcgagaggggcatcgccacgacaaggttcatgcgtgcttggacttcgccgcaccgacatgatcctgcacgctggtgtggcgtggcgtggcgcgtgctgagacgacgcttgaggacctcctgatccccaacatcgatcggcaactttgtggagatgctcaacaacgtggactgcatacatggagcagatgctggagcagttcatcgatcgacgccgaacatgttggtgactgttcgccgcctcgccggacgccggagataaacgtcgacgaagcccagctggtcgacgcatgcatcaagcgagctcatgcagttagaacagtggccaagctcatcgacggatacctctcaacctctaggttctaaaccatctttggtcggtctggcaaaatcaacaatagtcccggttccaaaaagaaacagaacaaaaggttgcttttagtcctggttataaaaattttgatctttagtcccggttggtaacaccaaccgggagtaaagatggttcatagcctgtcagaggcatatcagggggtcgaggatctttaggccttgtttgtttcagcttaagattactgtaatctatattattgagacaaattactataagctgaattataataagccgacatagaataagttgttagctttttgtttctctggatcattagctggttgttaggtgttagcaacccaataatctaaaaaaagcacaattagagtggattactagattatagtaatttggcttatagattgtaataatctatcataataagctatatgtttatttcaatttactcctaataatccagattataataatcctaagctgaaacaaacagggccttagtcccggttggtgtcaccaac

SEQ ID NO: 71513 - DNA, 6455 bp, Oryza sativa
taatgaagggtagtaagtgaaaaacttgtctaaagtgaatcgtaagaacaagaagtattttgaaaaaaaaaaagttgattgctagaatgttgaaacagggagcaattattatgaggatcatattaattaagaagtcctctcgtaaacagacttatcttctaacataagcggatgaacagactattcttgtgcggttattccatgtgccaaagggcctttcctgcaacatgtcgtctagctttttttttttttacaaaataaatattgcatcatgcatgtatgaacagggtattccattagtagcacttgatcaatcaaagccattggcaatttgacaaaatggctgtgtcacggcctcacgggcattggagctagctggccatgttttttttttcaccatgtcattgttacgtgggctgcagttaattaagtcttcaaattgaaaatagagcagcagtctaatgcttcgattaccatatagtatggcatatatacaattatagatgccccaaacgtccggggcgacctgactgacctgctctaggactgggcctgagtcgtacacttagttcggagcagagttcacaattttgataccagttactatgccgacactagcggaacattggttttcgtgaaatccaatcgaaaatcgatagattccaaacaaattttgtgggaaaaaaattgaattcatttatctcgaaatttcgatcggcaatcgaaagtgcaaacgaagtgaaaaaaacgtttggtttgtatcgagaactgatcaattttgttgacaaactggtaaggaatttcaaatttatttttgtttcctaaaaatgtagaaaatagtgaaaaaaaatgattaaacatttggggggaaatctaaaacttttggcattccctctcctataaatttgataacttgacattaagctacagacgatatacaatacatactcataaaaggcgataatttagagcacatatgacatatcacgcacaattcaatatgcatctcggcatcaatcaccaaacattaggcaaatagaatgcacgccacctaaattgaagtccattagtacaagtttagagtccagtacataaggtctaaaggttaaaactaggttttattctagcttctagcatgcggacacctccatataatttattgaacaaagtaaacatatgtggaattcaactttttaaaaaaattatataccaacaggttatattaatatcatactatttataggattttttaaaaatcctttttctcaaattaaatttgaatttggatggaaaccatggaaattttagagaactattgccgagccatgtcgagacgttgatttttcgcgaaatccaatcggatttcatcgttttgtgaatcctggttctctatattaatttagttgaatagagtgacaaaagatttgccacttgatgagaggagattttacgagagggattaaacttttttatacgaagtggcaaatgttaagagttaaatgccccttattgttagcctcgataacatcactcactaaagccctctttgtttaggcgtatacaccaacttatgagtcaaaaaaagtctgaacctaaacaaattaacgatactttcatttcacttttcatattattaagctaaaaactaggttgaacgtagactccaccattacacttagcacttcaaattcattggtttataaatcatactctccgtcccaaaatataataatttttagcactcatgattcgtccaaaaatatatcttcactaacattcaatttccaaccaataacaaccctccatcacttactttttcccacttacctctacttctcaaccatcacaacgtctccctatttaattctatctacttttttaataattatgtccaactataaaacttcttatattctgggacgaaggtaatataagccaaaagcaatctaagccaataaacctaagcataaacaaaaaggccaccggttcaaaaattagcttatcacattagttataaactagtactatgttagattcattgtgttagaatatgtctaatccggttttaggtggctatattttgaaatggagggatataaagataataaatatagaagaaagctatttaagtaatactaatatagaagaaagttttggagtagtatattttctgaagcatagctacgataatctatacctctatattagcatgaaatatcatggtgataagcgcgttgatggtatagttaagaaataatgtcaccttggcgaagaaaaaaaatattattatgaatagtcaaacttgcttaactcaagtctaatgaagtttagaaataaaacaaatgacgtgatcgtttttaccattctcgtgcttatcatcctggtgtgtccagtgtcccgagtctcctggcccatcaatgatatccattatccaccagttaatatgttagtatatcccgtttgcaatatggcaatttgttttttaatcttcgaagcagtttgccgagtacccccagttctccatattttactgacactttcacactgttttcatgagtaatcattatcaaccccatcgtttcggtatatttgtaaatgaaaaataatttataaagaaaacttgtgtgagagagagagaaagcaaaaacgaaaaaataaactttaatgaaaaaaaaatctcaaaatcatctttaaatttaagactgaaagttcaaatattggttgacaagaataagcataggtgaaaagatgaggtcctataatttcactcattataccaatatgtttactagaggtttaggagctgttcaagcaaaaataaaccttaccaaatttttgcaataccaaaattttgacaggagtttttatgcatttattaaagtttggtaagaaactaaatggattcacatatttagcaactctaaaaaaaatgatatggtttaaaatgacaaattccatcggttggcttattcataagcttattctatgaataagccaaacagcatattcacaaacgaaaattaatttgtgaataaaacttttatatacatgttcttagcgacctaaaagcaaatgctgaaaaataaacttcgatgaaaaaacatctaaatcaactccaaatttaaagttgaaaattaaattttagctgataagtttaagcataattgaaaaaataaggctagacatcaatctaaacaagccctcagtaagaatctagaacagcaaaagccgcactctggattatggaacctgccagatagaaattctttaagaatacaattgatcgacaactgcggaaataacgcaccaccagaaaagtaggttcaggggttgtttggttcgtgaccacatgttgccacactttgccacacctcaagttaggcagctttgagtaagttagccagacgtttggttcattgccacacttgtggcaagattctttttctagcactttggtcccacatgtcattgtctcagaaaagtatggcaatgttatagattgctagccaaagtgtggtgccaaatttgtttgtctaaccttatgcaaggttggcaagaaaactatggcaaccctaggcaatgttagtatataaaccaaacaacccctcaatctgcaccatcacaacacaaagtccactttgcagtttccctttctttttccatagcggaaaaccgaaagcatgcattactggagccatcgtttcgctgaataaccgaaacagcatatttgtaaacgaaaaataatttatgaataaaatttttatatacatattcttagcgatctaaaagcaaaggcagaaaaataaacttcgataaaaaaacctcaaaatcagctttaaatttaaggttgaaaattcaaattttagctgatatgcataagcgaaaagatgaggtggttaatgatactacttcacattgctgaaaagaaagtgcgccatcattcacccaccaaaagctggtgcgtcacatttacagaattagtacaacatagcattatgcacttcatagattagatattgatatgtttagcaggtgcatggaagtgggaactagaagcaaggaataagatagggtgttcaaaaatgccccatatgagaagggatagaagatttgtcacttgatctttcctttcaccgatctaaactgaaaaaaaaaagttgcttcctactgtacttgttagcttcctgcagaaacaagagagtttgtttgatcagcaatgaaaactgacgattgaaattaatatcagcacaagggctcaaatatttactgtgatttgcaggactgatccagaattatcggtcgtgcttctttttaagaacttcccttcccacgtataaatctaagtaaccctgcaacacaaaattatagctcattgtaaaatgcacctaaattaccagtcatggccatggaacagaagatatcaaataaaaacagggagagcattggcataatacctgaacgagtttctctagattctgagattcttctaacaaaaatctacaggcatctatctctgtcagagggacctttgagcccaacacggtggtcactttttccacagccttcctcactataattttgtggacttcccgggataacagcccatcttcccacaatggctttatgatattttttatgaattcacagaggttacacttgaatacatcaatggacatgctactttcttcaactatgctttgctgagatggtccactatgtgaattaggtgactggaacctatttccatctttcctttcgcaaattcctccagtaagttcaattggctcaggttgcttagactgttctttctgcagagtgggcttacaagaggaagctgaaagactcttgatattattctggggatttgtaccatcctcatttacctgaaaagtcacattctcaactggctctagctcatcatctgtattcatattaggcaagcaatttaagtctggtatcgaggaacatgaatcccaatcagcttgtctagtagtacaaggattatctctgtcagaatcaaactgatggggtatttgttggtttgatgccactttgagagcttgtgatggttccccactctctttatgatgtgtatcctgttcagagtctgcatgttgtgaattctcttgtttgattctcacaatgttgcaatccacggcgccccattggatgactctaaagttacttcctgtggaaagattgacaggcttctctaggaacttgtttgcagttcctttatccaattttgtcacaccgcacggagtagtgtcactgtcctgatttgaacacgctgacacatttactaccttcacactatcatcatccattgagcaaagaacagcagcttttttgtccagcaattccggaacagttgattgctcacctgatttggcaccatcagcttccagtgtattttcaatgtcacagccaacaaccaattcatgtctgctccttgcgttggaatgaccttcaattgctccctgctgagaaaacttctgatgcacactactttccggatgagaatcagcaactggtttcgtgctagtatcagaacagccattccaacaacatgaaaggtcatcttgttctttctgctgcataacttcactaggatttgtttctggtggaacatcctgataaaacattagtcctttctcagctattgtattttgtgggcttttcatgcgattgtcgccactaagggatttgaagggttcctctgactctctctcagttcttcctttgctacacttttgtgcttcactggatgacattacacctctacattgtttggagtcctcagatggactattactttcatcatcgctttctgagctaacagaagcactccctgatgtgctgctgttttcatcatcaaatcctgagctaggtcttccatttctcaatctttcgctcacagataccttgcttgtttgcactgtccgatttgtattggttttttttacattttcagcttcagcacaattatctttcttcaatcttctccatataatcaaacaatcacgaagtagttcagacggagaagcattatctgattctttcacaccattctccacataggtgactggagcatcttgtagtttaccattcgaaacctcatcactcttcatgtcttctgttttttttgtgcaaacaaccaaactaggcttcttatcagactctaacttaatgttctcacttccttcactttgttttggtccatttgatgacataatggttttacttctacacttaggacttaacaaacctgaattctcattagactttgagccactacatacaacagttggaatattgttgtttcgatgatagttccctttttctccattttgacctcctttcttgatttttttggtatttccctcctgattatcaccactctggcgtacatcaccatgagaatatgattgccaatccttcatgttcggatagca

SEQ ID NO: 71514 - DNA, 1809 bp, Oryza sativa
aaattatcacgtggagattggtgaagttgctcatgatggaatgcatgaaattcatcaaatgccttactggtgtgagctctccctacttcaaacctatgacatgttcgaccaaccaaggagtgatcagaaatattaaacatcaaatcttttgaacaggtgccctgatgcttcttgcaagtctggaacttttccatgtaagatcgatgccttgctttatctatcgctgagaaatgggcatttgggaagttaacttcagttggcagacgttgaacttcttgataacttctattttgtgtgcaactcccctgattagatgaaaagaagtccccaagtctttctgttgtacgcatatgtccatctgcaccttttgcatactcagacacacgattgagggaaggaacttctccctcagtcctagattaaggaacaaacaattgaatcagataatagtaatacacataaacaggtgcatgctgccaccgaaaaatctagatctgcacctaaaaaatattaccttagacaacttgtcggagcatgatcaggagaaagactatggttgccccattttgatgaatcgcgaggacaagcacgaccttcaccatgatatccatcaatcttatttccaaagggataactgtaataacagaagatagatcataacatggtgcacatatttattttgttaggaaggaaatctttaaggaatgcacagatcataaaatgcagaatattgaccaatacaacatgcgagaacatcaaagtgggaaataaaagagtaaatttcacaaaatcacatataattatggcaaaactagatttagagaaactatattgcaaaactagagtacttctctaccgcaaaactacaaattttagactttacaatctccatcgctagcagtgataacataacaagagggccccacctgcagcctcatgtctttacacaaatggaagcagaaaagaacaaagctccaaaagtctttcttcaaagcaggcttgcagtggcaagagcaataacagttacagtcatgaccctagaaaatggcttgcatgtcacggggcaatctagccagtggtagcaccttggcaggagatagtcagtcgcttggacagtaagtggcaacgtatgcaactcatgttttgcttccattggtgaaacatgctgcgtgatgctttgtgaggctacaagttgagccctcttgtcaggtcatacttcaaagtggtagggatggatattctaattcctaaatacggtcatctctcttaaatctatattttttgctataattttatcgactcaacaaaaaatatggcaggattaaccaaatttatgaatgtcaatagtttggtaacatatacacacctcttcatacaatatctaggggaggagctgcgcctgtgtcgctttgactccaggagtccagttcgatcaagaggttggtcccatatagcaaaattcttctcagtttcagcatcatcatgtgaggaggacacaagatccttagtttcttcctccctaaaagaatggctacaacttctatcattcaaagttttgccatgactatgcagcaaatcatgtcctctaaactgatgtggaatttctgtagcagcaacagaatcttctatcctgtctctgcatcataaattgcattagtgaaactactactggatagagaaactaacaacatgacgaccataaattggagaaaattgcatatgtaccatcacataagattggattcgctagaataccatcacataaattggcttcactagaatatcattctcaaccagggcatatttgcc
